United States Patent 9,328,346 (POLYCOMB-ASSOCIATED NON-CODING RNAS) - sequence listing, part 84

SEQ ID NO: 15666 - RNA, 40897 nt, Homo sapiens
ucgguggcguaggucgucguccuggaugcuggcgagauagauguuaucuuccagaggaagaggaggaggcggcgaagcguuuucccagccucagucucucuuucguuuuccuuuucccuucccccaacccuccgcccuucucuaaaucagccggccuuccuugaccucagugacccgucuggccccgcccacccucgucgacgugauucccgccgugagguaagcgccgguggaaccuagagccccgcggaagagcagaacguuugggagugugcagcuccugggcccggcucaggcccgucgcggaggcgcggcgcaggggagcgcucgggugggagucucgcuccuccaccaguuuauugcgacguagcauccaggccuaggccuccccguccauccccgccggacucgggccucuggcagcagcgggugacgcagacggaacaucaugucguccgcggccgagccuccgccacccccgccucccgagagcgcgccuuccaagcccgcagccucgaucgccagcggcgggagcaacagcagcaacaaaggcggccccgaaggcgucgcggcgcaggcgguugcgucugcggccagcgcuggucccgcagacgccgagauggaggugagggcgacuugcggcauggggagcgggugcagcggggaggaggagcuggcucccucgccggaucguggcgaucggacgcagagccggguuucucucucugcaccagacucagcuucacacccuguggauacgaaaugaugcucucacucuugcucccuuguucuuacccuauucgagcuaagcaaaauggauuucuggcuccucacauuuaaauuauuugucucuuucgugaauccugacaaauauuugaacgcucucagugaacagauguucuugguuaccguggcccgggggacccaucguuuuuuucccacuagacucccauaauucccucuccuaccucugaaugugguuuuuaguuuccaccaaacuucggggaagggcgaggagaugaccccuuaggagcgggaugcacgggcggggugaaggaggcauuuaaaagcagcgcguccgaggacuugggccuccuuuucuucuucccgguccuugcaggggcgguaucuguugugggcagaaacaauggcgagagcuggauggccgagugcgcaguggggauaagcggggcgcagcugcuucugugaagggagagaaggccccucccaggcacuauuccacuggaagggaagcaaccaaggcagcagcagcugucucggaucccccgucuaauuuaggggggaugaauaaguguaggaaugaauuagagaaccaggcgcaguugguuggcucucaguccggcacuuuucucuuuuuggccucuggccuuaagaaaaaaaaaaauuaguaccacucgcugccgagacuuauggguuuggguugggcaggggaugcugacaguacugagggggcuggaaagaugggggaagcugccaggcggguaaauuggauaugcuuccaggcuuugcaucugggaacaaaguaauugcuccuuccaauuuuuauuuucuuggccuucgaccuguuuugagauauuuugugagucggagcccaaagauuucugggauuuuccuauccuuagacagaaugaaaguaauacugcuccgaagaugagucuugaugcagaaucauuauacaguaagaaaaugguagcguaauuuaccauugaggcuuuuggcacaguaguuauauuuggguagcugggguuaaguaacauuaauguuaguaaucauuuaaagaacuuuuaguggugaggguagguuuagugacauaggaacuccugauaguuccuguaguuuugagugauuaagauaagauuacuuccaaauuaaaauauauucaguguugcuuuuuuuuccuuaaggaaaugguucuuuuggguuacuagggcucuuuaacuuggauuucuguuccaaggcuuaagggguuugacacaaagcaauuauguguaaaugugcaguucucuacaaaaauuguuuauaguuuuuccucagcuucucaaaggggucugccauccaaacuuuggaaaaaugaauguuucaccagaggucuuauuaauaucugaaugcagaguaauuuuaagccuaaagcaagucaacauuuuugacuugaaguugcuauuuuaaaugaaaauugauuuuaaguucaaacgugaguauagauguuaucacuaccguauuaaauuagugauauuuucauuugccagauggggaaauugaguucuacuagguagaaccuguaauaaaacucggaucugccuuuaaaagugagccguuucccacccaucuugcucugccauguucuuaccaaaaaaaacauauuuggcgguucaauuuauugaauaacauuguuauuuuuaccuuccuaguauagaaauauuaggaauuuuauuuuuuuauccaucuuaucacugacacauuuuuuuuuugguugacauuauagugugauuuuuuuuuuugucuuuuaaaaugucaguuuccuguuuaacaaaauucagaauuacugcaauucaugauauaaacuaaguuugagcacacaugcuuaauauauaugucacaacuuaaucuguuuugcacuuggaaaaugaauauuuuauaaaugacuuuuucuuguuuggaaguaugaucuaagguguuuuucuaaacagaguaaacccagcauucaugaauuuuuuuuuuuuuuuuuuuuuggugacaaagcugauuuucccagaaauagccuuccuauguauucaguuacuuuuuuucuuuuugcuugauacuaauaggucaauggagcacuuguuuuuuaguuauccuuuuggcaguguggaacucuucuguguucauccucaucucuauugacuagauugauuaaauagucaccuguauaccaauaaugugaugucaagaugccugaagcacauuuuauuuuuguagguugcauuucauggcauuuuggaauuuuguaaacuggacuggguagguggcuuugucacuuacauauguagaccagagauuuaugaugaacauagggucacacaagugccaagggucuuaacaaugaaguuagacuugacuuaaggucauuuuaccuucuauuccaguaccguaccagaucuccuccccacaacuuuuuggucacagauaguuuuauuauagcauauauugccuagcauagauuugugcaucauuaaugaagauuacuucugccaauuuuuuuuaauggaugaauagaacuuugcaguguagaaguuguuuuuuguugcuugugacauaugaaugucaggauaaauauauuugcaagaauaacauuuauuacuaguuuaggaaucagacuguaguuagaguauucaauuuaggcugcgagauaaaguuuuuguaauauuccagaagguggaaaucagggugacuaauucugauuucuuuguagacauuugugugguagcacaguagauacuguaguuuuaugacaaaaggggaacuuuuccccacauuuuauacuauuuaguuugguuucaugguuauuacagaaaaagagaaacagauuggcuuguauuaaauguaguuuucuuuuaggaugaugaagauaaucuuguguucuaaucuuggcaacaaccauacaguuuauauauauggguuaaauacguuguuauccccauaguaucuaauaucauuuuaucaguuuuucuguuagcuuagaugacagcuguuuaaguuucuaggaaguuuggggugagaauguauuauuuaagauguguuuuggucagaaauuggucuauaaugguauguuuacuauuuucgaagaccaauucuauuuaauuauuucuuucuaccaggaaauauuugaugaugcgucaccuggaaagcaaaaggaaauccaagaaccagauccuaccuaugaagaaaaaaugguauguucuaggcuugugaauagagucuauaaggaaaacuuuuuaucaggugauuaaauguacuaaacaucuaucuuaguccauuuuguguuacaacaauaccacagacuggguaauuuauaaagaaacgaaauuuauuucuuagaguucuggaggcuggcaaguccaaggucaaggccagcauuuguugagggccuucuugcagugucauuauauggaggaaggccaagagaagagagcaagacaggacugaacuuucuuuuauaacaagcucacuggugauaaccuccuccugagauacugacaguaaucuuuuccuaaucaccucuuauuaggcccuaccucccaacacuguugcguuggggauuaaauuacaacaugggagauuuggagggggacacagucaaaccauagcaaugucuguuuaauuuuuguaauuauggcacagauauccauuugaaauauguguaauauggaauacuauaacuuccauaucuuaugugucuauguaagccaaauggaaguauuauaugaauuaacauaauaugaugucauuaucuaguuauguuaacaacaccuuuaaaaauuuaaccuuggaagcgaggugaagaccagaauaguuacucaguguauguuuauucugcacuugacuagcauuguacucugcuaguuaccaaaaaaagaaauaugcuccuuguucacagcauuuuuauauuauagauggggucuuuacaaaaagaacaugacauuauauuggagucauucaagucccaguucacguuccguaucuucuaagaaacuucucaaaacuaugacuugacuuaaacaguaccuacacagagcuuuaaauuuaaauucaguuuuaguaauaguaguaguggcuaacagugaauguuuacuccguaucugacccuguuaggaaugcuuuauauggauuaaacucauuuaauuguauugaaaucucaaaaaguuaaaauaacaauguauuaaauaagaauaccacuacacagugugcuccuguaggguaaaaacagugucuuaaucuuucuuucugucuucaguacccagaacaguaucuggcacauagcagaucuuacauauuuuuuaaaacauacuuuuuucuuguccuuugacuuucucuuccaaaucaguaaauauuuuugaaugucuuaaauagcuucaaaaucuuaaaauuaugguauguauuuuaugugcauguauaauaugcacaauacauauaacacuauguaaauuauaaaugauauaucuuuagguuugauuuguuauauauuuuacauauguauauauguaacugucaccuuuuuugcuaucaaacuuagagaaaaaauagauuugccgcucuguuuuuuuaaagugaauacuacuuugaauacagucuacauauuuuaauacugcuuuaacccuuuauaguuuagauucugacacacucugcuggugaaucuaauugccaauucugaggcuuaguuuuaguuucuugauuugugcuugacauuguugaccauuccucaaaaaucuugacuugccuugaaagacauuuuuucccgugauaauauccucuuugcuuuuuuauuccuuuguccuuccuuauuaaaauuugaacauuucuuccuagacaguuugauucuuacugguuuuuaccugguaucuuuaaacugaauauuuucaaauacuuaaccucuagcccagaagccuguaauccguauuuucauuuacuuuaaaauccuauucauaccucuuacuugagaauauccaaaacugaauucauaauuuuuacuuagcauaccuuaguguuaccucaaugaaugaaaguuccucuucagguauacucaagauguucaugacaguacugcauacuuguaaacaauaaguuuacuuacgaguuuauucucuuuuccauaucacccuaguuuaguauuuuucuauuauugcauggauuauuuugugcuucuguauuugccuccuuucuuaugaucuggccccuuccaaguuucuuaacauuuuugcaaaguguuauuuauaacacaaauuugacugugaaauggagguuuuucaguggcucucuacaaugcuuuucauuuucuuaguggccuuuauuggaacucuuuucguuucuuccagguuuuucagucucccagcauuauuuccuuuuuugacaucaugaucuucaccugcacaguuuucuucuaagcaagaagcucccuugucaucugcuaguucuaaccauagauaaguucacuauccacuccucguucuugaacccagaaugcugaguacuacuucagaaaacuaaauacuagugcugauuggugccaguauaaguuuaugguuuuuauuuucuuggaccuugaguauuuauugccuaucagucucauuuagccauucuaaaauguccccacucugaucagucuuucuucuccauuucuaccaugcccucauuuccaaucuuccuccacaaagaauugcaggccugucuuuauuuucuuucucuuuucaaacauauguauagccucuauuauccuaccucauuucuuccuguuucagagaaagaagcuaguccaaagcuauucacuuuaauuuccguuugauuuuauaauugauuucuuucagguuccuaaucauacucucuuguuucugcuuuuuagguucuguugguuuuucucccucaagacauuucaguuuuaaccuuuucauucuuucaagcaguuuaucuugauuccaaacauaauuacaauaauuauuuuuucaguccaaacaucuuguagaugcgugcucuuggcuuuuguuucauuaucuauaaauuaagaaauguaauuauguaaaauaugcauucacauauguaucuuguucagcacuuuaaaaacagucuguaaucuuggaaaacauaaauaacagaggcuugucaucuguaggacauuacugggguucuagcauguucacagucuuguuacugugcagauucauuugcugcuaugacugccauuugugacccaaugaaacacuauaaccaugugccuuccuaauagcaaauugggcuucaguuuuuacauuggugugaccuuaaaaaaugauuauguuccuuuuaaaaauacguaguuguuacaacauuauggcauuuggauacuucuuguguuugcuagguaaaaugucuuuuuguaauuuauucccaaacugacauuuuaaacauuuauagacagagauguugaguaguugguuucccuguuuauugagcuuuucuugucuugcuucuccuuuguuucaucaaacuauuauuguuuuuguauaaaggcugccuaauggcucccaauuucauuauuuuuaugaaaauuugucuucgaggcucuuaagguuuuuuuugcccaaguaaauuuuuuccauucucucgguauuauaauagggaacauucaaaggggcagauggcagauacgaaaggaaggaauaguaucaaucccaauaccguuuuaaaauuugucacagccuaacuaaugaaugagcacugcauuuuuuccagcuucugaguaaauucacuuguauugcacaguguuuaauauuuuaaaaauuguuccgaucaacuguauugaaguauaauugacauaaaauaauuuuaaguuuguaauucaaugaguuuuagcaaauauuucuuuaaauaccaucacaaucaugaugcagaguaguuccaucauccccaaaguuugcuccugcuccuuucuaaucaguucuugcucccaccuccuugccacuucugaucugcuuucuaucacuaguuagcauuucauuuaaguggaaucauacagcauguagucuuuuguguuuggcuucuuucacuuugcauagugcuuuugaaacucauccauguugcauuuaucuguaguucucuuuuuuuuuuugcugaguucauuguauggaggcaugcugaaacuuugauuucugaaguuuuaauugauacucugauaaaauguaucuuaaauuuuuuuuuuucagcaaacugaccgggcaaauagauucgaguauuuauuaaagcagacagaacuuuuugcacauuucauucaaccugcugcucagaagacuccaacuucaccuuugaagaugaaaccagggcgcccacgaauaaaaaaagaugagaagcagaacuuacuauccguuggcgagugaguaauaguuuaaacuucauaguucaaccaaacuuauuuucgauagucuucaguggaagcauaaaaucacuaugauaaauaacuuaaaauuauuuuagugccauuauuuauuuggcccuguuuggcuuggcaugauuuagccauaaauguauaaguauauaaaaauacgcauaaugguuagagcacaguggcucuugccuguaaucgcagcauuuugggacgccaaggugggaggauugcuugaguccgggaguaugagagcagccugggcaacguagggagaucccaucucuacaaaaaaaaaaaaaaaaaaaaaaaagaauaaaacugcauaacgccuuauuuuuuguagcauuauauaguuuaugaauuguaacaaucauguugaguauggaauuuagaugucacgucauuccucagagaggaaacaaaugcagagguuaaguggcuuguuuaacaucacauugaagaaugauccagacuugaauuugaaucugacuugggugugcucuaggcuccuccaucacauacagauguugacaguauuuuaucuaaaguguggugugugggauauugugaugacuuacaucacggcagccuguuuaaaauuuuuauugcauacuuaguuguuuuuauauaaauugaagugucacguuguaugccguccuuugguggugguugaaaauaauucuuacauguugaauuuggaaauucucuagaauuuucauucugguuggauaaauaagauguuuaauuaguaauaguagauuuagggcagucuuggcucccugaaauggcuuuguguaauucccaaagugaaaacugugauuaguaauuaaaauacaaaagauuguuuaaaagaagaaguaucaacaagguuaaauucacuacacaguuuguugaaagagggaaguaugaucuucaucuugaagggguuaucguuguaagcauaauaccuuuuauuugggguauuccacucauucauuauaucuuauuucucauccauugugaccaaagcacuauuuuaauacuuacgaaacuuugaagggacaauuuugcccuucagcuguauuuaaaauauuucagacuucagaaguuugcauuagugucauggcaugaaacuggaaacuacuguacugaauauuguuaugggauagucaguaugaugucucgaaaagaaacacuucuuuuauucuuuucuauuuuauuauuauccuaauuuaucuuuuuuauaagauaaaaaagauucuauuggaaauaguaauaauaaauuguuaggcuuaauguauuaaauaguguuauuagggaaaaaaguccuaguuaacagauuucuuuacuccucaaaccaucuuaaaugggaagcuaauuuaccuaaaguaaugagggucauaguauugucuuuggguaucaggaauacauuuuuuuaaaucuuuuuuuguuuguuuguuuuuauugagacagagucuugcucuguggcccaggcuggagugcgugcaguggugugaucucgguucacugcaaguugugccucugggguucaagcgauucuuggaccucagcugggauuacaggcucacgccaccacgcccagcucauuuuuguauuuuugguagagaugggguuucaccauguuggccaggcuagucucgaacuucugaccucaagugauccacccaccucugccuccuaaaguguugggauuacaggcgugagccacugugccuggccaggaauacguuuuuuuuuuaagucauucacgauuauauucaauuuuuaacaauaaaugacaucucagcuuuuaaguuuuacaacuguaauaaucaaacauuuugagaguaacuauaaaggauauuuuauaaaaagaauuuaaaauuaucucccaguuuauggagaauaaauaggggauggaaguagaucuuuguacucaauuucauaggcucagaaugcagagaaguacaaggaauaacagacuaggauguacugauuaugauuagaagcauauauaacaaacaagaaggcccuugaauuucugaggaaugcuucuaucuuggaaggccgcuuauccuuuuagcaagcaugugguuuugguagaaaugaaguuacaaauuagauucagcggucucaacagaggcauaacgugccuuuuucuaaauaagaugaaaauauuuguugaaagugucagaauuggggaguaaguauuaauaguuuuacugaaccaagcccuuuagagauuaauuggcaguauuaaaacuuuagaaaaucaguuuuuaaggggguaguauaucugauucucuuaggauguagaauuuagauguguauuuaaaaauuuuuuugaugaauccguggucacugcuuaaauuucugaguccuuaugcugcagcuuuugcucgaaguuacaauuuuaaacaugugguuucuggaacuuuuuuuuccuuggcaaaaagauuuuuaaaaagguacacuuuaaaauucaaauaaugagauuuucugacuacauaguucuugaaauuugacuaucauauuugaguuuauuggguucugguuaauguaucguacugguguauuuuaauaacuaauguauauuuuaaauaauuauuuaaaacauugcagauuuaaauguacucauauuuucuacuguccacugguugaugccuguuaaaaauuuaauuuuguggaaucuuggucagccacuugacuaugauguuuaaacaguagcugauaauuaaagccaaaacucaaaucagguuauuuuauuuucaucuuaacaguuaccgacaccguagaacagagcaagaggaggaugaagagcuauuaacagaaagcuccaaagcaaccaauguuugcacucgauuugaagacucuccaucguguauguuaaacacacuugauuuuuuuaaaaaauugcccuuugagaucuccuuugguuaauguuuuggauuuguguuggcuacuauuugugaagcaaauuuuuaguagucuuagauguuuauugguuaugaaauaaacuucagauuuugauggagaugagagcauauuacaggauaguagugcuguauuucaaaguuauauaaaaugucauuguguuuguuauugcccugaaguauauguaaaucuaaggaucguuuugcuuuauauuugucccacauaagaaaacuaauuuauuuuaaaaaagguacuucaugaacacauuugcuuacuucugauguuuuuauauuaauuuaauuuuuugugaaauguauuuguuuauugguuagcuuuuuauccucaaguguuuuucaaaaggagauggagggcuacacuguguacauauuaaaaaagaaaaaucaggugaccguuauguauauuugguaauuauucuggggagcaaaauaaguaguauacccugaaagagagugcauuggaauguauaagauauauuggacaaguaacuuaggaauuuccuauuucuuuuuuuuuuuuuuuuacuagaaagaaaauaaaauccccagauaaccuguaucuggucuuuaugaaagcugaaaauacuugguuaggaacacuugguuuuucauuaaaaagacgagaggccaaagagucucucagaccaguauauggguaacguaagaacugaguuguuggaguggguacucugaugcccgcagucauguuucccgcacuugauuaucuuccauguccagcuuuuccacuucagaccauggcagcuaccucuaguauuuuggaacuugcagaguuccuauucaagaauccguuaguaaugaaaauaaagucaguagauauguguaggcuuagaugaagagauugccuuguauuucuugucuuaaaaugccuauugugcuuuucuuuuguucuuagauguaaaaugggguaaacugagagauuaucagguccgaggauuaaacuggcucauuucuuuguaugagaauggcaucaaugguauccuugcagaugaaaugguauguguugguaguuuuuuuugaaggguauguuuuguauugaaaauaucuuauacguugauaaaaguuucuuacagucuacaacuguuagcaaauggauccucucagaaacuaguauaagcagcuugccuuaguugcauaagugugaucuguauuuuaauugugagaaauuuccaucgcugaaaauaugauaaauuuaaaaagaauacauuugagaaacauguuuuuggaugacuuuuauaguacaaugauuuauuugcuuccaguuuuguaaaacaaaagugaggucauuaauuguuuauaauugauaaauguuuuuuccaggugguagcuuguacaauucuuagaaaacauuuaucuuuuguuaacuacuaguuauguaaugaauguuuaaaaaaguuuccuuauugcuauaaugcuaaaacguuuaauugguuggagaaaguaugaagucaaaagaaauguguuucaaugcuagcucugcuagaugacuuugggaaugucacuuaaacggggccuuaugcgggugauaauaauaccuccuuuagagacuugugaaaauuauaugacauaacacuuacaaacuuugauauauguuaaguuuuugccauuuauuaacuguuauaaauauguagcauuucuuuugaacauuucuauauguugggagguauaauugugaaauaauauuuucauuuuucacugcuucaugguuauuuugaaaucuuucagggccuaggaaagacucuucaaacaauuucucuucuuggguacaugaaacauuauagaaacauuccugggccucauaugguuuugguuccuaagucuacauuacacaacuggaugagugaauucaagagauggguaccaacacuuagaucuguuuguuugauaggagauaaagaacaaagaguaaguuucuaguauuucauuacauuuuugaggcuaaaauaauuugaauucaggcuuggguauggguauagcuggaagaaggauaaaugagacgggaucuucgcaaauauuaguauuuacaaauguagcauugucuugguggauaaaaaacagcacuuugggaggccgaggcggguggaucaugaggucaggagaucgagaccauccuggcuaacacagugaaaccccguuucuacuaaaaacucaaaaaauuagcugggugugguggcacgcauggccuguagucccagcuacuugguaggcugaggcaggagaaucgcuggaaucugggagguggagguugcagugagccgagauggcgccacugcacuccagccugggcaacaaagcaagaccaucuuaaaaaaaaaaaaucauacugggaagaagacauuagaaaugguagaaagcuguaagacuguaguuuguuucucucccuuuugggagugguuguauaaaaucauugguugugcucucauuagaaguuauuuucuuguuuuuaaaagauauuuugaaaugugaguugguuggaaauuuaaggagccacauuuuuagaugaauguguguagugguaauagucacagaauuagaguuuuuaaagacggguugagucauauauaguaauuuggugauuuauuaugauauuuaacaaaauaaguuaaaauuucgaucaguugacaacauccuugugggaagaagagauggaaauaaugacauuaguauauaaagcucagauuuggaaauuuauucagacucuacugaauagcuguguacuuguuuuuuauuuccucuucauuuaccugugagugauaagucuauauuuuucucucccuuucuaguuauguuggauauuuuaaguuaucaauuuuuguuuguuuguuugggagcccaaagagugguaauuacuuaaccagucuuugcuucaguuuccuuaccuuuaaaauaauacuauuaggaauguguuaauacauuuauaaaccugaaaggaaugcagaugccuacuacugcuaacuaucuuuccacccucuuccuuucuuuauguuaaaaccucccucuuuuuugucuaaaccugccuccuaagaauuucccgaucuaguggaauugcagaaagacauuuuaagugucuauugaauuuuucacugguuaacuuugucaguuuuuuaaaacuuaaugguucugacauuuaaaugauuaaugacguuacuuuagucuuaggaaagcugguucuaaacguuugcauaauauagcuagcuacucuacuccuuuuuaguauucccaccucuuuuuauauacuagauuacuugucaucaguaaauguaaugcguaguuuauuucuacgugauguaauuuuuuucucuuguuacacaggcugcuuuugucagagacguuuuauuaccgggagaaugggauguauguguaacaucuuaugaaaugcuuauuaaagagaagucuguguucaaaaaauuuaauuggagauacuuaguaauagaugaagcucacaggaucaaaaaugaaaaaucuaagguaauuugauacuuagaugugaaaagccuucauguaagaauuugauuaaaguacagauuuuuuuuucuuuuaacuuuaaguuaugagauacaugugcagaacgugcagguuuguuaacauagguaugcaugugccauggugguuugcugcaccccaucaucuagguuuuaagccccgcaugcauuagguauuuguccuaaugcucucccucugcuuucuccccacuccccgacagguccuggcaugugguguuccccucccuguguccauguguucucauuguucaacucccacuuaugagugagaacauguaguguuugguuuucuguuccuguguuaguuuacugagaaugauggcuuccagcuucauccauguccuugcagaggauauaaacucauucucuuuuauggcugcguacuauucgcugauguauaugugccauauuuucuuuaaccggucuaucauuguugggcauuuguguugguuccaggucuuugcuguuguagauaaugcaauaugcagaauauucuaaugguguauuugguucuuuucuuucaguugucagaaauagugagggaauucaagacuacaaauagacuauuauuaacuggaacaccucuucagaacaacuugcaugagcuguggucacuucuuaacuuucuguugccagauguguuuaauucagcagauguaaguauuuccuggugcuuucugguuaauaauaauauuuugcuuaaugcuauauauuuuuguaauaaaaguggccugccuuuuagcauggcuugagguuauuauuaauuuuuuaugcuuuuauuuacauaguuagccugguguuaucuccuagguugucucuguauaaugggaauuuacuuuugugccuuugguuucaaucuuauuucauuauuauuauuauuauuuuauuuuuuuugagacguagucucacucugucaccuaugcugaagugcaguggugugaucuuggcucacugcagccuccaccuccggaauucaggugauucuugugccucagccuuccgaauagcugagaucacaggugugugccaccaugcccggcuaguuucuguguuuuuuguagagaugagguuuugccauguuguccaggcuggucucaagcuccuggccucaagcgaucugccugccucagccucccaaagugcugggauuacaggcacgagccaccacaccaggccucagucuucuuuaaaucauuguuuucucuaucugaaauggcauaaauugucacuccuauuugguaagucagguuggccugacuuuguuucaguggcucuagguugacugguuauguuuuuaaggugcugcucaagguauuccugaagugauuuguauaccucacauugcuuauguuuuaagucccaaggaugacugucaaauuuagugaaaucugucuggcuuuucuuauauuauagucuaacaaacaaauagaaccuaaucuuuauggauuauuuauagucauagaaaggauaguaaugguuaauuagcuauuugaacuguuaauaguaauauaauaacuaugucaagaguuugugcuauuagaaauugcaguuuuuuuugccuggaccaguguuuauuuuugaagcuuuguuugcauagcuggcgucuuauguguauuggagggauuugaagagcuccauguuaguauauuuuuguacaauuaaguuauaaaaagguauuaauuaauuuuguuuuuuuucuguugaagauuguuuugaaagaauagauuguguuguaaaaagauauuuaaucagacuccaaaagcaauuuuagcuucgauuuuauguauuuugauguuuuugagauaauuccuguuucucacuacauugacacuuucauuuacuuuaaagcagugaauucuaagauuauguuuacucaaaaacaaagcacauauauaauacauauguucaagagaugagguuagggaaacugcccuuguugaaaucguaaccaaauauuaaugaaaugcugguaauuucaauuucauuuaguaaguuugauuaaaauugacauuguucguaaacuuguauuugaguagugcgaauggucucagagaacaaacuauaaaauguuuuaauuuucaagcuuuuaugaaacuugaaagauacuuuacaagaauauuaauuuucuaauccuauagaacuugcucuccaacuuuuuacugugaaacuuguuauuuugauguuuuugagaagaauguuuagaagguagugugauuucugaacuacuuguuuuaaaauuaguaacaaugacacaugaaaaccaggauuggacuaagugauuuuuuuuuguggguuacaauucaaauuacuaauucuagaaaucauuucuauaucugguauuauaggguauuuguuaauauuaucucugaucugaguauauuuuuuguuuguuuaucuaggacuuugauuccugguuugauacaaacaacugccuuggggaucaaaaacuaguugagaggcuucauaugguaaguauuuuggaguaguguuaaagcauauuuaugaugggaaaaaggauaaagguuuaaauuaguagauuauuuuccuguuaauaaaaaacacaauggcuuaagaaucagaucugcuugaauucugacacuuaacucuuacaucuuacaaucaguguagggggugaugugugguuguuucaguguuagaaccuagaauggaauccugacuuaagggagaaaguauucucuuacaguuauacaaaauacaguggggggaagaagaauugcauaauaauuaauauagacaaguuuuuguuguuguuuuugagacagucucacuuugucguccaggcuggagugcaguggcaugaucuuggcucacugaaaccucugccucccaggcucaagcagucucuccccauucagcgucuagaguagcuggggcuacaggcucuggccaccaugcccagcuaauuuuuguauuuuuuguagagauaguguuucaccauguugcccaggcuaaucucgaacuucugaacucaaguuaucaaccugccugccuuggccucccagaguguugggauuacaggcaugagccaccacgcccggccuuaauagacaaguuuuuaaagcuuaguucaauuuacauuccauggaagaaucuaacagguucacuuuugaaagggcuaaagauccaucuguuuuuucuuaaaucuagcuacauuguguauaaacaacugcuaauauugcauuaugagcacaguugguauguuuuugcuugcuguauagcuuuguuucuacauacagcuuccugugacgguucacaaguaaaaguugguagguagagaaacuucucuaacagacaccagauuaaaauacccugcuaagcagguuaaagcaggagcuuguaagaauguuauauaaagcccuuaaugaccuaacucaggaauucucagccucuuuugacauuuuggucuggguauaucugagagggguaaggagagaggggagaacgugauuguccuguguauuguagcauguuuaauagcaucccugauacuuuuacucacuagauggcaguaguaacauuccuccaguugugacaaccaaaaauuucucuagacauugcagauguccccuggggaacaaaauugugccccuccaugaccuaaccuuuuuaacauucuuuggcaucuguuuuacuucuucauauauugagcuuuaauuugauagauugcugaccccacugucaguuuucuguaaacauugugguaauucuaaucuauuuuugcuuaucauuuuugcuacaccuagaauccuuuuuccuggucucuuuacuaauaccuaguccaagacucagcgacaucaccuccacugaaccagccaggcugaggcuggccuaggugcccuucuguguauuccaucuuuaacaaucugagcauccuaauauuauaggacuuugcagaggauauugagaugauucacaaguguuuuccauacuggauuguaagcacaaaggcaggaagcacagauuuauuugucuuuguauaccuggcacaaugccuaguuagaguggauauuugaacagggaaaaaaauuuaaguucaugauuguucaaauauuucauuauaaaguacuuuaaaauucuuaaauauugagaguuuuguuaaauauuugaagguaguaauuuccuagcuaccuuuguuucaauucagauggcauucaugcaucuaagcacucucuuuguauuuacuuagaccaaggauuguggaguguauauguaaucuuggggguagaaaaggaggcagaagaacaugauuuuuuuucaugcauuuuuuuccccuuauuccucugcucuuggcuuuccuuuaguaaauacguagguacaucuagguaaagcaaaugaacaacccauucagcaguaucaaccagauuugguaacucuguuuuguucacaggguauuuugaaaaugcuuaugaagucagggagaagaggucuuguagcuaccucucuacuuucuccugcucuuuacuuugaaguuucuacaguagcaccuguggucuuauaaugaaaggaggguuuagaagucgguauggaugcgcuuaggaaugagauaacucuuauuugauguauuaguuaucuaaugcugcaaaagaaccccuuauucccuccaccccccaaaaacaccuuaaccccccuuuagggguuacuaagacccccuuauuucccccaccuccaaaacacuucauaguuuauauuuuauuaacaaccccagaauuuauggguugacuggaugguuucuuuguggauuacacuugggguuauccaguuacauuuauuuagcuggacaaugcuagaagagaaccgguggggcuaaaggucuucacuuacacaucuggcaguugcugccgccuguugacuagggcugaacuagcuuuucuacguggugauguuagagagguguugcugguauuuuucccacuaaugucuaauuugguuugugauauagucacuauuuuuaaaaaccaguguaaauagaacagagguacaaaaaaggguaucuuuaguuguguaguuaauuuuaaaacuuacuguucuaugaaaaugagugaacuacuacuacauauaacauggaaaugucucauuguuuaauaaaagaaaccagauauaaaugggugcauauugagugaguccauguauauaaaguuaaaaaugauaggcaaaauuaauuuauggugucuaaaaauaagaauauugcuuacccuugggaaggaaaagaggggauagugauuggaagggacacaaaaaugauuucuagaguguucuauuuggguaauaacauggguacuuuuacaguacuugaauaaaauuucuagaacuguacacucaugauuuauugaaguguguacuuuuauauucuuucccuaaguuaguacauuaaguuuaaagacuaaccauaaggagaucuuaaugagacccuuguccauucuuuuuuuuuuuuuuuuuuuuuuuuuuugagauggagucuagcucugucgcccaggauggagugcaguggcgccaucuuggcucacugcaagcuccgccucccggguucacaccauucuccugucucagccucccaaguagcugggacuacagguaccugccaccucgccuggcuaauuuuuuguauuuuuaauagagacgggguuucaccauguuagccaggauggucucgauuuccugaccuugugaucugccugccucggccucccgacccuugcccauucuuaggcacuguuagacagucugcaugcaaguaacuaguuuuagaccugaaaggcagcaaauuguugaaaacauuuuaaaaauuuacuauuguuuuuaguauuuuaugguaguauaacaaguauauacucaaacauauacaggcacaucucauuacccuuugcagugcuucacagauacugcauuuuuaagaaacauuuauuuugcgaaacaaauagaugguuuguggcaacccugugucaaggaagucuaucaauaaacaccguuuucccaacggcauguguuuacucuguuuuuaaagcaguaauguauugcuuuaaauaauguaucacauuuuuaaagcaauaauguacuuuuaaaauaagguguguacguuguuuuuuuuuuagacauaaugcuauugcacacuuaauaguguaaauguaacucuuagaugcacugggaaaugugacuugcuuuauugagguagucuggaacugagccuacaauaucucugagguaugccuuuauugaauaaguaauggucuuguauuacuacccuucaggaacccaguaguaauaaauuauauacaguuagcccuucauauccauagguuccacauccauagauucaaucaacuauggauuggaaauauuuguccccaaaaaagauaaaaauaaaauagaugguuccaucuguguuaaauauaccgaccuuuuccuugucauuauucccuaaacgguauaguguaacaacuauuaacauagcauuuacauuccauuaacuauuauuauaaguaaucuagagaugauuuaaaguauaugggaggauguuuguagguuauaugcaaauacuacauuuuuuauaauggacucgagcauuuguggauuuugguauucaaagggaaggggacaggaacuagucucccacagauacugagauaugacuguauuugcagggagaaguccuaagaaaucacuugauacucacgcagagaaauuucuuuuucauguauuuuauauacaauucuaagaugcugaaauaugaccuuauguguaauauugguauuaccuguuuauuuuuguccuuuuuaagguuuugcguccauuccuccuucgucgaauuaaggcugauguugaaaagaguuugccuccaaagaaggaaguaaaaaucuaugugggccucagcaaaaugcaaagggaaugguauguauucucagauguacuugauagcacuauugauucuucccuaaauuucauguguauuuuguuuuccuaauuugugucuucauggaauuccaauuugcuggauugaacucaaccugaaaagaguuuucuugucacguaguauaggacuugcucauuaaguucguuauagaaaguuuugaaccuguuagaugacagaaucaggauggaaggcuuaugaauccaaaauuaaaauugggauuuaauuaaacgggguucauaugaaaccaucuacuugggauuuuuaaaaaggaaacugugauagcacagugugggagauauaugguucacuuauaguucauaaauacugggucaguguaaaguagcugcagaaaaagauacuguuggccuuaauguaaauguaguguucaaaggagaggaaauaaauauagcuacccuuuucuuuacuggucucaucauauuucauguauauuuaacugcauacuuaaauuuugauaaguauuugcaagaggccagaguuguuugguuaaaggacuuaauaucauauagagaacugggcauguuaucuggguaagagguuaucuguagaaggugguugguccuaaauguccucaaaaacuucugaaaggguagcagauauuaggcuuaccuuggauggcucuaaaacagaacuaagaugagucaaugcuaaggaaagacaaaucuuuuuuaguuaaacauuugagugaacuuuauaucagaauugagauggaaaggucugccuuguuguuuaagcauagauugccuaggcuacuuacuuuguucaaaggauccaaggcucuaaaacuuugaugcuuagacaaauuacucauucuuucauaacaaugucuacauccuuaguauauguucaaggcuuuuuauaaucuggccuuagcuuauggcuguagcuucacaguccugccucacagacauaccucccucccccauguauuuauacguauguuuaagucacguuguauucauauuauucucaucaucaugccuuaccauuucauuauucuuccugucuucucagauguuaggguucuuaccuaaaugcuacacuagcuaugggguauauaguaaucgaauaguggcacuuucuguugcaaaaaaacugcaaacuaaaauuauguuuaaaacuuacauuuuuuaaguuuugcuuuauuacuuaaaaauauuaugucuuacugcuguaauucuacccaagggaacuguuuuuguacuuuaaaaauaauauccucaaggcccaaggcguaaguaugaacauuauaaugcuauggacaguaaagaaaaauggaagcaaaaagagguuacagauguuaaauuccuaaccauaccuagaaguugaugaguaguuucuuacagauauuuggggguucauguggggaaggggauuaaguauguaaaguggcagggauugaucaaggaacauuugagcucuaaaaauguuuuucuucuuugaauagguauacucggauauuaaugaaggauauagauauacucaacucagcaggcaagauggacaaaaugagguuauugaacauccuaaugcaguugagaaaauguuguaaucauccauaucucuuugauggagcagaaccugguccaccuuauacaacagauaugcaucuaguaaccaacaguggcaaaauggugguuuuagacaagcugcucccuaaguuaaaagaacaagguaucgguuacccguaucaaauuaucaaaacuguuuuaaaaugcucauguuaaaacaaaggagcacuguacuuugaaaugacugcucugaugcuuuccaagguugacguguagaacauuaaaaaaaccuguucauuaucugagcucuaacccccacuccugauuuuaggccuuaagucucuuagaagguaagcaauaguuagagcaaccauacucccuugauuuugggaagaguucauacuuuauauauacuuuccuagaaauuauagcuuucugucauaaaaugugaagaaugcaucucccucccacacaugguuaccagauccauuguuagacaguggugguguguucaugauauuguuuuuuaauuauuuauguggaguuuuaauuuaauaagguaccauguacauggaccugaaacauuuuuauuuguaguaugcugacuuuuuuuaugaaaauggguaugucuguguuguguguuuggguauauuuaaauuacacgaaugcagaaagaacuuagaagccagcuucugauuuuaacuaauaaaaacguuuuuagucugcuauacccuuccuccucccagauuauucgaagcaaacgccagacacuauagccuuucauaaauuauuacauaucucuuaaagauacgaaauaucacugcuauaguauuaagugugcagauucaaguuuguguuucucucuauauuuuaauaagaaugacauuuggaccaguaggugaaucuccucuaugauacuaucaaaagcauguuguaagaguugucagugaauggguuuacuuuuuccuuuucauaccuuuuuguagagauagauuuuuaaaaaaugcuuuccuugaaagcaaaguaauuaaaggaguuaaauugguggggaggaguggcaggaacguggugggaauacucagauauuaaugaaagguauauuaaacucugcagggaaaauggagacuauuaaguagucucaugucccagcacuuuuuggaaggcugaggugggcagaucaccuaaggucaagaguuugagaccagccuggccaacauggugaaacccugucucuaucaaaaauacaaaaaaaguuagcugggcaugguggcaugcaccuguagucccaguuauuuggaaggcugaggcagaagaaucacuugaaccugggaggcagagguugcagugaacugagauggcgccgcugcacuccagccugggugucagagcaagacuccaucucaaaaaaaaaaaaaaaaaaaaauucuuaugcauuugaggugcaggaacgugugacaacagcagauugucagccucugcuucuaggacaggaucauuucauaaucauuacuuuucaaaaugauccuuugucuugauauauucuacugaagguauuauguagcugccuaaagaaguggaaggcagucggauaguuugaaucauggcagauaagugauaagugaaggauagucauuguagauauaugaggcacauauuaugguccuuugaucuagaauggaucuucagaaccaggcugagaccaggauuauuagguguguguuggagguuuggggagucauaugcauugaagaguuguugugaaguaguggaaaguuauuuuuaaauguauaugggguaacaagauaaugauuaucuuacccuuugggauggcaaagccuuccagaccagaggcaaauaugcuuuucuguacaaauguuacccuuuuuuauuugugccauggugagaaaaaagugggaaaugacugacuuggauaauaauguguagauuuuuuucccccuuguaaccaaguagguagcuuuggaauuaaggauaauugauuagucuuaguuuugguuacccuuaaauuuuucuacuuuugaagccacugauaauagauuguuauauuccccaacagguucacgaguacuaaucuucagucaaaugacaaggguauuggacauuuuggaagauuauugcauguggagaaauuaugaguacugcagguuggauggucagacaccccaugaugagagacaagugaguaaaauuuggggagggagauaaaaaagaaucagauaaauuuuuugacaaccauuuuguuuuauccauaggacuccaucaaugcauacaaugaaccaaacagcacaaaguuuguuuucauguuaagcacgcgugcugguggucuuggcaucaaucuugcgacugcugauguaguaauuuuguaugauucugauuggaauccccaaguagaucuucaggcuaugguaagagauaacgaauaaauauauucugugcuuaguagauggcguuaguuaggacaggcuaauucuacaaauaucagugacuuaacccaauagaauuuuauuuuucucuaaucuaaugguucagugagaguauauugaggugaucuuccaucuaaauaaggguauuuccaucucagggaucugccauaucuuaggacccuggaguccucugcuauacugcauccuauuggcagaagggggaaacgauagaguuggggauuucccaggaaauucuuuaugggucagaccuugaaagagccuccuugucucuccacccccuugaucaaagaauuagacagaacucaaaucauguagcauaacugacugcaagggaauugguaaauuauaguauaguuauaucacaggaccaaagagaauuggguuugaugagcaacuagccugucuuccacuuuaguuauuuaaaagaacaccugugugagaguaccuggucagaucaggaagauuauuuuuagauugagagaauugauacugcagauuggccugacccaugauauuggugaccacaaacccaacuuuaaucucugucauuagucacuuucuuuuuuuuuuuuuuuugagauggaguuucgcucuuacugcucaggcuggggugcaauggugcagucuuggcucacugugaccuuugccucccagguugaagugauucuccugccucagccucccgaguagcugggauuacaggugugcgccaccacgccugacuaauuuuguauuuuuaguagagaugggguuucaccauguuggucaggcuggucucgaacuccucaccuucaggugauccacccaccuuggccucugaaagugcugggauuacaggagugagcuacuacacccagcccauuagucacuuucaucuuguacucuuacuaagggugacaggggaaaauggaccaauuauuagaaauaagggaguuuuuuaggaauguaguuagcaaaaguaaaacaaauucauauucagauuaguuugacuacuuguauauaguuaauuggguaauauuuaaagguuagaauuuuuguguuguuugcuaaguuguuucaugucacuucuuugccugauagcagugacaauuuggguuugauuuagauagaaaaacauuuugaauuuaaaccuaggaaaaaagacuuaaaaucuuuccucaucagacuuaaaaauuauaauguuguauauuguuuggagacauuauguguuuuaucucaguguaaccuagcagaauucaucugauuccuuacagaugcaguguuauuacaaauuuuuaaaaguuuuauauuucagaauauuuuaauuuuuuuucucaguguacccauuucaguguuauuuaugugacuuuuaaacuaaauucaaaauaacaugguaauuuauuuaggaccgagcacauagaauugggcagacuaagacagucagaguguuccgcuuuauaacugauaacacuguagaagaaagaauaguagaacgugcugagaugaaacucagacuggauucaauagucauucaacaagguaagccauggaacuuuaaaacuuuaccaaguuggauugacacaaccuguuuuuguuugaaaaucgucuuagaagauucuuguuacuaagcauccauugagucaagcuugcagccaguagagaugacuuguauugcaaauacaguaaacuuuaguuuugucauuaaaaagauggauuugggcucaggacaguugagguuugaauaaugagucugccaguuagcaguucucucugguuacaugaacccauuuccucaucuguuaaguggggauaaaaauaacuacacuuaaggauuuuaaaggauuaaaggggauaauguauauaaaauaucugacauucaguguggugguuaaugauuuauauguacuaacuacucuugauuacuguggggaaaacugaagaaauaaaaaucaaagagccugauuuuauucuuuuuucuugucugcaauuuacugaguacccaccagaugcuaggcaccguucuuggugcugagaauucagugguaaauggaacaaacaaguauucuuacuuucaaagaguuuacaauuuaguugggagggagagaugaaguaaacaaggguauaaguaggaguagggggugagagugggauuuuauuuuggaucaauugaaggaaacuuaaguucucauuccagaucagcuuuuaaggaugacauaauuuauguuuucaugaagccuacuauaaaguugaugaugggaaauauaaaauucaagaaaaggggugggaaacuuaauaauuucaagugugcauugguuuccuuuguaacugcauuugugagcauguauuuacuaucugucuauaaagcugaaaggcauacuguuacauuguuuacugauuauguagguaucuugauuuugucagucucugauguccauguaagagaguauuguacaugucuuugguaucccuaaugcuauucauaguguuagccauaugucugcauaccugaagacaauaaauuauugcuuauuuuuacaaaucguuucccuuaauaaaguguuuacuuugugccaggcagugugcuauauacuuaacauuucauuuucuccuuuagucuucaugccaacuugagauguuagcaucagagauaaaggcuuuugagagguuaaauuacuuguucauuguacauacagcugggaagugacucaagggggaucaagaacuuuguuaacucuuaaguguuuaauuagaaaagucucuggggacuucucgaggcugccaccccgugauguuaucucaugggugauauaauggcuaauguuuuauuuuucuucacacauccauguguuuugaaauacaccugccguguguuucuuguucucaguuauuuucauccaugaaacacuuuuuuuuuuuuugagauggaguuuuguucuuguuacucaggcuggagugcaauggcacgaucucggcucacugcaaccuccgcuuccuggguucaagcaauucugcugccucagccuccugaguagcuggauuuacagaugcccgccaccacaccuggcuaauuuuuuuguauuuuuaguagagacaggguuucacuuuguuggccaggcuggucuugaacuccugaccucaggcgauccacccaccucagccucccaaagugcuggauuacagguaugagccaccacgccuguccaaaacacuuuuuuuaaagauaaaaaagaccuuaauugauucauaauuaauuuagaaaucuugagguuuuuuuacuucauauuuacuguggcaauuuuuggagcaaaccuucaggcuaauagcuuucuugugccguuuguagacauguuagucaaacagcaagccuuaagugcauaccuuuguguuacuguuuuuuauuugagggacauaauuaaaaacgagaguacacaagcacuuuacaucugaagguuccggaaccuuccugcccaacuuggaaguaguuuguauaagcauaagaacauuuugguagcaaugguagcauccaauccaaggaaacauaccuuguggauaucuccucacuuacaaagucauggauguuuggcuguauauccuauuaugggucccaaaccaugauacaaguauuuaaagaaguuguugaaaacuuggaucuuuuuccacuuacuuacaaguugguuggcauauaaaaaucaaagcuuuguuuagguguaugugagugacccuugaggagggugaaaacaagucuuucuggguuuuuguuuguuuuuuuauaccuguauuuuugaaaaauuacaagguuguccaaacuccugccaacugaaaauauuuauuaauuuauuaauggugaguuucuucgaugauccagauacauuuucucaccaggugugguagugcaugccuuuaguccuagcuacuugggaagcugagacaggagaauggcuugagcagggaguugaaggcugcagugacuaugguccugucauugcacuccagccuaagcaacagagcaagacuccaucucaaaaaaauaaacgaauaaaauaaguuuuuaggaguuucaguucuucuggaaguuuucuuuaaaaagaaacugauguuacauauuucaguucuguguaaaguuuggccuaggugaaggauuuuuuacuuuacuuuucuaaggagaaaagcugauuuggggaguauuaguuaauaacaccuuucugcucaucagaaacuuguguguauaaugcuuccaucuguugaaacuuguagguuuuugaaaauuuuucauaugcagcuuucacaaaagauuauauuucguuggcacaguauacagcagguuucauuauauaauacauaagguuuaggaauguuuuguagcuuaccaacugaaaauuuggcauuaaauuuagugcaaaaaucaaaauuauuagaugugaauaaacaguaaacagaaaugauugacauuugagauaaaauuauaaagcauuaaaccuuacauuuaaaguuucaaguuuccaguaaaauaaagucuguucaguuaacauuauacaacacaaucuuuuuucagggaggcuuguggaucagaaucugaacaaaauugggaaagaugaaaugcuucaaaugauuagacauggagcaacacauguguuugcuucaaaggaaagugagaucacugaugaagauaucgaugguauuuuggaaagaggugcaaagaaggugagauguagauuaaauaaugcuuuuaauauagaauguuuuagaccagaaacaggaaauauuuguuacauugaugauaaauaauuuuauuuccuuaaagagaagcuuuuguguacgugaaguuaauuuauuuugacugcaguuuucaugcuuucuuugcugugaaucuaagaagcugauuguuuuguucucuagacugcagagaugaaugaaaagcucuccaagaugggcgaaaguucacuuagaaacuuuacaauggauacagagucaaguguuuauaacuucgaaggagaagacuauagagaaaaacaaaagguaauuuagaaauagguuuggguuacaugaaagcuuuauuuuacuggaaacuuggaauuuuaaguguuacuguaaugucuuauaauuuugcuuaaaacaguagucauuuuugcuuauucacaucugaauauuuucaucauuauguaaaauuuaaugccaguuuuucaguugguaagcucugaaauauuuuuaaaguuuuuguaaugaaguuugugguauauguuuacagugaaauauauucuuguaugggaugaauaguaauuugggaugguaaccugauucauuuuauuuuaaacagcagaauuggcugguaauaaagggaaaaauuucuuaacuucauaaguaauacuugguaauauagagauaaauugaaaaauacccagagauuagaagaaaaaaauaauucuacccaguguuuuucuuguuaauauuuaggucuauaucuucagaauuuuuuguaggcuaauuaugugucuacauuuuucuccuaguuuagauuuauaccaaacauucuguagcauuucucccucauuuaacaguuguuccuuuaagcaagaaauacugaaugcuuacucuguugacuagacacugucucguguuaauuauauacauaauauugagcaaaguaucauagucuccacccucauagagcuuauagcccaggauuuugugaauaucuuuacauuuacaaacauccuucuugaugaugauuuguuacuguguauaauaaaaguuggugauuugaguuguuucccaugugcuagauugcauucacagaguggauugaaccaccuaaacgagaaagaaaagccaacuaugccguugaugcauauuucagggaagcucuucguguuagugaaccuaaagcacccaaggugaguugacugacacagcauaaaaauaucuaaaaauuuugaaaauguaauuuuuuucauauauucuugcaaaaagauugauaauuagauuuuguguuucuuuuuuuuuuuuuuuuuugagacagagucucacucuguuaccaggaguucaguggugcgaucucagcucacugcaaccuccgccucccggguucaagcaauucuccugccucacccuuccgaguagcugggacuacaggcacccaccaccaccccuggcuaauuuuuguaauuuuaguagugaugggguuucaccauguuggccaggauggucuugaucucuugaccucaugauccgcccaccuuggucucccaaaguauugggauuacaggcgugagccacugccucuuuccuacauuuugcauuucuuuagaguguacucucuucuguuuuuaguuaacauuuuucaaaaauuaauuuugaaucugugcauuuaaaauuaagauauaaauucaguuuuauugaaagaugcauucaguugcuugcagaauuggcuguugugguuuaugaagugaggacuaaggauacauuuaaaaugaaauuucuuuuuuauggauaacacuuauuuuuguuuuucuuuaggcuccucgaccuccaaaacaacccaauguucaggauuuccaguucuuuccuccacguuuauuugaauuacuggaaaaagaaauucuguuuuacagaaaaacuauuggguacaagguaauugaaauuaucugccuuucuguucauuccuauccagaaauuauggaagguauaaacauuaguuauaaauauuuaucuaauuuggaccuagugugaaacaauacugcuuuagccuagucuaguuguauguaugaaauacauaaacuugggucuguuuuucuuuaacaagaaaaaauaagacuucaugaccaaucugguuuguuuuuaacauaauacaugcaauguaucaguauauuuucuuuccugguugaauugaaacuugugaaaugucaguuaguugguucaucacaugcucuuuaaaauuuacugauuugauggcauagaaaaauaucuuuuagguaccucgaaauccugagcugccuaaugcagcacaggcacaaaaagaagaacagcuuaaaauugaugaagcugaaucccuuaaugaugaagaguuagaggaaaaagagaagcuucuaacacagguauagccuuuaaucaguacaaacuuuaguaacaguuuguuguaaaggacuguguuagguuauguuggggcauaaaaauaaauacaaguuucugcuuuuaaagauggaauaauuggagacaauaaaguaugggcauguggauaaaugcuccaucugauugucacuaguugagguaguugagaagacuacagauuuuauuacucuggcucgguagaguggguaucuuuuuuaucaccuuacuuugaauguucccgucuuuccuaugaauuuuccacauugcuacccagucaccauuuucaacuauaaaucuuggcuugguuauuuuuuaaacauccuuugguguucaucaaggucuuucagaaucuggccuuugacuuaccuuuaaagcuucauuuuccuuccauuuuucuacuugcucauauuuuugcccuuuauguuauucacucuuucuggccaacugcuaguaauccuucaaagcucagugaaacugucaccuuuucauacaguauuccuuacucucagccacucauauuuaauugcuuggguauuugagcaauauauaauguguugucaaaaguguauauuuauguacacgaaaaguuaccacucuaaaagaacuuaauaaacuagugaaaauuuguuuuuguaauauuuagaagguuugcuaauagcauguuuuccaaguuuaaugugcugugauuaaauauuuuguuucuguuccugugaagggauuuaccaauuggaauaagagagauuuuaaccaguuuaucaaagcuaaugagaaguggggucgugaugauauugaaaauauagcaagagaaguagaaggcaaaacuccagaagaagucauugaauauucagguaauucuuuuaagcaggcuguuggaguuuaguaagagcuguuggaagguucuuguuuucuuauucugaauuauguugugauuagcuaauuuugucacaguguaguuaguaccuucuucauuauuuuuuacaaauuagaaaauguucuguuuccagaaauggcguaaugguuuccuuuuuaaaaauuuuuuaacccuagcuaacucuagcgacagcaaagaaaaucagaauaagucacuggauaauugcccuugcauuuuuaucuuaauuucucugcauaacuucaaguauuauguguuguguuuccugaagucaguuguauuauuagguuaacaugugaggguaugcuguggugagucugcuuagaauagcagaaauuuaagaauuagaagauaaauaauccaguugaucccauuuuuuuuacauuaaagaaauaaaaauauaaaugauuuguuuacuuuguccaacuuuuacagcuguguuuugggaaaggugcaacgagcuccaggacauagagaagauuauggcucagauugaaaggggagaggcgagaauucaaagaagaauaagcaucaagaaagcacuugacacaaagguaauuugcuuguuaauaaguuagguaguuaauaaaauaacuccuagcugugaguaugagagagugacuuuuuauaaaggaaaagaaguaaggguuuacaauuuaaaauuucuucagaguagcauucaaacaugguauugucagcagaauuuaccuauacacuagacugauagaucugagucaaagacacuaagauuagcuuuuuacuaaguagaaucaggaagucuuagucuguauuucucuuuauaauaauaaagacuauaaaggucuuucgggacaaagauuauauaaagcaauugaagugcucuagauagaaaauucugauuugaaaugcaacauuuuagcuaauuauacuaaagcugaguuugaaauacagauuauauaggauuuguauuuuauauaauauaaaaucugacuuucauagauuggacgguacaaagcaccuuuucaucagcugagaauaucauaugguacuaacaaaggaaaaaacuauacugaagaagaagaucguuuucugauuuguaugcuucacaaacuuggauuugacaaagaaaauguuuaugaugaauugcgacaguguauucgcaacucuccucaguucagauuugacugguuucuuaaguccagaacugcaauggugagugcucagggcuuuuuuguguaauguagcagaguucagaguaagugucaucuuugguauucuuuaaggugacuuuaaaaaaaucuaugaaguagacuuuuguuacaauauuguuaguaucauaaaaccuaauaccagggauagcuuacaaguuuauugguccuauccuuuaguaucuuacgucuuuaaauaucacuauaugauaagacuagcuuuucaaguucuaagugggaggaaguaucaguuucaacuucugaguguuacgacuuuuugguuuuucaaaugaacauauuucuauaaagaaaaaugguccuugcauucaagcaucugcacaucagaaucagcauucugauuuauuuaauauaaaucauccagagucuggauuauuuuaagauggcuuauuauagugaaacacuacuuuugcacugauuuagugcuagguuuuguuuuuauucccaauaucugacuaacaguuucugaccaaauagccccauuucuaauaaccuaaaauuugaauucagaaaaguuuaacuuugauggauugcuccuuuucuuccuuauuucaccaccauugaacuuugagcuucaacuuguuuucugccagaugaggauaaugcuaauaaguucuuuagucuuaaguuugggauauucugggauaagcaaaguuuaaacaucuuuguguuuguuuauaguaagauuucucuguauauuuaaaguaaaaugucacuuuguaagacaguggauaguaagcaguauuuucauguuugaccacugaaaauuuuuuuucacuagacaucacuguuugugauacccaaguuugggaaauguacuaaacuuaaauacaugaagauacuuugaagauaaaacacuguauaaauauauaauuagagaaaagauccaguugcugaaagcuuauuucuucuuaagugggaacaauuuauagaguuaauaaagaauaauuuuauagugauuguaacaagacagugccauguuaauuuaacuaguacaguaccguaauuuaaaacuguguuacuucuuaacauguuccauguuaagaugcacaaaaaaugauaauguauucuucuaucucuauauacuauuucuaagucuugugugguguauucuauacaguaguauuuuaaaauuauuuuacuguaguuguguguguaguaguaucacuuacuauaagaaaaaaauaauuuugcucuauaagaaagggggcugcuacccagcagccguccgugcagauggacuucuguuucuuucaggguuaacugcuacuucuauguuauacuuuaaaucuuuucuggaggcuguauguccaguuugccagagagagaugagguagaacucaucguagacuuccauggcugguuuuccaaaauugggaaaggugccaugugauugauugacuaccauaauucuagugauacuuugaagggaaagauuauacacaccuguuaaaguucuuguuguuuuugacccucacauaugugcacuauuaaucuuuuuaaguuuuggauauaaguagcacaguaguucucagacauacacacuaaguagcaguauugcauauguucauuuuuauugcuuuaauuccuaagugaaggaagaauuuuugaagaauacacaguaguuuggcuuuaaagauuggaguaaaaacauuauuuacaaauaucuugccuuuaaucuucauagcaugaauuguauaugaaaaucaguuguuuuuuuuuuaaaucagggguguauuagugguuuuauauauuauccuauuaaaacauaccuuguuuuaaaauugaaaucaugaaacuuguggauggaaagugcguguaccauguuuguuuauaauuuaggagcuccagaggagauguaauaccuuaauuacuuugauugaaagagaaaacauggaacuagaagaaaaggagaaggcagagaaaaagaaacgaggaccaaagccuucaguaaguauucaugaauauguaaauauguggauuauguaaauuuccccuuucuaaguauuuaacacugcuuggcugucauugauguguuagucccuguugugcaccccuccauugccuuuacuuuuuuuuuuuuuuuuuuuuccuuaagggagaacccaagcucauaauuugagauucuuccacuuucaaauuuagguagugguauaauuuuuaauuuuuaguuguuaugaguaaguauguauuuauagguuacaugagauacuuugauacaggcaugcaauaaguaauaaggacaucaggguaaaugggguauuuaucaccuccagcauuuaucccuguuacaaacaguuuaacucuuaguuauuuuaaaauguauaauuaaauuauuuauugcgguagucacuguguugggcuaucaaauacugggucuuagucucucuuuguauuuauuuguauccauuagccagccccacuuucccccacccccacugccuuucucagccucugguauccauccuucucucugucuccaugaguuuaauuguaguuuuuagcucccacaaauaagugagaacaugccaaguuugucuuucugugucuggcuuauuucacuuaauaaacuccaguuccauccauguugcugcaaauuacagggucucauugcuuaugguugaauaguauucuauuguguauacauaccauguuuucuuuauccauuuaucuguugauggacacuuagguugcuuccaaaucauggcuacugugaauagugcugcaguaaacaugggagugcacauaucucuuugauauacugacuuucuuuuggguguaaaccuaggaguaggguaacucuuaucuguaguuuuuugaggaaccuucaaacugcuuccacagugauuguacuaauuugcguucccaccaaaaguguaugaggguuuccuuuucuccacauucuugucaggauuuguuauugccugacuuuuggauaaaagccauuuuaucugggaugagauguuaucucauuguaguuuugauugcauuucucugaugaucagugauacugaacagcuuuuaauaugcuuguuugccauuuguaugucuuccuuugagaaucaucuguucagaucuuuugccuauuuuuaaaucggacuguuaggauuuuuuucaguagaguuguuugagcucuuacauauucugguuauuuauuaauccuuugacaaauggguaguuugcaaauauuuucuuccauucugugggaugucucuucacuuugcuguuuccucugcugugcagaagcuuuuuaacuuaaugugaucccauuuguccauuuuugcuuugguugccugugggguauuauucaagaaaucuuugcccaguccaguguucuggagaguuuucccaauguuuucuuguaguuucacaguuugaggacuuaaagucuuuaauacauuuugauuugauuuuuuuauauaguuagggauacaggucaaguuucauucuucuguguauggauauccaauuuucccauuaccauuuauugaagagacuguccuuucuccaguguauguucuugguagcuuugucaaaaaugaguuccauguagauguauggacuuuacggacuuaucucuggguucucuguucuuuuccacuguugcacugaucuauguaucuguuucuauaccagcaccaugcuguuuugguuacuauagcucgguacuauaaguuaagucagguaaugugauucuuccaguuuuauucuuuuugcuuaggguggcuuuggcuauuucuggguguucuguggguccauauaaauuuuaguauuuuuuuuucuauuucagugaagaaugucauggguauuuugauaaggauugcauugaaucuguggauugcuuuggguaguauggacauuuuaacaauauugaauuugcuaauccaugaacauggaauaucuauuuuuuugugucuucaguuucuuacaucaguguuuuauaguuuaucuuagagaucuuucgcuucuuugauuaauuccuggguauuuuauuucacguguaauuacuguaaaugggauuacuuuuuauuuuucacauucuucacuguuggcauagaaaugcuacuguuuguuguauguugauuuuguauccugcagugucacugaauuuguuuaugaguucuaauaguuuuuugauggagucuuuagguuuuuccaaauguaagauuaugucauuuacaaauagggcaauuugacuucuuuguuuccgauuuagauguccuuucuuucuuucucucgucugauugcuguagcuaggacuuccuugaaauacuuaaaaaguacaaauuuagcuugacuggguugugugggaaaaaucacuucuugaugauaugguaguccuuaauauggggcuucgugaaaaucaggaaaguaugucucguaaaugucaaguguguacacaucucauugagaauacaaguuauaauuuuagaauaauuuaagaaacauuggaaaagcagugguauuaugacuuuuacuguuagucucuaagcuuugauuauuucagugauguuuuagcaaugugaaggcaaacacuuaaagggaaaaaauguuauuuaauaauaguuaauuuaauaaaaaaugguuaauuuauaaagucaugaauaaaugaguaucucuggauaauauuugguacuuauguaacugccuuuuaaaaacucaaguguuucuuacuauuuugggaagcuugcauuuauuugauauugaucuacuacuguuaauugugcauuaguuuuauaacgucauuauuaacauuaacauuuuuuauucuguaaguaaaauaaguagguaagauuauuuggaggcuuuauaguuugcuuugaaagauuuauauagccugggggaaaagucucauaccuauuacuuuguaguaguuguuauuacuaaaguguuauaaugugucugcaacuauauuucauguuuauauuagucuugugaaaaguaauccuucugucuguuuguagacacagaaacguaaaauggauggcgcaccugauggucgaggaagaaaaaagaagcugaaacuaugaauauguuuuuguuucauaaucacuaacuuuaaaccaguaguucuuuaauuuacgggucuucauaagauguacuguacaaugcucaauuguuaugucauuuaaagacaucagguucaucuguuuacugagcuagaaacauaguauguaguuucacuuuuuuaaaugcaacagcugugcugaaauuuuuuuaucauuaacacuugaaguaauaaaauaggcuucauuuauuacuaaguguuucauuugauuuauuuuucuauuguaguuccauuugugaagauugugacuuuuuguuuauuagcuauaauuucuacacuuguaaggcuuaaaaacaaguuaaaaagaaaauugcaaauaacauuugucccuuucagucuucaccuaguuguguaauuauuuuaauucacuuugccuuugcagaaauuuggguauuuucuuuguagugcuauugagucucaucuggaaagauuauauaaauugcauucuccuugcuuauguggguagaaugggaaaagaaggcaagacaaaguauacuuaaauucuaugcauauuucuguuaugcuuucuguuuuuuuuaguugauucugaaaugaauaugcccuauucuuuugaaagaauggccuuuuaguuguauagccaaagacauuuaguauuuuccgguuccuuaagguauuacuguaccauuuuguaaaaggaauauuauuauuauuauuuuuaauuauuugguaaauauuuugucauaugaccuucugaagcagccacaacuuagauaaugucagaacuaaggugauuuuuuuuuuuuaauuuugaaagcccagccaaaaugaggugugaauuugucauacuguuacauugaaauugguaacaaaauauauccccucccauuuggacuuuuaggguaaaugaaaauuuuauuguauuuuaaaguaguuucuaaguguuagcaagacugacuauaauuccaguuucuguuuucuauggacagaccugauaaacuggagacccuaaagcaggaauacccaaauuauagugucaggauuuuagcuguaccagaggccuuuaugugcuacacauaauuuguauaaaauuuuauaugugcagauuggguacauaaacaguucuccauuuuucuaagggaaugcaauaaauguagcaucgugaauaaauauaacuuuuauaauccguaaag

SEQ ID NO: 15667 - RNA, 36717 nt, Homo sapiens
guaggaagguaggguuuggcauuuuaacauuuuaucuaaaacuacgaaaauagaaacaacagugccaaacauaugacugaaacaaacaaacaaaaaacccaaauguaaaacucuaaaaauaugugaucaauguuuaauauucugaggaauaaguaacaaaaucaagacagauuuuuuacuuagcuggguuaauuuccucugaauucuucuaagaguuaaaaaugaacuaucacauugauugauuuagaaccaucagauuuuacuucuggaaaaucuauuaccuuucaaaaaguuauaauuuuaauguuagcacgaaaauuacuuccuaacauuucauuaaaauuuugcagccaaagauuccuauuuuugaauuacaguacugcaaggcacauacagaacucaccuccuucaaaaccacagaagauauacucccugaaauagaauuuuaaaauccuugaacaauuagaaauacuauaaaguuagcauuuuuuagguaaaaauguugcuccuacaggaucaugcaacuuucuuaaaaucaauucagcacauauguauaaagaauccuuuuuaaaaacauuuguacuugaaauacagacacagugaugcugaagacacuaaacaaaaacugaaaaguacuauaucuugauaaauuuuguuauugccuucuuuagagacuuuauaaucucuaguugauuuucaaggacuugaauuuaauaaugggguaauuacacaagacguaaaggauuuuuuaaaaacaaguauuuuuuuuuaccucuagcaucaauucuuuuauaaagaaugcuaaauaaauuacauuuuuuguucaguaaaacugaagauagaccauuuaaaugcuucuaccaaauuuaacgcagcuuaauuagggaccagguacauauuuucuucugaacauuuuuggucaagcaugucuaaccauaaaagcaaauggaauuuuaagagguagauuuuuuuuuccaugaugcauuuuguuaauaaaugugucaagaaaauaaaaacaagcacugaguguguucucuugaaguauaagggucuaaugaaaaauaaaagauagauauuuguuauagucugacauuuuaacagucauaguauuagacguuucgugaccagugcauuuuggacucucucaggaucaaaauacgagucugccaacuguauuaaauccuccuccacccccuccaccaguugguccacagcuuccuggugggucguugucaucaaauccauugggccgaaaugaacaugaagcagaugcagcuuggagggcccgggcucgagcauucaacucuuguuccuaaaauuaaaaauaacuuuuaugaaauuaaaaugcuaaauacaauggaucguuauaucaccuauagaaauauuuuaaaacuaccuuaauccuuauaaacauucuucaaaucucaauaacuuugaaacuaaagcaccuaagaaaaaaaaauuucucuaagaaaauauuacaguuccugcaacacucucuaaaacauacuggaauagauucuuuucuaauauauuuaacauagaauucaaagauuaucacaauagauuaucuauucuccagcaauuggggcuauuuuggaagugggugauuacaguuaaauguaugaauaaaggaagaagacugaauuuuuuucuggccuuuccauagacuauuucucaauaaauaauaaaacaggucucaaagaacacugacaaguaaaaugaagccuaacuccucacaguaauaucuaaaauguuuccuuaucaggaaaacuuuuaucagaaaucagucauauuuaucuagaugccaagcauauguuagguauucaauaaauauuaaugaucucagauuagaauacuauuaggugcuuagcuucaaagggagcaaauaugaauaaauaauggcaaauucauuuggcaagguauacaacuggauucuaaaacugggacccacaaacucuuuggaaaaauaugcaaaauauucuggcaugugcuuauuuuucugggagaggaucuacagauuucaaaugggguugguaaaaauaaggucuaaaaguuacuggucacagcauaccugaacuuguuagcauaaucguccugaagagcuuucaaaauacaguuaacauuaauaacgaaaacacuauuauuucgauuuuucaacuuaaggccuagugauuuuguuccaucuggcaagguaauacuauuuuauaauuucuagcuaaaaugguuuaguuuauuauucuucccucuucacaaaaugcucaauuuuucguuaugaagaaaagacccaggcauacccugacaccuaucugucauauuauagauacuuuauuuuucaguagcaugcagcaucuucuguucaagucccaguacacaagaugaucaagaaucaccuauuuuuauggcugaaagggaccuuugauaaauccuuguaacaaaauggcuuaacuaaccagucuguuaggacuuuuaaaacuuaauuugcaggauauuucuuaaaaacauuuuugugaucuacagugucauuuacaacauuuaaaauugcuggcucuuugguauaauaucuaccuacagaguauuuuuaaggugauauauauauuaauuuauccuuugaucuauaaaauuaacguaggaauuauaaauguuuuacagauugaaauuaagugccauaaguaacaucagaaacagacagaaaccccccaaccaaagauccucauuguucuagcucuauaaccuauuaaacuauccaaacaagcgaugaaacuaugacucuguaucugagaaacaaugcacgguuucagauauauagacaauguucuguaacgaauuaaaacugaacaaacauguaagguagaguucaagaaguucuccuugaacuucugcuacuaaaagauauggcaaaucuugcauagacguuuuuauacagugauucccuuauagaaacuaugucgaaugacauaaaauauaaaauuaguagcuccauugcaucuguacccaugaaaccuacauuauauuucaagauauacaacaucccaaaaaaguaauauacuuuuucugcuuuauuauuuauagaaauauauggcugacagaaaaaaaugugugguauucuguuuucugauaagcuuagacaaugcauaaaaauaggaaaaacugucuuuuauuuuacuuaauacagguaagaacauuguguacaaugucaaaauuaugauuaucauagaauguguaauuuauaucacaaauuuauaucaaguacuaaaguuaauucuaauuucaguaguagacuauagaucuagucacaggaaaguuauugcuccuugagacaaauaauuuucaguauauuuauauuucucauucaaguaaaacuguugacauuaauccuuuuauuuuucuuuaaacugcacauauauauugaauauacucuucugaauguaugaaaaagaaaauaauuaagaaguuaagaagaacuacugccuccuccaaagaaacaaaggaaagaaaccaagcaagaaaagaugggaaguggucuguggcugaugcacgacagauggguggguaaucuggaccauacaaugaugaugcauuacacaaucucucacuguauccuaaccaaaggcuuaguuuuuauauuccagacauuaaaacaauggagauacuccuaauggaagcuggacugaagggaaagaaauauaugaaggggaaauaaauauaugaagagaaaaguccuuucaaaaauuuacuucgagauccacaauuugcauuguuuucccaaaugucaggcuaugauacacagaguagagaaugguuugucacaaaagauuuuuugccuggguuuuucaaaaccacggaucuugccaauacucaaaagagcaacauuuucuaacacuuguaaaucugguuguggcuagauuuaaaauugaaaaaugaaauccuaaaauguaaaaaugaaauccuaaaaaaagcuucuuaaaauuaucacaaggugaguuucuaaucugauuaugaaguauuaaaaugaaagcagcuacccugauauguacuaaaaugguaaauucauuagcaauauuguucaagagcagaggaacucaaaauguucacuucacauccuuacuuuuacgauuuaaguuuuuauagcuguuuuauaaaaagguauuaugcuauuucuuauaguccagacauaguaaucuauuauaaagcaugacauauauuuauaauaauuauaucucaaaaauggauauaaaaacaaaaaugauagaaugaaaacacacauguacaugcuccagguguuuaagaagugauagcugaaaacugcuguauacauaaucucaacgcuauaguuuucuauugccuggcaauuaugagcacaugugcauccacauaacagaauaaagaacguagucuuuuaacauguacuuaaaauaccagaaugaucugauuaaaugguaugaaaaauuucacaauuugagccuuuauuaaucacuguauuuaaaaguaaacaggcugggcacaguggcucaugccuguaauccuagcacuuugggaggccaaggugggcagaucacuugaggccaggaauuugagaccagccuggccaacauggugaaacucugucucuacuaaaaauacaaaaaaauuuaccaggcacguuggcguaugccuguaaucccagcuacuugguuauccgagaccugagauuugcuugaacccaggaguggagguuacagugagccgagaucacaccacugcacuccagccugggugacagagcgagacucugugucaauaaauaaauaaauaaauguaaauaaucacaaucuaaauauaaguuccuaauugaguugauuauugggccacaugcaguggcccagcacuuugggaggccgaggagggaggauugcuugagcccaggaguuugagacuagccuggguaaaauagcaagacaaucuuuaaaaaauuuuuuuuaaaaaauuagccaggcauggugacacaugccuguaguccuuagcuacucaggaggcugaggcaggaggaucacuuaagcccaggaguucaaagcuacaauaaaccaugaucacggcacugcacuucagccugggugacagaaugagacagucucaaaaaaaaaaaaaauugaauauuuauuauuguauuuuugcuuuaaaaggguacucugauaaugaaacuuugauuuacuaccuagucuuaauacagguaaauaccuuaauauaaaauuuggugguaucuuuucuugcaucaaacaacuugucaauaugaaacuuaagauugaaucuagaacaacugcacaaaacugaaaaacugaauuaacaaaauacauaaugcuuuuucuuuauaauaaaguaacauacgagucuuaaaauaauaaugaaaagaacagcuccucaugcucaaauauuguauaaucagaaaguaaugggguaaaaggcaagauaaacuggaaaaucacuuggagcuaagcuacaaacaagugguugcuauggcuauacaagcauuugggauucuaaucacagaaaugagaguaguuuuuuaucuuucaaaacccauauuucuccucugacuaguguuuauaugauaucuaguaagaaggacacaguugaauacauucuauuucuagcauguugaucauaagccaucugacuagauguuagagucuucaguaguuaaucaguucaaacaaauauucugauuuucuauuuuuuucuguaaaguuuauuguuuuugucacucaagaacaucgcuauacuucuuuaaaaauguguauuuuauaacgcaguaaauuugaaagcuuuugagaaaauuucccucuaaaaaucaguacuauaguggcucauuucuuauucuaucuguaucuuucaggagugacuuucaaacacagaauuuucaaaauguacucauucaaacucaaaaucacuuagacuacccaauuaauguaccuagaauuucaccuguaauuuacugcuagcccuguauguugagaacaaauuagcaaguuucaaaaacaaaaaaaaaauacuuucagcaagaauuuuaacuuuuuauuagccuuuauuuaaguaauaaaaucacuaacuccuugaaaaaaguauauuuaugaauaaauuuaucucauauaaaaccauuccuuggcuucgauuuacaauuguucuauuaucuccuugguuuuacuaaccacauccucaaagaauaugaauauccuuucuuuacauagucuacauuuuaguguuuuuuaaucuuauccaccuaaauaucaauaaacagcccuuaaaacauuuacacaaaagucuugagggcauaaauaccacauuuagcaguuauuuccucuggugggugaggcugagaggaagagggaggauauguccacuuuuguaaacuuucuguauuuuguauggcaugauuucagaaugagccaucuuuuguaaggaacaaauaaagucuucugcauuacaucuaauugccacuuuucauuuaaauugucacaauauuagaaaggcaauuuaguuauacagguugagaauacuucauguaaauccagaccuauauuucagaauuuaauaaaaacucauguuagauuucaaaaugaggguacucauuuaacugugucaauuguuuaauauuuucaacaaauaaagcuuguauuuccaacuuaccuguaaauauaguuuauugucuuuuguuauagcauccauaaguucuuucuguagaggugggucuccauuuauccagaguccacugguuggguuauuaccacuuaaaccauuaguacuaugcuguuuuuuauacaaaagcacauaagcuguguccuuuggaaaccugcucguaauuuucuggacugacugaaaugaaguaaaugucacucuacugucauuaaauaaaaaccauucuuuugacauuuccuuauuuuccaaauccuguucaaaaacugcacugggacuaucucucccuaguaaaugacucugggaggaugcuaaugccagagccucagacuggugguacaucugauaugaagagucuguacuugugauauuccuggcauaagaauaguaaugcccacuuucagaggauauaccagagugaaccacaacggaacuuaauagauagggcaccaauuuugugcaggaagcuucaucagucccugaaggcuuuaauuuuuuagcaagguucucacuaagaucagugaagucaacaucuacagaccaacuuucugacaaugaagagaaagaaguaauucuuuuaacuggcaacuccaaaaccaguggcagugauacauugucuaaaauuuuccuucucacaugauacuucugaucauaugaaaaucucaggagaguaagaauaagguauucagguuccuccgugauuugcauaguuuucucagcauuuugcagagaggcacaguuuucacaauaauauugguuaucaccaguaagaaucucuggagccaaaaaauaauuuaguaagucaguuacugaaggugugguuucaccuccugguuucugagguacaucuuuauuaacaagaaucuuguuagauucguuagggacagaaguguuuucagaacaguaaaacucauuaggaggacugccuaugguuuuuucauucacaagugagucacagaugaaggcagcuguuguuggauuauaaacuacugguucuucugaaggaccggguacagaggcuugcauuagaccaccaucuuguauacugggugaugaugcuggaucuuggacagacauguuuuccaaagaagaggaaggacaaaaggcaagcgaaagaucuguaaaggcuuccacuuuuugugagguacuccugcaguucaaacaacguaugugaguucguaguuuuccuccaaacauuuuuucuauuaaagucuucucaccgucacuuguacgaggggucucuguuaguacugcugcuuuacuagcuacuuccuguaaagaaguuucacugcauuccagaauuucagaaggcuugugugaggccugaacuuucaagaucuuuucuucuucauggagccugcagcagaggauaucauuauauagcuacuuaaauuaacuucaaaugucauuucuauuuaaaaauauuaguggcuucuauaaacuauucuaaucaaauuuaauguaaacaaaucagguuuuuccuguuuuaauuaaaagaaaauugaacaguuuugagaaugcagaaaaaaagcuggguggcuauuacuacucuauauucucauuacacuuucuucauacugcuacuuaauagcauguauuacauugcaguuaauuauaaacgucccuuaacugucuuauauaucucugucuuccugacaucucauagaaagucaggcacaaauaaacuacugaauagauucuuagcugaauggaaggaaggcugcacauaccaagcccaacuaacuuuacuagucauuccacagagcagaacaaagacagggagauacagaugauaacagguuuuauuaauuaaguggucaggcgacaauaaaacauaccaaacccauacaauuaugaacuggucuaaaggagugguucuuaaauuuuuuggugccaggaccccuuuauacucuuaaaaauaauuaaaaaacaaagagcuuuccuuuacauggguuguauuuauugauauuuacugucagaacugagaaaauaaaauauuaacauuuagcaaacaauaauaaacccauuauuuaauauuaguaacauuuuaaaaaugaaaaaguuguauuuucuaaaaccaaaaaaaaguaagaauggcaguguuuuacauuuugcaaauauuuuaaguaucuggcuuaacagaagacagcuggagccucauaucuucucugcauucuauuguuauauguuuuuuggaugaagcauauaaagaaaaucuggccucacacaguuacgcuguuggaaaagagaagaccucacagacuccugaaaguguuuugggaacccgcagggguccuuguuucacacuuugagaacagcuggucucaaggaagaaaauucaaaaaggaaaauaaauuaaaaacaaaagaaaauauaaaaaacauacaagaaaugcaauaguauuuuaaagaguaauauuugaaauauguuuuuaaagguaaaagcaauauuaaguagaauuaaacuguuaugaaagacaacacucaaaucacaauuuuaagaauacuuuuuaccugucaaggagaaaucugagguauucagaacagucuugcugugaucugggaguaaaccauggaggucuggaagccucaaagaauauccgaggugcguaugcuucccucuuuugagagcaauugagaaaauauaaggaagugauucuuauagcaugaaccaaguaacugaaaucuuaauauacaguguuuaauaaagguuauuuacaguuaacauugcaucagccaaaagugccggacguggcaacuuagggacagauaaaauuauuuagaaauaaaguuagguaaucuuuagucauaacuucucacucugcagaggagaauugagagcuagagaaacaggugacuugcccagggucauacagcuaaaugaguagcacaaggcauuaaaguagaacccaugucuaacucuugauauaaagcuccugguaucaucccucuaugacagucauguuugaguccacaauuuuuugaaaaaucaaaucuaaaaaagauuaauguauauuuuguuaguauauauuuugaacaaaguaauaaaggaaauacucuagagucaugcauaccuacuuuaggcaaaaauuuccuugagcagauacaugucauauaugugcagauugugaguacacugguuagaaaccuuugcuaauuuuuguuuuaaaguauagaggcugcuuagugauuaaacuuuggacucuggagugaaccagguucaaauccuagauuuugccaugacaaaaaagaacugaaaaggcaucucgaagaugugauuguaaguugaaacuuuggaauucucuugacauuuugauuauuuguggcauaacuucauaacaaugaaguucucaguuaagaaaaauuuuacccaaauuaaggguguuuauagcauucugaaggaaggaaguuuagccuacauuaaacaugggcuucagagcuguuugguucauaucucaacccugcugcuugcuugcaugacccugaacagguaauguaagccuguuuucuucaucuguaaaauggggauauaccuuauuaccugacagacuguuuuugaugauuaagacauaaaagauuuagaccagggguuaaaaaaaaguaacuguucaauaaguguuguuuuauuaauuauaagaaaaaaggacuuuucaauuauaugggaaaaucuaucugccuaaaauaaucucugucaggcugcuaccagagacagucucaacugugacagaaauuuaaucaggcucuuuuaaauuucuacuuuucuugggaggaggagggaaaccuccccuaagauuuuuuuuccuaauagcucugauuuaguaaguuaauaaaguauauaucugccuacauauauauuuuauauauaauaaauacauacuagugauaaagcacaaaaaucaauuuacuaggaaacaacagggagugaggaaggagauaguuuucauuucguuucccuuggucuugauaugguaaauuuaauuugugaacauacuuuccccagauaaagaauaauaaaaauaucugaguauauaacuacucauaggccauuacuaucaucucauauuaauccugucuagauucuuuccauuuaagaaguuauauuugagauauuucucagcuuguagaaagaaaacaaaagcauucccaucaacugaaccccaucaauucucaaccuauuguuucuucugguccuaacuacugcuccuuuagaccucugugagauaaaggcaaugaaaguaaaaccagaaaaauaauaauauauauuauaaauaaugacauauauauuacucauguguauaggcucaaaaucuaaacuaaaaguucuuugaacauaaagacucuuuuuuuuuuuugagacaggggcucacucuguuagcuaggcuggagugcaguggcacgaucucggcucaccgcaagcuccaccuccuggguucaagcaauucuccuaucucagccuccugaguagcugggauuacaggcgugugccaccaugccuggcuaauuuuuguauuuuuaguagagaugggguuucacaauguuggccaggcuggucucaaacuccugaccucaaguaaucugccugccuuggccuccaaguguuaggauuacaggcgugagccacugcgccuggccaagacucuucuuuuaaugcuuaucacugacugcauauagcgucucuuaauaaaugucuguugagugaauauuuacuauauaugaccaccuuggugccauuaacauaaauuaaugaccccggauuaauguguggacauaaaagaucaccacgaaauuuuaagcucuagaacuuaacagauaaacagaacugcagagaucuuuaguuauaaugaauagguauacauaagaaaagagaaaaaagcccaggcaccacaauauuauuuuauuugcucauuauuguacaaaucuacuaauuuaauaucaggaaacaaagaugcacuuaaaaauaauucuucaugaaggaacuuauuuauuggauaggaaaucauauuuucuuuguaaaaauuucuagaucaaugggucagcguaauauucagcuacaauaaugggaagcaagagaaaaauauaaaaacuuagggcauauccugaaaauaaaaaaaaucuagauauuuuaggcaggaucucuuuagcauuucuaaguggauuuguuauacugggugagauaucuauuauauuauuucaucaguuaaaaagguuagguauaagguaaaguuuaaugaauauuaccacgcaguuaacauaaacguacuauauacacauacacacucaccuguguaugggccagaaaggcaaaaagaugcuguaauuuuuucauuaaugaauugcacccauuuagauuuaaagauaauacuugucuccugaaacugaaagagaauauaaugauuuauauauaugugcguacaaacacaugcauuuauuaaaagcuuuuuuuuuuuuugagacagaguuuccuuuuguugcccaggcuggagggcaguggcacaaucucagcucaccgaaaccucaaaugauccacccaccucggccucccaaagugcuggaauuacaggcauaagccacugugccuggccauuuaaaagcauuucuuaaaagcuaaaagcaaguuaguucaagaauuuauuauccuuaaaguaaaacuucauuuaccuaaugguccuuuuccuaaggaaguuaucuaucuaacaguaaagaaggaagggaagaaugacaauaaauuaacauuuacuauaaagccuguuaauggacuaugugcuaucacauauuauuucuauuuucuggauuagcaaauacaaauagguuaagccauuaauuuauaagauaaguaaacuuaaauucuuucaaaucuucaugaaauaaaaaaauaugcugucauuaaaacacacuauaaaauuaaagucauuuaaagaauagagcgugggaaaaggauaaacuacucaaaaaaaaaaaaaaaguaaagggacagcuggguauccauccgguaaaaaaugaaguuacauaagauuauacaccaauacagauaccacaggacuaaugagcuagauauaaaauacaaaacuacugaaguacuuaaaauaaagaaacaagaaauuuagaggguaaaggcuuuuaaaaguccagaugcuacaaaugaaaaguggaagacuggaauacauaaaauuaaaaaauuauaaauaaaacaccccacaaauuugaauugugccuugaaaaaagcauguagcaaaggaugauuauccagaguauauauaaagcaacaugaaaacaaaaaagacccaacaaaaagauguacaaagaaaagaacagguuauuuggaagagaaacacaaaugaauaaagaaaaauaagagagggaaaaacucuauaauuagcagcaauaugcaaauuaagagacauuuuucuucauauuggcaaaaaauuaaaaaggcugauuuguugcuaaagguacagguucuagguacaaucuuauauugguaucagaguucaaaaugcuacagcuuuuuuggagagcaauuugaaagauauucaaaggauauucaaagauauggaaaauauucaaagaaaaauccucuguaucuguauaagggcagagagauguuaauuauaagcaaaacaaccuaauauucaucaauaggagcauuauuaaauaaagaaguauuuauuaaauacuaauuuaacuuauuuauuaaaucucauuaaauuaaaugaguauuuaauaaauaaaugauggcauacacauuuacugggaaugacacggaucuguauugccccaauaugggaauauuucgaauacaaauuauuaaaugauaaaagcaaguggcuggaaaagaauauauaaauaggauucucugcaaauuuucuuuaaaaaaugcauuuguuuucauauuaaauacaaacaugcaacuguaccaaaaaaggucuggaacaacguaacuguuaacaaauuaccuuuggaaaugggaaugucugcuuuuuauucuauauaaaauuuauuuuuaaacuaugaagaagaauucauauauuacuuaagaaauaaaauaugcugucuucccauucagagauaauauuauuggccacuguucaauaagagauaaccuuuuauuugcucuugccguuauaacugcuuugguuuuuuguuuucucugucaucuguaaaaggagaugucuggacuagaugaccucuggugguaagauggggauucuuucagucuuaugccuaguaucacuugugucuaaagauauagcugcucucuaaaaaaaaaaaaaauuccaaauacaaacaaaccaaaaaauuaaaugcuaaaugaaaccaaaaacaccugagugcugauauuauaaucuggagcccaacaauaaaauaaagcaaauucuucucucucucucuuucuuucuuuuuuagauggagucucacuguguugcccaggcuggagugcaguggcacaaucuuggcucacugcaaccuccgccuccuggguucaagugauucuccugccucagccuccugaauaguugggauuacaggcacacaucaccaugccuggcuaauuuuuguauuuuuaguagagacgggguuucaccauguuggucaggcuggucucaaauuccugaccucaugauccaccugccucacccucccaaagugcugggauuacaggcgcaagccacggcacccaaccaaauucgacauuucauaguuuaugauuccucugggcaggcauaacaacuuggaaaagcuuagaacuuaauuuguaaaccucuuugggcaaguuccaugaauagcuuauugguaaucaggagaaaaauucaaucauguuuuugucuucaggaaaaguuuaucguuauuuuguaccuuugcagauagcauucacauaacuaacaacuucugauuuccuauuugcuuaggugcaaaagaaaauggauuugaaagaaaauucuuaagaggggaaaggaacaugucuguuuauacauguguucaguaauuauugcccugggguggagcagaacuuaaacuucucaaacagcaacaaaguuguugaucugacaaauaccaaaauacugaccggcagauaaaauuauauauaacuucccucaaaacacguauagguuaaaaaaaauuacagucucacaggauaacaacaaugaaguacucuagcacacuuaaacucuuuggaauaguaauuucuuuaaaguggcauuuaaaugcaaugaauaauaagcagaauuaauguuaacuuuucuuuuuuugagacugacucucacucuguaacccaggcuggagugcaacagcacgaucuuggcucacugcaaccucugccuccuggguucaagugauucuccugccucagccucccgaguagcugggauuacaggugcccaccaccacgccuggcuaauuuugguauuuuuaguagugaugggauuuugccaugacggccaggcugcucucaaacuccugaccucaagcuauccacccgucuuggccucccaaagugcugggauuacaggcgugagccaccacacccagccuaauguuaacauuuucauaguuucugagcacuaaaagcaguuucauuucugaauaaggcaaucaaaguuaacauuuaugccauuuauaaggaauaauguguagacaauucuaucaucuuauauuucaucagcaugcaucaacuucuacaguuaaaaugaaaagauucaaguuuaaacuuacucuguggccauaaacaaggcuuguauaacacuguucauauaacauguauuuccuagguuaauaagaccaguuuucccaguuucagauuuuccagaaagucuagacaagcaagacgccaaagaauuggauugagaaguccaggcacuuugauugagaauuaacuuaaucuucucuucacugggcuuaggaaaauccuauaggucauaaagaagaaaaacaguuuaaaaguaaaguaaaaauuauuuuuguuguuaaauuaauuaacaccauuaagaagauucuuacaccgacauuugaacuuucuuuucccccacuuaguuuugaaguaacuggcaguacuuggcuagucaugaaaauaucaaauuucacuguauggcaaaaauaaauauugucuaauaacagauuuuaucaaguuaaggaauacucaaaagcuggaaauucaagucacauuugaacucuuuauguucucuauaugccagcaaaauguuuauaaaauaaaacuuuggggucagagaauacacugcagugcuauucaaaggcaguagaaugaagacuuaaauuuuagcacacaguuaaacauaaguaaacaauuuguuuucaaauuuuguaauaaaaaugucuccuuuucauuaaauacuaauauuuacucaguauuaacccuuagaaauaaaaucccaaaguaauuaagaaaugagaaaugaaagcaucuaugcacaaugaccuuuaagaaaaauaaaacuuaaucucauguuacccauauagaaaauuauuacaacauauggauuuuucuuaucaacuuugugaaguaugagauaacauuucaaguguaaauuauuucaagcaugaauagagcacuggagaguaagggaaguugguaaaaucauuagggcuuaucuggauugcuauuagcaucuggcacuuagaccuuaacaaacaaacauuuucugaaggaguuucaaucuucucauuuuuguuguuguugacagcuaagaaaaagugcuuucuuugggcuuagagcgagcccauuguuucuucugagccuauaugaguuaucagaauuuucaacaugaaaaacucugaugaacuaaacaauggcaaucaauuaacaagugcagcaacuaucaucuauggauccagggacaauguagaaagagauuaauauuaccaucaaauccacuucacaaugcuccugaacauaaucuacuucugaagugucaaagugucaccccagcaauauacauuaauugcuuaacagucuuuguguucugagcucaaccaaaauaaguuugauuuaguuaaugauacaguaaaaagaacuguuuuuaauccaccucagauacagaaguaaagauaauaagaccuuuauguugaaauucagaucucaaaaaaaccaucaauagaauugauuucuaauaauuucugauugaguuuggcugaguucaguucuccuauucuuuugcuauacacugauuaugcaguaaguuuacugagaggaaaguauguuuauugugauccagucuucaacacaaacagaagugcuuuuuaggcuaggcacaguggcucaugccuguaaucccagcacuuugggaggaugaggaucacuugagccuaggaauucaagaccagccugagcaacauagugaggccccgacucuacaaaaaauaaaaaguuagccuggcgugguggugugcaccuggagucccagcuacuugggaggcugaggcaggagggucacuugagcucaagauguagaggcugcagugagccgugaucaugccauugcacuucagccugggcaacagagcaagacuguccaaaaaaaaaaaaaagugcuuuuuagaaccauuuccauauaaaauugaaacacaguauaacuccacaaauaauucaaguaaagauucgaaacauugaugaacaguccacagcaaaaauagaauuaaaaaagaggccaggugcaguggcucacgccuguaaucccaggacuuuggaaggccaaggcaggcagauuacuugaggucaggaguuucagaccagccuggccaacaugguaaaacccugucucuacuaaaaauacaaauuagccgggcaugguggcaggugccuguagucccagcuauucaggaggcugaggcggaagaaucgcuugaauccaggaggugaagguugcagugagcagaaaugguaccacugcacuccagccuaggugacagagcgagacuuggucucaagaagaaaaaaaaaaaaaagauuaaaaaggggaagaaaucaaagucaaauauuuuauuaaacuccauuuccuguauucuaagauguacucuacauauacuuuaacacuucuaauauuggggugcaaaucugauguaugcauuaacuuaacguagcauuucuuuuuaaacaaauuucccaaaaagcuauuauaaauuuaaagauaugccuuauaauugaugacacugcagaaauaaagaaauaugguuauuaauuuagaauggugacuccagcaagaaagcuguuacucccuaaaugaaaccugauucuaacugcauuuuucaaauaaaaagcauauuaccauaaaauaguaaauugaguagcugguuauaagaauguuucaccuuauuaauauaacacaacuccacaaauauugguacaacuaucaucauaccuuuauugccuccagaauagguucauagagaucuggaaauccagaauaaugauacaucauacaguguaucaauucuguuaauuguacuaagaaggcuguacuugaaggcagaccaucauuuuugaaagaaugaaccaaauuaaccacaugaggaacaaucugaaaagaaaaaaggauaaacaaugcugaauuuauacaaauugguaacacauucucuagccuacaaacagaacacaaacgauauaugaucagcagauacuuuucuguaugugcagucacagaguuuuucuuguuauuaaguuaaacauuucuaaaauaucaagguaaaucuaguuuucgaagucgcauaugacuguaaucucauauaugaccccucuccucauccuuacacaccaucuaaaacauaaacuaagguauaaaauaggaaucuuagucauugccaccauucugaaaaaugcuguagguugaaauuguuaggguuauuauauuuaccaggucauucaaugggaauaaacuuuugaaaaauaauccuggaauuagcuaaagagcuccaucuagugugaaucuaaaauuuuuuacuugaaagaauuaaaaguacauugcacauuaaagucuacuucaagaaaaucuuuacaugaguaacuaaaauugcagcucagguaaugggauuacuuuuagauaagcacagagaccaugccuuauguuagaguggcuauucuuacuaacaaaucccauuucacagcaaaagaugagaugguucuaaaaauaaagggcaucagaaacuucuguuaguuuuaaagaccuggggcuaaaaauaaaagugaaaucuaaaaugaucauugcucauaaacauauagaauauuguuaauauugaucaucagcacaaccauguucuuucauuguaaaauuaaacuaaaaagucaucaauccagagccaaucauaucuuuaggagguuauuaaaaugaaacaacuucuauuuuacagacauagcucuuuccauuaguaugauacuauauuuuuuucaauuaauuuuuaauuauaaucugauacuacauauuuacacuucuuaugguaaaagguaucuucuguucuauuuguagaacauuuugggguugcuaacucaugguaaaaaaguuauaacuauuagggucguaccaucaaacagcaauaacagcaauuauaguaauaacccacuaauuccccguccuucccacaaaaagaacaaucauagucuuacaacacagugcuauuuccauucugcucugucuagcuuuacauuugugcuuaaaucacacuguagcuuuugcauuaccuucuuaccuccaucacagguacuaaugugaccauaaaacuaccaguuccuagugaguucauucuauugcuaucaucuuuacauuucuaagcaaauaugaauuauacuucugucgcauaaagccacauuuaucagauauucucuugcuaaaagucagaaauccaaaauuauuuuguuuucucaaaggugaagggagacagaagaggcaaaaauuuuagaaguaauuauuaaauuuauaauuccaaaucugucaaauuagauuaggucuuuguaaucagguuauaugguugucuauuacuauaucucaaauggucaacauuaucacgacauggaaauaagacuuagucuuucacaguuauacagauauacuuccaagcaggcuauuacuuucuaaaugugugaaaguugauuuuuuugaauaagugaaacuaaauguuucuugacauuauuauaauacuaaaguuuuugaggaaauguauaaaacuuauuuaauuagaagcuuugauuuuuuuucuuucuccauuauuccuaucugccauagugucuguuuaaaauaaauuuauuccacuggguaaaaugcauaagaaaagcaaccugacccauaacaccacauauucuaacaucaaccuuggcuugcccuaagauauucuaaacuuaugaugaauuaugaugaugcugauuccagauuauugcucauacuuagcaacuccuaagcccaaguccuuuacugaguuauuuggaguuauaggugauuuaacuaccacauuacccacuacuagauuaaggaauguccucaauaugggcaauaaacauuagaaugaaugauaaaguuaugucagagaaucuccuuccuagaaauuuggaaaacaucuugaguugauuuuuguauaugguguaaggaagggguccagcuucaaucuucuucauauggcuagccaguugucaaagcaccauuuauugaagagggagccuuuuccccauugcuuguuuugacagcuuugucaagaucagauggucauaggugugcagcuucgucugugggcugucuauucuguuccauuagucuaugugccuguuuuuguaccaguaccacgcuguuuuaauauacuacuguagcccuguaguauaauuugaagcuggguaaugugauggcuccagcuuuguucuuuuugcuuaggauugcuguggcuauucagguucuucuuugguuccacacaaauuuuaaaauaguguuuuuuuaguucugugaagaaugucauugguaguuugauugaaguagcacugcaucuguaaauugcuuugggcaguacggccauuuuaaugauauugauucuuccuauccauaagcaugggauguuuuuccauuuguuugugucuucuugauuucuuugagcacuguuuuguauuucucauuguagagaucuuucaccucccugguuagcuguauuccuagguauuuuauucuuuuuguggcaauugugaaugggaucgccuuccugauuuggcuccuagcuugacugcuguugguguauaggaaugcuagugauuuuuuuacauuaacuucuuauccugagacuuugcugaaguuguuuaucagcugaaggagcuuuugcgcugagacuaugggguuuucuagauacagaaacauauaaucuacaaauaguuucacuucuucucuuccuauauggaugucaccuauugccuucucuugccugacugcucuggcuaggacuuccaguacuauauugauuaggaguggugagagaggacauccuugucuugugcugguuuucaaggggaaugcuucuagcuuuugcccauugaguauaauguugguuguggguuugucacagaugccucuuauuauuuucagacauguuccucuaauaccuaguuuauugagaguauuuaacaugaagggauguugaauuuauugaaagcuuuuucugcauccauugauauaaccauguaguuuaugucuuuauuucuguuuaugugauuuauuuguguaugcuaaacuaaccuugcaucccacagaugaagccuacuugaucaugauggauuagcuuuuugaagugcugcuggauuugcuuugcaaguugaggauuuuuguaucgauguucauuacaucaaggauaagacuuaaauguaaaaccccaaacuuuaaaaacccuggaagacaaccuaggcaauaccauccuggacacaaagauuucaugacaaagacaccaaaagcaauugcuacaaaagcaaaaauugacaaacgggaucuaauuaaacuuaagagcuucugcacagcaaaagaaacuaucaacagaguaaacagacaaccuacggaaugggagaaaauacuuauaaacuaugcaucugacaaaggucuaauauccagccucuauaaggaacuuaaacaaauuuacaagagaaaacccuauuaaaaagcaggcaaaggacaugaacagacgcuuuucaaaagaagacauauaugcagccaacaagcuuaagaaaaaaagcucaguauuacugaucagcagagaaaugcaaaucaaaaccacaaugaacuaccaucucauaccagucagaauggcuaucauuaaaaagucaaaaaagaagacaugcuggugagguucaaaaaaaggggaacacuuauacacuuggugggaguauaaauucguucaaccauuguggaaagcaguauggugauucuucaaagagcuaacagcagcacuggcauuugacccagcaauccuauuaugggguauacaccaagaggaauauaaaucauucuaccauaaagauacaugcacaugaauguucacuguagcauuauucacaauagcaaagaaauggaaucaaucuaaaugcccaucagugacagauuggauaaagaaaaugugguacauauacaccauggaauacuaugcagccauaauaauaagaucaugucuucugcgggaacacggauggagggcgaggcuauuauuauccuuagcaaacuaacccagcaacagaaaaccaaauaccccauguuuucacuuauaagcgggagcuaaauggugagaacucaugaacacaaaaaaggggacaauagacacugaggucuacuugagcggggagagugggaggagguagaggagcagaaaagauaacuauuggguacuggguuuaauaacuggguaaugcaauaaucuguaaaccaaacccaugugacaugaguuuaccuauguaacaaacuuucauguuucccugaaucuaacaaguuaaaaaaaaaauguggaaaacaaagccuuuucucaaaugucuuacacaugauugugccugaagacaaggacaaguaauugauguuuuuuuucuuggaagacuuugcuaguacaccugcuaucuuagaguuugaguucuguuuguauuauacauauauauaagguuacugcuugaugauuaaauucaccaaaauuagggcaauuaacugcagaaaucacucauccuaagugguaauguguaauguaauuacuugcuaguaagguuuacuuacuacaaagccuguggacuuuccuucaguggaaaugagacacugagcaaccuaugugaauauauucuagauaaauaaaaacaaauggaauucugaacuucauuagucuccucuaaaguuuguuauggugaaucaguauuccuaagauuuuuccacuguggguuuauugacaaugaguuucuaguccuauaaaacaggauuagucuuuggaagaauuaaguaaccacacaaaggcacuguuuuccuaugaugcccuagagugguaaauggacagcugaccaaaauuacaauuugucauuucucaucugcaguaacugauaaucaaauaauugaaaucaaauaaacgccaaugauucagcuggcuuaacgugguaggauucuagauguauuuuaaagguggggucaacaggauuuguaggauguaggcugagagugaaugaaaagccugcaaagacugguguguuuucaugcuuucaaaauucuaaagcagugguuuucaaucauuuuaauccuucuauacuguucauuugugcaacagacauccaucagugacaucucccaugugaacaguaacucucaacugcugguaguuguugcaaguggaguaguuugaaugagacacgaaaauauauuccuaggagggaaaucucacaaucucaauuuucuaggaaaucauaaagcuauaugaaaacagauuugggacuaacuugcaauauuuucacuacauaaaaaugugacucaauauuaaacuaaauuuucaaauugaggcuuuuucaaaguagaacguuuaugucauaacuuaccaaauggaacgccucuggagaaugcugaaagcuaagcagcaugugagaaagaacugcaagagcaccaggucucacaagaggaaaccaaagucgauuaaaaaccuucaaaauaagacaagacaccuucuuaagaauuugcaggaaaaucauuaauccaacagugguuauuuuccuagagcuagaauuuauuuauaugaaugucccccuucuggaaaguucuaacauaacuuauauuauuaaacuuugggagaaggaugaaguuaggaaauaacgugacagagaucaaggguaauguaacuggccuaaccaacuguuaaaacuccccaauuaaauaaaaauuugucaaacuauguuuacaaggcaauagcucccuaguccacuauucauucaguucacucaacaaauauuuguuaagcacauacuauuacuuguccuaguucuaggaacuagugcuacaacaguggauuaaaaaaacaaaaaaccaucucucucuuacaggguuuaccaucuagagggcagguagaaacaauaaaaaguaacacauggugguuaguguuauuaagaaauuuaaagcaggguaugaugaauagggaaugcuguguagcaaaaaaaucugcuguuuuauauagcguucaauaaaugccucaugaaagaagugauauccaacuguaaaacugaaggaauugaauaagccuugcaaauaccugggacaagagcauuauaggcagggcaaacggcauugcaaaggccuugaggccuucaggcuggugugcuacagaugaagaaaaaagggcaguguaagugaagcaagagaccgaggcaguaacagugggaaaugggacuagagaaaaagugggccagaauacauaggaccuugugugauaaguacaggggaccaaggacaggagcaggaaggcugcugcaaucuugcagcaagggaugauaauguaggaccagggugguaggauucuggauauauucuaaaggugguaucaguagaauuuguaggauaugggcugagagggaaugaaaaaaagauaagaauagcuucaagguuuuuggcuugagcaagugaaaggauagaguagccucuaggucugggagggaaaagucaggaauaagauuguagauaaagugaaucugagauucauguaaagacagauggauacaugaauauggaguucaagggagaaaaauggacuaaaaauauaaaucuggcagucaucaaauuagagauguuguuuaaagccauggaacaccuaugcugugaguaugcacugagaagaaaauggaccaaagacugaacuguaaggcauucuaaaaguuagaguaaguacaggagacugauaagccugugaaggaggacaaaaaucaggagaguauaauguccuggaaacaagagggagugaucgacugugccaaauacugcugacaggucaaaugagacgaggccugagaaaugacucuugaguuuagcaacacuggaaaccacugguaauuuugguagaguaauggugguaaaagcuugauuagcuggacucaagagauaauggaaagaauguuuucauauuggauauuugaaaaugaaaaaauuauuuuaauuacuuauacuuuuuuuugagacgcagucuugcucugucauccaggcuggagugcaguggugcuaucuuggcucacugcaaccucugccucucagauucaagucauucucgugccucagccuccugagcagcugggacuacaggcaugaaccauuaugccaaccuaauuuuuguauuuuuaguagagacggaguuuugccauguuggccaggcuggucuugaacuccuggccucaagugaucugcccgccucagccucccaaagugcugggauuacaguugugagcaaccaugcccaaccuaauuacuuauauuuaaaugacauuuaaaaaaauuucuaaagccuauucaaacuguuauucaaaacaaaacaacaauaacauauucaaaauuagaugcuuucaaggauaccacccaaagaaaaaaauauugauuuuaugagucuauauauucuaauagauuuccauacucccacuuaccaguucuauuuucagcaaaguaacaucuaucaaaauaguaaacuucuggacagcugccaguccuuucaggagugcaauuacccauguauccacaugcugagccaauggccaggauagccagucaaucauucugaaauugaaggaaaaugaaacaaucauuauugaaaauauuuucauuuaguuagugauaacaagaguuacaguagauaaucacucacuuugugaauaaacauuuacugaauuugcuggugaaaagcacugaccaagauguagaagugaauguaacaggugcuuguucucauggaauuuccaaucuuguaaacugacaguuucucauauccaacauauuuccauaaaaagaauuucugauaaauuauuuugcauaaacgcaaaacuuaaaauuuaugcuauauaguggcacagguugaguauuccuuauuugaaaugucuggaaccagaagugcuuuggauuuucaauuauuugcauuacauauuuacuggcugggcauuucaaauccaaaaauuugaaaucugaaaugucccaaugagcauuuccuuugagcaucaugucagcacucaaaaaguacuggauuuucaaacauuucaaauuugggaugcucaaccuguaucaagaauuuauuaggcaaauuuacucuaaaaagagcagcugaaauguaaucugaacuaagacauaugaauaugauccaagauuccuccuuccuggugaguacagucuaauaugaaauguacuguuuaaaaagacuguauuuugaacugugaaagagguaucuuuuucaaauccgacuauacaaagagaacaaaaagaaacuucaaauauauaaaaaagcacuaagucuguaaauauuguaauggcuucauuuugcacuaaugagugcuuuucuugaaagaaaacucauuaaauuacccaauuuagugaaaaaaaaaaaaaaaguaauauaggauuggacagagacacucccuaaaguuagaucucuaccacaaugaagauugauacaacucuuucagaaagcagcugaaagucagaugcaguggcucacgccuguaaucucagcacucugggaagccaaggcggcuggaucaccagaggucagaaguucgagaccagccuggccaacagggugaaaccccaucuccacuaaaaauacaaaaauuagccaggcauggcggcacgugccuguaaucccagcuacucgggaggcugaggcaggagaauggcuugaaccugggaggcggagguugcagugagccgagaucacgccacugcacuccagccuggacaacagagcgagacuccgucuccaaaaaaaaaaagaaagcaacugaagcaaauguucauauaauuugaccuaguaguccuauuuuugggauuauauacuaagaaaauagaaaggggaaaaaugaguuuuugaagccagagugacugguuuaaaaagcucaauucaccauuuauuagcuaggggacccuaaauaccuacauagauuauuuaaccucucuguuuccucaccuguaaauuacagauaaacaugcuuauuuuauagcacuguugugaagauuaaaugaauuaaucuauaacacuggaaacauugugaaugccucucuuccaccaaauguuaauacauguggcaauaaauaaauaccuugauuauacaaaauguaaauauaaacacuaaggacauaaauacauuacuaaaacaacaacuacuauguuaaaaggacugacaucuuuuuucuuuuugagacacagucucgcucugucacccagaccggagugcagcagcauuacuucaggucacugcaaaguucgccuccuaggcucaagcgacccucucuccucagccaucugaguagcuaggacuacacagcugugcaucaccacaacuggcuaauuucuguauuuucugagaugggguuucaccaaggggguugccugagcuggucuugaaauccuggccucaagugauuugcccaccucggccuccuaaaguguuaggauuacaggugugaggcacugugccuggccaaaggacugacaucuucauuuauaugguuauuuucacaacaguuguguuauauaacuaucuacauuaacacuggaauguuuuuuauuaagguuuuugcuuuuaaaauuaaaauguccauucggauauuaagaguggucccaaaguccaaaugcauguuaacuacaaguuauguguauguucccuccauucucuacacaaacuuuauuuccauucuuguuuuucuggccuuuuccaacaaugaugguuacaagugauuaacauaguccuugacagcuauuccacgucuuccaacuauuguuggggugauucucauaaaauuuuguggccauucuacuuauacagaguagcaaagcagagacacacuugcauauguguacagaggguauucacuguagcacuguuuaugguauagaagaacugcaaacaaccuaaaugauugucaauaaggaaauggcuacuaugguacugauacuaugcaacaguauauagaguuuuaaauaauaagauagauguacaugaaucuauccaugaggaaucuaaaauggaaagagcugagaaauuguugaauuaacaaggaaaaaaaaaaccacugcaguuuuuuuaaaaaacaauuuuaguuuaaaagaaaaucaugugaauauauauguaaauauggacauaaaaaagauguaaucuaaaggcaggguaugugugagcacaucuuggcucuguggauucuuugcaucaugggaagucacacugucagagcagaaccagacagggcucaccagaauacaggucucaaggccagucuaaagagaguacugagagaggacgagagcagagaguagaaaauuccacuuggccauggcuuuucauuauccuucauuacucagucagccuuuuucucauccuuuccauuucugccuuuccaucucaaaagcuuccauucuuuaccuuauuucauguaugccaaucuccugaccaccuauaaauaaacuucauaucagauguuacacaaaucagaaggugcuguggucugaauguuugugucccuccaaaauucguauguuaaaaucuaauccccaguguguuggcauuaagagguggggccuuugucaggugacuagugagugggauuagaggcugaagggggcaccccugcucuuucugccaagugaggacacacagaaagcuccaucuaaaggaacaggcccucaccagacaccaaaucugcuugaccaauuuaaugaaaaaaaaaaaaaaaaaaaaaguaauaugggaucugauagagacacucccuaaaguuagaucucuaccacaaugaagauugguacaacucuuucagaaagcaacugaaggccgggcacaguggcucacaccuguaaucucagcacucugggaggccaaggcggcuggaucaccugaggucagaaguucgagaccagccuggccaacauggugaaaccccaucucuacuaaaaauacaaaaauuagcuaggcauggugaccuuggauuucccagccuccagaacugugggaaauaaauuucuguuguucauaaauaacccaaucuaaaaucuguauuuuguuacaguagcccaaacagacuaagaaagcauucaugaaauaaauauuuguguauuauauagcagguacuguguuuggugcugagaauauaacaguaagauaugguuucuguccuuaaaaaggaaagaaaaguuaggaaauuugucaacaauuacacaguuaucaaauaauaguacuggcauuuaaacuaagcucugccagcauagaauacaauguuuuuugccacacuuuaauuauauuucaguuccguuucaauuugauuggacuugcacaugucugagguucuucuccaguacaggcaggcacugcaagauaagcuauuuuuaugguuaacuauaggaaucuuauccaccauguaucagugauuaucaauuugaauuccaaggacacuuucuuuuaacucugguauacugauuuaauaucuuacuauuuaaauaacauuuaacuauauacuugucauuuauguacuccacgaccugucuccauuagacugugagcuugagagcaguaaucucucauauaucuuuggauucccagcacuuagugccuggcacugaguaggaacucaaauuuguuaaauaaagcauuucuuuauauagcuaaagaaaaguacaugcaacuuuaaaaccauaacaguaaaacuggcaaaaauuaugaaagacaccaagauugguuuaaucguaauuuauggagaauaacagcaauuuccauuuuuacauggcagcuugugggcuauaggcagccuucccuuuuauuuguuccaauguuuuaaacauugagaaauuucacacagaaaacuggauuucaggcuucuuuugaaaaaucagauaaaacaagacuggauuccaauuuccuuguauuaacagacaacuggacuugaugaucaguuuucucuuuuagaagguacuuauguaucccauucccuaucauuucacuuauaccuggccuauuucauauuuuaauguuaccuguuugguccugguacgguaucuacauuugcauuugcauuucuauggauuauagaaaaugacuauaaacaugaucacugcuauguuugggaaaguauagugcauggggagguauaaagugggagguggaugguaaaagcaaauaucacuaucccuuucaguuacauuuucuguauaagaguaauuacuucagguagauuauggguacauaggaucacgcaggcuacacuggaaauguaauacaaaaacugagucacaacuccccguagaaaaaaauaaguaaaaauuaauucccaaauacaucuugaaaaaaaauuccuaaauuggguacuauaacuguuuuugaagaggcuggaaaauuaagagcacugaaugccaagaaguggaauaugaauucgacuuaguagguaguggaagucacuacaaugucuuaauuagaagagaaaaaucaggaguccacaugguugacauaagaaaaguaagucacugcuagcaaaaagaccaacuaaaaaacugugcaacgaggaaagccugauuucuucaagguaguggggauagaauaagcaucauuuuaagaaauguccuaaagaaauaauccaaaggacuuauuaauuauguuaaucaaagggaaugaaaggauggauuugaaaauugcuuauagguuugugaccagauaucuagaauuauugucaauuuaaguaaaaaaagagaaaaaauaaacaccaacaucaggccaugaagauaaguucugccucuaagagagugacccuaagugagaaacuugacuacccugguuuguuucuucauuggugacuauaucauaacugggagccagauuuaaguucaaauacuggauucacuguuuauuaccugaacgagcuuggguaaauuaucuaaccucucaguuuccucaacuaugagauggggccaauaacaguaccuauuucaaaagacuguggugaguauuaaauaguuuaugucauguaaagaaaaucugcuacuauuacccuaugcaaugaaagugauggaccaacuaauuucuaauuucacuuccagcuguaaaaucuguaauucucugaauguguuuuacuaggaggaaauagaaguuauaauacauucaucccaaagagaaagacacuuuagugcuguuacagucacacugacaaaagugugcugcugcuaaauacggcacagaaggaguuacauuaugaggagaugaacaagauaacaguuucuuaaaaauaaaugaacaaugagaacuucacauaaagacuuggaagucaacuacauacagaucagaacugauaaagugaugauaauaaugggaaggaagaaaauaaaaagaauagauacagaaagaaauuccuaacaguauggugucagagacaaaaauuucaagaacaaugaauagaaagauaucaaggagaugagaauaaaaauacagauuaucaaacacagcaaggggaucaucaaaauuaaaagcaauggggguagaggucacacaacaggaaaaacauuuacauaagaguuuucucaaacguacaaagcaccuucacaaaucucgaaagucaaagagggaaugaauaguaugaaacuggaaguaaaaguuacagauaaauugauucaauuauguuuaagagcacaaaaagaaagaagaaacgcuagaagaggaagaccuuuuuaaacaaugaagugaaaagggggauacgguggagaaaaucaaaguccccagaguuuguguuacagagagugaaguuaguacaaaugcagcugagaacucaauaugaauagcucaguuuauauguuaccuuauaauuuuauaacaggggcacagaaaccauuuuguccaaauccuuauauuguauguaaaugugcuuaauauacacacacaugcaggaaaagaauuaaaaaacaaaaacaggcagguauuaaauaagaacagacagacacaaaaaacucaauuagaaaaaaauagucauugaaauaaagaaacucaguaacuaaguaagcucuacagaugagcaccuuugaagagaaaauuagugaacuauaaaauaguacugauauucuuccccucagauauccacagguuugcuacuucacauccuucaugucuucacuucaugguuaccuuagugaagccuucuucauccaucuuauuuaaaauugcaaaccacuuccucacaaccugucccccuuccugucuacuccuaucccucuuuuugucugcuuuuuuuucaaacauguaucacuaucuaacauacuaaauuauuuuacuuaucauauuuaaucaaaucuaaaacaaaaccaauuuuaagaugcauaauuagcuuauauaccacuaaggcaagaaaagccgugccaauuuaacuaggacaugaaugacuaggcauuucuacauuuaaacaucuuugaaauuagaagacauguuggaaucagugaaguguguuauuaaauuacugucugccuccccaacuagaaugcaagccuauaaaggcagauauuuuuaucaguuuguuugaggacauuuugaacacugccuggcacucaugguaaguacucaguaagugugguuugaauaaaugaaugaaugacugaauaaaagugccaaagugcuaagaagggcaaauaauauuaagauuauaccuagaaaugcaagaauaaaauuacagaacaucaaggauaaagagaacauaaaaguuuccagacaagcugacuacucacaaaggaaugacagucagauugacagcugacuucccacgagcaacaacagaugcccaaagguaauacaguauuauuuuuaaaaugcuaagagaaaauggcuaucaaauuagaauucuguaucuugccaaaucaucuauuuaaaacugagaaagaaaaaaaauucaaacaggcaaaggcaaagaguguauuacacauugagccugguugaaagagaaaguaaaguauauacuuacuaaggaagaaagaaaaaaaaacgcagaagaaagaaauagguugcaggaaacaauaaugggcagugaaauacuguauacugauaauccaaucaacaucugaguguauaauauguguauauguguguauauuuugguaauuaaaaaaaguugaauugaaaauagauuugugaauuauugggaugccugucaacgcuauaaacaauuccaaucuauuuggagaaucuuuacauaugucauuccaugauuuuaguuuuaaacauucguaaguuuuucauuacucacaaaauacaaaauacuuccucuuccccaaaucuacaauuaccauuaauagugucaugaagaaguaccugcaaagggcuugggucauacuugcaucuuuuacauuuggauccguaguaaggcuccugaugagaacuguaaucaucugaagaggaauaugcugcacaaggcuugccaaugcuacagaagguucaaaugaugcaucuguuuuuucaauuaaaaagaaaagggaacauggcaaguagguucaaguauuuaaaaagaacaacacuuuacaaaaaaaaaaagucauugcagcaaagguguuaacuaggaaggauuauuaugcuacacccucauggguagacucuuaauuuacaaggaauguuaaauuacaggaaugaaagauuaggagugaacagcaaugaucacucauacuauagacagaauacugaaauauauugauaugguuaguccauaaguuacuuuaauuuuucauaauuuaucgaguuauuguugagcuaaaauauuaacuuguaaaucacuaaucagaaaggaaauauaaagaaacauaaaguaucauuucaacuuccacuucagacccuccaaaauaacuuuaaacuuauugaucauuacaucccucuaaggaagauuuugaaaaaaucucuuaaaguagaaaugaaggugacuuuugggggcacuuaaguaucauuucaacucccacuucagacccuccaaaauaacuuaaaacuauucaucauuacauugcucuaaggaagauuuuuaaaaaaucucuuaaaguagaaauuaaggugacuuuuguggagauuuugcuuaaacuguauacaaauuaagcaaauccaagacaaguaccuuuacugcuacaguucaaaaaauuugggaggaaccuaacaguuaugacaacacaggcaauagaaguaaaauuacaauaagaaaaaaaaacaaaccaacucagauacugcaaauacaucguuuguaauucuuucguaaauauauuaaauucaucagaacacagaacguuuguuaaaacuccaccuuuacuucugguucuuaagauaagaagaggacacaucccucacaaguucaauuugaacagccacacaguccccacugguguuauaaaugaaggagaaugcuuguaccaaguagagcggaaaugaacaugauuuugaaucuauucagaccugaaagguccaagacagaacaacgaagguagagguacugguaaaauuccucggcgagaaagcauuuucuaggcaaguaucaugugacccuucucugcuuucugagaaugcaguucaugggcacaaaaacaaauauuuaaauccucguacucuuccuucccucauucuaucuguauuccuccuuugucuacuagauacuguagacaaaaaaugucacuauuuaaaaacuucauaguuaucugggauaauccaguaauaaaacaaacugcacaauccauuaauucaaaaaugaggaaauacaaaaaugggggaaaaacucauuacaaaauuagagacacguacaauaaauacuaugguaaacaucaugcuaccauuagucacuaaugaauggaagcuuucugcaguagcugucauccucaaagcauuccaaauaacuugagcagaggcuggguaauuaagcaacuuguuuagugccaaaggucuuagaccuggacguucucaaccuuuaaaaugggaacgcugccuguuuuuaaaguacgaugugacguccugaauaagguagugaaugugaauaaauuugggaugagguauuaggauuugcucucgcuuaagaauguuuuuagggcaggaggaaaacauggugugaaugugugugugcaagagagacauauacugauuuuuuaugagauauucugaaagauaaugacccuuaccuguggaagagaugcuugcaaaaacuucuugcagggaaggcaguaguguggcaggcucggccuuccagauguucugcagcaaguuacucacuuuugucaccugggagacauauucccgcagcucucuuuccuggguggacacgcacuggaaauggccuaucguucgaaccagcuguugacagaacgugauggacaauuuccccuuggggaugcauugcacaaagucggucagaaggucgcucagucgggcacagagcugcggcuccggccucucacacaccauccguaacaccucuaccugcaggaggcuaaagagauccagcaccgacggacagcucauaaucagcuucaggccguugugaauguaguccaggauggcuacauccuuccuguccagagagugguagcccugaugaaggaggcccaacacgaaggucuuguugaagaaggacucgaacucuggccggugguaucgugcguaggccuccagcaccuggugccccaccugccgcuggaaaggguccuggcccuccaggaugagccgggucgucaggucaaacauggccucgcacugcgccucgucuagccagugcuccgccgauuccaccaccuuccgcacaaucacccgcuugaggggcaggggaugcgaggaacucacaaggcccuccaggaucuuguccauugucgccacgcugcaaggccagggccaggggauaaggagcggguggcggcagccccgagguggggcaggagagccccggggcggagaugaacuuggagcgccgcagcagcagcgcgacgggccacggccaccgccgccucagcagccacauuuauggcgcagggagacccauccaagccggggcgggagcuagcgagccuggagagccuaagaaccgacaccugcggcuggccuaaggcgccagaggcccguacuccgccgccgccccgggcccucgaucccacucagcaucagcgccgaggggccugucgggccccccagcggcgucggcgggagcucagggcccggggcugcuagccggcggguggaggaagcacgccuccgaguuccgggucaggugugggcguccagucuccagcaggucgugagaagaagccgguccugggcugagucaggaggcgcugucacggagagugcugggaucagccggggagaagagaccgaagcgacacccuuugacccggauuuugaagugccggcaaacaggaagugaaggaccua

SEQ ID NO: 15668 - RNA, 36717 nt, Homo sapiens
uagguccuucacuuccuguuugccggcacuucaaaauccgggucaaagggugucgcuucggucucuucuccccggcugaucccagcacucuccgugacagcgccuccugacucagcccaggaccggcuucuucucacgaccugcuggagacuggacgcccacaccugacccggaacucggaggcgugcuuccuccacccgccggcuagcagccccgggcccugagcucccgccgacgccgcuggggggcccgacaggccccucggcgcugaugcugagugggaucgagggcccggggcggcggcggaguacgggccucuggcgccuuaggccagccgcaggugucgguucuuaggcucuccaggcucgcuagcucccgccccggcuuggaugggucucccugcgccauaaauguggcugcugaggcggcgguggccguggcccgucgcgcugcugcugcggcgcuccaaguucaucuccgccccggggcucuccugccccaccucggggcugccgccacccgcuccuuauccccuggcccuggccuugcagcguggcgacaauggacaagauccuggagggccuugugaguuccucgcauccccugccccucaagcgggugauugugcggaaggugguggaaucggcggagcacuggcuagacgaggcgcagugcgaggccauguuugaccugacgacccggcucauccuggagggccaggacccuuuccagcggcagguggggcaccaggugcuggaggccuacgcacgauaccaccggccagaguucgaguccuucuucaacaagaccuucguguugggccuccuucaucagggcuaccacucucuggacaggaaggauguagccauccuggacuacauucacaacggccugaagcugauuaugagcuguccgucggugcuggaucucuuuagccuccugcagguagagguguuacggauggugugugagaggccggagccgcagcucugugcccgacugagcgaccuucugaccgacuuugugcaaugcauccccaaggggaaauuguccaucacguucugucaacagcugguucgaacgauaggccauuuccagugcguguccacccaggaaagagagcugcgggaauaugucucccaggugacaaaagugaguaacuugcugcagaacaucuggaaggccgagccugccacacuacugccuucccugcaagaaguuuuugcaagcaucucuuccacagguaagggucauuaucuuucagaauaucucauaaaaaaucaguauaugucucucuugcacacacacauucacaccauguuuuccuccugcccuaaaaacauucuuaagcgagagcaaauccuaauaccucaucccaaauuuauucacauucacuaccuuauucaggacgucacaucguacuuuaaaaacaggcagcguucccauuuuaaagguugagaacguccaggucuaagaccuuuggcacuaaacaaguugcuuaauuacccagccucugcucaaguuauuuggaaugcuuugaggaugacagcuacugcagaaagcuuccauucauuagugacuaaugguagcaugauguuuaccauaguauuuauuguacgugucucuaauuuuguaaugaguuuuucccccauuuuuguauuuccucauuuuugaauuaauggauugugcaguuuguuuuauuacuggauuaucccagauaacuaugaaguuuuuaaauagugacauuuuuugucuacaguaucuaguagacaaaggaggaauacagauagaaugagggaaggaagaguacgaggauuuaaauauuuguuuuugugcccaugaacugcauucucagaaagcagagaagggucacaugauacuugccuagaaaaugcuuucucgccgaggaauuuuaccaguaccucuaccuucguuguucugucuuggaccuuucaggucugaauagauucaaaaucauguucauuuccgcucuacuugguacaagcauucuccuucauuuauaacaccaguggggacuguguggcuguucaaauugaacuugugagggauguguccucuucuuaucuuaagaaccagaaguaaagguggaguuuuaacaaacguucuguguucugaugaauuuaauauauuuacgaaagaauuacaaacgauguauuugcaguaucugaguugguuuguuuuuuuuucuuauuguaauuuuacuucuauugccuguguugucauaacuguuagguuccucccaaauuuuuugaacuguagcaguaaagguacuugucuuggauuugcuuaauuuguauacaguuuaagcaaaaucuccacaaaagucaccuuaauuucuacuuuaagagauuuuuuaaaaaucuuccuuagagcaauguaaugaugaauaguuuuaaguuauuuuggagggucugaagugggaguugaaaugauacuuaagugcccccaaaagucaccuucauuucuacuuuaagagauuuuuucaaaaucuuccuuagagggauguaaugaucaauaaguuuaaaguuauuuuggagggucugaaguggaaguugaaaugauacuuuauguuucuuuauauuuccuuucugauuagugauuuacaaguuaauauuuuagcucaacaauaacucgauaaauuaugaaaaauuaaaguaacuuauggacuaaccauaucaauauauuucaguauucugucuauaguaugagugaucauugcuguucacuccuaaucuuucauuccuguaauuuaacauuccuuguaaauuaagagucuacccaugaggguguagcauaauaauccuuccuaguuaacaccuuugcugcaaugacuuuuuuuuuuuguaaaguguuguucuuuuuaaauacuugaaccuacuugccauguucccuuuucuuuuuaauugaaaaaacagaugcaucauuugaaccuucuguagcauuggcaagccuugugcagcauauuccucuucagaugauuacaguucucaucaggagccuuacuacggauccaaauguaaaagaugcaaguaugacccaagcccuuugcagguacuucuucaugacacuauuaaugguaauuguagauuuggggaagaggaaguauuuuguauuuugugaguaaugaaaaacuuacgaauguuuaaaacuaaaaucauggaaugacauauguaaagauucuccaaauagauuggaauuguuuauagcguugacaggcaucccaauaauucacaaaucuauuuucaauucaacuuuuuuuaauuaccaaaauauacacacauauacacauauuauacacucagauguugauuggauuaucaguauacaguauuucacugcccauuauuguuuccugcaaccuauuucuuucuucugcguuuuuuuuucuuucuuccuuaguaaguauauacuuuacuuucucuuucaaccaggcucaauguguaauacacucuuugccuuugccuguuugaauuuuuuuucuuucucaguuuuaaauagaugauuuggcaagauacagaauucuaauuugauagccauuuucucuuagcauuuuaaaaauaauacuguauuaccuuugggcaucuguuguugcucgugggaagucagcugucaaucugacugucauuccuuugugaguagucagcuugucuggaaacuuuuauguucucuuuauccuugauguucuguaauuuuauucuugcauuucuagguauaaucuuaauauuauuugcccuucuuagcacuuuggcacuuuuauucagucauucauucauuuauucaaaccacacuuacugaguacuuaccaugagugccaggcaguguucaaaauguccucaaacaaacugauaaaaauaucugccuuuauaggcuugcauucuaguuggggaggcagacaguaauuuaauaacacacuucacugauuccaacaugucuucuaauuucaaagauguuuaaauguagaaaugccuagucauucauguccuaguuaaauuggcacggcuuuucuugccuuagugguauauaagcuaauuaugcaucuuaaaauugguuuuguuuuagauuugauuaaauaugauaaguaaaauaauuuaguauguuagauagugauacauguuugaaaaaaaagcagacaaaaagagggauaggaguagacaggaagggggacagguugugaggaagugguuugcaauuuuaaauaagauggaugaagaaggcuucacuaagguaaccaugaagugaagacaugaaggaugugaaguagcaaaccuguggauaucugaggggaagaauaucaguacuauuuuauaguucacuaauuuucucuucaaaggugcucaucuguagagcuuacuuaguuacugaguuucuuuauuucaaugacuauuuuuuucuaauugaguuuuuugugucugucuguucuuauuuaauaccugccuguuuuuguuuuuuaauucuuuuccugcauguguguguauauuaagcacauuuacauacaauauaaggauuuggacaaaaugguuucugugccccuguuauaaaauuauaagguaacauauaaacugagcuauucauauugaguucucagcugcauuuguacuaacuucacucucuguaacacaaacucuggggacuuugauuuucuccaccguaucccccuuuucacuucauuguuuaaaaaggucuuccucuucuagcguuucuucuuucuuuuugugcucuuaaacauaauugaaucaauuuaucuguaacuuuuacuuccaguuucauacuauucauucccucuuugacuuucgagauuugugaaggugcuuuguacguuugagaaaacucuuauguaaauguuuuuccuguugugugaccucuacccccauugcuuuuaauuuugaugauccccuugcuguguuugauaaucuguauuuuuauucucaucuccuugauaucuuucuauucauuguucuugaaauuuuugucucugacaccauacuguuaggaauuucuuucuguaucuauucuuuuuauuuucuuccuucccauuauuaucaucacuuuaucaguucugaucuguauguaguugacuuccaagucuuuaugugaaguucucauuguucauuuauuuuuaagaaacuguuaucuuguucaucuccucauaauguaacuccuucugugccguauuuagcagcagcacacuuuugucagugugacuguaacagcacuaaagugucuuucucuuugggaugaauguauuauaacuucuauuuccuccuaguaaaacacauucagagaauuacagauuuuacagcuggaagugaaauuagaaauuaguugguccaucacuuucauugcauaggguaauaguagcagauuuucuuuacaugacauaaacuauuuaauacucaccacagucuuuugaaauagguacuguuauuggccccaucucauaguugaggaaacugagagguuagauaauuuacccaagcucguucagguaauaaacagugaauccaguauuugaacuuaaaucuggcucccaguuaugauauagucaccaaugaagaaacaaaccaggguagucaaguuucucacuuagggucacucucuuagaggcagaacuuaucuucauggccugauguugguguuuauuuuuucucuuuuuuuacuuaaauugacaauaauucuagauaucuggucacaaaccuauaagcaauuuucaaauccauccuuucauucccuuugauuaacauaauuaauaaguccuuuggauuauuucuuuaggacauuucuuaaaaugaugcuuauucuauccccacuaccuugaagaaaucaggcuuuccucguugcacaguuuuuuaguuggucuuuuugcuagcagugacuuacuuuucuuaugucaaccauguggacuccugauuuuucucuucuaauuaagacauuguagugacuuccacuaccuacuaagucgaauucauauuccacuucuuggcauucagugcucuuaauuuuccagccucuucaaaaacaguuauaguacccaauuuaggaauuuuuuuucaagauguauuugggaauuaauuuuuacuuauuuuuuucuacggggaguugugacucaguuuuuguauuacauuuccaguguagccugcgugauccuauguacccauaaucuaccugaaguaauuacucuuauacagaaaauguaacugaaagggauagugauauuugcuuuuaccauccaccucccacuuuauaccuccccaugcacuauacuuucccaaacauagcagugaucauguuuauagucauuuucuauaauccauagaaaugcaaaugcaaauguagauaccguaccaggaccaaacagguaacauuaaaauaugaaauaggccagguauaagugaaaugauagggaaugggauacauaaguaccuucuaaaagagaaaacugaucaucaaguccaguugucuguuaauacaaggaaauuggaauccagucuuguuuuaucugauuuuucaaaagaagccugaaauccaguuuucugugugaaauuucucaauguuuaaaacauuggaacaaauaaaagggaaggcugccuauagcccacaagcugccauguaaaaauggaaauugcuguuauucuccauaaauuacgauuaaaccaaucuuggugucuuucauaauuuuugccaguuuuacuguuaugguuuuaaaguugcauguacuuuucuuuagcuauauaaagaaaugcuuuauuuaacaaauuugaguuccuacucagugccaggcacuaagugcugggaauccaaagauauaugagagauuacugcucucaagcucacagucuaauggagacaggucguggaguacauaaaugacaaguauauaguuaaauguuauuuaaauaguaagauauuaaaucaguauaccagaguuaaaagaaaguguccuuggaauucaaauugauaaucacugauacaugguggauaagauuccuauaguuaaccauaaaaauagcuuaucuugcagugccugccuguacuggagaagaaccucagacaugugcaaguccaaucaaauugaaacggaacugaaauauaauuaaaguguggcaaaaaacauuguauucuaugcuggcagagcuuaguuuaaaugccaguacuauuauuugauaacuguguaauuguugacaaauuuccuaacuuuucuuuccuuuuuaaggacagaaaccauaucuuacuguuauauucucagcaccaaacacaguaccugcuauauaauacacaaauauuuauuucaugaaugcuuucuuagucuguuugggcuacuguaacaaaauacagauuuuagauuggguuauuuaugaacaacagaaauuuauuucccacaguucuggaggcugggaaauccaaggucaccaugccuagcuaauuuuuguauuuuuaguagagaugggguuucaccauguuggccaggcuggucucgaacuucugaccucaggugauccagccgccuuggccucccagagugcugagauuacaggugugagccacugugcccggccuucaguugcuuucugaaagaguuguaccaaucuucauugugguagagaucuaacuuuagggagugucucuaucagaucccauauuacuuuuuuuuuuuuuuuuuuuuucauuaaauuggucaagcagauuuggugucuggugagggccuguuccuuuagauggagcuuucuguguguccucacuuggcagaaagagcaggggugcccccuucagccucuaaucccacucacuagucaccugacaaaggccccaccucuuaaugccaacacacuggggauuagauuuuaacauacgaauuuuggagggacacaaacauucagaccacagcaccuucugauuuguguaacaucugauaugaaguuuauuuauagguggucaggagauuggcauacaugaaauaagguaaagaauggaagcuuuugagauggaaaggcagaaauggaaaggaugagaaaaaggcugacugaguaaugaaggauaaugaaaagccauggccaaguggaauuuucuacucucugcucucguccucucucaguacucucuuuagacuggccuugagaccuguauucuggugagcccugucugguucugcucugacagugugacuucccaugaugcaaagaauccacagagccaagaugugcucacacauacccugccuuuagauuacaucuuuuuuauguccauauuuacauauauauucacaugauuuucuuuuaaacuaaaauuguuuuuuaaaaaaacugcagugguuuuuuuuuuccuuguuaauucaacaauuucucagcucuuuccauuuuagauuccucauggauagauucauguacaucuaucuuauuauuuaaaacucuauauacuguugcauaguaucaguaccauaguagccauuuccuuauugacaaucauuuagguuguuugcaguucuucuauaccauaaacagugcuacagugaauacccucuguacacauaugcaagugugucucugcuuugcuacucuguauaaguagaauggccacaaaauuuuaugagaaucaccccaacaauaguuggaagacguggaauagcugucaaggacuauguuaaucacuuguaaccaucauuguuggaaaaggccagaaaaacaagaauggaaauaaaguuuguguagagaauggagggaacauacacauaacuuguaguuaacaugcauuuggacuuugggaccacucuuaauauccgaauggacauuuuaauuuuaaaagcaaaaaccuuaauaaaaaacauuccaguguuaauguagauaguuauauaacacaacuguugugaaaauaaccauauaaaugaagaugucaguccuuuggccaggcacagugccucacaccuguaauccuaacacuuuaggaggccgaggugggcaaaucacuugaggccaggauuucaagaccagcucaggcaacccccuuggugaaaccccaucucagaaaauacagaaauuagccaguuguggugaugcacagcuguguaguccuagcuacucagauggcugaggagagagggucgcuugagccuaggaggcgaacuuugcagugaccugaaguaaugcugcugcacuccggucugggugacagagcgagacugugucucaaaaagaaaaaagaugucaguccuuuuaacauaguaguuguuguuuuaguaauguauuuauguccuuaguguuuauauuuacauuuuguauaaucaagguauuuauuuauugccacauguauuaacauuugguggaagagaggcauucacaauguuuccaguguuauagauuaauucauuuaaucuucacaacagugcuauaaaauaagcauguuuaucuguaauuuacaggugaggaaacagagagguuaaauaaucuauguagguauuuaggguccccuagcuaauaaauggugaauugagcuuuuuaaaccagucacucuggcuucaaaaacucauuuuuccccuuucuauuuucuuaguauauaaucccaaaaauaggacuacuaggucaaauuauaugaacauuugcuucaguugcuuucuuuuuuuuuuuggagacggagucucgcucuguuguccaggcuggagugcaguggcgugaucucggcucacugcaaccuccgccucccagguucaagccauucuccugccucagccucccgaguagcugggauuacaggcacgugccgccaugccuggcuaauuuuuguauuuuuaguggagaugggguuucacccuguuggccaggcuggucucgaacuucugaccucuggugauccagccgccuuggcuucccagagugcugagauuacaggcgugagccacugcaucugacuuucagcugcuuucugaaagaguuguaucaaucuucauugugguagagaucuaacuuuagggagugucucuguccaauccuauauuacuuuuuuuuuuuuuuucacuaaauuggguaauuuaaugaguuuucuuucaagaaaagcacucauuagugcaaaaugaagccauuacaauauuuacagacuuagugcuuuuuuauauauuugaaguuucuuuuuguucucuuuguauagucggauuugaaaaagauaccucuuucacaguucaaaauacagucuuuuuaaacaguacauuucauauuagacuguacucaccaggaaggaggaaucuuggaucauauucauaugucuuaguucagauuacauuucagcugcucuuuuuagaguaaauuugccuaauaaauucuugauacagguugagcaucccaaauuugaaauguuugaaaauccaguacuuuuugagugcugacaugaugcucaaaggaaaugcucauugggacauuucagauuucaaauuuuuggauuugaaaugcccagccaguaaauauguaaugcaaauaauugaaaauccaaagcacuucugguuccagacauuucaaauaaggaauacucaaccugugccacuauauagcauaaauuuuaaguuuugcguuuaugcaaaauaauuuaucagaaauucuuuuuauggaaauauguuggauaugagaaacugucaguuuacaagauuggaaauuccaugagaacaagcaccuguuacauucacuucuacaucuuggucagugcuuuucaccagcaaauucaguaaauguuuauucacaaagugagugauuaucuacuguaacucuuguuaucacuaacuaaaugaaaauauuuucaauaaugauuguuucauuuuccuucaauuucagaaugauugacuggcuauccuggccauuggcucagcauguggauacauggguaauugcacuccugaaaggacuggcagcuguccagaaguuuacuauuuugauagauguuacuuugcugaaaauagaacugguaagugggaguauggaaaucuauuagaauauauagacucauaaaaucaauauuuuuuucuuugggugguauccuugaaagcaucuaauuuugaauauguuauuguuguuuuguuuugaauaacaguuugaauaggcuuuagaaauuuuuuuaaaugucauuuaaauauaaguaauuagguugggcaugguugcucacaacuguaaucccagcacuuugggaggcugaggcgggcagaucacuugaggccaggaguucaagaccagccuggccaacauggcaaaacuccgucucuacuaaaaauacaaaaauuagguuggcauaaugguucaugccuguagucccagcugcucaggaggcugaggcacgagaaugacuugaaucugagaggcagagguugcagugagccaagauagcaccacugcacuccagccuggaugacagagcaagacugcgucucaaaaaaaaguauaaguaauuaaaauaauuuuuucauuuucaaauauccaauaugaaaacauucuuuccauuaucucuugaguccagcuaaucaagcuuuuaccaccauuacucuaccaaaauuaccagugguuuccaguguugcuaaacucaagagucauuucucaggccucgucucauuugaccugucagcaguauuuggcacagucgaucacucccucuuguuuccaggacauuauacucuccugauuuuuguccuccuucacaggcuuaucagucuccuguacuuacucuaacuuuuagaaugccuuacaguucagucuuugguccauuuucuucucagugcauacucacagcauagguguuccauggcuuuaaacaacaucucuaauuugaugacugccagauuuauauuuuuaguccauuuuucucccuugaacuccauauucauguauccaucugucuuuacaugaaucucagauucacuuuaucuacaaucuuauuccugacuuuucccucccagaccuagaggcuacucuauccuuucacuugcucaagccaaaaaccuugaagcuauucuuaucuuuuuuucauucccucucagcccauauccuacaaauucuacugauaccaccuuuagaauauauccagaauccuaccacccugguccuacauuaucaucccuugcugcaagauugcagcagccuuccugcuccuguccuugguccccuguacuuaucacacaagguccuauguauucuggcccacuuuuucucuagucccauuucccacuguuacugccucggucucuugcuucacuuacacugcccuuuuuucuucaucuguagcacaccagccugaaggccucaaggccuuugcaaugccguuugcccugccuauaaugcucuugucccagguauuugcaaggcuuauucaauuccuucaguuuuacaguuggauaucacuucuuucaugaggcauuuauugaacgcuauauaaaacagcagauuuuuuugcuacacagcauucccuauucaucauacccugcuuuaaauuucuuaauaacacuaaccaccauguguuacuuuuuauuguuucuaccugcccucuagaugguaaacccuguaagagagagaugguuuuuuguuuuuuuaauccacuguuguagcacuaguuccuagaacuaggacaaguaauaguaugugcuuaacaaauauuuguugagugaacugaaugaauaguggacuagggagcuauugccuuguaaacauaguuugacaaauuuuuauuuaauuggggaguuuuaacaguugguuaggccaguuacauuacccuugaucucugucacguuauuuccuaacuucauccuucucccaaaguuuaauaauauaaguuauguuagaacuuuccagaagggggacauucauauaaauaaauucuagcucuaggaaaauaaccacuguuggauuaaugauuuuccugcaaauucuuaagaaggugucuugucuuauuuugaagguuuuuaaucgacuuugguuuccucuugugagaccuggugcucuugcaguucuuucucacaugcugcuuagcuuucagcauucuccagaggcguuccauuugguaaguuaugacauaaacguucuacuuugaaaaagccucaauuugaaaauuuaguuuaauauugagucacauuuuuauguagugaaaauauugcaaguuagucccaaaucuguuuucauauagcuuuaugauuuccuagaaaauugagauugugagauuucccuccuaggaauauauuuucgugucucauucaaacuacuccacuugcaacaacuaccagcaguugagaguuacuguucacaugggagaugucacugauggaugucuguugcacaaaugaacaguauagaaggauuaaaaugauugaaaaccacugcuuuagaauuuugaaagcaugaaaacacaccagucuuugcaggcuuuucauucacucucagccuacauccuacaaauccuguugaccccaccuuuaaaauacaucuagaauccuaccacguuaagccagcugaaucauuggcguuuauuugauuucaauuauuugauuaucaguuacugcagaugagaaaugacaaauuguaauuuuggucagcuguccauuuaccacucuagggcaucauaggaaaacagugccuuugugugguuacuuaauucuuccaaagacuaauccuguuuuauaggacuagaaacucauugucaauaaacccacaguggaaaaaucuuaggaauacugauucaccauaacaaacuuuagaggagacuaaugaaguucagaauuccauuuguuuuuauuuaucuagaauauauucacauagguugcucagugucucauuuccacugaaggaaaguccacaggcuuuguaguaaguaaaccuuacuagcaaguaauuacauuacacauuaccacuuaggaugagugauuucugcaguuaauugcccuaauuuuggugaauuuaaucaucaagcaguaaccuuauauauauguauaauacaaacagaacucaaacucuaagauagcagguguacuagcaaagucuuccaagaaaaaaaacaucaauuacuuguccuugucuucaggcacaaucauguguaagacauuugagaaaaggcuuuguuuuccacauuuuuuuuuuaacuuguuagauucagggaaacaugaaaguuuguuacauagguaaacucaugucacauggguuugguuuacagauuauugcauuacccaguuauuaaacccaguacccaauaguuaucuuuucugcuccucuaccuccucccacucuccccgcucaaguagaccucagugucuauuguccccuuuuuuguguucaugaguucucaccauuuagcucccgcuuauaagugaaaacaugggguauuugguuuucuguugcuggguuaguuugcuaaggauaauaauagccucgcccuccauccguguucccgcagaagacaugaucuuauuauuauggcugcauaguauuccaugguguauauguaccacauuuucuuuauccaaucugucacugaugggcauuuagauugauuccauuucuuugcuauugugaauaaugcuacagugaacauucaugugcauguaucuuuaugguagaaugauuuauauuccucuugguguauaccccauaauaggauugcugggucaaaugccagugcugcuguuagcucuuugaagaaucaccauacugcuuuccacaaugguugaacgaauuuauacucccaccaaguguauaaguguuccccuuuuuuugaaccucaccagcaugucuucuuuuuugacuuuuuaaugauagccauucugacugguaugagaugguaguucauugugguuuugauuugcauuucucugcugaucaguaauacugagcuuuuuuucuuaagcuuguuggcugcauauaugucuucuuuugaaaagcgucuguucauguccuuugccugcuuuuuaauaggguuuucucuuguaaauuuguuuaaguuccuuauagaggcuggauauuagaccuuugucagaugcauaguuuauaaguauuuucucccauuccguagguugucuguuuacucuguugauaguuucuuuugcugugcagaagcucuuaaguuuaauuagaucccguuugucaauuuuugcuuuuguagcaauugcuuuuggugucuuugucaugaaaucuuuguguccaggaugguauugccuagguugucuuccaggguuuuuaaaguuugggguuuuacauuuaagucuuauccuugauguaaugaacaucgauacaaaaauccucaacuugcaaagcaaauccagcagcacuucaaaaagcuaauccaucaugaucaaguaggcuucaucugugggaugcaagguuaguuuagcauacacaaauaaaucacauaaacagaaauaaagacauaaacuacaugguuauaucaauggaugcagaaaaagcuuucaauaaauucaacaucccuucauguuaaauacucucaauaaacuagguauuagaggaacaugucugaaaauaauaagaggcaucugugacaaacccacaaccaacauuauacucaaugggcaaaagcuagaagcauuccccuugaaaaccagcacaagacaaggauguccucucucaccacuccuaaucaauauaguacuggaaguccuagccagagcagucaggcaagagaaggcaauaggugacauccauauaggaagagaagaagugaaacuauuuguagauuauauguuucuguaucuagaaaaccccauagucucagcgcaaaagcuccuucagcugauaaacaacuucagcaaagucucaggauaagaaguuaauguaaaaaaaucacuagcauuccuauacaccaacagcagucaagcuaggagccaaaucaggaaggcgaucccauucacaauugccacaaaaagaauaaaauaccuaggaauacagcuaaccagggaggugaaagaucucuacaaugagaaauacaaaacagugcucaaagaaaucaagaagacacaaacaaauggaaaaacaucccaugcuuauggauaggaagaaucaauaucauuaaaauggccguacugcccaaagcaauuuacagaugcagugcuacuucaaucaaacuaccaaugacauucuucacagaacuaaaaaaacacuauuuuaaaauuuguguggaaccaaagaagaaccugaauagccacagcaauccuaagcaaaaagaacaaagcuggagccaucacauuacccagcuucaaauuauacuacagggcuacaguaguauauuaaaacagcgugguacugguacaaaaacaggcacauagacuaauggaacagaauagacagcccacagacgaagcugcacaccuaugaccaucugaucuugacaaagcugucaaaacaagcaauggggaaaaggcucccucuucaauaaauggugcuuugacaacuggcuagccauaugaagaagauugaagcuggaccccuuccuuacaccauauacaaaaaucaacucaagauguuuuccaaauuucuaggaaggagauucucugacauaacuuuaucauucauucuaauguuuauugcccauauugaggacauuccuuaaucuaguaguggguaaugugguaguuaaaucaccuauaacuccaaauaacucaguaaaggacuugggcuuaggaguugcuaaguaugagcaauaaucuggaaucagcaucaucauaauucaucauaaguuuagaauaucuuagggcaagccaagguugauguuagaauaugugguguuaugggucagguugcuuuucuuaugcauuuuacccaguggaauaaauuuauuuuaaacagacacuauggcagauaggaauaauggagaaagaaaaaaaaucaaagcuucuaauuaaauaaguuuuauacauuuccucaaaaacuuuaguauuauaauaaugucaagaaacauuuaguuucacuuauucaaaaaaaucaacuuucacacauuuagaaaguaauagccugcuuggaaguauaucuguauaacugugaaagacuaagucuuauuuccaugucgugauaauguugaccauuugagauauaguaauagacaaccauauaaccugauuacaaagaccuaaucuaauuugacagauuuggaauuauaaauuuaauaauuacuucuaaaauuuuugccucuucugucucccuucaccuuugagaaaacaaaauaauuuuggauuucugacuuuuagcaagagaauaucugauaaauguggcuuuaugcgacagaaguauaauucauauuugcuuagaaauguaaagaugauagcaauagaaugaacucacuaggaacugguaguuuuauggucacauuaguaccugugauggagguaagaagguaaugcaaaagcuacagugugauuuaagcacaaauguaaagcuagacagagcagaauggaaauagcacuguguuguaagacuaugauuguucuuuuugugggaaggacggggaauuaguggguuauuacuauaauugcuguuauugcuguuugaugguacgacccuaauaguuauaacuuuuuuaccaugaguuagcaaccccaaaauguucuacaaauagaacagaagauaccuuuuaccauaagaaguguaaauauguaguaucagauuauaauuaaaaauuaauugaaaaaaauauaguaucauacuaauggaaagagcuaugucuguaaaauagaaguuguuucauuuuaauaaccuccuaaagauaugauuggcucuggauugaugacuuuuuaguuuaauuuuacaaugaaagaacaugguugugcugaugaucaauauuaacaauauucuauauguuuaugagcaaugaucauuuuagauuucacuuuuauuuuuagccccaggucuuuaaaacuaacagaaguuucugaugcccuuuauuuuuagaaccaucucaucuuuugcugugaaaugggauuuguuaguaagaauagccacucuaacauaaggcauggucucugugcuuaucuaaaaguaaucccauuaccugagcugcaauuuuaguuacucauguaaagauuuucuugaaguagacuuuaaugugcaauguacuuuuaauucuuucaaguaaaaaauuuuagauucacacuagauggagcucuuuagcuaauuccaggauuauuuuucaaaaguuuauucccauugaaugaccugguaaauauaauaacccuaacaauuucaaccuacagcauuuuucagaaugguggcaaugacuaagauuccuauuuuauaccuuaguuuauguuuuagaugguguguaaggaugaggagaggggucauauaugagauuacagucauaugcgacuucgaaaacuagauuuaccuugauauuuuagaaauguuuaacuuaauaacaagaaaaacucugugacugcacauacagaaaaguaucugcugaucauauaucguuuguguucuguuuguaggcuagagaauguguuaccaauuuguauaaauucagcauuguuuauccuuuuuucuuuucagauuguuccucaugugguuaauuugguucauucuuucaaaaaugauggucugccuucaaguacagccuucuuaguacaauuaacagaauugauacacuguaugauguaucauuauucuggauuuccagaucucuaugaaccuauucuggaggcaauaaagguaugaugauaguuguaccaauauuuguggaguuguguuauauuaauaaggugaaacauucuuauaaccagcuacucaauuuacuauuuuaugguaauaugcuuuuuauuugaaaaaugcaguuagaaucagguuucauuuagggaguaacagcuuucuugcuggagucaccauucuaaauuaauaaccauauuucuuuauuucugcagugucaucaauuauaaggcauaucuuuaaauuuauaauagcuuuuugggaaauuuguuuaaaaagaaaugcuacguuaaguuaaugcauacaucagauuugcaccccaauauuagaaguguuaaaguauauguagaguacaucuuagaauacaggaaauggaguuuaauaaaauauuugacuuugauuucuuccccuuuuuaaucuuuuuuuuuuuuuucuucuugagaccaagucucgcucugucaccuaggcuggagugcagugguaccauuucugcucacugcaaccuucaccuccuggauucaagcgauucuuccgccucagccuccugaauagcugggacuacaggcaccugccaccaugcccggcuaauuuguauuuuuaguagagacaggguuuuaccauguuggccaggcuggucugaaacuccugaccucaaguaaucugccugccuuggccuuccaaaguccugggauuacaggcgugagccacugcaccuggccucuuuuuuaauucuauuuuugcuguggacuguucaucaauguuucgaaucuuuacuugaauuauuuguggaguuauacuguguuucaauuuuauauggaaaugguucuaaaaagcacuuuuuuuuuuuuuuggacagucuugcucuguugcccaggcugaagugcaauggcaugaucacggcucacugcagccucuacaucuugagcucaagugacccuccugccucagccucccaaguagcugggacuccaggugcacaccaccacgccaggcuaacuuuuuauuuuuuguagagucggggccucacuauguugcucaggcuggucuugaauuccuaggcucaagugauccucauccucccaaagugcugggauuacaggcaugagccacugugccuagccuaaaaagcacuucuguuuguguugaagacuggaucacaauaaacauacuuuccucucaguaaacuuacugcauaaucaguguauagcaaaagaauaggagaacugaacucagccaaacucaaucagaaauuauuagaaaucaauucuauugaugguuuuuuugagaucugaauuucaacauaaaggucuuauuaucuuuacuucuguaucugagguggauuaaaaacaguucuuuuuacuguaucauuaacuaaaucaaacuuauuuugguugagcucagaacacaaagacuguuaagcaauuaauguauauugcuggggugacacuuugacacuucagaaguagauuauguucaggagcauugugaaguggauuugaugguaauauuaaucucuuucuacauugucccuggauccauagaugauaguugcugcacuuguuaauugauugccauuguuuaguucaucagaguuuuucauguugaaaauucugauaacucauauaggcucagaagaaacaaugggcucgcucuaagcccaaagaaagcacuuuuucuuagcugucaacaacaacaaaaaugagaagauugaaacuccuucagaaaauguuuguuuguuaaggucuaagugccagaugcuaauagcaauccagauaagcccuaaugauuuuaccaacuucccuuacucuccagugcucuauucaugcuugaaauaauuuacacuugaaauguuaucucauacuucacaaaguugauaagaaaaauccauauguuguaauaauuuucuauauggguaacaugagauuaaguuuuauuuuucuuaaaggucauugugcauagaugcuuucauuucucauuucuuaauuacuuugggauuuuauuucuaaggguuaauacugaguaaauauuaguauuuaaugaaaaggagacauuuuuauuacaaaauuugaaaacaaauuguuuacuuauguuuaacugugugcuaaaauuuaagucuucauucuacugccuuugaauagcacugcaguguauucucugaccccaaaguuuuauuuuauaaacauuuugcuggcauauagagaacauaaagaguucaaaugugacuugaauuuccagcuuuugaguauuccuuaacuugauaaaaucuguuauuagacaauauuuauuuuugccauacagugaaauuugauauuuucaugacuagccaaguacugccaguuacuucaaaacuaagugggggaaaagaaaguucaaaugucgguguaagaaucuucuuaaugguguuaauuaauuuaacaacaaaaauaauuuuuacuuuacuuuuaaacuguuuuucuucuuuaugaccuauaggauuuuccuaagcccagugaagagaagauuaaguuaauucucaaucaaagugccuggacuucucaauccaauucuuuggcgucuugcuugucuagacuuucuggaaaaucugaaacugggaaaacuggucuuauuaaccuaggaaauacauguuauaugaacaguguuauacaagccuuguuuauggccacagaguaaguuuaaacuugaaucuuuucauuuuaacuguagaaguugaugcaugcugaugaaauauaagaugauagaauugucuacacauuauuccuuauaaauggcauaaauguuaacuuugauugccuuauucagaaaugaaacugcuuuuagugcucagaaacuaugaaaauguuaacauuaggcugggugugguggcucacgccuguaaucccagcacuuugggaggccaagacggguggauagcuugaggucaggaguuugagagcagccuggccgucauggcaaaaucccaucacuacuaaaaauaccaaaauuagccaggcgugguggugggcaccuguaaucccagcuacucgggaggcugaggcaggagaaucacuugaacccaggaggcagagguugcagugagccaagaucgugcuguugcacuccagccuggguuacagagugagagucagucucaaaaaaagaaaaguuaacauuaauucugcuuauuauucauugcauuuaaaugccacuuuaaagaaauuacuauuccaaagaguuuaagugugcuagaguacuucauuguuguuauccugugagacuguaauuuuuuuuaaccuauacguguuuugagggaaguuauauauaauuuuaucugccggucaguauuuugguauuugucagaucaacaacuuuguugcuguuugagaaguuuaaguucugcuccaccccagggcaauaauuacugaacacauguauaaacagacauguuccuuuccccucuuaagaauuuucuuucaaauccauuuucuuuugcaccuaagcaaauaggaaaucagaaguuguuaguuaugugaaugcuaucugcaaagguacaaaauaacgauaaacuuuuccugaagacaaaaacaugauugaauuuuucuccugauuaccaauaagcuauucauggaacuugcccaaagagguuuacaaauuaaguucuaagcuuuuccaaguuguuaugccugcccagaggaaucauaaacuaugaaaugucgaauuugguugggugccguggcuugcgccuguaaucccagcacuuugggagggugaggcagguggaucaugaggucaggaauuugagaccagccugaccaacauggugaaaccccgucucuacuaaaaauacaaaaauuagccaggcauggugaugugugccuguaaucccaacuauucaggaggcugaggcaggagaaucacuugaacccaggaggcggagguugcagugagccaagauugugccacugcacuccagccugggcaacacagugagacuccaucuaaaaaagaaagaaagagagagagagaagaauuugcuuuauuuuauuguugggcuccagauuauaauaucagcacucagguguuuuugguuucauuuagcauuuaauuuuuugguuuguuuguauuuggaauuuuuuuuuuuuuuagagagcagcuauaucuuuagacacaagugauacuaggcauaagacugaaagaauccccaucuuaccaccagaggucaucuaguccagacaucuccuuuuacagaugacagagaaaacaaaaaaccaaagcaguuauaacggcaagagcaaauaaaagguuaucucuuauugaacaguggccaauaauauuaucucugaaugggaagacagcauauuuuauuucuuaaguaauauaugaauucuucuucauaguuuaaaaauaaauuuuauauagaauaaaaagcagacauucccauuuccaaagguaauuuguuaacaguuacguuguuccagaccuuuuuugguacaguugcauguuuguauuuaauaugaaaacaaaugcauuuuuuaaagaaaauuugcagagaauccuauuuauauauucuuuuccagccacuugcuuuuaucauuuaauaauuuguauucgaaauauucccauauuggggcaauacagauccgugucauucccaguaaauguguaugccaucauuuauuuauuaaauacucauuuaauuuaaugagauuuaauaaauaaguuaaauuaguauuuaauaaauacuucuuuauuuaauaaugcuccuauugaugaauauuagguuguuuugcuuauaauuaacaucucucugcccuuauacagauacagaggauuuuucuuugaauauuuuccauaucuuugaauauccuuugaauaucuuucaaauugcucuccaaaaaagcuguagcauuuugaacucugauaccaauauaagauuguaccuagaaccuguaccuuuagcaacaaaucagccuuuuuaauuuuuugccaauaugaagaaaaaugucucuuaauuugcauauugcugcuaauuauagaguuuuucccucucuuauuuuucuuuauucauuuguguuucucuuccaaauaaccuguucuuuucuuuguacaucuuuuuguugggucuuuuuuguuuucauguugcuuuauauauacucuggauaaucauccuuugcuacaugcuuuuuucaaggcacaauucaaauuugugggguguuuuauuuauaauuuuuuaauuuuauguauuccagucuuccacuuuucauuuguagcaucuggacuuuuaaaagccuuuacccucuaaauuucuuguuucuuuauuuuaaguacuucaguaguuuuguauuuuauaucuagcucauuaguccugugguaucuguauugguguauaaucuuauguaacuucauuuuuuaccggauggauacccagcugucccuuuacuuuuuuuuuuuuuuugaguaguuuauccuuuucccacgcucuauucuuuaaaugacuuuaauuuuauaguguguuuuaaugacagcauauuuuuuuauuucaugaagauuugaaagaauuuaaguuuacuuaucuuauaaauuaauggcuuaaccuauuuguauuugcuaauccagaaaauagaaauaauaugugauagcacauaguccauuaacaggcuuuauaguaaauguuaauuuauugucauucuucccuuccuucuuuacuguuagauagauaacuuccuuaggaaaaggaccauuagguaaaugaaguuuuacuuuaaggauaauaaauucuugaacuaacuugcuuuuagcuuuuaagaaaugcuuuuaaauggccaggcacaguggcuuaugccuguaauuccagcacuuugggaggccgagguggguggaucauuugagguuucggugagcugagauugugccacugcccuccagccugggcaacaaaaggaaacucugucucaaaaaaaaaaaaagcuuuuaauaaaugcauguguuuguacgcacauauauauaaaucauuauauucucuuucaguuucaggagacaaguauuaucuuuaaaucuaaaugggugcaauucauuaaugaaaaaauuacagcaucuuuuugccuuucuggcccauacacaggugaguguguauguguauauaguacguuuauguuaacugcgugguaauauucauuaaacuuuaccuuauaccuaaccuuuuuaacugaugaaauaauauaauagauaucucacccaguauaacaaauccacuuagaaaugcuaaagagauccugccuaaaauaucuagauuuuuuuuauuuucaggauaugcccuaaguuuuuauauuuuucucuugcuucccauuauuguagcugaauauuacgcugacccauugaucuagaaauuuuuacaaagaaaauaugauuuccuauccaauaaauaaguuccuucaugaagaauuauuuuuaagugcaucuuuguuuccugauauuaaauuaguagauuuguacaauaaugagcaaauaaaauaauauuguggugccugggcuuuuuucucuuuucuuauguauaccuauucauuauaacuaaagaucucugcaguucuguuuaucuguuaaguucuagagcuuaaaauuucguggugaucuuuuauguccacacauuaauccggggucauuaauuuauguuaauggcaccaagguggucauauauaguaaauauucacucaacagacauuuauuaagagacgcuauaugcagucagugauaagcauuaaaagaagagucuuggccaggcgcaguggcucacgccuguaauccuaacacuuggaggccaaggcaggcagauuacuugaggucaggaguuugagaccagccuggccaacauugugaaaccccaucucuacuaaaaauacaaaaauuagccaggcaugguggcacacgccuguaaucccagcuacucaggaggcugagauaggagaauugcuugaacccaggagguggagcuugcggugagccgagaucgugccacugcacuccagccuagcuaacagagugagccccugucucaaaaaaaaaaaagagucuuuauguucaaagaacuuuuaguuuagauuuugagccuauacacaugaguaauauauaugucauuauuuauaauauauauuauuauuuuucugguuuuacuuucauugccuuuaucucacagaggucuaaaggagcaguaguuaggaccagaagaaacaauagguugagaauugaugggguucaguugaugggaaugcuuuuguuuucuuucuacaagcugagaaauaucucaaauauaacuucuuaaauggaaagaaucuagacaggauuaauaugagaugauaguaauggccuaugaguaguuauauacucagauauuuuuauuauucuuuaucuggggaaaguauguucacaaauuaaauuuaccauaucaagaccaagggaaacgaaaugaaaacuaucuccuuccucacucccuguuguuuccuaguaaauugauuuuugugcuuuaucacuaguauguauuuauuauauauaaaauauauauguaggcagauauauacuuuauuaacuuacuaaaucagagcuauuaggaaaaaaaaucuuaggggagguuucccuccuccucccaagaaaaguagaaauuuaaaagagccugauuaaauuucugucacaguugagacugucucugguagcagccugacagagauuauuuuaggcagauagauuuucccauauaauugaaaaguccuuuuuucuuauaauuaauaaaacaacacuuauugaacaguuacuuuuuuuuaaccccuggucuaaaucuuuuaugucuuaaucaucaaaaacagucugucagguaauaagguauauccccauuuuacagaugaagaaaacaggcuuacauuaccuguucagggucaugcaagcaagcagcaggguugagauaugaaccaaacagcucugaagcccauguuuaauguaggcuaaacuuccuuccuucagaaugcuauaaacacccuuaauuuggguaaaauuuuucuuaacugagaacuucauuguuaugaaguuaugccacaaauaaucaaaaugucaagagaauuccaaaguuucaacuuacaaucacaucuucgagaugccuuuucaguucuuuuuugucauggcaaaaucuaggauuugaaccugguucacuccagaguccaaaguuuaaucacuaagcagccucuauacuuuaaaacaaaaauuagcaaagguuucuaaccaguguacucacaaucugcacauauaugacauguaucugcucaaggaaauuuuugccuaaaguagguaugcaugacucuagaguauuuccuuuauuacuuuguucaaaauauauacuaacaaaauauacauuaaucuuuuuuagauuugauuuuucaaaaaauuguggacucaaacaugacugucauagagggaugauaccaggagcuuuauaucaagaguuagacauggguucuacuuuaaugccuugugcuacucauuuagcuguaugacccugggcaagucaccuguuucucuagcucucaauucuccucugcagagugagaaguuaugacuaaagauuaccuaacuuuauuucuaaauaauuuuaucugucccuaaguugccacguccggcacuuuuggcugaugcaauguuaacuguaaauaaccuuuauuaaacacuguauauuaagauuucaguuacuugguucaugcuauaagaaucacuuccuuauauuuucucaauugcucucaaaagagggaagcauacgcaccucggauauucuuugaggcuuccagaccuccaugguuuacucccagaucacagcaagacuguucugaauaccucagauuucuccuugacagguaaaaaguauucuuaaaauugugauuugaguguugucuuucauaacaguuuaauucuacuuaauauugcuuuuaccuuuaaaaacauauuucaaauauuacucuuuaaaauacuauugcauuucuuguauguuuuuuauauuuucuuuuguuuuuaauuuauuuuccuuuuugaauuuucuuccuugagaccagcuguucucaaagugugaaacaaggaccccugcggguucccaaaacacuuucaggagucugugaggucuucucuuuuccaacagcguaacugugugaggccagauuuucuuuauaugcuucauccaaaaaacauauaacaauagaaugcagagaagauaugaggcuccagcugucuucuguuaagccagauacuuaaaauauuugcaaaauguaaaacacugccauucuuacuuuuuuuugguuuuagaaaauacaacuuuuucauuuuuaaaauguuacuaauauuaaauaauggguuuauuauuguuugcuaaauguuaauauuuuauuuucucaguucugacaguaaauaucaauaaauacaacccauguaaaggaaagcucuuuguuuuuuaauuauuuuuaagaguauaaagggguccuggcaccaaaaaauuuaagaaccacuccuuuagaccaguucauaauuguauggguuugguauguuuuauugucgccugaccacuuaauuaauaaaaccuguuaucaucuguaucucccugucuuuguucugcucuguggaaugacuaguaaaguuaguugggcuugguaugugcagccuuccuuccauucagcuaagaaucuauucaguaguuuauuugugccugacuuucuaugagaugucaggaagacagagauauauaagacaguuaagggacguuuauaauuaacugcaauguaauacaugcuauuaaguagcaguaugaagaaaguguaaugagaauauagaguaguaauagccacccagcuuuuuuucugcauucucaaaacuguucaauuuucuuuuaauuaaaacaggaaaaaccugauuuguuuacauuaaauuugauuagaauaguuuauagaagccacuaauauuuuuaaauagaaaugacauuugaaguuaauuuaaguagcuauauaaugauauccucugcugcaggcuccaugaagaagaaaagaucuugaaaguucaggccucacacaagccuucugaaauucuggaaugcagugaaacuucuuuacaggaaguagcuaguaaagcagcaguacuaacagagaccccucguacaagugacggugagaagacuuuaauagaaaaaauguuuggaggaaaacuacgaacucacauacguuguuugaacugcaggaguaccucacaaaaaguggaagccuuuacagaucuuucgcuugccuuuuguccuuccucuucuuuggaaaacaugucuguccaagauccagcaucaucacccaguauacaagaugguggucuaaugcaagccucuguacccgguccuucagaagaaccaguaguuuauaauccaacaacagcugccuucaucugugacucacuugugaaugaaaaaaccauaggcaguccuccuaaugaguuuuacuguucugaaaacacuucugucccuaacgaaucuaacaagauucuuguuaauaaagauguaccucagaaaccaggaggugaaaccacaccuucaguaacugacuuacuaaauuauuuuuuggcuccagagauucuuacuggugauaaccaauauuauugugaaaacugugccucucugcaaaaugcugagaaaacuaugcaaaucacggaggaaccugaauaccuuauucuuacucuccugagauuuucauaugaucagaaguaucaugugagaaggaaaauuuuagacaauguaucacugccacugguuuuggaguugccaguuaaaagaauuacuucuuucucuucauugucagaaaguuggucuguagauguugacuucacugaucuuagugagaaccuugcuaaaaaauuaaagccuucagggacugaugaagcuuccugcacaaaauuggugcccuaucuauuaaguuccguugugguucacucugguauauccucugaaagugggcauuacuauucuuaugccaggaauaucacaaguacagacucuucauaucagauguaccaccagucugaggcucuggcauuagcauccucccagagucauuuacuagggagagauagucccagugcaguuuuugaacaggauuuggaaaauaaggaaaugucaaaagaaugguuuuuauuuaaugacaguagagugacauuuacuucauuucagucaguccagaaaauuacgagcagguuuccaaaggacacagcuuaugugcuuuuguauaaaaaacagcauaguacuaaugguuuaagugguaauaacccaaccaguggacucuggauaaauggagacccaccucuacagaaagaacuuauggaugcuauaacaaaagacaauaaacuauauuuacagguaaguuggaaauacaagcuuuauuuguugaaaauauuaaacaauugacacaguuaaaugaguacccucauuuugaaaucuaacaugaguuuuuauuaaauucugaaauauaggucuggauuuacaugaaguauucucaaccuguauaacuaaauugccuuucuaauauugugacaauuuaaaugaaaaguggcaauuagauguaaugcagaagacuuuauuuguuccuuacaaaagauggcucauucugaaaucaugccauacaaaauacagaaaguuuacaaaaguggacauauccucccucuuccucucagccucacccaccagaggaaauaacugcuaaaugugguauuuaugcccucaagacuuuuguguaaauguuuuaagggcuguuuauugauauuuagguggauaagauuaaaaaacacuaaaauguagacuauguaaagaaaggauauucauauucuuugaggaugugguuaguaaaaccaaggagauaauagaacaauuguaaaucgaagccaaggaaugguuuuauaugagauaaauuuauucauaaauauacuuuuuucaaggaguuagugauuuuauuacuuaaauaaaggcuaauaaaaaguuaaaauucuugcugaaaguauuuuuuuuuuguuuuugaaacuugcuaauuuguucucaacauacagggcuagcaguaaauuacaggugaaauucuagguacauuaauuggguagucuaagugauuuugaguuugaaugaguacauuuugaaaauucuguguuugaaagucacuccugaaagauacagauagaauaagaaaugagccacuauaguacugauuuuuagagggaaauuuucucaaaagcuuucaaauuuacugcguuauaaaauacacauuuuuaaagaaguauagcgauguucuugagugacaaaaacaauaaacuuuacagaaaaaaauagaaaaucagaauauuuguuugaacugauuaacuacugaagacucuaacaucuagucagauggcuuaugaucaacaugcuagaaauagaauguauucaacuguguccuucuuacuagauaucauauaaacacuagucagaggagaaauauggguuuugaaagauaaaaaacuacucucauuucugugauuagaaucccaaaugcuuguauagccauagcaaccacuuguuuguagcuuagcuccaagugauuuuccaguuuaucuugccuuuuaccccauuacuuucugauuauacaauauuugagcaugaggagcuguucuuuucauuauuauuuuaagacucguauguuacuuuauuauaaagaaaaagcauuauguauuuuguuaauucaguuuuucaguuuugugcaguuguucuagauucaaucuuaaguuucauauugacaaguuguuugaugcaagaaaagauaccaccaaauuuuauauuaagguauuuaccuguauuaagacuagguaguaaaucaaaguuucauuaucagaguacccuuuuaaagcaaaaauacaauaauaaauauucaauuuuuuuuuuuuuugagacugucucauucugucacccaggcugaagugcagugccgugaucaugguuuauuguagcuuugaacuccugggcuuaagugauccuccugccucagccuccugaguagcuaaggacuacaggcaugugucaccaugccuggcuaauuuuuuaaaaaaaauuuuuuaaagauugucuugcuauuuuacccaggcuagucucaaacuccugggcucaagcaauccucccuccucggccucccaaagugcugggccacugcauguggcccaauaaucaacucaauuaggaacuuauauuuagauugugauuauuuacauuuauuuauuuauuuauugacacagagucucgcucugucacccaggcuggagugcaguggugugaucucggcucacuguaaccuccacuccuggguucaagcaaaucucaggucucggauaaccaaguagcugggauuacaggcauacgccaacgugccugguaaauuuuuuuguauuuuuaguagagacagaguuucaccauguuggccaggcuggucucaaauuccuggccucaagugaucugcccaccuuggccucccaaagugcuaggauuacaggcaugagccacugugcccagccuguuuacuuuuaaauacagugauuaauaaaggcucaaauugugaaauuuuucauaccauuuaaucagaucauucugguauuuuaaguacauguuaaaagacuacguucuuuauucuguuauguggaugcacaugugcucauaauugccaggcaauagaaaacuauagcguugagauuauguauacagcaguuuucagcuaucacuucuuaaacaccuggagcauguacauguguguuuucauucuaucauuuuuguuuuuauauccauuuuugagauauaauuauuauaaauauaugucaugcuuuauaauagauuacuaugucuggacuauaagaaauagcauaauaccuuuuuauaaaacagcuauaaaaacuuaaaucguaaaaguaaggaugugaagugaacauuuugaguuccucugcucuugaacaauauugcuaaugaauuuaccauuuuaguacauaucaggguagcugcuuucauuuuaauacuucauaaucagauuagaaacucaccuugugauaauuuuaagaagcuuuuuuuaggauuucauuuuuacauuuuaggauuucauuuuucaauuuuaaaucuagccacaaccagauuuacaaguguuagaaaauguugcucuuuugaguauuggcaagauccgugguuuugaaaaacccaggcaaaaaaucuuuugugacaaaccauucucuacucuguguaucauagccugacauuugggaaaacaaugcaaauuguggaucucgaaguaaauuuuugaaaggacuuuucucuucauauauuuauuuccccuucauauauuucuuucccuucaguccagcuuccauuaggaguaucuccauuguuuuaaugucuggaauauaaaaacuaagccuuugguuaggauacagugagagauuguguaaugcaucaucauuguaugguccagauuacccacccaucugucgugcaucagccacagaccacuucccaucuuuucuugcuugguuucuuuccuuuguuucuuuggaggaggcaguaguucuucuuaacuucuuaauuauuuucuuuuucauacauucagaagaguauauucaauauauaugugcaguuuaaagaaaaauaaaaggauuaaugucaacaguuuuacuugaaugagaaauauaaauauacugaaaauuauuugucucaaggagcaauaacuuuccugugacuagaucuauagucuacuacugaaauuagaauuaacuuuaguacuugauauaaauuugugauauaaauuacacauucuaugauaaucauaauuuugacauuguacacaauguucuuaccuguauuaaguaaaauaaaagacaguuuuuccuauuuuuaugcauugucuaagcuuaucagaaaacagaauaccacacauuuuuuucugucagccauauauuucuauaaauaauaaagcagaaaaaguauauuacuuuuuugggauguuguauaucuugaaauauaauguagguuucauggguacagaugcaauggagcuacuaauuuuauauuuuaugucauucgacauaguuucuauaagggaaucacuguauaaaaacgucuaugcaagauuugccauaucuuuuaguagcagaaguucaaggagaacuucuugaacucuaccuuacauguuuguucaguuuuaauucguuacagaacauugucuauauaucugaaaccgugcauuguuucucagauacagagucauaguuucaucgcuuguuuggauaguuuaauagguuauagagcuagaacaaugaggaucuuugguugggggguuucugucuguuucugauguuacuuauggcacuuaauuucaaucuguaaaacauuuauaauuccuacguuaauuuuauagaucaaaggauaaauuaauauauauaucaccuuaaaaauacucuguagguagauauuauaccaaagagccagcaauuuuaaauguuguaaaugacacuguagaucacaaaaauguuuuuaagaaauauccugcaaauuaaguuuuaaaaguccuaacagacugguuaguuaagccauuuuguuacaaggauuuaucaaaggucccuuucagccauaaaaauaggugauucuugaucaucuuguguacugggacuugaacagaagaugcugcaugcuacugaaaaauaaaguaucuauaauaugacagauaggugucaggguaugccugggucuuuucuucauaacgaaaaauugagcauuuugugaagagggaagaauaauaaacuaaaccauuuuagcuagaaauuauaaaauaguauuaccuugccagauggaacaaaaucacuaggccuuaaguugaaaaaucgaaauaauaguguuuucguuauuaauguuaacuguauuuugaaagcucuucaggacgauuaugcuaacaaguucagguaugcugugaccaguaacuuuuagaccuuauuuuuaccaaccccauuugaaaucuguagauccucucccagaaaaauaagcacaugccagaauauuuugcauauuuuuccaaagaguuugugggucccaguuuuagaauccaguuguauaccuugccaaaugaauuugccauuauuuauucauauuugcucccuuugaagcuaagcaccuaauaguauucuaaucugagaucauuaauauuuauugaauaccuaacauaugcuuggcaucuagauaaauaugacugauuucugauaaaaguuuuccugauaaggaaacauuuuagauauuacugugaggaguuaggcuucauuuuacuugucaguguucuuugagaccuguuuuauuauuuauugagaaauagucuauggaaaggccagaaaaaaauucagucuucuuccuuuauucauacauuuaacuguaaucacccacuuccaaaauagccccaauugcuggagaauagauaaucuauugugauaaucuuugaauucuauguuaaauauauuagaaaagaaucuauuccaguauguuuuagagaguguugcaggaacuguaauauuuucuuagagaaauuuuuuuuucuuaggugcuuuaguuucaaaguuauugagauuugaagaauguuuauaaggauuaagguaguuuuaaaauauuucuauaggugauauaacgauccauuguauuuagcauuuuaauuucauaaaaguuauuuuuaauuuuaggaacaagaguugaaugcucgagcccgggcccuccaagcugcaucugcuucauguucauuucggcccaauggauuugaugacaacgacccaccaggaagcuguggaccaacugguggaggggguggaggaggauuuaauacaguuggcagacucguauuuugauccugagagaguccaaaaugcacuggucacgaaacgucuaauacuaugacuguuaaaaugucagacuauaacaaauaucuaucuuuuauuuuucauuagacccuuauacuucaagagaacacacucagugcuuguuuuuauuuucuugacacauuuauuaacaaaaugcaucauggaaaaaaaaaucuaccucuuaaaauuccauuugcuuuuaugguuagacaugcuugaccaaaaauguucagaagaaaauauguaccuggucccuaauuaagcugcguuaaauuugguagaagcauuuaaauggucuaucuucaguuuuacugaacaaaaaauguaauuuauuuagcauucuuuauaaaagaauugaugcuagagguaaaaaaaaauacuuguuuuuaaaaaauccuuuacgucuuguguaauuaccccauuauuaaauucaaguccuugaaaaucaacuagagauuauaaagucucuaaagaaggcaauaacaaaauuuaucaagauauaguacuuuucaguuuuuguuuagugucuucagcaucacugugucuguauuucaaguacaaauguuuuuaaaaaggauucuuuauacauaugugcugaauugauuuuaagaaaguugcaugauccuguaggagcaacauuuuuaccuaaaaaaugcuaacuuuauaguauuucuaauuguucaaggauuuuaaaauucuauuucagggaguauaucuucugugguuuugaaggaggugaguucuguaugugccuugcaguacuguaauucaaaaauaggaaucuuuggcugcaaaauuuuaaugaaauguuaggaaguaauuuucgugcuaacauuaaaauuauaacuuuuugaaagguaauagauuuuccagaaguaaaaucugaugguucuaaaucaaucaaugugauaguucauuuuuaacucuuagaagaauucagaggaaauuaacccagcuaaguaaaaaaucugucuugauuuuguuacuuauuccucagaauauuaaacauugaucacauauuuuuagaguuuuacauuuggguuuuuuguuuguuuguuucagucauauguuuggcacuguuguuucuauuuucguaguuuuagauaaaauguuaaaaugccaaacccuaccuuccuac

SEQ ID NO: 15669 - RNA, 1113 nt, Homo sapiens
augcuguuaaaaauguauauuugacaucuuaauaugaaaaugacaaaauaaaaugcuguguuccugcuugucuaccuaaggcucuguacggcacacucuaaaugauggugacuaacaccugcugucaggcauugccuucauaugcuacaaaaauaacuucucuaaauauucuuaagaaagucagaagugugugucagccaucugucugccuuaauugguuuuucauuagaauccuaccauuucuuugaguuguuauuccaauuuuuucccuccauuuccuuaaacugaccuuuggguagguugggagggccagccaugggaacacaucuagugcacugcuagcaauugcagccaggcccaaaguuaaugccccuuucaugugcacauucagagucccuguguggugccuugcacacuuuguuucuccagaguuuugcaaaagaacuggcaagggucagauucaacuagcaccuccuggcuaaucaagcaucagacccccugcuagguguuucccaugagaugccaucacacucaccaaaaauggaaagaggagguugagcagcagcaaacucuugagcccuguauccaagggagucgaaacggcaauccauaggaaguaucaccuggcugugcaaauacaaggucuguuucucauuucuccuccuggcuugcaaaaguacuuucaaaccucugcauccuuagugcagaaaagaucaaagauacucagauucagaagaucccugauaaucugaaaagugaaaacagacuuaagagaaauaaugaaguuaguaaucaagaacuuaaaacuauccacauuugauauaagguuccuaaaguagaaccacaucacgugcaacaggaacagugugaaacagugcaaggauucacaacagcuaaaaaguagauccucagccauacugccaaaggaugugucaucaucaguuuccuacugaagaggaauaagaaacugauaucccaacccauuguguuuccuuuguaguuuggucuauauaagcaaacauaguucucuugaaaggcugauauuccaguguucucaauaaauccuucagugguccuuguuaaguucauuauaaaagauucucuuaguauugu

SEQ ID NO: 15670 - RNA, 30070 nt, Homo sapiens
cgcggccucgcucccugacuuccgggucgcggugcuugaagggaguguuccgucguuuccguugccggcuguuugcaguggggaaaccgaggcagcuccugcucccccuaguucuuccgcuccugugagguggcugcuguuucuuuuccucuugccccggaugccucggugcggcugcacugagagcgcgcgggcucgcgagccccgcgggguucugcgggaacccgggggcgccugggccggcgggucuuugugcgagcccugcccucccauucgcgggcggcgcgcgaggggggucggcgcagagacgcccagagcccuggggugcucaggcgccgcuacgcgugcauccccucugcucggcaguucugcgcuuuuguccuaaugagcgcggacuagauggcuugauuuucaagauaaugaucaacccagcugugcuaugcgcucuuucugcacugaccugcggguacuucgaacuucgacagucccuccucaggcccuaguccagaggugacgugucugugggaauguuuaaggcaggaaggagacgagcaauuuuguuuuuaaguaucucccucucacuaguaucucccugacuuuuucauuuagaagcugaagaauuuucuuauggcauaagauauaguuguaucgaguguguacuuagcaaaacaaaaacuuguuaguauuucugcccuugaccuauugaauggaaaaucaagaaugagcuaagguguuauauacucaguguucaacuuguauacuuaaguuuguaguguuuuuauuugcuggcaucaccugacugggacaguuguaacgaauuauccacaugggauaagaagaguguauucuauaaaaacaacucugauguuuugguauauauuuuaauuguugauuaguuggaguccucuugaucuugaacuguugagccccaguucucaaagaaugggaaguuaggaaacuaagauaugaaauacaauuauuuagcaaaaagugcaaaccauucuguuacucuuucaagccauugaauaguuugaguacauuguuugaauuuuaguuuugaaaaagugauuaauuggccauuugaucaucaauuaauagcgguauauauuacaccugccauuguuuuuaaaugccuaauuaaacugucaaaacagacacaaugaaaugauagauacauaauuugagauuugaucaguuguauaaacuuuuuaaauuuuaaaauucaguuuaaggucauuaagcuugucuuguauguuucccuccuccaggaaaaaaaaauguuuauuucuuugugggaguucuucuaugggcacuuuuuucgauuuuggaugaaauggcuauuacgacagaugacugggaagugugaauugcagcgaauauuugauaccuauguaggugcacaaaggacacacaggauagguaauguuauucaaaaagaaaaaguacuaauaaaaguuuaacggaguguuuuucucaggacucacagugacagauguauuucuuuuguauccugacaagucacuuaaacugaauuucauaagcucugaagucccgcuuugacuccuucagcucuaaaauuguaugaauuuauagaaaaagugguuauuuaauugcuuauguguggaaagaauucucuggcuccugaaguuuaucgguuauuccuuagauuauaguugcaaccuauuuucuggugaaaaauuucuauacuuacauaaucccuuugaaauuuucacucacauggugggaagaaugagugccucagucuacauccauuuuuauacuuaggauccuucaucagucuuuuacuuucuuacuguuacuuaugaaaggccuguaauuauguauccaguggucucuaggaaagauuauuagacucauucucacuguccaauaccauagccaauagccacauuauauugagcauuugaaauguggcuagucuaaauugagaugugcuguaaguguaaaauauaaacuguauuucaaagacuuauaagaaaauguaaaaagucccaguaauuguuuauauucuuuguauguugaaaugguaauauuuuggauauguuggguuaaaaauauauuaaaauguuaucuguuucuuuuuacuuuaauguggcuauacagaauuuuaaaguacacaaaugggucacauuuuggcuuguguuauauuucuguugaacaguguugcucuguuaccuucuaaaauacaucaguuuucagugcuucauugaaaauuuuacucuaaaauuugaacacagaugaguaagaacuguguuuugaagucgcuucuuuucagccaggguaaggaagagcagagaagugcucuagcucaugcucucuguguuaaacggaaaauugugaauuagccagauuuuuuuuuuguguugaucaagugugcuucgacugagaaaucaaccccugucagguuaagagaguggaguauuggcaaauggaaccuguauccaagacaacaucggaagaaugacagacagacgcugccucauagcagcugguugauuaaguuuaauuacuuuccuaguuuucuuacaacuucaugguugacuuaaauuauugcugcucuuuuaauuugcccuuuugacuacucaaaagaacaaaguaccucuugauaagaaaucucuucaggcaguauggguugguguuuuauagugugggggaagaauauauauaaaggcauuuguuuguggcaaaagcauuuuuccuaaauuuuucaaauugcugagaaaagauuauucguaaaugugccagaaaauuuuuuaaauagaccaauaaaaauguuccugugauucuugauauagaaaccaggaauggagaagcuauuugucuggugacagaaggguugaccagauaaucugaaguccuugccuauuuguuguacgauuugguugcuaucaccucaaaucuaaaggcucaggcuaacaaaugaaaaugcaguagagagcacucucauuguagucuuaagaugaguuucugggaccugagcuacugugacacaauuaugggugaauuugcagugguuaguagacacuuuggggucuaaacagaaacauaugaccccagguaaugagguuggugucaccucuuugaauagguauuuuguguuugguugaguuuuuugaaaucauauguuuauacuguaagauuaaauuuuaaaaugcuuccuguuauauagaaauuauaucuccuggaacuauuaguuuguuacugguuugauauuuuuacuaguuguuuauuauaggguaauugacaaacagcauuuaagugauaacaucuuuuuuuuuuuuuugucauuucagaaaauuccuugacauacuccaagaauaagguaggauaacauaaaggugguaacucuagaaaacuuaacguggacauauuuuuucuuaaaaaaaaaaaagugcccugcuagaagaguguuuucuauagugagcauugagugaaauuuuccccguuuagagguaauauucuguuuucaaacauuucucuauauauguguuuuucguguguauuucaaagaaaauacuugaauaauuuguccuguccugagguuuuauuuguuuauuuugcuuuaagaguugauagcuuuuaggaaagcagggccuuaggaggaaagucgucuuuuagacuguguccucaggauagauuauaugagagaaaagcaacuuaggauagagaaaacccuggguuguguaccuuuugagcuaaaauaagucauaauucaugcuauguauuagucagcuuuugcuguguaacaaacuauaauaaaaucucaggggcauaaaacgauacguuguuucuugcucauaugucuaugggucagcuggagaagccuuacuucaagcuggggccaaguuccugucuauuccauuugucucaucugggacucagguaggggguuaacagguaucuggugaauguuuucaccauggauaacuaaaggcccaacuacacaaauauauuuuaagucucuuugugucaugucuguuagcaaccuguuaguuaaaacaaguuacauggccaagcccaagucaagggguggagaaauaugauaugcccaccguaaggcuaugguagggaguagguuguauaauucaauuacaagguaaugaagaauugggaccaauaauucagucuaccacaugcuguuacuucccuauuguaguucacaauuuugucuacauguagauuauuugguguggcaaggauagaauacgggucaucuagaccauuguuugaaaucccauaauagaacacaaccaguauuaaacaauaauaggaauagaacagaaaauauuuagaaaccauuggucauaauaugguuaaauauauuuuaggaauuuuuuauacuauuauaauuauuuuaaauauuucuguguacaucuguguguauuuuggacauccacaugaauguuuguuauugaucaugauguaaaauguggcucaaggucaaaaauguugauuugcuacugucuaguauuaugaaucgugccagaaauaaaauagaccuucuugagaguugcaagcauaucuguuauguucugaagaguaaccuuuaaaauagguacuuuaaugauuuaguuguacucuuuaagaauggucuauuuaagaauaacucauauauauaagugaauauuugggggaagaguccagaguuacacuccuuuguucagaauuguuagagagugauuaauauauuuuuuaaaaugaggauguggagguccugaaagcuaacagguugcugguucucaaaauuuauuuauaccuuauuuauuuguauaguuccuuuauuugaaacauaggaugcaguuucccaaaguaacaauauuacaaauuuuagcagaugcacuuggggagguguuauauuucagguccauuacaagaguaguccuuaaacuuaaggaagaaucaaaaucuucuggaggccuauuaaaacacagauuauugggccccauccccggaauuucuggucugguucugauugcauuucuaacauguucccaggugauacugcugcagccguuccugcuggugagggcagugucuugaggcacuaauagcauauuaguaugcugucuggggacuguuguggaucauaacugcuuuaacuuuguuucgauaggaaacuguguauguuuuucaaacugaccuuaaacaaguugguuuggaacuauuugggugcugaacccucuagaaugaauuguucugugaaaucuguuuucuuuaagccucgacauuguaaagagaguaaaaccauagcugagcucuuuauguuauacccacaaucccagcuuccaaccaauuuuuucaguaguguguuccuccaaauaaccuugacaucucucagccuggaaguuguccaacacugccauugcuguccacuaaaacucuuaucugguccccuucauuacucucugacuuuaucuacuacuguucuugccuugcucacuggucaucaccacuaugcugccuguuauuuuccaaacacaucagcaugcuucugguuuaugaccuuugcaccaggucuucuguuuaaguagaauuaucuucucccgcuuaaaagcuuagcucacuuccucauuuucagguuuuuccucaguuaugacauucucuaugagauuuuccaugaccauucucuaccuaaggguauaccuuugucucucuuuaugauccccuuuccuuaauuguuucaccauagcacagaccaucacuagcguacuaaauauuuuacuuacuuauuuuuccauuccugaaaagaaaaaggcauuguuuauuuuuuguuguuguuuuguucacugauguuuuucuaguaccugaaacagugccuggaaugugauaaggcucugaauauuuauugagugaaugaaugaauaagugagaaaaauaagaggauaaagaauaauaaguaaaugaaaauuaacuuuuuucagaauagaguguaguguuucuuuuauuuacuaauuuacuguagagguucuggaacuggggacucaguaucacaucuaucaguguaauuguuauaacugcauuuguaacaacaguuuuggucacagaauuuauuaaugggauuguaugugugguaaaaucaugccaagcuuaaguggaacaauacauaagaugcuacauuuaagaacuccagugccuuggucaaauccguccaaggauuugaaugacuaccacauguucaguauucaaccagggucuuugggauauucaaaagauauacaaaagaagacuggaauugaauguaauuguaaguagaaguuuagagaaggaagagguaaauguagacuagaguguuuggggauuuuaaaguagugguuacaaguuaaagaaaaauaaaauguucaucauuuuuuaccucuguuucuugcuauuaaaaaguucacuugaaaaguaaacauuaaaauuguauucuuaugaacuucauuauucaaaaauagaaauugcuauaguacuuuggagggcauccugcaaagagaguggucaacaaauggguaaauacugaaauuaaaucacuuaacgauuuauucuuuuaagguuuuaaaucuaagacaaacuuuccaauaaacagagguagccuuaucaauuuaaaaauauaauuuauguguguauugcaccuaauuuguauauuccauuuacuuuguaggguaaaucuauuucucauuuugugauauuuugguuuaccuaauuacauuuuuauucgauaaaaaagucuggguucaaauccugauauuaucaauuaccaguuguuugacuguguacaaguuacuuauuuucucauucuaaaagcuauucauacccacauaguuguuuugaaauuagagauauuacuaugaaaacagucuaagagaaugcccaauacuuaguaaguauucaacaaauagugguuacuaauaauauuaaugauaauauaauuaagccaauauauaccauaaucauuuuagaaauuugauauucaugaaaaccucuuugguacuugagaguacuuagcauuaccaaugauugcugugaauaaaagugauuuuaaucuauucagagugauucccuaaagcagugaucuugaaguaugaucauguuggacugugcacuguuccacagugugcauucuuucuuuguuaaaaauugaaucuuauuugcuuauauuuuagauuaaggacuauuuaucaauuagauauuaaggguuaacaaacugggauuuauaaauaaaaauuaaugacuuauucgaauuugaggagucuaauucaauauucugcuaagaagucuggcuuccaugcaauauaugacaauggagcaaagcuccacuguacuuacgcauauacaggcauuugaauuucugaaaguuagggaggaauacuuuggcaaucuauugguguuuuugguggcugucuuuuuauugcagcugccgucuuaggguuuaaauaauaauguagcuguuaaauaguugaauaauaaauacauuuuacggcauuaguuuaguuuucuuuuaaugcuauagugaugcacauuugcauuuuugggccucuacuuuuccacuacagccuauagucauucaaaguauaauaaggggauucuaugaacaacuuuaugccaguaaauuguuugauuuuacacaaaauggacgaaguccuugaaaaacaacuuaccaaacuaacacaaaaagagauuaaaaaucuaaauaguaguauacuuacaaaagaaauagaaacuguaauuuaaaauuuuuucacaaaucucuaaucuuggcuucacuagugaaguguuaaacauuuaagggagaagaaauaauaccacuauuacauuaacuccuaggaaauagaauagaaagaaacacacuuuauggggccaguaucaucuugauacuaaagccagauauagacaauauaauauaugaaaauuacaguucaauguccuucaugaauauaggugcaaaaguccuuaacagaaugcuagcaaauugauccuaguaauacauaaaaaggauaauaugucauguugaguuguuuuuuuuuuuuuuuugauacagagccuugcucuguugaccaggcuggugugcaguggcgugaucucggcucacugcacccuccaccucccggguucaagcaguucucucaccucagucuuucucgaguagcugggguugcaggugcacaccaccaugccuggcuaauuuuuguauuuuuaauagagacaggguuuuaccauguuucccaggcuggucucaaacuccugacaucaggugauccacccaucucugccucuugaagugcugggauuacaggcaugagccauugcaccuggccugucauguugaguuuucagaaucaauguauguaauuuaccacauuaacagaguaaaucagaaaaauauggacauuucagcagauacugaaaaacuguuuugacagaauucaguaccaauucaugauuaaaaaaucucaacuaggcauagaaggaacuuucucaaccuaugaaaggcugugaaaaaccugcagcuaacaugauacauaacacugaauuauugaaugcucaccacauuuaacugggaacaagacaaauauauguacuuucucugcuuuuauucagcaucauacuagagauccuaaguagugcaauaaggcaagaagaagcaauauaagacauaaugauuggaaagaaauaaauuauauuaacagaugacguacuuugugaauguagaaaauccuaagaaaucuacaaaaacuacuggcauuauuaguaaaugaauuuaauaguguuacaggacaugguauacuacuguauguuagcaacaaacuuuuggaaaauaaagaacaauaccacuuacaaaagcauccagaaaacauaaaauauucagggcuaaauuuaaugaaagaugcauaagacuucugcacuaaaacucccagagaaaauugcugagaaagaugaaaauggaaccauacacuguauucauccauuggaggacucaguauuaagauguuauuucccaaaucgaucuauggauucaaugcaguuccagugaaaaccccugcagacuacuuuugaagauucugacaagcucauucuaaaguuuguaaagaaauggaaggaaccuagaauagcccacguaaccuucuaaaaggaccccuacuaccugacuuuaagacuuuauagucaaaagaugaauauaacagaugagagaccagaaauugaccacaccuaauaugucacaauuuuuaacaagaguaucagagcaauucaaugaggagaagaaagucuuuucaauaaauagugcuggaacaacuggguauguaugggggaaaaaagaaaccucaacuucaaucucuuaccauacaugaaaacuaauuuaauacggauguuagaccuauguuuaagcuaaaacuuuaaaguuucugaaagcaagcauaggagaauaucuuccaccuugaguuaugcugccacuuaaaaaaauugaaaaguuaaacuucaucaaaauaaaacugcuuaucaaugauaccuuuaaggaaaggaauaggcaggccacagacugagaauguauuugcagcauauguaucugauaagggacuuguaucuaguaaauaacuuuuauaacucaguaauaaaaaggcaacagaauuuuuaaugggcaagagcuuugaacagucacaugacaaaaguguauauauacguguguguguguguguauguauacacacuuggaaaagugcucagcauuauuagucaucagggaaaugcaaauuaaaaucacagugagaagacacuacauaccuaaaaguuaccuaaaugaaauagacgaacaacacuaauguuggaaacaccaguuggagcagaagaugauauuaucacuuuggaagugguuuuggcaauuucauucaaaguuaaacacauacugcccuaguaauuucacucuuaggugucuaagaaaugaaaauauauauuuaccaaaaguauaauaaaguauggucccaaacugggaacaaugcaaauuuccaguaccaggagaaugaauaagcaaauugagguauauucaugcaauacaacucaacaauuaaaagggacaaauuacagauaugagaaagaauguggauaugaguaagaauguggaugaauccuagaaacguuauguugaacaaaagaagccagacacaaaauaguacguacuuugauuccauuuaugggcauacagcuaagcuauggugguagaaaucagaacagugguugcuucuugaaggaagaauugauugaaaaggggcauaaacgaacuuucugggaugauagaaauguucuguaucauaguagggauguggauuaucuggauguauguauuugucaaaacagaucagacaacaucugugccuuucacuguauuuaaauuauaaaucaauuuuuaaaaaaguaauggaauaguauauacaggaaagaguauuugcuuagaaacuagaugugguuucucgucuugacucugcccuaaauuuauauaugccuugggcaaguucauucaaucagucauuuguucauaauguauuuaacaaaguuuugagcauguaaucaguaaugugcuauccuagacgcucaagauauaagaguaaauaagagagacaaaugcugguggagaacauagagaaaauaugguguggucagugcucucuaacugaaguaugacugugaaaggaaguagguaacucuagggcuggggaagacuucacagaggaagugacauugaacuggauuuuuaauguuuuaggaguuuguaauacaugcaaaagguauggcuuuugccaugacuacccauggcgaagguaguccuuuuaccagugcugguauuuaagcuucaacacucuuccuguacucauauuaucucaggauuggacaagcuagacuuuguugaccauaucuguaucuuuacugauuguuauuaauagaucuuugaccauuuucuucucaccuuuuacuuuucucuggggaaaucuguuucuuucucucucucucucucucucucucucucucucucucucucgccuugggguauaucuaaacuaaggacucuauuuuuauuuuucuuaccauuuuugauuugaagucuuaguuugugaacuguucuucaguaugcacaguaaauuccuacaguuuucaaauuugaucugauuuuguuuuugucaaugccaguuuguuaccaguggugaucucuggagacaagauuuugagauucaacucuuuucugcauuuaauuuuuuaaacuuaugcauucaagauuuuuauuauguaauuaaaauaucuacuucguaaacacuaugguggcagcucauuugcugagaacucaucagcugagaaccuguugacucaguugaggaagccuuccucugguacaucauguugcuguucuuuuauuauaaaacuauauauauauaugugaauuuagcccuagagaaaaugugaaauaaacugguugaaacaaacuggguuuauuuugcauuuuuaauaucuacuuuguaagguugauuaaaugucucacaacuaugucuuuuucagcuacaaagaauuuuucucauuuggcuuucuuuuacauaaauagguuuuacagaaggcgacacauguuguucagagugaaguggacaaauauguagaugauauuaugaaggaaaagaauauuaacccugagaaggaugccaggugugcguuuuuuacauuauucuuuuuuauuaugcauuuauagccugugagguaucaauaucacacacuguuguaacacuuuagagcugaaggguuuguggagaucaucugauucagcgcucucacuucacaagaggagcaguugagauccagagagggcagugauagaaucgggacuagaaccuguaucucuugguuuccaguccaguacuaaugccaguauaucaucugccuucuucaagaugucuuaccaugacuuucccaagguuaauaacuuuggcuacuaugucuuuugaaauacaguuccuguguccuccucuaguaagguccuaccaggcuccuccauucugaguuaggugcauugcuguggcaucucauagugcuaucauaccauuuaacccauuguacuauagucauugauuaacucuuguccuucccucuguaaauucuaaguuccauaagaagaggacuuaucccauuucuguguucccagcgcugguauguugacauaguauuucacacuuuuuccuucauucagcauuuucuaugugaauauagaggaaggaacaauuuauuucagcugagaugaggaacggucuaggagggaacugaggauaguuccacccaagaggugguauuuacacuggaccuugaugaauggguaggggaacagugccaacaaggcacagagacauagaaauauuaauacuuuuguaucuggaaugauagggaauuauuuguagcuggaucauugaauaugagcagaguaguggcuggagaaaugagugaaaugcuagauugauacauugcagagucuuguaugccauacugaaggauguagauguuguccucugguuuuuaagcaaacaagcuacauuuuuagauauguauuuuaggaagauggagaguagauuugauaaugugggaggcuggcagaaggaauaaagaauaggaaauuugaguuauucagguaagaaaugacaaaggcauaaauacaguaggagaaagagugcuaugaggauugcuuugaaggacauuucagagauagaaagguuuagcguauggggaucuuuugauacauugugauggagagaggcaggucagaacuuggaguguuguagcuuggggaacuaauggguagcgaugucauuaauagaucuagacacuaaagaaagagcauguuucuuuagggaagagaagcaguuuuauuuagagcugagauaaccuguuguggagcuauuuguuuuauauauacucggaaaauuaagucuacuggugauaucuggcaauaaagauuuaggaauguauaggauugcccagagaaaacaugaagagaaaauccuucacaaauccuuacaguugugaaguuugccauuccuaccaugucuugcccucuuucuaggccuuguauccuauauaguacuuuacauaauguuuuguauuuaagguggccuuuggugggucuuauauuaaacugaaagccaggaaaugcuuucuaaauagacauaugaaccacaagcuaugaaagacuuuauugugauaagaggguaugcuuuuuaaaaauaauuuuaucauuuuuaguuuuaaaauaugcaugaagaugugcuuacugcagauaacugguuauaaacagcuguauuuggauguagaaagugugaggaaaaggccauaugauucugauaaccuacagcaugaagagcuacucaugaagguaaauuucuguuuucuuuauguggaguuguugaacgcuagaaaaauaaaucaggcuucagcuaaguaaagucugcaaauucuagaggcuuauauggcuaggcuuauaugguuucuuugcccuuagagaauuuuauuaugcuggauuucacugauauggaaagauuuuuaguuagguauuuuuaucauuuucugauaagcauuauuauaaauauauaaugaauauauauuuauaugaauaaauauauucaaauaaauuuuauuuuaauguuuuuauuucugaaauaaaaaccuauagagaucuuuucaaccaaaaaguauaugucuacaaguuucagauuuuucuccuacuuuuuauacaaauugcucauauaaguuaagcauuuuuucagcuacuuacaaguugaaaacaugugugucccuuuucagauuauuuuguccaaucuuuugggacuuauggaauguuaauugccaagcaaugccacaaaagauuuaaacuuuaagaaaguaaaaauuauuuacuuagaauuuuccuuuuucuuauuucuaaaguauaaaugcauaaagccaaugaggugccaaaauuaaagaguaauagaccuagaguaagcuuuacagaucaucuagacuagucccuuuguuugagggaugaagacucuaaggacuagggagaugaagcaauuugcuuuaguacuagaaugguagggccuggaacagagcugaaucuccugcccauccucuacaccuauuccaauuuuauuuuaaaaucguuaaagaaaauagcgcauugcaguuggaauuaggaguucuuuauaacaaaaaguacuguggaaacaacauugauacuaucuaaauaacacuaagcgauacaaguuuaaaaacaauaaaggcuuuuuuuucauuaaaaguguauuuuguuaaaugaggaugauacaaauauguaucucaaaggguuauuguauggaggaguuuuuauauuuaaaguguuuaaaauaguaccuggcacuuacugaggauuaacugcuauuucuguccccauugucaucauuuuucccuucauguuaggcccuugcuacacgauaccuuuccuuuugagggaaaaaaguacaaguccuagcccucuaguccagggaauuuuaccuuggugcuucauggugaaauucaguucuacacuacacauacucagcagucuuacugggugaagagcuauguaaucugucuugcuuuaaguguaguccaaggaccaccuuuacuagcguuaaauagcauuuacuauguacacuccaaaguuccaccuuagacuuagaaaauuagaauuuccaggaauggaacccagaaauucaauauucaugcauauuaaauuuuuaauacuagugguucuacacuguggcucucaccacaucacugaggccuuaucauuggcauaaucaaacuccuugcagaauucauggagagaggcuaauguaagcaagucacagguguugauaauaaaaguagugaccagguaaaccuaauguaaugauuggauuuagcuucagagccagucuugacccuguuuuaaagcaaggucacuucacauuuuauuuuagguaacagaauacuccuuucauuagggguccuuauucaacagugcuuuaaaugguaaugaaaugggaaaaaaaugaaaguauuucuguuuugcaaauuuucgcaaaccuucuuuagucaacuuccguaaguuucuuucauuugauggcuugugguauugaauuuaaacaauaaauuuucuuuauuuugcauugaguaguuuauugguauguaauauuugauaguugguuuguuuuuuuuuuuuuccuuuuugagauggagucuugcucugucgcccaggcuggagugcaguggcgccaucucagcucacugcaagcuccgccucccggguucacgccauucuccugucucagccuccugaguagccugccaccacgccuggcuaauuuuuuguauuuuuaguggagaugggguuucaccguguuagccaggauggucuugaucuccugaccuggugauccaccugccucggccucccaaagggcugggauuacaggcaugagccaccaugcccagcuugauaguuuuucuuaaauccucaucauuaaagauauuuauuuaaaaccaaaucauauuuuuuuaaacugaaaauuuguaaaacaaguuggaaugcuaucaguaucauuucuucaugcucuucugucuuauaccuauuuucauucugauuagggacuauuaacccaccauuauaauagagccuauuuaacuauacaguaucugaagcaagggcuaaguuccuaaaauacuguguuuuucucaagcaguuuaccaguucugggcauaucuguauuaauuaguaaauaaagacaucucauuguuuaauauuuuucuguauuauuuguuaucuuuucaaaaucuguucuuuauaccagucuuuuuaaugggaauaaaugugcugcguguuuuaggauaauugaaaaauguucuaaagucuuugcuuaaccuaugguuuuucuacaaaaguuauuugauagcauuaaauuacuaguuacaagcuaugagaaagaaaaugucuuaauaauggaaauauauuuguacagcuuuggaaucuucuaaugcccacgaagaaguuaaacgcuagaaucuccaagcagugggcugaaauugguuuucagggugaugaucccaagacagacuucagaggcaugggcauacuuggguuaaucaaucuuguguaagugaaaguaaacuuucuuuucuucccuaaaugaaauuacauuuaaucucugaucuaguuacuucuaauaagaagugaucuaguugauucauacuaucucugaauuuuaauaacugcagugcuggaaguauuugcuaauguguuggcaacaauaugaagauauuggaggccaggcacaguggcucacgccuguaaucccagcacuuugggaggcugaggccagaggaucacuugaagccagaaguuugagaccaaucugagcaauauagugagacccugucucuacaaaaauaauuagccaggcaugguggcauuugccuguaguccagccacuugggaggcugaggcagaaggauugccugagcccaggaauucaaguuuacagugagucaugauugugccaccuccagccugggugacagagcaagacccugucuuuaaaaaaaaaaaaaaaaagacauugguggaaauauaauuguguaugugauuucuuuacuuaccaaugcuuuccucuccuuuuucuuucugauuuccauucugauaccucuuaaagaauuauguaugcuccuacugccuuuauucacuugcuuuuucucucucggcucucugauucuauuuuggcaaauauaaccagauaaggugauaauaaagucucuuuauauauguucuucaccaccugugacaacuuaccuaccugcauuccugacuugguauagacuaccguaugaacuuucucuccuuuaucuucuuuaauacuuacgauuagcuacauguaucgaaauccccaaauauguaagugaagucacaauugauagacaaaacuauucuagaagauagccuggaagauuaauuuccuccuauaaggauaugcaaauguacaaauuguaguguuugggucuguccaugaaauugugauuuauagacuauaaaaugucuagaaugggaaggcuagacuauuaaaguuuggauaauucuuacugugaaaaaauccugauauuggcuaaauuagguuaauauugaugguuuuuuuaauuguuuacagauguuuauuuuucaccauuugauacuguuaagauugagguuaacuaaauucaggaaggaaauuaaaaguuguucuauauuacagauugaauauuuuaagaguaguuugacuauuaaaaugcaaugcugaauuauuacaaaaaugaaauauaaauagucaacugagggcauuuuagagucaaucuagggauaaaguagaaaaauuagagacuuaggaaagcauugcauuaagcaagacuuuuaaaacuauuuugguguuuacagaucccuuagggaaucugaugaaagcuuuguauacucucuccccgggaaauauauauauagaaaaaguccauaauguaagaugguuccuggauuccccuucauucauaaauuaucauuaauucauggacuucuaaguuaacagccccugguguaauggguugaaaauuagagccagugaagaaauaaggaaguguauauuaauacucucuagaagaauaaagagggaagaguuaauuagaaauuucuaugcuuuaugaaaaugucaaugauuuuguccucuaaaauguaaauaaaccauggacauuuauuuuuuauuuuuauccucacgugagcaucuaguugugugugugucuaucauuuugaggugauccuaagguuaaauagauuugguguaggccaaaaggauguaugugccuacaaauagauaguuucauauacaucucucuuauacugcuaauacuucuguuuuauagcuaguauuuuaguuauaugauugaugaaggagguuucucauugcaaaaagauuguugacucccuucugauugcacugaaaauggcacuaaacaacacagacuuaaauuguaguagaaggaaugaaccuaaguguaaggaagaguguccuaacagguacauauugacucuuucauagaaauagaaccagcaaagaaacaaaaagaacuuugguuguuuuuuuuuuuuaagguagucucuuuuuauauuaucuauuuauuaaaauacuuuacagucuugucaaugaccuauauucuguacuacauaggccugauagcuugggaaauuuugauucagaagcauuugugaaucacugaagugauuugagacagauaucaggauacucauggcaauacuaggacuaugauuuugacaguagcuuuuuaaauugguucuggauaucuuacauuugaauggcguacauuuguuugauuauuuuucuuaaacuuuuuagguauuucagugaaaauuacacuagugaagcucaucagauucuuucccguucaaaucauccaaaauuaggguaagcuggguauauuaaagaagccguaaucucuugcauuuauaaugauuagaugauuuaaugaauuugaagguauaucaagguauuucuuaaaauaaaguauuuuaauaagaacuuuuuaaaggauauuacaugauacauuauuuuuaaggaaaaaugugauuguaaaccaauuuuguauguauuucaguauauuuuuaucacaagauauaguuuaucuauacaauggagauaagggcccuuauaaaaugcuuuugagaaauagauuugaagauaggaagaggaaauaguuuggaaaaguaauaggaaaauaggaaauagcuuugaaaauuguaaagugaaauucaaacugaggugguuuuauuagcuuuaccguuauuuuuaaaaauauucugaugguaucuaaucuuugaaaaagcauaguaacaauguuagaucauaaaaauaaguacccugauaauggagaagaaaauaucagauuauccagauuauccaguguauuuuagaaaucaaugagauuuggugucuauagucccccugaccccuuuuuuauuuaagaauuuuaguuuuagauaucaugugaacagagcuuuauuuuuauuucuuagauuauauccagaaaaauauacaggcuuuaaaaagcaaaaauguuaaauucuuucuaguauauuuuucuuaccauguagagauuaucauaaaaucaauacuguguuaaaccugaagucacuuucuacuaauuccuaacauaauuuuaauuuauuuuaugaguuauuuggcuagcugguauaacugguaauguuucugacauagguauucuuaugcaauaguuggaaucaaucuuacagagauggcuuauagcuuacugaagagugaagcuuugaaguuucaucucuauaaccuuguuccugguauaccaacaauggaacacuuucaucaguuuuacugugaguauuaaaaugaguuaaaacuagaucuuucuaagauaauucuuaaaccacuaggaauguauaauauauauuuuaaucuguugucucugugaaguauauaacuuauguuuaucauuuuauuacuuagggucuuugaaaaacaagaaaacaguggaagauggguccccaagaguauuccauacuucaguuuuuauauuugcugauuauaaaaggcaauauuucacauguagacacaucuaagauucauguaauuuuucucuaggcauucauuuuccagcuaacuacaaaauguauuuucccucuuggaugcugguuaaugaaugcuguuaaggacagaccauuugcagauuauuuuuuuacuuuuggaaggaaauuuaauuuagaggaacuuuucgccucccccugccuugaauuucaaggccaaauuuucuugugguagguuagagguacugaguaacuguuccuaaagcugucuuuacuuucucuguuccauucacuuuuagugauaauauuugaauacugaagguuuaauugaaugaguccaucuucugaagcuauuguucagaagcaaagaacucaaaucuaguuuuucuucacacaguacuuuucuugaucuuuuuaugucuuuagaaugucauuugaauguugguagcauauaagaaacuacuuagauaauagguggccaaaucauaauuucuucaucuccauuguugaaaauauccaugucuccuuuucgcagaaacuuuccugccuuuucuuacacccuaauuccaguuuugucugcaucuuaacuuucucuugcaugugucuguuucuuucuauacccauuguaacuguacaauaucaggccuuuguuacuagguuacuauaauggccuuuagcaguuuuuuugugguaacacucuucuauuucuucuccacauugaaaguauaguuauuuaaaaugaaaaucugaucguuuuacuccacucccaaaaauuauucaaaggauucccauuauaaggcccugcauaaucugaaccuugguaaccucuccaggcucaucuuuugccauauaccagccccccucucacccccacagacucuauaguggaggcaucccagucuucuuuuuaguugcucaaauauauuaugcucucucuugacucugugccuuugcaagugacauucacuuggccugaacacuguuccagcucccucuguucuuuccaggugaugccuucucgccuuccaaaucucaguuuagacgugcucuucucugggaaguuuauucauuuacuguguguuagauguuguucuaggcccuggggauguagcagagaagaagacaaagucacugcauuuggugaggagcugucaucuucagaaucaaaacuucccccuagugcaguguccaccuccagauacugcuucauuucucugcucucuuuguucaugaaacuuuuucaauaauugcuuuuucauuucuucaucuccaguuuuuaucuaauuccaauuuaguuucucucuccaugacucugcucacacugauuuuucucagacaccaacuuuuuuuugccgccuaauacaaucgccauguuuuuucuucauguuauuugauccuuuuaguggcacugggcauaaaugaccacacguuucuuuucgaaacauuaucaugacuuuucugaugccacauucuccuggcuuuucuuuugccccacaggaauuccuguagacauccacugccuuacuagauauagggagcaccucagggcccagcccugugcccacuccucucuuuagcccucauacuuuuccuaagugguaccaucuggucccuugcuugaaaugccaaaugugcauuaaaugccaaaauguauaucuucagcccaaccucugcuuuaaucccagcaacuguauguccagauccuuuuucucccuuaauggauaaggauaaagaaucauaugaggaugcuuaaacaaaguaggagccaaugcaacaugucuuuaaauggagggaacagauuucagguuccuaaggacagcauugaugauucuacccaaguguacugaagauuucuagcaggcgugagaugcuuuccuuuaccauuccaaaguguuguugcugggacuuugcuaacuugccucuaauuuuuuuuuuaaaugaauauaucccuuguucauuagcuaccuauugaacauaaauaacauaaaugagauaucaugucacaccaguuagaauggcgaucauuaaaaagucaggaaacaacaagugcuggagaggauguggagaaauaggaacacuuuuacacuguugaugggacuguaaacuaguucaaccauuguggaagacaguguggugauuccucagggaucuagaacuagaaauaccacuugacccagccaucccauuacuggguauauacccaaaggaauauaaaucaugcuucuauaaagacacaugcacacauauguuuauugcggcacuacucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaagcuggaaaccaucauucucagcaaacuaucgcaaggacagaaaaccaaacauugcauguuaucacucauaggugggacuugaacaaugagaacacuuggacacagaaaggggaauaucacacaccggggccuguugugggguugggggaguggggaggguuagcauuaggagauauaccuaauguaaaugacgaguuaaugggugcagcacaccaacauggcacauguauacauauauaacaaaccuacacguugugcacauguacccuagaacuuaaaguauaauaaaaauauauauaaauaaauguaaagagacuaauguaaaaaauaaauaaauuuuaagaagagaauuagcuacaaauaagaaaacuaaaguuccuuagaacuuaaaaaauaaaucuucauaaaauuaaaaaaaaaaaaagaauuugaaaacuccccaaacaauuaagcaguuucccauaucucaauauauacaggagggugguagguuagaaagcagugcagaaugaccuuugugcaguauuuuuccccuaaagaccagggaacuugaggaucugugggaacuguugcucuccagcacccugacaccaucucggcuggcuccucuauaggaaggacauuaaaguguaauaucugagguagaaaagucauuguagaacccuuucaguugccuccugucagcucaaucuauaagagcuguagaucauccuggaaacagugaagcuuaugauuuucaauuauuuugagacauuaaaaugcacauaugcauauaccuauguaccuuuuaagcagaaguuucccaaaaacuucauucuuauacccauuaccauuggaaguuucacaucuuaaauaagguucugcuuuucuucuuaagaggaaccuguucuaacuagaauaauaacuugaaaccuugucuuugaaugugcauacuuuuuugguagaggaguaggauaaauuaguuugcacaaauuaguuccaaggucauaguuucucuccagaaggaagaacaguucagagaugaguuuccacauuuuuuguuucccuaugaucugccuucaucucccucuuuuccuuugaucgccuuuguuuuaaugcguccuguguaggaagggcuggaaacguuuguaguuuagcuuuuuagcuccauugucaucuuguacguccaaacugugagcagcuauccgccaugauucugggaaguuaccacuaguccagcaggagggcucaggauuuugggaccucugucuuuuguauauuccggucuaggaugucuccauucuaguuuuguagggccaaaauuuuagcuggacuucugguuuggugguuccaaaaaaaaauaguaacaccucaaguuuguauaauaaaguuaugucucaauaacaacuuuauugagguauaauuuauauaacauagaauuuacccaucuuaaauauacacuuaaauggauuuuaaugagcuaaauuggguagccaucaucauaauccacuuuuagaacauuuucaucaccccagugagauacagguuuacaguuaaucccccuuccuaugauuuucuaauccuuaaccucugcaguaaauucaugcagggaauuucagguuuagacauuucauaugguaauuucuacagagucuuaaguauuccaaacaucuggacucaaaaggacaaaauaugugcaucauggaaaacagcucuuuuccaucacuuuuugcaaaacuuugggauucuuaugccaaggauggcccugccaguuuccuagaauuucaguauuuuuuccugugguuuccugaugucacauuaaaucacuuuagcuauuauagucuccguucuucaaguuagucuuucucugacacugauuuauauuauagaucaauagccucacucugaagcaagaaguuccuagugcuuuaacuugagcaguuuguuccaggcccauguagucauuugaaugggccacauuacugacaguaaugaaaaagcaauuuaaaggacauaagaaugguaaauaucuaaaacauaauaaccagauauacugaaacaaaugguauggccauaaaauuuggauagcuaucugccuuaucauacuaggcagaacauuaaucucuaaauguauuaauuagacaucccuaacaguguaugggggauagagauagcagaugguauuucuccagaggcuucauuucuugauuuuacccauauaucaugguugacaaaaaucuguuuuaucauauauugagaauaauccaaaaaucuuucuuaaacuggccuucuuaugaaaugauauuucagugugggaauaugaugauuuuaaccauuaauguuugcuguaugaccaauauuauuaaaaugggauuuccauuuuacauaguaagcaaucaugauagucuagccacccuuuuguguaaagucauugacuuuugcaacagagaccacuuacaaacugugugauuuggggcacaucauuuaacuucucugcaccucucuuucaucuuugguagagugggaauaacaacauaguacuugcauccuagggcugcucugacaguauaugagcauuuagugagcacuguagaaauauuuuaaaaaauaauucaauaaauacauuugauuacauacaaaguaggacuggggugguuuuauuuuuugcuuuacuuuuuaacagcuuuguuaagguauaugauaaacugcacauauuauaugacauaugauaaacugcacauauuuaaauauguaugauuugauaaguuuuaacauauguauacaccugugaaaccaucuccaugauccaaauggugaauauagucaccaccucugaaaguuuuuauguacuccuugguaauccaugccucuugcuccuccccccaccauccuaggaaccacaauuuuuuugucacuauagaugaguuugcauuuauuuucuagaauuguauuuaaguggaaucaugcaguuuuuacucauuuuggucugguuucuuucugcauaauuuguuguguguauuaauagcuuuuuuauuuguuauuuuuuaaaaauugacauauuagcucauuuauuuuuauugcugaacaauauuccauuauaugcuacacauuguuuauguacuuguugauagauauuuugauguugggugguuuuaaauucacauuuaaguuuacauauauguguguguguguguguguguauaaacaaguucgguuucaugaaauacauuuaacauuuuggggguuaauuuggcuaccauaaugaggauauugaaagccaaaaauauuaagccgauuuagaguggauguauuuuuuuaaaaaagagaagaugcugauaguucauugaaaaaaaaguagaaauaacucuuagauuuagaaaucgaguaggaaauaacuuuccuacacuuuaaccuuauccaacauuuuuucguuacuugcauuuuugugcuuuggaaguuucucgggaaacuuuucucaagguaucuuuugaaaguacuacaucuuuuuuuuuuuuuuuuuuuuuuuuuuuuuugagauagguucucaaccaagcuggaaugcagugguacaaucacggcucacugaagcccugaccuccugggcucaagugauaccuuuaccucagccucccaaguagcugggacaauaggcgcaugccaccaugccuggcuaauuuuuguguuuguugcagagaugggguuucaccauguugcccaggcuggucucuuaaguccuggccucaagcgaucugcccaccuaagucucugaaagugcugagaguucagguaugagucacugcucccaggugaaaguacuauaucuuuuaaacuugagggacguuguugauuuuugagacaaauaguaaauauacacuaaaucguuuauuaagucuuauuaagucccucaggcuucuaauaguuuugagauuacuuuugauuauuguauucuaauauggaauuuaaaggaugguuauauacuuuguaaagaugagacgguuugaaugugauuucaacauugaggauuaaauguuuuguuuuucuuuaacugcagguuaucuugucuaugaauuugacaaguuuugguuugaagaagaaccagaaagcauuauguauuucaauuuguauagagagaaguuucaugaaaagauuaaaggacuuuuacuggauuguaauguagcacuuacuuuaaaaguauaaaucauccacuguaucuucuauuucuaccacauuuugcacauucaacagaauuuauauguuguaauaggaauuaucugaucaauuacacucuuauauauaauuuccuacaaaaauauuucagaaauucuauuuaagaaagcuaguggacaaucaguguauguuuacaauuguuuauacacuguucuccaaagguaccuuauccuuccaaagauccccucuguagagucaugcgaacuacaguuuggaacuugggacuuagcccguugguguaaaaguauaaaucagguauuuguauuaaauugauuaaaauguguaaaaucaauuuucguuuuuauguguuauagggucaaguugguaucuuuuucaaagcucuuuaagauuuuuuugguuuuuaguuuggaaauggcuguuuuuaauuuugucugauuuuuauuucuagguuaauuaacagcaaguguuucuuuaugguuuucuuuguuugcaucuuaauuacaugucauaacguugcuucauuaguagcaaauagagcagagauacagcagagagaauaaagaauuagggccuccuuuuggguuucugugauuauugagcauaacugaugagagaaugacaguauuggugacuagcuuuuuuguuuuuaaauaacacacuuuaaaaugccacaguguuauuugaaagcuuaaaggcauuuucucaucuucaguauuugcuuuuuaucaguuguagaaaagaaccuuaguguuuucuucucuaccuauguaugcuuaugaaaccgcucuaccuacauaugaaacuucucuaccuauguauguuuacgaaaagagauguauuugccaagaaaaucuugauuauauaaaagacaaaaagauuauaaaagacaguuucuguuuaaguaaaacugucuuugaaacuuaagaaagcuuaaguuuuaaaaaaaucucaguuaaacaucauugguuuauuugacuuacuguuaacucuugcuucucuuugacuccaugguguuuuuagauaaccauguaugaacuuuauguuaaugguuugugggauacuaaaauagcuugaagaugacuugaugacugugcauuuuauauaguuuuauucuccuaaaaucucaggagggcagcaagugcugucaacgauuauauagugaugagauuuuuaugggaaugauuucuucuuggugcguuuuacacauuuguacugauagcaaaacuaaaguuuaaagcagcaaaguuuaaguucuccuuaaauccuacagaaaccaaccuuuuaaggacauaauuucaucuaaaacaugacgauauuuagcacaccuuuuaauguggguauauaucaaguguuuaaggacuggcuaguaugugauagagcaagaccugagacuuuauaaguauuugcucgugucuguugacagaccucuuucuuucaaacuuguuagaagagugguaagacauauccaauuggaaaauaagaugcaguguuguauagcacauacauuuaaagugcuugcguuaaaauuaguuucucaauaagauaaaauuauuuuaaaaauuugguucacuuuauuacaauaguggcaauuuagcuuuucaguauuacaggaauuuaaaaauugguuucuuguaggggacaucucaacuuugggaauaucuucacuuaauuuuuaaaaaauauuuucaugcuuuauuguccagcuauacaauaugucgcaaaauccugacaaguucauuguauuaagguauuaacuauuacauggaaagcaauucuguucaucuuuugauguuuguguugaaaaugcuuaucuuuguguuuugaucuuccaacagcugagagcuugaacugauuuaaacauuugucaauauacuuaagaaugcuuuaaguaaagaaggggaaaauuuuaaguaaguuuuuucccuucuaggaagaaaaacuaugaugauguuaagaaaaugucauuauagagcuugcucaauaauauguucuuuaaauccaccuccauuuguacauuauagguaucauucuguuuuugcuuaaaauaaucugcaaccauuucagauaguuuuacagcaaauugaucuaaaagccacuaauaaauucuaggguuugagucuagaagccaagcaaacugucaccaaugucaguuguaaauuagaaugcaacaugaggcuucagacucaugacaaugauauacaugaaaacaaaaauauaauugugucuaccuuccuacuuucccuuuugacauauguaguuggaauuuuacauagucuuaaaauccauauuuagaaucuuaccuguuucuauaauaauuaguaaaaugccaaaguagugauagaauauuguggcauugaaguagccgaaaaauuguuaguuuuagcaucaaaaaaguaaauagauguugaaaugaauuuuuguaugugccagguugaagagagugugccagugacaggaaguagucuaaaaaauuaacaguuaugguuuuaauaggaucugaaagacaaucuuuaaagaaaugggagaaauuggggguaucagugaaccuauaccaaccucucuuuguacauaaauauggugauguagcuagauauaaaaaucagugucuuacuggcaccauuuacaguuuagaaaacaaucuuuuucuuaaaaaugcccaucugauuucuauuuuuaggagcuacuuggauuuguauguauuuuuucuacgugaaaauauauguacucuucacuuuuguuccaguacuauaauugcucaugcacucuuucuccccuuugagaacauucagugaaauacaacuucaucaaagauuugcucaaaggagaagaaucgcaugagugugaaaaguagaugcucguagccagaacagaaaagguuacacaugaucauggcacagaagauaggagguuugacuuggugggccauaauguuuauuauccuuuuugaaauaacagggaccagcagcaguuuucucaggauaaaugcucuaccccacuucucuaugaacagguguggggaggcuuacuuuccauuuucauauuuauacaccucucuacaaaagcaauuuuuaaugaagguuaguggaauuguuaaaaaucugagaggaaugaugacuggagguguuugggguuuuuuucuguauucauuuuuuaaugagaaaaguuuuaaauguaguacagguuagacccaacuacuaccuuacuauuauaggacgauucuauguuucuguuaaaguauucaaguagcuuucucugggggaaaaaguaccacuuggacacuuaaaggaauugggauuuuugucuacuuuggauaaggcaguugacuucuuaaguaaaagcaauaguguaaaaugucauuuuguuuggaauguuaagugagcaaauaaaaaacauguugaaauuguuguaagccuuccuguugauacuucuuuuuuuccauauucccucauuuagucauucaugcucauuaaacauuuuucuuauuuuucuuaucguguugcuguagguaaaucagaauauacagaaaaaaguuuugauuuucuugacuuguuaacugcugauuaccuauuuacaguguugaaugagaaacaagugguuaugagacugaaaauuuccuuuauuuaaaaagaugccaccaccuccaccugccccuucuuacaaagaguaggaauaauucaugcuaaacugcgcuguuuuauucuuaacuuuacguaaaaguucuauuauccaucauaaaguggaucuauuuacauguuaauacaucauuuuuuuacagcugcauagcauuucugugugcguguguguguguguauguguguauaucuuacuuugaaauaaaaauagguggaucugguu

SEQ ID NO: 15671 - RNA, 1104 nt, Homo sapiens
gaugucauagguggccccgaugcacaaagacuugucccaggacacuuccccccaaaaacugaugacgaaggccagggcuucacggggcaccccuugguucaggaagaacuuuaggcccucagaaaacuucuugugcuucuccugccccuccagcuccuuccugcguucuuccuccugugcugacaucuccccauuggcaggaaacucauccaccucgggcuccuccucuguggcaggcaccaccacgcgggccaggcuggcagugagggcagccauuuucuccauggagcucucagaguccaaugcaugggugcccucacuggccuuugccucuucuugggccugacccucgagcuucaguggguaguggagguugagccacugguagagguggaaguugaugaagcccagcagggugcuguagaacucggugaagguggccaugacccuguaguccaugucuguuggguggucaugggagaaggcauaaguggugauucacgugaugggcugucccaggaccuugaccugguaguaaaugccuuugauggacaggaagaccuuguggcagggcacuagcagcgaugauguagugcaugaacuccauggugaauggucugcacauggcccuugccaguccgugggaagguggaaaagaggaagcacauggagagggcguuguccaggucucgcagggcaucagugaacguaggguaccauuccuugaugaugcggucaaguuuguaguugggcuuauuguccuuuagauacucuacaguguuuccacuugcucuuccuauaggccuucaggagcuuccggauuaacaccuuguauucccagaacuuguugacaauggguucauggaggagaaaccugaugucuucgauaagguaaaaaguuugggcugcuguagaacguuuguuaaccuucuucuuguguuuggguucauggggauaaaugcgcuucagaaugcacaacugccuaaagucagccaggcucagcuggagcuucuucugggcuuuauucugggugauguaguugguggcugagccucguucauaauucuucuucccaaggccucccauggcuccacguugaggagc

SEQ ID NO: 15672 - RNA, 3750 nt, Homo sapiens
cugagguuuagcaucagucuuuaaugcugucgcacuucauugacuagucacacacuuuggucucauguuggcaguggcaacuuacaaugagucuaaaggucugagcacuggacuggccuccagggaacagacauuuguuccaacuccccuucccuccccaagauuucuucagaauuccauuauggcccuauacagagagcacuggcugccggggacagguuuugaguguacaccaacuauacauggaauuauaaaaacauauuuacagacguuccacagugcuccuguaaucagaagcaaagacccuuuuaucaaaagggauuguaucuagggcugugcaaaauucaaaaggaucagaucccuuugaaagaguccauaguccaugaaacaaaaaauuaccugggccacugguaagccccacgugugccaagauugccuuacagaaauguaaagagugugacccacaaagugaggacauucagcuucacuggagccagaggucaggaaggccccuugcugaggccaggcucccagaccaucaagggagagguggcugcacuugcuggagucacucacuggaggcuggcucccuugguccugcuggaacgagagguauugcuuguggacgccaaccaggcaguucugcaggaauaguuuagguucucaauuugagauggccaaagagaagacagaauucuccaggagaagagcaagacaugggagacaaauacagaauaaagcacaaacugaucacacaacagaaaaggaggaguguacagggucugggaaucaagacugcagguugacauuaucuaccagccagaagcaaaaagacacagagggaucaaguccaucugcuggucugccucucaccccuggccagggacuggagguggaugugggcccaucccgggagggcugccagacccaguggggcagacuggaaugccuuuuccugcuguucccaccaccugaugcccuauagcucgaaaaaccacugaagucuagugugcgacuuugaaagauuguaauauaugcucuggaaaacauucagcaguacgaaagcccucccugggcccucccacccucucaugguccacaacugguagaaagguccagaaauccuugagcucuggaaaggucccuggucaguccuuggggagcucagauagcuauauuggaagaaccugcucaaguacgguucuugaugucuggggaauccuuucggggaagaucacuucaaacucaauaaugagguccccacguuucucggguguuuuggggagggggaggccuucuccaggaacuuuucgccgcaugccaggccugauaacaucuuugaauacgacggguaucguccugccguccagaguggggacguucacugugcagccacacagagccuugaaaagcaaaaggacagcauuagauggaagcuggcucaagaggcucagcucuugcccagaggccgucugccauagauaagacccaucaggccucugcagcuaagaccuggcccccaaaucuacacguccccaccacgaaagcuccacaacagcgcccuggucaguccuguucacuguugugccccaagccuggcacgcaccacacaccccaacacauugguucagcaaauacuaaacugcuucaaaaagcagccaucgcccucuacagacaccgccccaccuggcaccuuaccucccggaggcugauccuggcaggauaaaugacaucagagccaucucucuuaaagauauuguggggcuuguccuuuaaaacaaagacgauaucagcuggaauguuguuggaggucuggucuccuuccuuggggaaagugauuuugguuccuucuuuccaccccuucuucacuucgauggucaauauuuugucuucguuucgaaugcucuuuccgucgggguuuagccgcuugugggagauuuucaucuucuugguacagccgcuguagaucucuucaagggagacucgaaggucgugggugacugggggaucuugcuucuuucgggcgggcucuugggcagagcgggagcggccaaaguucacguuggugaagccacccaugcccauagggaagccagagaaugggucaucaauguccaugccuuccuccccguuccgcugcccaaaaaaggugucaaagggauuucugccaccgaagaacucagcaaacauggcaugagggucuccauggaauguguagcugaaagagguaccauuggcaccaccgccgcuaccgccacuggggccacuccccuuuaggccugaaaagcagauuuagaagcagucagauggcugaacagcagacucucucucgagcuucccuuacagggggaaacagcuuggaagccaugggggaggaacuuuuuugucugucaggggagagcaaggaagaaccccaaguuucuaccucucacugccaacagcagagacgccccccuaccaacaguauuuccgcguagccugacaguggaaaaggacucaugcgguuagguguucaccuccaggugccaccuaggcccugccacuccuggacugacccauccuccuggcaacaucaccaagagauggcuaaagacacaugguccagggucggcuuucgguaaguguuuacucucaacguuuuagggcuaauggugcguaggaagagaagaaaaaaaaaaacaaaaauaaauagggaguuuuuaaauccucacacauuagcauucacugccaccauccuugcacaaaaagucagcuccagaucaagcccagaagccagccugaaucaucaacgggcacaggaacaaaaagcccugcucuccuuacccuccgaggcggccccgcucuccggaccugggcggccgcugccuccugcgugcccugccggggccaggucaucacuucccgggaauuaucccaacccagcccccaagcccacgaacggggucggcuccugcauucacaaccccucgccccgcagcugagccggaggcgccgccccgcggaccccggcggccgagcccaggugagcccggguccgcagcgggcuccgccgcgccguccccgucgucacccccggcucccccacccccaugcaccgcaccccggggcugcucggggccgcgggaggaggcgcccggggaggggcagccccagacaugcuagaagcuucuggccgagcggcugggccaaggcuccuccucccaccgcgcggccgccaauccgagggcggaggcccgcgaggccggagggcggggcagcucggccccacggcccggggcguccuucccggggggccgccgagaggggccagcgugccucaguuucccugucugucaaaaggcggggccgcgccccuggccgcgagcacacaccuuccuccccguagcggucgaagaucucgcgcuugcgcgggucgcugagcacgucguaggccucagcgaucuccuugaacuucuccucggcgccgggcuccuuguucuuguccgggugguagcgcagcgccuggcggcgguaggcccgcuugaucuccucguccgacgcgccgcgggccaggcccaacgucugguaguagucuuuacccaugacccccuccugcggcccgccgacccgcugucgccgucccccggcuccgccgccgaccagucccggacucuauauacccguccggcggaagcuuccagagcccgccagcccccuccagaaccuuccgccccgcccgcccccgcggcgccggccaaucgccgccgcccu

SEQ ID NO: 15673 - RNA, 863 nt, Homo sapiens
gaagugaagaagggguggaaagaaggaaccaaaaucacuuuccccaaggaaggagaccagaccuccaacaacauuccagcugauaucgucuuuguuuuaaaggacaagccccacaauaucuuuaagagagauggcucugaugucauuuauccugccaggaucagccuccgggagguaaggugccagguggggcggugucuguagagggcgauggcugcuuuuugaagcaguuuaguauuugcugaaccaauguguugggguguguggugcgugccaggcuuggggcacaacagugaacaggacugaccagggcgcuguuguggagcuuucgugguggggacguguagauuugggggccaggucuuagcugcagaggccugaugggucuuaucuauggcagacggccucugggcaagagcugagccucuugagccagcuuccaucuaaugcuguccuuuugcuuuucaaggcucuguguggcugcacagugaacguccccacucuggacggcaggacgauacccgucguauucaaagauguuaucaggccuggcaugcggcgaaaaguuccuggagaaggccucccccuccccaaaacacccgagaaacguggggaccucauuauugaguuugaagugaucuuccccgaaaggauuccccagacaucaagaaccguacuugagcagguucuuccaauauagcuaucugagcuccccaaggacugaccagggaccuuuccagagcucaaggauuucuggaccuuucuaccaguuguggaccaugagagggugggagggcccagggagggcuuucguacugcugaauguuuuccagagcauauauuacaaucuuucaaagucgcac

SEQ ID NO: 15674 - RNA, 27764 nt, Homo sapiens
guguguaugcagcgccccugggucuguguuuuuauugcacuuuccugcuggcuuccagcugcaccgccaguuccggggagggcccugggccagcggcuguccgcccccccuccuucauaaaguccuggccucgggacagccugcacagcugccuagccuguggagacgggacagcccugucccacucacucuuuccccugccgcuccugccggcagcuccaaccaugggaggccgcgucuuucucgguaaguacuuuggggccccgcugggaggggcgaggaagcuccagcgggaccccuuggcugcgucugagaaacgggaggcgccgcuggugucuguggggccugcgauagaggaagccacauggucaagcaggcacucacgggcacacggcgagaggggcugguggugcuugggcacccccacaccccggcaggaacuccagggugcucuuggagccugcuacccugccuggagggauccucaagcuuucuacuggagccagucuggcaucugcucccuaagaggggaaacugaggcacgggggaaggaaaggggcaaaaagugagugcugggacccugagagccgcugugcuuaauauaacgcauagaaggacaugggcggggguggggaagcuagaagccaggacuucuccacugcaagguacccccaauuugucccucgcagucucagcagcaggggcagcccccagagaccccaguucuugcuccccgcagaccuggcuggggcucagcugcggaucgaagggacuuugccugguucuggguuugaauuugauuuuuguugugacuuccugggacucccuuucccgccccacccaaggugacuguaacgguuaucaggguagcucguugccuaagcaacggggcaacaaagagagugaagaaaugacauuuggggcaaaaaccagaacuuccuggaccacagggacacagcuucccugggccagccccaaguggcaggugucagcucagcaccccgccuuggcuugagagugagagacaagagcccaccuuggguuucuugggggcacacuuguugggggcaguugccaagaccuggcuucccaaggguuccacgcccuggcugucugugucaccagggccaagucagagagccucugcgccucacuuuucucaucuauaaaauggagcacaacccgucuccgucuuagauuguuuuaagggaugagugaguuaggacacaaacuauuccugguucacaguaagaauuagguaaacagcauuuuaaaaguguuggcugggcacaguggcucacaccugcaaucccagcacuuugagaggccgaggcagguggaucucuugagcccagggacuggagacuagccugggcaacacaucgagacguugucucuaccaaaaacaaauuuuuuuuuuuuuuuuugagacaaagucucgcucuugucgcucaggcuggagugcaauggugcaaucucggcucacugcaaccuccgccuccuggguucaagcgauucuccugccucgcccccauccaccccgaguagcugggauuauaggugccugccaccaugcccggcuaguuuuuuguuuuaguuuuuguguuuguauuuuuaguagagacgggguuucaccaugauggccaggcuggucucaaacuccugaccucaggugauucacccgccuccgccucccaaagugcugggauuacaggcaugagccaccgcgcccagccaaaaaaaauuuuuuuuaauuagucgggcuugguggugugcgccuguaguccuaguggcucaggaggcugaggugggaggaucccuugagcccaggagguugaagcugcagugagcuguguuugcaccacugcacuccagccugggugacagagcaagauccuaucucaaaaaauaaauuaauaauaaggccgggugcaguggcucacaccuguaaucccagcacuuugguaggcccaggccagcagaucaccagaggucaggaguucgagaccagccuggccaacauggugaaacucugucuuuacuaaaaauacaaaaauuaccugggugugguggcgggcgccuguaaucccagcuacucgggagccugagguaggagagucucuugaaccugggagguggagguugcagugagcugagaucacgccacugcacuccagccugggugacagugagacccugucucaaaauaaaugaauaaauaauaaauuaugaugauuauuaaauucugguaagacacuagugggucuggggaauugucucgggguccuuaggaggaagccuaaagaaggggugacugccccaccaccccccaccccaggaucucaaugcaggaaacugacuacuuagggcucagcccagagaaugcaaaccagaaggaacucaaaccagaacagcagcuucucucccggcuucuguuugggcaacuuccaaggccccagauggaggcagcugggcccuguagccucacggugggaguagagaacccagcucagcccaugcagaggggauggggcacaaaggaacccugcccagggcccugaggaccucaaucccucaauuccuccuuccccaaccucuucuguuuauuggauuccuccugauccuuuucugggcuccaagccucaguuucucuaucuguagaaugggcaucaacacagccccugccuccuagagugguucugagcuuuaaaggaguuaccuggggcuuugggaguuagagaugaaucugccuagauccuguccugccaggggaggucauuuuguggucuguucugcaaagaggaacuggguucuggccgagggaggaacuagccaagccuuguggccagagaggaggaagaggggaauccugacagaaguggggaguacgggcuugggcugggggguuucggccuugguuuaacccagcuggaaggaguguggaggugggaguggggaucucugccuuccacccaccuaagggguacuaaauuugaacacaguggcugagugguccggggaccuccaaucugcaccccaaacacccgcccucugaagcugugcucauaacagaccccaaaauuccccuggaagccccuccaggguugaauuggggcaaaugaguggugagucauuccuucccuuaggcccaggaagugacucaugcccagccguuguccugguccccaucccucugcccgacaccccccuucaggucucccuggauuauugggguccccaguauucccagaucggcagggacuggacguccccucccagcccgccccaggccccaccugccgcucauaucccaacgcccuccguuccccugcccuuccccucuguuuccauccacccuccuuucucaugguuuucuuucuuccucacuguuuaucucucugucucucuguucucucugucccaucuccuccuguuuccccuucugcucuuuaugggccccuuguuucucucuccaccucucucuaucaccauguaauuucugucucucugucugucucuaucucuccgugucucugucuccucugucuuauauuucucuagcugucuucuuucuccucucugucucccucucucucuccagcuugucuccuuucuccucucugucuccgucucugucccucuaucucucugucucucucucucuuuguucuuuucuuuucuuucuuuuuuuuuuuuuugagacucuugcucuuuuuuuuuuuuuuuuuuuuuugagagucuugcucuguugcccaggcuggcgugcaguggcgggaucucagcucacugcaaccucugccuucuguguucaagcgauucuccugccuccaccucccaaauagcugggauuacaggcgugugccaccaugcccggcuaauuuuuuguauuuuuaguagagaugggguuucacuauguuggccaggcuggucucacacuccuggccucaggugauccaucugccucggccucccaaagugcugggauuacaggcgugaaccaccaagcacagccccccaccuucugucucucugucucuuugugucucugucucucuuucugugucucucuuucuuucugacucuuucucucucucugucugucucucucucucucuaaucucuauuuucucuccaccccugcuucuuugucucuaucucucuggugaacagcaaggagaucccuagguccccaucucugaauccccuggugaccugaggagggucccccagaacaugccuugggagggggaacccccugagugcugggaaccgccacuccacgugcaccccaacaggcggcuacagcgucuuccugugggaggggggcccgggggugaaauaucaccacuggguuccaggacagaccgccagggccaguggcaguuguggguguggugugugugcaccugugucccugaggaagcguggagguccagggcaucucagagccugggugauccaacaccgucauuuuuuuuuuuuuuuuucugagacggagucuugcucugucacucaggcuggagugcaguggcgugaucuuggcuugcugcaacucugccuccuuaguucaagcgauucucaagccucagucucccaaguagcugggauaacaggcacccaccaccacgcccagcuaauuuuuuguauuuucaguagagaggggguuucaccauauuaggcaggcuggucucgaacucccgaucucaagugauccacccgccucggccucccaaagugcugggauuacaggcaugagccacugugccugaccacgccuucauuuuuaccuaaagaaaugaagauggcaggcagggccuggcggcuugugccagcacuuugggaggccaaggcagguggaucacgaggucaggagaucgaaaccauccuggcuaacauggugaaaccccuucucuacuaaaaauauaaaaaguuagccaggcgugguggugggcgccaguaguuccagcuacucuggaggcugaggcaggagaauggcgugaacccgggagguggagcuugcagugagcagagaucacaccacugcacuucauccugggcaacagagcaagacuccaucucaaaaaaaaaaaaaaaaaaaaaaaaaagagaggccgggcgcgguggcucacgccuguaauuccagcacuuugggaggcugaggcgggcggaucaugaggucaggagaucaagacuaccauccuggcuaacauggugaaaccuugucucuacuaaaaauacaaaaaaauaagcugggcgugguggcgggagccuguggucccagcuacucgagaggcugagacaggagaauggugugaacccgggaggcggagcuugcagugagccaaguuugcaccacugcacuccagccugggcgacagagcaagacuccgucucaaaaaaaaaaaaaaaaaaaaagagaaaugaagauggcaggcugggcacgguggcucacgccuguaaucccagcacuuuuggaggccaaggcgggaggaucacuugaggccgggaguucaagaccagccuggccaacauggugaaaccccgucucuacaaaaauacaaaaaaaucagccgggcuugguggcgggugccuguaaucccagauacucuggagacugaggcagaggaauugcuugaacccgggagguggagguugcagugagccaggaucgugccaucgcacuccagccugggcgacagagagagacucugucucagaaaaaaaauaaaauaaauaaauaaauaaaagaagaagaaaugaagauggcaguaaaugcucaggcacaccggacagcagucaugugguuuacucccacacacacuacacuggggagugggcgccaucaucccuauucuacagagggaaacugaggcagagaggcccacugucugggauuugaacuggggaugccuggcuccugucuguuuucuuagccacuccccacacaccccaggucagaagagcagcagcuggagcugagacccccaccaggcucauggcccuucccuacucaguuccugaaacuccacccucaagccgagcucgggaggcugaggcggggaggaucgcuugaggccaggaguucaagaucagccugggcaacagagcaagacucugucuguaaaauaauuuuuugaauuauuuuuaggccggccacaguggcucaugccuguaaucccagcacuuugggaggccgagguggguggaucacgaggucaggagaucgagaccauacuggcuaacacagugaaaccccaucucuacuaaaaauacaaaaaauuagccggguguggugguggacgccuguagucccagcuacucgggaggcugaggcaggagaauggcaugaacccaggaagcggagcuugcagugagcugagaucaugccacugcacuccagccugggugacagagugagacuccguuucaaaaaaaaaaauuauuuuuaauuuuuuggccuggcaugauaaauuauuuuauuuuaaaaauuuugagucaggaaauguggcucacgccuguaaucccagcacuuugggaggccaagacaggcagaucaccugaggucaggaguucgagaccagccuggccaauauggugaaacccugucucuaguaaaaauacaaaaaauuagccgggugugguggcagacuccuguaaucccagcuacucaggaggcugaagcaggagaaucacuugaacccaggagguagagauugcagugagccaagaucacagcauugcacuucagccugggcgacagagcaagacucugucucaaaaagaaaaaaaaauuuagugcacaccuguggucccagcuacuugggaggcugaggcaggaggaucucuugagccuaggaauuggaggcugcagugagauaugauugcaccacugcacuccagccugggugaccaagcaggagccugugucaaaaaaaaaacaaaaacaaaaaaacccgccccuaugggaacagggugacagacucuuuggcuuugagcaucugagugggacaugacaucugcucacucugaacgaccgucaggaucugagccugagaggggucagcauccuccucccacaaagugcaucacccuuacgccuccuuucccacccugggauccccucugacccccuuuccuuucucuguugcagcauucugugucuggcugacucugccgggagcugaaacccaggacuccaggggugagucugcugggaagcagaaagcacaguccacagccagagccuggggaggguccuggacccccgcccagcccccuucagcccagggaaagagagggcucgcgcacgagaaacucagcgcccugccccaucucccccagugcccccuuuuuguguauucccuuaccccucaccuucugaccgugcucccugcucuugcaggcugugcccgguggugcccucagaacuccucgugugucaaugccaccgccugucgcugcaauccaggguucagcucuuuuucugagaucaucaccaccccgacggagacuugugacgguacagaggcuugagggcagcgcaggggacauccgcgauuaugaggcauugcccagccagugggggacagagguuguugugaggggccacagccuuaccuuccagacuaucaucauggccagagaaaagaaaaagagggcaggcgugguggcucacgccuguaaucccagcacuuugggaggcugaggcgggcagaucguuugaggccaggaguacucagaagacugaggggagaggauuauuugagcccaagaguuugaggcugcagugagcuaugauugcaccacugcacucuagccugggcaacagaaugagaucgugucucagggagagggagaggaaggggaagagggagagggggagaggaaggggaagagggagagggguagggggagggagaaggggaggggaagggggaaagggagggggauggggagggagagggggaggggaagggggaaggggaggggaaggggaggggaagggggaaggggagggggaugggggagggaggggggaaggggaggggaaggggagggggaugaggagggagacggggaaggggagggggaggcagagggagaggaaaggaggcaggaaggaaggaagggaggaagggagggagagagauaggcccggcauggugggucaugccuguaaucccagcacuucaggaggccgagguggacagaucacuugagguugggaauucgagacuagccuggccaacauggugaaaccuccucucuauacuaaaaacacaaaaaauuagccggggguggugguggucaccuguaaucccagcuacucgggaggcugaggcaggagaaucgcuuaaaccugggaggugaauguugcagugagccgagauugcgccacugcacucuggccugggcgaccagagcaagacuuugucucaaaaaaaaaaaagagagagacagagaaggagagaaagagaaagaaaaguaggcccggcaugguggcuuacgccuguaaucccagcaguuugggaggccaaggcgggcggaucaccugagguugggaguucgagaccagccugaccaacauggagaaaccucaucucuacuaaaaauacaaaauuaaccgggugugguggcccaugagcacaugcuuguaaucccagcuacuccgggggcugaggcaggagaaucgcuugaacccgggaggcggaaguugcagugagccaagaccgugccauugcacuccagccugggcaacaagagugaaacucugucucaaaaaaaaagagaagaaaagaacaagagagagagggagggagggagggaaagaagagggagggagggaaggagggaggaaggaaggaaggaaggaaauaagggaagaauaugaagggggagaaguaagaagugaauaggcauggcuuccuggagagagagaagcugggugcucaggaaucuggagucugugccucaguuuacccuuaagacuggggaggggguacauucuggcuaugagguuuuuuuuuccuuuuuuuuuuuuuugagacagagucucacucugucacccaggcuggagugcagugacccgaucucggcucacugcaaccuccaccuccuagguucaagcgauccuccugacucagccuccuaaguagcugugauuacaggcaugcaccaccaugcccagauaauuuuuguauuuuuaguagagacgggguuuugccaucuuggccaggcuggucucgaacuccugaccucaggggauccaccugccucagccucccaaaaugcugggauuacaggcgugagccacugcacccggccgccaugggguuuaaauuucuacaaagagacuggggauggggauguggagcuuccuguccaucccucaccucagcacuguucacuguguccaaaucuaagaugccagccagagaacuaagaucaaguguggucuucaggaauggcuugcuccagcugcagcauagccugugcagugcaacuuaagauuuuuuccaaaagauacuaagcagcaggccccauguuggggagucaggaugggggucucugcccugacagaacucacaucuuugggaggugacucccuguccuguuguguuccagacaucaacgagugugcaacaccgucgaaagugucaugcggaaaauucucggacugcuggaacacagaggggagcuacgacugcgugugcagcccgggauaugagccuguuucuggggcaaaaacauucaagaaugagagcgagaacaccugucaagguaagaaccaccccacguccucugacuuuccauccaugagguuuggggucaccagagccauucuggcagcauccagagagcagggccuugguuguagggucagugccuggcgucugagaugggacaggugcacauguaccuaccccaccaccccagagaggcagagugaugugaggauuaagggcugacucugggaccagcugccugggccaaauccugauaaccaaguguaugacguuggccaggauacuuauucagaaaccgcuguccacaugugagaugugauaacguuaucaugcuuguaauuccagugcuuugggaggcugaggcgggaggaucucuugaggccaggaguucaagaccagcccauagcaacauagcaagaccccaccccuauaaaaggggaggcgaaggcagguagauuguuugagcccagggguucgagaccagcaugagcaagcgggugaaaccccaucucuacaaaaaauaccaaaaaaaaaaaaauuaauuagccaggcauagaggccugcgccuguagucccagcuacucaggaggcugaggugggaugauugcuucaggcugggaggucaaggcugcagugagccaugaucaagccccugcacuccagccugagugacagagcaagauccugucucuaaaaaagaaaaaaucaaaccaaagcuuucuuggaggcaggauuuuaaaaaauuaaaaacauuaaaugaaaaaagaacuggccgggcgcaguggcucacaccuguaaucccaacacuuugggaggccgagguggguggaucacaacgucaggaguuugagaccagccugaccaacaugaugaaacccccgucucuacuaaaaauacaaaaauuagccagacaugguggcacgcgccuguaaucccagcuaccagcuacuccagaggcugaggcaggagaaucgcuugaacucaggaggcagagguugcagugagccaagaucgcgccacugcacuccagccugggugacagagugagacucugucugaaaaaaaaaaaaaaaaaaagauagguugggugccauggcucaugccuguaaucccaacacuuugggaggccaaggugggaggaucacuucacuugagucugggaguucaagaccagccuggguaacauuucaagaccccaucucuacaaaaacaaaaauauagacaaggggaagaaagaguccuuaucuuuuauuuguuuuguuuguuuguuuuugagacagagucucacucugucacccaggcuggagggcaguagugugaucucggcucacugcaaccuccgccuccuggguucaagugauucucaugccucagccucccaaguagcugggauuacaggcgugagccaccaugcccaggcugaguccuuaucuuuuaaagauaaaaacaaaaguagcuuugacuuuuguuaaauauagaccuuggacagguuacuuucaccuuguuaaaagguuaaaguuacuuucaccuugcuaaaaggggaguaauggcauuuaccuacaaaaguauuuaacaggcugggcacaguggcucacacuuguaaugcuaguacucugggaggccgaggcagguggaucaucugaggucaggaguucaagaccagccuggccaacauggcgaaacccugugucuacuaaaaauacaaaaauuagcugggugugguggugcaugccuguaaucccagcuacucaagaggcuaaagcacgagaaucgcuugaaccugaaaggcagagguugcagugauccgagaugacagcacugcacuccagcuuaggugacagagcgagacuccauuucaaaaaaaaaaaaaaaauggcuaggcgcgauggcucaugccuguaaucccagcacuuugggaggccgaggcggguggaucacgaggucaggagaucaagaccauccuggcuaacacagugaaaccccgucucuacuaaaaacacaagaaauuagccaggcaugguggccggcaucuguagucccagcuacucuggaggcugagucaggagaauggcgugaacccgggaggcggagguugcagugagccgauauugcgccacuacacuccagccugggcaacagagcgagacuccaucuaaaaaaaaaaaaaaaaaucacuuaaaagcuccuggcuugcagaaugcacucuaucagcaauggcuaauggggauuuuauuguaauucugaucugaugcgcccccaggauggguauccguagggugcgagaucagagagcagcugcaaggcucuaccccugcgcagaggccacagccuuugcuauggucuugcuugaggccacagcucaggccgggagaaacugggacuccaggcuuugccuauuuuccagggaagcugguugggcaggggaggggcuuccaggauucacaggggcagaugggagccagcagugggcagcugggagcugcgacucauucaaagagagggaguuagugcaggguaccgagaucaggaagaggaguggugcagaggugggaggugaugagacucaagacuacagagagaagaaagggccggcagcccagaucccagccccaccccuccugcccugcauucaggcagagcacagagggauaaagagggagguggguugggggacaaggcagagaugcauauaccugggacguacaccugcguggagcccagaaggaggcuucuguccgccacacugcuaguccccagggcccccuugcaaguggacaucauguuaccccacaugcaugugacuuggccagaggagacagagucuucaugugaacuggaaaaagaucccccucucccgguggauacauuugacaaacaaaaagugggcugguuuucagccccugcucaucucauuggcccaauaccugugcagugagcaaccugcacagcuguacuuggugaucaugguuuccucccagggugcucuggcuaggggugccgcccacccacugcuaugaacccccugcaugggauggugguugugguuaugaaggagguguguugcuguguuagaaacaggccugggcugagagaaggggacucagucaggcagcugggcagagacauggacagcagggcugaggugauaagagggaccuccacggacaucaaagcaggugauggagccaacagccugcugguuuggagcaggaccuaugaccagaggugagacgcucagaggggccugggccccucccuuuaacccaaggcacuccaggcuucgcuauugcaccugaggacacgugcacccagugucacagcccauggggccugugacauccaggccagagaccucgggcggcucccuccacuccucaccccccugucuccaggcaucucagggccauccuaaaccccugaucacccgucuuugucccaacccugagacucgggacacuccacaggaggccacuuuggaagcucggaacaucccccugcccaucuggcaucuuauuugcauaaaacaaaagggggcuggcacucaggauauuucaugggcucaugacauggcgugugguggcgcauuccaguacaguauccauccucuccgccaucgccggggacugccaggaugagacuugcugccaccggggcucccaugagcucagccacaccuggaaccccucugacacccacaccuaccauaaugaaccccaaaacccuguccagaaacucaggaggagggaaucucaaggacaggacaacugucuccagccagcagccuugcuuggagaagaugccucccgaccaccuuucuggccguuuagcccucauccauuuccccauccaaggcuccacccuaacccacccugguaauuccugggccugaacgcaccgucaaugaccaaagcuugggaggaugcuguggccaggugugggcagcgugauguggaccccacaaauggauucagagggcugggugccgugacucaugccuggaaucccagcacuuugggaggccaagguggaaggaucacuugaggucgggaauucgagagcagccugaccaacauggugcaacccugucuguacuaaaaauacaaaaauuagccgggcgcaguggcacgcaccuguaaucccagcuacucaggaggcugaggcaggggaaucgcuugaacccgggaggcagaggucgcagugagcugagaucacaucauugcacuccagccugggcaacagagagagacgcugucuccaaaaaaaaaaaaaaaaaacaaaaacgcacucagaggguuggaugaaggaggcggcuccagccuggacuagccggcaagagacagcaucacuggggaccaucgucccaggcccgauccucuccuguagucaguccuggucuggaccacucaaggacagagauggaagcuugaaccccauucagcagggcccacaggucucugucccugguggaaugacaagggaugagaggacagauacaucugccaccccucacccaucggcaccugugcccucucuagccacaggcccccgcucacggccaguucugcuuagauauggauucucaccaaauccugcuauuuccauauccauagauccuuuccuggggaucagaaaaaagcaucuuuguagacucggggcugccuggcuggacaucagcccccacuguucaccccagccuggugcccacuguccgggcagcccuagccugucccacaucaucccgcacucuccccaccccugcuauugcccugcaucgcgggggcacuggcuuagggaggggucuugguccaugcccaugaagcugggcucucagagcuaguguggaugggagagcagcauccugcuagggccaccaggaugcugagaauuuggccagcgagcggccguucugugggagucaggccgagggccaccguugggaaccaagacguguccugcccaggcgcacggcauguccccugcauuugguucucaggaaggccccacccuggccuuugcccggaauccuuaggcugggacacagauggcugggacaccccagcuuggagcugcccaggaaggcagaggagaaggggaggacuuggcugcuuccagccacaucuggacaacagaaggacugagccaccacccucaccauaggaugccucuguguggauuggaaaagggaggagacaguggugccuuccagaugcuuccgugccaggaaacauggcggacccucagcccugaaagcugcucacagcuacgggcauccuucacccucuccuuccucuugcagauguggacgaaugucagcagaacccaaggcucuguaaaagcuacggcaccugcgucaacacccuuggcagcuauaccugccagugccugccuggcuucaaguucauaccugaggauccgaaggucugcacagguagaggccccaggaagacgccgugaggcuggacgggagcuggggauggagcugaggcacguccuccaaagcagccgaggaggagggggaagauccgcagguucccacaaggucaaggaccugcuaagccccugccuaaggauucaccucccaggaagguccugccacacggcagggaggcggcagggccuucagggcuggagugcccuugugggcccccagaccucaccccuuccucaucugucacgugcgaguggaagaaggugucacuuccaguucuaagaaggggaaucuccacuaugaccagggagggagcagaugagaguuuuuaguuuuuagucauggaaaucuagcucccaugacucaguuucccuuuugguuucaccuccuauaaacuggggaccauggucccugcugugcccaucugguaggaagaccaucauaagaugcuuugaaggugaaguugaaggucaccaaguggcggcaugugcaauaauggucuucagucugaggcaaugaaaagauaggggagugggugcagugaguggagggcaggcccaggcuggucagggacaggguuugacccucuggcuuuguccucagaugugaaugaaugcaccuccggacaaaacccgugccacagcuccacccacugccucaacaacgugggcagcuaucagugccgcugccgcccgggcuggcaaccgauuccggggucccccaauggcccaaacaauaccgucugugaaggucgagagcucagaucccacguuucuagcgacccacaaacaucugaucacauguucaacggcgcccacacaaaccaagcagaaugagcgcuggaggcaccuggcugugccaggcguucguucauucuucugaggcuagaugagaaaagagcaaggguccuccggaaggagcugggguacugagggggaaggcucagggggaccccaggcaacagcugaugacucacugggaggaaggcguuucaccauauucauaaccugcucaucugcacggggcccaccugcugugcccaggccucuccacgcuuccauaacccagcguccaccacuccaaggggggcacuaaugccgggaggaaugagcugggggcacagacaggagacaggacccucuccaggcugggacaggaccugacccccuucuuccuguccucagauguggacgagugcagcuccgggcagcaucagugugacagcuccaccgucugcuucaacaccguggguucauacagcugccgcugccgcccaggcuggaagcccagacacggaaucccgaauaaccaaaaggacacugucugugaagguaugaccuggcccuagaagcuccccacccccagcacacacacugacaagcggccuaaugagccgcuugucuuguucccuacagauaugacuuucuccaccuggaccccgcccccuggaguccacagccaggugaguggcccccacagggacgaggcggcgggaacuccauccacacagcacugcauccgucuccuuguucuaaacuucccacccgccguccaggcucucugacccccacaucuccucucucugcagacgcuuucccgauucuucgacaaaguccaggaccugggcagagacuccaagacaagcucagccgaggucaccauccagguaagggcaggaugcugggggaccccaggacaguguagaaucagcuagcggaggcuuccauguggccagagagagugcccaacccaagcaggggccucuagucagagacacacaugcgcauaacauacacacaccacauacaguaugugcacaaacauacacacccggacacgugaagacacacgcaugcacacacacacaccagguauaauggcaacagagugcagcacuuaagaaccuggaguugaggccgggcacgguggcucacgccuguaaucccagcacuuuggaaggccgaggugggcagaucacgcggucaggagaucgagaccauucuggcuaacauggugaaacccccgucucuacuaacaauacaaaaaaaaaaauuagcugggugugguggcgggugccuguagucccagcuacucagcaggcugaggcaggacaaugacgugaaccugggagguggagcuugcagugagccgaggucgugcagcugcacugcagccugggcgacagagccagacucugucucaaaaaaaaaaaaaaaaaaaaaaagagccuggaguugggccacagaaguucaaauccccccauugccacuucuugcucugugaucuaaggcaagugacuugcccucucugggccucgguuuucucaucuguuuuggggguugugguguguuuuuuuuuguuuguuugcguuuuuuuuuuuuauuuggaaacaaggucuggcucuguugcccauucuggagggcugugacaugaucauggcucgcugcagccucaaucucccaggcucaagugacccucccaccugagccucccaaguagcugggaccaaaggcauauaccaccaugccuggcuuauuuauuuauuuaauauauuuauagaugggggucuugcuauguugcccaggcuggucuugaacuccugggcuuaagugauccuccugccucggccucccaacaugcugggaucacaggcgugagccacugugucuggccaguuuccucaugggcaacacaggcaugaaaguaaugccuccuucauauagucagugugaaggguaaaucaacuaauagaaguaagacucagaacagugccugacacaugauaagccuuauauaaaagcuuuccuggccaagcacgguggcucacgccuguaaucccagcacuuugggaggcugaggcagguggaucaccagagaucaagaguuugagaccagccuggccaacauggcgaaaccccaucucuacuaaaaauacaaaaaauuagccgggcguaguggcgggcgccuguagucccagcuacuugggaggcugaggcaggagaauggcgugaacccgggaagcggagcuugcagugagccgagaucccgccacugcacuccagccugggcgacagagcgagacuccgucucaaaaaaaaaaaaaaaaaaaaaaaaaaaaaaauuagcuggcgugguggugcacgccuguaaucucagcuacucaggaggcugaggcaggagauucacuugaacccggaggcagagguugcagugagccaagauugcaccacuguacuccagccagggcaacaagaguaagauuuugucuuaaaaaaaaaaaaaacaguuuucccauauguuuuuagcacaguagaaaaaugaugugagccacuuaacaucauuuuaacuuuuccaguagcuagauuauuuaguuaguuaguuuuagagauacggucuuguuuugucacccaggcuggagugcaguggcacaaucacagcucacuccauucucaaccuccugggcucaagcaauccucccuccucagccucccaaguauuaagagcugagacuacaggugugagccacugugccuaauuuuuucauuuuuuuuuuuucuuuuuugugagacggagucucgcucugucgcccaggccggagugcaguggcacgaucucggcucacugcaagcuccgccucccggguucaugccauucuccugccucagccucccaaguagcugggacuacaggcgcccaccaccacgcccagcuaauuuuuugcauuuuuuaguagagaugggauuucaccauguuagccaggauggucucgaucuccugaccucgugauccacccaccuuggccucccaaagugcugggauuacaggugugagccaccgcgcccagccauuuuuucauuuuuugcagagaugggggccuugcuauguugcccaagcuggucuugaauccuggguucaagugauccucccaccucagccuccaaacgcacuggaaguacaggcgugcaccaccgugccuguugucuaauaacuacacuuuauaaaguaaaaauaaaguuaaauuaaaguuaagauugcaggccgggcaugguggcucaagucuguaaucccagcacuuugggaggcugaggcaggcagaucgccugaggucaggaguucaagaccagccuggccaacauggugaaaacccgucucuaaaauaacaaaaaaaauuagccgggcaugguggcgggcaccuguaguccuagcuacuagggaggcugaggcgggagaaucacuugaacccagaagucggagguugcagugagccaagaucgcgccacugcacuccagccugggagacagagugagacuuagucucagauaaauaaauaaauaaaguuaagauugcauuuaaccuaauagauccaacguauuaaccacuuuaacauggaaugauuuuuugcuuuuuuuguuuugaucugagaucgugccauugcacuccagccugggugacaagagugaaacuccaucucaaaacaaaacaaaaaaaaaauuacaaaaauuagccgggugugguggcacgcuucuguagucccagcuacucagaaagcugaggugggaggaucgcuugagucugggagguggagguugcagugagcugauuaugccacugcacucaagccugggcaacagacugagacccugucucaaaaaaagaaagaaaaaagaacaggaaaucaaaacagagccuggcaggcagcccgugcccaaccaguguuaagcgcugugauucauacgugcaugcaggcaaauacucaauccgucgcuuguuuucugguuacugcaucaucucagugauucccuugugccugugggucuccaguguguccccugguagggggugacauccagguccuucaggcaaccccuguggucugaugcuccagcgauucugucacccgccacccccuagaaugucaucaaauugguggaugaacugauggaagcuccuggagacguagaggcccuggcgccaccuguccggcaccucauagccacccagcugcucucaaaccuugaagauaucaugaggauccuggccaagagccugccuaaaggccccuucaccuacauuuccccuucgaacacaggugaggccuuggccuggccugcccugccccaacccugggccccaccugguaccuggggucccuaaucacaacugccccucuccccucagagcugacccugaugauccaggagcggggggacaagaacgucacuaugggucagagcagcgcacgcaugaagcugaauugggcuguggcagcuggagccgaggauccagguagcagcgguggucuggagggggagcccgugggagagagauggaggugcugggauggggccagggugagguucagaauagaacaacugacugggcgcgguggcucacgccugcaaucccagcauuuugggaggcccagguggguagaucgcuugagcucagaaguucaagaccagccugggcaacauggugaaacccggucucuacaaaaaauacaaaaauuagccaggugugguggcacgugccuguagucccaguuacucaggaggcugaagcgagaggaucaauugagcccgggaggucaaggcugcugugagcuaugaucacgccaaagcacuccagccuggacgacauagugagacccugucuuaaaaaaaaaaaaaaguccaggcacaguggcucaugccuguaguccuagcacccuagcacuuuggcaggcugagguagauggaucacccgaggucaggaguucaaaacuagccuggccaagauggugaaaccccaucucuacuaaaaauacaaaaauuagcugggagugguggcaggugccuauaaucccagcuacuugggaggcugagacagaagaauugcuugaaccuggggaguggagguugcagugagcugagaucacgccacugcacuccagccugggcgaaagagcgaaacuccgucucaaaaaaaaaaaaacaaggaacaacuagaaacugacucaucgggaggggcuccuggcgucaucgugguggacuggcugagccugagcugggucaucuugggagggaggauagagcaugggaggaggacaacgggaguaggcagcgagugugucuguuccccaggccccgccguggcgggcauccucuccauccagaacaugacgacauugcuggccaaugccuccuugaaccugcauuccaagaagcaagccgaacuggaggagauauaugaaagcagcauccgugguguccaacucagacgccucucugccgucaacuccaucuuucugagccacaacaacaccaaggaacucaacucccccauccuuuucgccuucucccaccuugaguccuccgauggggaggcgggaagagacccuccugccaaggucucugcucacucugcucacuuccucaaagauaacccagggccuucgcacaugcugggccucucucugggaugcucuuucccgacgugacucagucuuuuauguuucuggccuucugauuugggccuuccccaaccucauuacuuauuuauuuccuuacuuuauuuauuuaauuuaauuaauuaauuuauuuauuuuaagacagagucucacucugucguccaggcuggagugcaguggcacguucucggcucacugcaaucucugccucccagguucaagugauucuccugccucagccucccaaguagaugggauuacaggcaugcgccaccacaccucgcugauuuuguauuuuuaguagagacgggguuucuccauguuggucagguuggucucaaacucccgaccucaggugaucugcccgccuuggccucucaaaguacugcgauuacaggcgugagccaccacucccagacuuucuuuucuuauuuauuuauauuuuuagacaggagggucucacucuguggcccaggcuggagugcaguggcgcgauuauagcucacugcaaccucgaacuccugaacucaaccauuccuccagccucagaguuuugaguagcugaggcuacaggcaugcaccaccacucccagcuaauuuuuuuauuuuugauagagacggggaccucacuauuuuucccaggauggucuagaauuccugggcuccagugauccucccaccucagccuccugaguagcugggacuauaagcgugcacuacuaugcccaguuaauuaaaaacaaaaaaauuaauggagauggaggucucgcuauguugccacagcuggucucaaacuccuggccucaagcgauccucccaccuuggccucccaaaguccuggaauuacuuacaggcaagagccaucaucaucccuggccaccuucuaaugcacuaucuacauuacuuauucguuagguuuaugucauaaucugccucucccacuuuuuuuuuuuuuuuuuuuuuuuuuuuuugagauggaguuucacucuugucauccaggcuggagugcaguggcucauucucggcucagugcaaccuccaccucccagguucaagcgauucuccugcccaggacucccaaguagcugggauuuacaggugcuugccaccaggcccagcuaauuuuuguauuuuuuaguggagacgggguuucgccauguuggccaggcuggucucaaacuccugaccucaggugauccgccugccucagccucccaaagugcugggauuacaggcaugagccacuaugccuggccaccucucccacucuuaugucaaccucacaaggguagguacuugugugugcccuguucacugcugugucuccaaaccuguuacauucaguaggcgcucggucaauacucaucuaguaaaaagcagcccucuuagacucagcccaagcccaggaccuaagagugagcuccaggccaaccuuucugaccacccccaucugcccacaggacgugaugccugggccacggcaggagcugcucugugccuucuggaagagugacagcgacaggggagggcacugggccaccgagggcugccaggugcugggcagcaagaacggcagcaccaccugccaaugcagccaccugagcagcuuugcgauccuuauggcucauuaugacguggagguaaguagcuggaggcauccucaagugcccacagguaaugagguccagcugcaaccagacaggcagcuaguucuccauggagcccuacugguugcucagauauaucugcaugguugcacagcccagguguccccacgucacacccuucgcagccucuuccuuuggccucuucucuacaacccagcaacuauacacugggugcagccacuagcuccgcuccucugccuguccaucccguaccaguugugagaugucaacuaaaagcuccccauggagagcauuccaagggggcaccacuugcccguuuuuuuuuuuuuuugagacggagucucugucgcccagguuggaguaugguggcacaaucucagcuagugagguucaagggauucuccugccuuagccucccgaguagccgagauuacaggcgugcaccaccaugccugaguaauuuuugguauuuuuaguagagacaggguuucaccauguugcccaggcuagucucaaacuccugaccucaggugauccacccaccucggccucccgaagugcugggcuuacaggugucagccaccgcacccggccucuuuuuuuuuuucuuuuggacagagucuugcucuaucgcuuaggcuggagugcaguagugugaucuuggcucacugcaacccccgccuccggauucaagcgauucuccugccucagccucccaaguagcugggauuacaggugcaugccaccaugcaccgcuaauuuuuguauuuuuaguagaggcgggguuucacuauguugggcaggcuggucucgaacuccugaccucaggugaucugcccccccucagccucucaaagugcuaggauuagaggcaugagccaccacacccagccuggagcaccacuuucuguacgugacuucaguaggauccaucguuaagcugggccuugucgaaaacugcaauuaaccaggcagagaaggggggcgccugugguccaggccaaaggcccagcaagcacaaaaaugugaaaucccuagacuccccuuccagcugguaaguguggccagaucuaggagggacaagggaggaggucagagaggugggcccgucaaagugugggggggaaaagggaccacaaagagggcaggaaggccucaugcccugaaggaacccugagcacccggugccacuccuaggacuggaagcugacccugaucaccagggugggacuggcgcugucacucuucugccugcugcugugcauccucacuuuccugcuggugcggcccauccagggcucgcgcaccaccauacaccugcaccucugcaucugccucuucgugggcuccaccaucuuccuggccggcaucgagaacgaaggcggccaggugaggucccgccccgcucccuccugagcucuggggucagggaggccugggagggguuagccccgcccacucccggggcucagucggguaggcgggcccuggaggcaugaggccccgccccuguccgggaucuggccccgcccaccggggggucggguugucucuuuaaagggcgcuggcuuuggagcugccuggccacaccccgagugcccgcucgcuucugagcguuguugggggugggcccuggggggaaaccuggcccccgcuccagacccgcccacccuccggcuguggucccgcccacucucgggaccuggcaggcgacuggcucuggcgccgcaugccccuccccgcgcugacgucgcuccgccccuccguccccgccccgcagguggggcugcgcugccgccugguggccgggcugcugcacuacuguuuccuggccgccuucugcuggaugagccucgaaggccuggagcucuacuuucuuguggugcgcguguuccaaggccagggccugaguacgcgcuggcucugccugaucggcuauggcgugccccugcucaucgugggcgucucggcugccaucuacagcaagggcuacggccgccccagauagugagugcagcgagauggggcaggaggaaggcggggugcugggccuggggcucacaggcagugccacacacaauguccggccgcccuccguuccgcuccuggcuuccuggggcacugaugggaccccucccuucccuccuagcugcugguuggacuuugagcagggcuuccucuggagcuucuugggaccugugaccuucaucauuuugguaaguacccacucucccuccaccgaagcccgagcgccacaggcccaggcccggcuggaccaucgcucucgcccucuaacccacaaucugcucccugcccagugcaaugcugucauuuucgugacuaccgucuggaagcucacucagaaguuuucugaaaucaauccagacaugaagaaauuaaagaaggcgaggugagaggagaggcuggaaggacuuggaggcggggccggggugaggggcaugaagcuggaggugaggugggggcccacgcugcaaccccgcuccucgcagggcgcugaccaucacggccaucgcgcagcucuuccuguugggcugcaccugggucuuuggccuguucaucuucgacgaucggagcuuggugcugaccuauguguuuaccauccucaacugccugcagggcgccuuccucuaccugcugcacugccugcucaacaagaaggugggggccugggcacaguggcgcacgccugucauccucccaccuauuugggaggcugaggugggaggauugcuugagcccagaaguuggagaccagccugggcaacauaaccagaugcugucuuuacaaaaaaauucaaagauagccagggugaggcgccuguaaucccaacaguuugggaggccgaggugggcagaucaccugaggucaguaauucaagaccagccuggccaacauggugaaacccugucucuacuaaaaauacaaaaauuagccaggcaugguggcacacgccuguagucccagcuacuugggaggcugaggcaggagaaucauuugaaccaggagugcagugggccaagauggcaccauugcacuccagccugggugacagugagacuugucuccaaaaaaaaaaaaaaaagccgggugugcugaauacccaucucagcuucucaggaggcuggggcaagaggaucacuugggcccaggaguucaagguugcaguaagcuaugauggugccacuacacuccagccugggugacagggggacccgaucucaaaaaaaagacaaacacaaaaacaccaagaagguggggcugagggcagagcauggggaggagcgugcauggucccagggccugcuccugcccugacuuggugucugggccggcagguucgggaagaauaccggaagugggccugccuaguugcuggggggagcaaguacucagaauucaccuccaccacgucuggcacuggccacaaucagacccggguaaggggcugcgccuggggcgggugugggcaggaaggcaccagggcuagcggggcucaggccucugggcucuccucuccaggcccucagggcaucagaguccggcauaugaaggcgcaugguucuggacggcccagcagcuccuguggccacagcagcuuuguacacgaagaccauccauccucccuucguccaccacucuacucccuccacccucccucccugaucccgugugccaccaggagggaguggcagcuauagucuggcaccaaaguccaggacacccagugggguggagucggagccacugguccugcugcuggcugccucucugcuccaccuugugacccaggguggggacaggggcuggcccagggcugcaaugcagcauguugcccuggcaccuguggccaguacucgggacagacuaagggcgcuugucccauccuggacuuuuccucucaugucuuugcugcagaacugaagagacuaggcgcuggggcucagcuucccucuuaagcuaagacugaugucagaggccccauggcgaggccccuuggggccacugccugaggcucacgguacagaggccugcccugccuggccgggcaggagguucucacuguugugaagguuguagacguuguguaauguguuuuuaucuguuaaaauuuuucaguguugacacuuaaaauuaaacacaugcauacagaagauggccuugccugcugguggugauucagaggccgggcccaggguguccgugaaaggccaagaugaccaagaaauagauggggugggagccaggcuuccauaauaacaaguuuauucucauacaaucucuagcuucucaacaguggcgccuggaaaggggaggugaagcugcaugcgggcggcuccgggugggcggcucuggcacguggugguuaccggcucugcucgacuguaagacaugagaugcagugaacugaagggccgggggaggaacccucugccccagaccccuggcccugcccaaggcacuuacuguauguggagaugucgauuuccucug

SEQ ID NO: 15675 - RNA, 4050 nt, Homo sapiens
gaagcuuaaagagcucagguucccgccccccggcccuaccauggcuacagagcagugguucgaggggucgcucccccuggacccuggagaaacaccgccuccagacgccuuggaaccugggacgccgcccugcggagaccccuccaggucgacgcccccuggcaggccugggaacccaucugagccggauccugaagaugccgaggggcggcuggcugaggcccgggccuccacgucuucccccaaaccucuggucccccggccugggccagcaccuccccgccuaucccuggacacuuuguucagccccaucacccaacagcugcgcuaccuacugaagaaggcagaugauuuccagagcuacuugcucuacaggugaugcuggacagggucccagguccccauggguaaggagacuuggaggggaggcgacaggaugggugacacacaccagggucgcaaaauuacaagcgcuaggagccagagggagacaguggaagaagcuagcauauuagaauccaguuuaagagaaugaggaagacuguagaauugcggguaggggauggcugcuauuacugucguggcagugugggccugggguugucaagucucuaggacuuuuucucccaguuuuuaagugcugucuuacauuuugagcccugugcuggcuaaacaagacccaccugagccaaacuuggccugcaggacaucaguuugagacuccaaaggauaaugugauucccagaccagguuucccugugacucucaauuucaguguccauuggaauuuccuaggaggcuggguuggguuuuguuugcguguuuguuuuugagauggagucucacucugucgcccaggcuggagugcaguggugcaaucucagcucacugcaaccuccgccucccggauugaagcaauucucugccucagccucccgaguagcugggauuacaggcgcccaccaacauguguugcccggcuaauuuuuuucuuuucuuaguagagacagaguuucaccaucuuggccagacuggucuugagcuccugaccucaugauccacccgccuuggccucccaaagugcuggaauuacagacgugagccaccgcgccuacccgaggcuggguuuuuuuguuuuguuuuguuguuauguguuuuuuugaaauggagucuugcucugucaccuaggcuggagugcaguggggcgaacucagcucacugcaaccuccgccucccagguucgagggauucucaugaggcuguuuuuuuuuuuuuaaugagacagggucucgcucugucacccaagcuggagugcaguggggcagucauagcucacugcacccucgaacuccuggucucaagcaaucuucccaccuccaccuccuggguaacugggacuacaggugccaccaugcccagcuaauuauuuuuguguagagauggguucuugcuauguugccuaggcuugucuggaacuccuggccucaagcaauccuccagccucagccucccaaaacucuaggauugcaggcgugagccacugcgcccagacccugcaggaagcucuggguccuaaguguugugagacucaggugucagcacuuuaacaaguguuccaaauggguuugaugcagguaaaccagaaagauguucagaaaagaccugaaacugggggcuuuucuaaugggucaaagccagggauacagguugggauugaguagaauggggaaaacugcgggguggggagggguugugagggauuccaggcaaaggcccccuucuuccuucagcagagaccaaguacagaaggagcagcuggccaaggccaugcccaccuucuuacagaugugugagcccuacuuccuguaccuggaggcagccgcgagaagcauaccccccaucuauggaccccugcaggagcugguccgaaaggggguguguggagguuucuuagaccccacgccccuuucuucucgcagcucugagccuguggggaugguggagggggaggcccacuccucgcaggccagcugaucucacuguaccccccucuuguaugcagcuguuagagaucucccaacagcugacccugcgccuggaacagcugguccucauguacgcuuccuuuggguucguggaccuggaggagaugaacccccuuagguaaaaugguaggagacucagauggggggaugaaggaguccaaggcccagccucaccccuccauucucucaugucucgccagcaucuccuguuucuuuugcgggagguucuccaucagccugucccaugaggucuccaucuucagauacugugccccaaccgccuacacugccagccgcuucccccgcuaccucuauaagaagaugcgcuggcaccuggaagccaccccagaggccccuggucggggacaagauucccuuguggauuaguaaguccucuuacccaaaucaaaguccuccccuuucuaugaugaaugccaauaugacccuccaaaccgucaccagcaaagugaaaagugagccagggcccgaggcaguggcucacgccuguaaucccaacacuuugggaggccgaggcaggaggaucacuugagcucaagaguuugagaucagccugggcaagauggcaagacccugucucaacaacaaagaaauucgccaggcgugauggcuggcaccuguagucccagcuacuugggaggcuuaggcaggaggagcacuugagcccaggaaucaaggcuacggugagcugugauugugccacugcacuccacccugaguggaagcaauaaucugucucuuaaaaaaaaaaaaaagugaaccaggaaacuaaaggcuuuugaaaggcuaccucuauuuucuuaaaacccacccucccaccaaaauaaaaguucucaucuuaaaaguaggcuggcagggagaaaaggccuuggagucacauuccuaccugagaacuucagggcaacuucugaugaguucccaccucaacuccaaaauuaaagcccucaacagaaguagcuaggaagcugaucacuucuaauuacagcucccuccccuccuagcuacuuucugugcuaucgagauacuugggaagacacaggccagaguccagccaauucgugcccacagauccagaagcugugguccaucggccgaugggugccccuaggaccagccgaggaugaccuuuauucaugguaggagcuagggcaauagcaacgugggccugggagcuggagggggaggcagaaccccaccaaagacaauccaccuucccaaacacuuugcuucccuuaguagugauagcauuuuauugugcccugaaaagcacuucaugcagaccccaguaacaacccauggagaucuaugcuauuggccccauuuaacaaagaaaacagggugcucagagaaguuguuaccugcccaaggacacacagcuagcagagcgaauggacaggucaggaccaguuauucagccucuaggagccauuacuaagucucugaucaacaaggaaacaaguuucccccggggguuuuucccacccgcagcugaaacaaagccucuuucaccugagccucucacucaaagggagggacucccgaggggcagggggcacucaaguccaggccugucuaucccuggcccccccaccccaggauuuugugcccgcagccgcuuggggacuaccagcagcugcugaccaucggcuucgaggagcccacgcccacgcuggccaccgaccugcuggugcagauccucacgggccaggcaggccaggcccggccuccgagcgcagccgggccugcggggugggcagcgcaggggucuugaaccuggggaagaggguaggagcuggaacuugacaguuccaaacuccagaauagggggcaggggaggggcucacucguucucgcagugcagcccggccucgccuuccaaagggccaggccgagcugaccugucugcaccgaguccggcuuggccguggggcccugaaugcggacacgucaguuuuguguuaaauaaaagaaagaaagaggucacagg

SEQ ID NO: 15676 - RNA, 2229 nt, Homo sapiens
gucaagggagaggguaguucaguuugcaauuaggcagagaagggcugggcaguuucacuggcggaguugugggugguggucaguuucccaaugggggacuguaaguuuuauagagggggcuggucaauuucacaaaggcaagucgauuucaucuuccccaaugcagagagccgacccuucuccaggccuaaugcuagacgccccccgcccuguuccucugacgcguacguuacuuccggccgggggucccagccuuuucaaaccucaagguuugcgcuccuccuggggacagaggaccagaaggaaggccggccucagggaccugcgcacugcauccaggcucgggguggcgguuugggccucaagaccaccgucuccucuucaccccggggaugcgucccagacugaguucugaccagaguggcccuccagggaggaugcacuuuuccccaccaagcguccuggcaccggagggguggggggaccgacaagcgcuagaggcacacggguaagggggcucccaccugcuccaggccguucuccgagaccuuucugcgggggggccagaucaccaccaacuuuccgucgccccugcucgcugcgggggaaggggcgcucagcucaccagcuggcggcagccaggaugaaaggccggccgcaccccuuaaacacacacaggcguucacccuccgccuccccaugaaagccuccauucaacuccaggcacccaggaacccgagggaggagggaggugaacccagaauggagaagcaggagcccgaaaauucagagggaggacccaggagugccagaacccagucaggguucccuggaacccgacaaaaaggaagacaucuggaaugcccccacccccgcgcagccugggugguguggaucagagaguccaucacucccgguggagggguggaucacagcgaguaauggagcuccagaagggguaggcaagagacaaaauugagagggggucugggagcuuggagggagagaccccgagaaucggagggccacaggaggggccacugaaguugggcaaucggugggggcggcuggaacccugggggucccggcguugcuacgcccgcggcuuaccggugaggcucggcguaggcuccuugaacuccgcggugccauagacgcugcgccgcuggcgcugcaguuccugcucgcgcucgcgcacggcgcgcaccuccugcuccagcagugacggagugaaaggcggcggggcgcugcccagcacccggcacccgcccugcacggccgagcgcggccgucccccaggcucuggcagccucugcgggcccgcgccgucccccgcccccgccgaggagccgcuccccgccgcggccucgaagaagcgcuugaguucgcccagcggcugcggcggcgaccgggcgcgcggcucggggaccgcggggcgcgccagcgccgccugccggugggccucccgcucgaugucccgcugcaucugcgcgcccgcccgcgcccgcuccagggcgcgcgggagcgcggggccaggacccggcagguugagcaccggccgcacgcgcagcucgacgaguucacggccugcgcggcccgggcucaggccccggcuccggcgcaggcucuccucgcguucgcagcugcggcggauuucgcgcucgaugggcgucuccaugaaccgcuccuccgggggacgcuggggagccucggggcacggcggaaaacgcagguggggggcuuccgagccugaccuggaggaggaggucuuagggccuggagggggaugcugccccuggaccuccgcccuuugcgcuucggacggcccagggucgucucugccuggcucaggacucucaaagcccgcagcuguggacagcccggggcucucugcguccugcucgacugauggcucgaggacuucgcucucuugcuccaggaucuccacguccuuugcggagggcuuggggaccucgguguucagcuccgcagcagcucuggggcuucgcugucuggcccuggggacuccuggcccuccucuucagacgaccccaggguuucguucuccggccggugggggccuucguguccaggguuggaagcaguucggaagccucaguucccaaccgggguuuugauucccagagcgaggacagagggcacugugaggcaccuguggcggcaguggcggccguggguuccaaggcgucgcccgcaccggcggcuucu

SEQ ID NO: 15677 - RNA, 2229 nt, Homo sapiens
agaagccgccggugcgggcgacgccuuggaacccacggccgccacugccgccacaggugccucacagugcccucuguccucgcucugggaaucaaaaccccgguugggaacugaggcuuccgaacugcuuccaacccuggacacgaaggcccccaccggccggagaacgaaacccuggggucgucugaagaggagggccaggaguccccagggccagacagcgaagccccagagcugcugcggagcugaacaccgagguccccaagcccuccgcaaaggacguggagauccuggagcaagagagcgaaguccucgagccaucagucgagcaggacgcagagagccccgggcuguccacagcugcgggcuuugagaguccugagccaggcagagacgacccugggccguccgaagcgcaaagggcggagguccaggggcagcaucccccuccaggcccuaagaccuccuccuccaggucaggcucggaagccccccaccugcguuuuccgccgugccccgaggcuccccagcgucccccggaggagcgguucauggagacgcccaucgagcgcgaaauccgccgcagcugcgaacgcgaggagagccugcgccggagccggggccugagcccgggccgcgcaggccgugaacucgucgagcugcgcgugcggccggugcucaaccugccggguccuggccccgcgcucccgcgcgcccuggagcgggcgcgggcgggcgcgcagaugcagcgggacaucgagcgggaggcccaccggcaggcggcgcuggcgcgccccgcgguccccgagccgcgcgcccggucgccgccgcagccgcugggcgaacucaagcgcuucuucgaggccgcggcggggagcggcuccucggcgggggcgggggacggcgcgggcccgcagaggcugccagagccugggggacggccgcgcucggccgugcagggcgggugccgggugcugggcagcgccccgccgccuuucacuccgucacugcuggagcaggaggugcgcgccgugcgcgagcgcgagcaggaacugcagcgccagcggcgcagcgucuauggcaccgcggaguucaaggagccuacgccgagccucaccgguaagccgcgggcguagcaacgccgggacccccaggguuccagccgcccccaccgauugcccaacuucaguggccccuccuguggcccuccgauucucggggucucucccuccaagcucccagacccccucucaauuuugucucuugccuaccccuucuggagcuccauuacucgcugugauccaccccuccaccgggagugauggacucucugauccacaccacccaggcugcgcgggggugggggcauuccagaugucuuccuuuuugucggguuccagggaacccugacuggguucuggcacuccuggguccucccucugaauuuucgggcuccugcuucuccauucuggguucaccucccuccucccucggguuccugggugccuggaguugaauggaggcuuucauggggaggcggagggugaacgccuguguguguuuaaggggugcggccggccuuucauccuggcugccgccagcuggugagcugagcgccccuucccccgcagcgagcaggggcgacggaaaguugguggugaucuggcccccccgcagaaaggucucggagaacggccuggagcaggugggagcccccuuacccgugugccucuagcgcuugucgguccccccaccccuccggugccaggacgcuugguggggaaaagugcauccucccuggagggccacucuggucagaacucagucugggacgcauccccggggugaagaggagacgguggucuugaggcccaaaccgccaccccgagccuggaugcagugcgcaggucccugaggccggccuuccuucugguccucuguccccaggaggagcgcaaaccuugagguuugaaaaggcugggacccccggccggaaguaacguacgcgucagaggaacagggcggggggcgucuagcauuaggccuggagaagggucggcucucugcauuggggaagaugaaaucgacuugccuuugugaaauugaccagcccccucuauaaaacuuacagucccccauugggaaacugaccaccacccacaacuccgccagugaaacugcccagcccuucucugccuaauugcaaacugaacuacccucucccuugac

SEQ ID NO: 15678 - RNA, 8648 nt, Homo sapiens
gagugcuuucacauuuuauuuucaaguauaaaggcuucaucgcagaaggaggccaggguuacaggcagugggcaaggggucuggaagcccagguuuagguggacgugcaggcuagcuggcucccaggugccauggccaguccuguggucccugucugugccugggacccucuucugggugccaagaggccgagguagcugugagaggagcuggacaugggguggaggggcauggguucacaugaccgcacaacacuggcacgucuuuugcuuagggccacuugccucuucacccucggugggggcagauggcucaggcugccgggcaggcgcguaggugggcacagggugggcacugggguuggcgcugggccccucccccugaagcaguggcuggcauucggcgggcugcucuggggcuggggucucugccagaagagguguggcaucccccaaggggccuuggcccucagcagcgguuuggggcuucacuccuuccuccuccagggcuccuacuggcuucuccuggggcugggguccuuccuucucuggccuugucuccguguuagccucaaggggaggcccugccucauucaucuccucugccugggauucacuuccuucccuagacccuuguucuagauucagaucucccuccgucccuugggucuucucugucuccaaugauuccucaccuccccuuuucucugccuccagugucuccuccccucccuuucucucugccuccagugguucuuugguugccucuggcucuuccucaccuccuuucuucucuacucccaaugguucuucuaccuccuccuccucugccccucgcuuuuccucaucuccuuccuucucugcccucaaaugucccucaacuuuucucucuaugcccagugguuccucaccuccuucccucucuguucccagcuuuucugcacuuccucugcucuccagcuccaacuucuucucuccuccuuuccucucuaccacuggugacaucuccgcuucaucccucccugucccuggcuuuuccucacuuccuauucccauggauucuuccgcuuuucucuucucugccucccaggucuccucgccuccucccgucuuggcccccucggcccccagcgggcuuucaucuccucucucccucccugccaccucgggcccuuccaaccccuccaccagcagcuccucccacucuucacugagggucacucucuccacccaaaugaaggaucccuccucuccuccagagccucccugcccaucacccucagggcugcccuggggcacaucuuccccuucuauggaagcugcugccucuaaucucuccuggagccuaggcgagcuagucugcacgaccucagggacccugccuaucucccccauggccucugcaucacugccacccacccccucccagaccaccuccacgaugccccuguccuccuucacccaggccgggagcuccaggcuaccagcucccuuccugucuccgauggcuuccagcaccacuuccuccaccuuagccuccagcucggggcccguggccccuguggcacaguccucuguggcccucagcccuucccacaccacacucaccacgcccccuccuuuggccucacccacccgcccuucggauggcacugcccucugacuuagccccugcucuggaguggggauggggcuggggcaugggccauuggcuucugaggagucuccugcugccccggggaccugccucgggccuggcagaaaccccaagacauccucccugggcucagagggggacucuggaggcgugcccacuaguccagccggcagggaggcucucuuguucagaucagucuggccugggggagucagagguggaggggagaggacaaaagggaagacaggguuaagauggaacaaaaggacugccauccacacuccccuugagucacccucucacacccaggcucuggggugaccugacccccagaccuaggggcucccacacuuaccuacagaaccugccucgacaauggacugggagagaggacggugacccugcagagauggcggagacaaggucaggcuggcccucauccccaccuccagccucccugcaugcuaggcucccaccccaccaccccuaaauacccucaguggcucucuauuaccuucaggaucaaacuccacauuguaccucugccuuccucaucuaucuuauugcccuauguuccagggccuugcacacaguaggugcuuaaacaauacugcauucccauagccaaucuguauuaggggccuacuuugucaguuacugguuaccaugcacaagggacacuuaagccuuuuguuuuuggcacuuacauuccaaucaacauaaauacaaauuaauuuuuuuuuugagauggagucuugcugugucgcccaggcuggagugcaguggcguaaucucggcucacugcaacguucgccuccugguuucaaacgauuucccugucucagccucccuaguagcugggacuacaggcaccugccagcaugcccagcuaauuuuuguuugagacagagucucacucuguugcccaggcuggagugcaguggugugaucucagcucacugcaaccucugucuccaggguucaagugauucuccuaccucaaccuccccaguagcugggacuacagggacacaccaccauaccgagcuaauuuuuguguuuuuaguagagaugggguuucaccauguuggccaggcuggucuccaauuccuaaccuuaagugauccgcccaccucggccucccaaaguucugggauuacaggcgugagccaccaugccuggccuauacuguuguuauucccauuuuagagaugggaaaacuaaggcuuggaaaaggaaauugacuugccaagaccacagagcaaaguaaaagcgggaagcggaucugaaugcagaccuaguggccaggcugcccuuggagaaagcugcauuccugauuccauguccugccuugaggccugcuggccaugcccucccaucccacuccccugauuccccccucaccugucugcgccagcugggccugccugagggcuugugcugggcaccuguggaagcacuuugcaacaguugcagcugggacuggagucugaagaagagagagggcugcuaggagcugggcccccaggcuccuugggcuccuagacucaagcgaccaccuccuuggaaugugcccagggucucgaucucacccagcuggggcaggguucgggcagagcuagaaggucuccacucacgugaacaaacugucuuccagguuccggauucgggccugagccuggcccucgggugacuggggguccuucgagguggggucuucggauggcucuggcacugcagcugccccauccauuagccaacguucccggagagacuuccucugggcaggggaagggaguuggggcugggcauacagacuaccccgguccauguaaaguccccucccgaccucugcaggcugggcagguaucuuaucaccaccucacaaccaguugcgacauacaucaggcugggauacauggccacagugccccccaacgcugcaagugggcagacaucccuuguuccaaacccuuccaaaaugaaacgggcacuuccaaagugaaaucaaugucccucccuacuggccccucccuaccccaaagcuagacuucggcuccucuccaucucccccaaauugggacaaacagcaucacugucccagacuuuuccccaaauggaacaaauguccccaugaccaccccacuucgucccucccaggcugggaaagacauaccccgccccggccaagcuggaaccaacgcccccaacugcccgcucccccccaaaaauuggacagaggcuccuaucgucccccaaaccgacuugcacagacaccccccacuccauuccccaggcuaggcaggcgcccccgcccgcccccaaccuugagacgcuccacgcggaguuucuccuccuccaccucccggcgcgcggcgcggaucuccuccugcagccgccgcuucuccugcgcacagaggacccggagcugcccgccggccgggcgcggccuccaccaccuccucuucccucccuuuccccucccuccuccgcggggcucaccggagcucccggggcucccgaggcagcgagcccggcggggguggcccagcgcgggucugcacccagggcggggagggggcugcggaggcgcugacucagcggcgggcggaguggggggggcggggcgggggcggggccggccgcgcccgggaugcugcggaggccucgcccgcgcccaaugggggucuguggaugggggguguaggggguggggccuugggacagcuaucgggggaggggcagagcuggggagcuccgagauacgagguuaagagaaauggggaucaaagggagggugcggccguacgcgguggcucacgccuguaaucccaggacuuugggagaccgaggcggacagaucgcuugaggucaggaguucuagccuacccuggccaacauggugaaaacccggcucuacuaaaaauacaaaaauuagcugggcgugguagcaggcgccuguaaucccagcuaccggggaggcugaggcgggagaaucucuugaacucgggaggcgcagguugcagugagcggagaucgcgccacugcacuccagccugggcgacagagcgagacuccgucucaaaaaaagaaaaaaggaggggagggugcuagugagauggggguccgaaauggggaugcagccaugggagcccagaguaauggaguguagacauggaaucuagagagauggggugcagaggugggggugcagagagaugggguacagaagugggguacagugagaugggguacagaaguggggugcagauaggugggguauagaaguugagugcgaagagauaggguacagaagugggguauagagagauggggugcagggagaugggguuccauagauggggaauaaaaaggagggugcuagugagauggggauccaaaaugggggugcagccauggggguccggagagauggggugcagagauggggaucaaaaggaggaugcuagugaguagugagaugggagugcagccacgggguccagagauacugagguguagagguggggaucagggagaugggauacagagauaggggucagaaauaugggguacagagguggagguauggauagaugggguauguaagugcgugcggaaaguugggguucagggagauggaggagggaaggaugcaggacagagauaggaucagagugguagagacccagagaugggggaguccagagagacgaggaagucagggaugaaaguucccaaggaaggacugucaggaugggggcuccgagguagggagauuugagagauagcggucugauaaaaggcgguccgagagaugcggcucaggcaugggguuuuugggaggcugggguucaggaaugaggcauagccgaugcaggcucuggaagugugggggccacagcuccccauucugagggugguagugaccagacaggaacuggggggcagagggggcuggagaauugguguggggagcccugggcggggcuggagcugagggcgcucuccgcagagaugacggagagacgagaagggagcaugguggaaaguuugggggugcccagggcgcggggagggcgucacuuacagcgaugacuucuagccgcugccgguagagggagcucuccgccaugggccuguugggagagggcaggggcuucgaggggcucccaucuugaacgccccccucuuggccaagaucccugagcaguauggaaauugccccgagcccagcacuuugccucuguuuccccuuugcaccugggaagagucugggcggggggcgagggucuugggaggggaacugagcagugaccacgacuggugaggcuaaagcccucccuaaaucuggcuuugucucucucagccucaguuuccucaucuguaagaugggcaggaauagcuugaccacccuguccuugccacccccgaucucagaggacgcuugcaaggagcuauucaugcagggaaaagcuuaggguacagugcuacaaaaauagucccauuguuuaugaauaaucauaauuuauauaauuccaugaugaauaauauguaugauuaauuauaauaaccaucuccaguccaaccugcagaaacucucaaaugccaccaggccccuaacaggcugugugccucuuucucuucccagucccacacccucucuggaccucagcuccuacccagaauuucucaagcgcugggggggcaagcgagucuguggcccucccacuguugccaugguaaccccagagcugccuccuccaccugcuaaccccccucccuggggacaaggaucacugggucacucugccuaggacuggacucugagcugggaggagggggacuugccauuuaagguuuaacucgagauuccccugucauugucuuccucaaaacaucucuacuucucagccuccagaguggccucuggacccacuuaggcucccguggaagcuggagggugacugucauacugcaggaugauuagggacagucagugucacaccaaccuuaucaacacagacaugcauugggcaccccugacuauguugcuauguugaccacgugucacaggccaguaucuagaaagcgaugucucucugccugucaucuccaccggcauggacgggcgcugaucaaacccucaaacauuuauuaauuugaacagucacccuacuggguaagccucauugccugaacuccagcuaggaccuuccagaucuucuguggccacaacgugaaggcuauuagcacuuauagugcuauauauaugauauauauauacuauauauagcauauaguguucuaagugccccacgggguuuccgcuagguucccacagccaccucugccucccccucccugccucuaucaugacacaguggagucaacucuuugcugaguugacauuccagcuaagaacaaaaucagccaaccauuagcuagcccguaacacgugccaggugcaauguaauucacugaauccucccaacgacucuaggagguaagcuauaugaauguguccauuuuauggaugggaaaacugagguucugagaaguggcagcaguguccaaggucauggagccaagaucagaacuugaagcuaucagauccaaaauacugagaacacagcuggcgaggggggugggggugcaggucuaggaauccccaucaagguagcuaagagagcagccuggagacccugaaugcuguuuggggcaaggaauugaagucaugcucuuucuuuuuuugagucggagucucgcucugucacccaggcuggagugcaauggcucaaucucagcucacugcaacccccgcuuccuggguucaagugauucuccugccucagccuccugaguagcugagauuacaggcgugcaccaccaagcccggcuaauuuuuguauuuuuaguacagaugggguuucaccauacuggccaggcuggucucgaacuccugaccucaggugaucugcccgccucggccucccaaagugcugggauuacaggcgugagccaccgugcccggccacgaagucaugcuuugcaagauaucccaaaggaagcccagauucugugcuuauagguuugccccugggggagggcugaagucccguggucuccuguaccacccccaagauguaaucucccugccucuuccuugcugggggggaucggguucccauugcuaagcaaccagguuuguaguuggugaauaaugcaauggaggaccuagaagggugaggaaccgaauuggggucccuaguguggggggaagccccuuuuccaaaacucuuuccaaaccucugaagcccccucuacccuuuuaaccuuaaaaaacucucaccccucagcuaugaaaagacuucacacaccccauuccaucuugcuuaucucuaacuaacucuggaagaacaacguaggcggccugggcuucuggccacccgcaagaguugguggccauuucaugaaggaggucauccuugcaauguugccauugucuuucucaggcugggagcuuuuaacuucuguuggaucucaagccuuuucucccaccuuggacacugacuuuaggggcaaaacguggaacccagugacccugaccuuccccacucccugcaccacagcaguagccccacccccuggcuggacuuuggguucucagcccuggcagcggaaaauccccgaagaggaaggggcagggggagccuauaucucucucccaccccuugacucuuuaaggaagggugacacugaugagccuaugggguuggcuagccaaccccuccacuccccggguccccuuaggagagaccacuggagcucucggcucccagacaaggccagcaucccccaugagccccucccaaggcccugcccaccagccccccugaccccccagacacuuacauggguguggccagagaccacaccuggcucugcagggccaucucugcccagaaguucacuuucuggucuccgaguuc

SEQ ID NO: 15679 - RNA, 6907 nt, Homo sapiens
acaggcuguugugggggguggcaugggucuggagauggggggcggugguggccacagcagaggcuccaggaggugaccgccugguuuccauuaggaaguccuggucagcagcuugggcgagauggcagagucagggcuggccaugguaagguggggcacgggagggucugaggguggggccugccugcccccccaccccugcucugccaacuggccacugccuccccaccaagacccuccccgaggaggggaugcuccagucaccauggcgacccugcgcccagccuggagacacgcugacccucccucccccgcaguggccgagccugcugcugcuccugcuguugccggggcccccgcccgucgccggcuuggaagacgcugccuucccccaccugggggagagcuugcagccccugccccgggccuguccccugcgcugcuccugcccccgagucgacacuguggacugugauggcuuggaccuucgaguguucccggacaacaucaccagagccgcucagcaccucucccugcagguggggcccacggaggggagugggggcaugcagggcugagacccaguggugaggggagcuggaggggugccccagagcugaggagcguggugggguauaggaacacacuugcaggagggcggugcagagcaggcugugauggagcuuugccuuggcagauuggcucugcaugcccaagaugagaggggugagcguggacaugcuggaaguugucggggacugaggauuagugguguuagggucaacaucuuggcgguuauaguguuguuuggaguuagugugauggggaguuugggguuauggggauguuguggcgugugggguugauggugggggugauggcacauuuggggucgauugugggggugauggcgcauuuggggucaauugugggggugaugucgcauuguggucgauugugggggugauggcgcauuuggggucgauugcgggggugauggcgcauuuggggucgauugcggggguguuggggcaugugggguugauugcgggggugauggcacauuuggggucgauugcggggguguuggggcaugugggguugauugcgggggugauggcacauuuggggucgauugcggggguguuggggcaugugggguugauugcgggggugauggcacauuuggggucgauugcggggguguuguggcaugugggguugauugcgggggugauggcgcauuuggggucgauuguggggguguuguggcaugugggguugauugcgggggugauggcgcauuuggggucgauuguggggguguuguggcaugugggguugauugcgggggugauggcgcauuuggggucgauuguggggguguuguggcaugugggguugauugcgggggugauggcgcauuuggggucgauuguggggguguuggggcauuuggggucgauugugggggugauggugcauuugggggugauugugggggugauggcacauuugggguugauuguggggguguugaggaauuuggggucgauugugggggugauggugcauuuggggucgguugugggggugauggcacauuuggguugauuguggggguguugggggaauuggggucgauugugggggugauggcacauuuggggucgauuguggggguuugggguuugacaucuuggcaguuauaagacugggucagagugaugggguguuugggauuaacugugggggugaugaugguauggggcugguuugggcugaugggaaguugagaaucagugcuuggggucacuuggucacggggucacgggugugaacaccccaacucucacccugcagaacaaccagcuccaggaacuccccuacaaugagcugucccgccucaguggccugcgaacccucaaccuccacaacaaccucaucuccuccgaaggugagggggcagagggaggcggccucucuggggcuguaggacugaccgaggucucagcugccaucccccucccccgccccaucugcgggcagcucuguggcaguucccagaacugcccuuugcugagcaggauggaaacucaggagcugggguggggguugggggcuguggcuuuugaguagggauggggaggaggggaucugagggccuggggagccucugccaguuccccggccgagaguccuggggcagcugggagcccagacucccccuccacccaagacaggccuggggucccuucacugccccccuacucucccaggccugccugacgaggccuucgagucccucacccagcugcagcaccucugcguggcucacaacaaggugagcccccagccccacccgcaggccgagcccagugagggugcagcuucagucacucagcccaggguguggaggggacagcucugcuggggaagugguggggccaaggcgcaccaggaccaguccggcugugggcuguguccccacagcucucaguggccccucaguuucugccccggucccuccgugucgcggaucuggcugccaaccaagugauggagaucuucccccucaccuuuggggagaagccggcacucagguagacccuggcccagcccaggcccccaggccucagauacaucugugucaugccccgguucuaggagcaaugagggaguuaagaccuugcccucggccgggugcaguggcucacuccuguaauccuagcacuuugggaggccaaggugggaggaucaucuggggucaggaguucgagaccagccuggccaacaugaugaaacccugucucuacuuaaaauacaaaaauuagcugggggugguggugugcgccuguaauccccgccacucaggaggcugaggcaggagacuggcuugaacccaggagguggaguuugcagugagacgaaaucgugccaccgcacucaagccugggcgacagagugagacucugucucaaaauuaaaaacaaaaacagaaacaaaaugccuugcccuggagggcuuaaccagggacagaucccuagccuuggggagugggaagagggcauaguucuacccugggaggagagugagcggggagacagggcccuguaugcugugucagaacuccagacugagguggagacaguaugugcagggacacacacacacacacacuuacacagacucacauacacaccugcacacacaaccacaugaacacaugcucaugcacacacaaucacaugcacacacaagcacacacacagacucacauacacaccugcacacacuuccaaccacaugcacacaggcacacacucaugcaugcacacgcaaucacaugcacacacaagcacacacaugcacauauguacacaaugcucacacuuuugcacaugaucacaugcacacauggacauacaugcauacacacaguugcacacucggcugcacacacacaaucacaugcacacuuaugcacaggcaugcacacaugcacacccacacuuacaaucacaugcacacacucacccaugcacacuuaugcacaggcacauagcacacacuugcauauacauacacacaugcacgcccacacacucuuacaaucacauacacacgugcacacacacuccacauaugcacucauuacacuuacacaugcacacugcucacacaugcacacacgucuauucauacaacacacaugcacacucaccugcacaccuacgcacagucacaugcacacauacacaauuacauucccacacagacuccacacaugcgcgcgcacacacacacacacacacacacacacacugaaggcgacccugagcaggguguggugcgggaguggggugguaggaggcgaggggcaggcugguggccggagccuggcucuccucagguccguguaccuccacaacaaccagcugagcaacgcuggccugccccccgacgccuuccgcggcuccgaggccaucgccacccucagccucuccaacaaccagcucagcuaccugccgcccagccugccgcccucacucgagcggcuccaccugcagguagcccugcuguaggucccaccccgggccagacucucuucaccucuuuccagggggaccccuccaguuccuagcuuuccauucuucucaauugccccucagaaugccaguggucagaguuauccuucuuugaaucacuuuauuggaaaucgcuuugagcucaaggcaagcuccucgucacucccuuacucaagagccgucuguggcuucccgcugcccucaucccagacucaagucucauucucuucuuccuucuccagaacaaucucaucuccaaggugccccgaggagcccugagccgccagacucaacuccgugagcucuaccuccagcacaaccagcugacagacaguggccuggaugccaccaccuucagguacaggcugguuggggggcagcaggggcugagaauuuacagucgggggucccaaccuucagucccccuucccugacuggcuccuaagccacggccucauuuacugagugccugcugcucacugggcucggcagagcacuggguaggugucccuguuccccacagcccugcacugacaucguaagucucacaugccuuuccaucucggcucuacccuggucacccccauagcuaacucucaggcuggaaucugcccugggcaccccaaguuuaccucccacccagcucucuccacgcaucacucccaagucaaaaucuccagcuuaaaucugucucaggaccacuccccagccuccccgccaaaaucugucaggcaccccacuccaagugccccaccuaacaccgacccucucuccuuccagcaagcugcauagccuugaauaccuggaucucucccacaaccagcugaccacagugcccgccggccugccccggacccuggcuauccugcaccugggccgcaaccgcauccggcagguggaggcggcucggcugcacggggcgcguggucugcgcuauuuguugcugcagcacaaccagcuggggagcucagggcugcccgccggggcucugcggccgcugcggggccugcacacgcugcaccucuauggcaaugggcuggaccgcgugccuccagcccugccccgccgccugcgugcccuggugcugccccacaaccacguggccgcgcugggugcccgugaccuggucgccacaccgggccugacggagcuuaaccuggccuauaaccgccuggccagcgcccgugugcaccaccgggccuuccgccgguugcgugcccugcgcagccucgaccuggcagggaaucagcuaacccggcugcccaugggccugcccacuggccugcgcacccugcagcugcaacgcaaccagcugcggaugcucgagcccgagccucuggccggccuggaccaacugcgggagcucagccuggcgcacaaccggcuccgggucggcgacaucgggccaggcaccuggcaugagcuccaagcccuccaggucaggcacaggcugguuagccacacuguccccagggccccuccaucccccugccugcccugccacgucccaaacauucuaguuagcugguaaagcaaucagaacaagaaaaugauaagaguggguuagaaggugaugaggaggcugggugagguggcucaugccuguaaucccagcacuuuggggagccaaggcaggagaaucgcuuuaggcuauggguuugagaccagccuggcaacacagcaagacccuaucucuaccaaaaaaacauagccaagcgugguggcacaugccuguagucccagcuauucaggaggcugaggcaggaggaucgcuugagcccagaaguuugaggcugcaaugagccgugaucgggccacugcccucuagacugggcaacagagcaagacccugucucuugaaaaaaaaagugaugaaagagguauggugcgauucaaugacugacucauuuaaucaaguggggaccugucugucugugccuuccugggaagggccuuaguuuaccucugcagaagggaggaauuuggcaaucaugggggguggggggcagaagggccaggcugguaugaagggggcaggggacucucagagagguugggggcuggcugagcugaguggcccaggccuggggcugccacgaugccaucuauaacccccugcccagaugcuggaccucagccacaaugagcuguccuuugugcccccggaccugccugaggcccuagaggagcugcaccucgagggcaaccgcaucggccacgugggccccgaggccuuccucagcacaccccgccugcgugcccucuuccucaggugccccgagggugaccggagggguggaggugggcaggggagggccugggagggucaugaccgccucucugugcagggccaacaggcuucacaugacgagcaucgcggcugaggccuuccuggggcucccaaaccugcgugugguggacacggcagggaauccggagcagguccugauccggcugccucccaccaccccacgugggccacgggcagggggccccugauccuagagaggcccagcagagcagcucagacuccugggacuccgcugggccguggacugaggagacaacgcccaccaggggcccuuggucuggcucuccugggccuccagggcugggccugcucugccugccacuggccgagacacagaggcacacagcuggcauacuccaggcucacagaccacgccggccuggcgggacacacccuaccccaaacucccaacacagauggaggcagcaacaauaaagccaaacccuuccagcacucagcacggaccaggcacccuuugggggcucuguccacggacuccuccccacaa

SEQ ID NO: 15680 - RNA, 2441 nt, Homo sapiens
uggagcgcggccggcggccgcccccggccggucucgggcccgcagcccgcccgccugagccucggccggcccggcccggggcggcggccggagcccggagugcgcgcccggcuccccuccccccgcggguaaguggaagucaggagggacccaggagggaggccgggagcgaucggcgccucggcggcagcggcgccggcaacuuuuccgcgccuggcucgugggcggaguggggcugcgcccggcggguccccaagagcguugcgagaaggcgagggcgccgccccgcgcgccuugagcgccccgccgcccggggugggucggggaucggggacagugcgucugacgguggcgacggcggccgcggagucccggggcgcccccuacggagcgggggaagggcggcccggccucuguucccuucccaguggccccuccaccccgaccccccaggggacgcaugggaaugcgguggggagggcggguccccgcgcgacuugggcaggucaaggugggcagagaguugucagggugggagggcuuguguccggcucggacauggggcuuggguugaggggcuuggauaugcauaugccuaccccacuccuagccccccgaccuggccuuuggacgggaggaauggguugggggggucucucagaguucuuugggugggggcggggguggauaccgguccaaguucuugacgugucgcccgcuggguagggggaaggucucuuguugggcaggggcuggugggagcuggggggaugucuccuuucccuucggagaaaagcgcucauucaagguugcauaggaaggaaagccagguuggggaccagcccugugcagcuugggguccccgugccuuuuggcugaaggaggagguuaaaagggcccagacugaaccccgaccccucugucuuagccccagacuguuuucugauuuuagcacuagauuuggcugccccuaaagcccuuagcccuaacugaccuuccugcccagcccagcccagcccagcccagccaggccccagacccaguggcuucuugaauguuuuggcugugcagcuggcuccuugucaccugcccccuucccaaccuuccccagcuggcagccucugacuccuggucuaugagggugaggcugggggcugggggaccccuggcauaagggguguccucuggcaguccugccccagcuggagggcuguacccaacaggugcccaggcuuagaggcgaggugauguuggacacacccuguccgcucgcccacaugcccugcccgggccagccuggguacauguguucacaugccgauguccugggaaggcacaggcccuggggcuggugcuagcuuuguucucugaucccgugaggcacccauggcccucugcccuugcagcacguccucugggagcuccuucaagaccccaacaggcaggccuugccuguggaucuagagggggcccuaaaauaggugccggccuggccuggggcuggcacgcggagcacaugcgugacagggcguguccagagggucgggccugucugugcuggccuggccacugagccuccgccgacccuugcucgcuggagaaagacagcagaggcggaugcuuuaggagggacccccgugucgugcccacccucuaacaaugcaaguggacgccagauguuccaugcagaccgcagcugcggggcaggcccccaucuaucugcaaucccaggguaauuagcccgguggguacacuggggugacccgcucgcccgaucuagguggugcuuugauaccucuuaaagcauuuuuuggaguuugcccuucaccuuggaaagcugggugggggauucuguccuccaugaauaacggcgccaggaaccuugggcgaucuugagaaaacuccuuccuguaaccucuguuuuccacguuggauguguuuuaggccacagucaggccuggcuuuuuuuuuuuuuuuuuuuuaagacuuauuccaugaccuuaagccccagucugaaucucugagccuuaauuauucuaucuauaaaugggaagcauuuggaaaugggacggagagaaguguacacuuugccccuggccgccuucuucccuccugguguccuggguggacacggaggugugucuggggaagguguguccuuuagggccggucgccugggaaggauguugagcggagggcagugggugugggugagaaucccugggcagagaagggcgccgccaugcugggcacggcugagucacgcuccagcgacgccuugccccagggugcuggagcuggcgccacccuggguguggucacugagcuguggcccugggcagagcagggcuggguggucuaggauguggggccucggugccuggggaacugacuucgaagaugccaagcccccuggccucccgccuggccuagguucuggg

SEQ ID NO: 15681 - RNA, 4787 nt, Homo sapiens
ugggccgaguaugaccccgcagcuugguaagaagucaccccgaauccuccagccacaauacucaccucucccuggaacuggaacacgggcuaggucaggccccagacucuggagcacugaacuccugggguccuagcaggggucucacagguucagucaggagagaagauauaagaaucaucacccuugcauaccccagauuaaacacguagggugccaacccugcccaaacccuggacuuucugggaaaugagggagggcgucaaccaugagauguccugaagagcccucuccuccuacgagucucuccugucucucacugugaagucuccagauggugaggaugcauuagccaggcuccagggagaaaaccaacagcaucccagccucaguucucuugagaguguggggaggagggcuggccuacccuuggcagacaggauuggcagcaacaucagaguagcagaacucagcucccacugggacccgugaaccugggagugagaggacauacaggccaggggaggacgcagagccucaggggcccaugcaucuuuguggccacaaagggagugggcgcucccaucuggguagacaccagaggggucccucuccacugacgggcaaugguuucagaggguggguuccaccuugugcacguguauugagugcccacccaacaccaagccuugaaggacacucagaggcuuuaucugaauaccuggaacccaccagccacuaacugaggauuuaguucaggcuggucuuggggccugaagaagcauuacuggggggcccucagcagccuaagccccaucuuccucuggccucagcaccagagaggaggccgucacgaggaaggugggcaggagguggucuuggcuauucccauagccucaaacaaguacuccaugagaccgagaggcuggggagagccgugggucuggggcugggcuuuggcugguuccuaacucuuccucuuuugauuuuaggucacagcaauuggaugcuguccccaaggccucuauuccacaagcccccccccaccccuguagcccauguagacuguggaggaggcagaugcagagagagccccaggggaggugcccugcagucccgaacucgacugacauccuacaccccugggucuccccagugucugggaauguacuggggaccuucacuuguccccagucucucccacuccuucaagccagggacaccccagccucgggcaucaugaccucgcugugugcccagggagcccgugugaacccauugccugcacuaacccccuuucuucuccuuucagcggucggauucauuauaaggauauguacaguuuauuacgaguaauaucucccccucucggcuuaggcaagaaauguccucauaggguugcuugcaagguuugacuuccacuaaaaccugcuagcauccauggaaugaguguggcuugggguucuucaauauauauauuucauauauauauauauauauaucucucucucucucuaaaaaaacagagccaucucucuuucuugcauuaaacuagaaaacucucuuagccaacagaaugcagucauguagacucgauaaagcauggaacauauuuccuccuucccuucagccuucagccaucuuugcuugcucuuagcugaagcugcccauccuggggucuccacggcaccccaaaucagauacauccccugggggauuguaacuuugcauuucucccccaaccaucaccuccacucucucccccuccaccccucaccucccaaagccccuagcccuccuccccucccuggcacuggccccugcuccccaccuaggcccccucagagaccagccucagccaaaccagagaacgugacccaacuguagaaauaacagugauggccgggcgcaguggcucaugccuguaaucccagcacuuugggaggccaaagcaggaggaucgcuugagcccaggaguuugagaccagccugggcaacauagcaagaacccccuucucuauaaaaaauuagccaggcauuguggcgcaugccuguagucccagcuacuugggaggcugaggcagaaggauugcuugagcccaggagguggaggcugcagugagcuaugaucacaccacugcacuccaacccaggcgacagagagagacccugucucuuuaaaaaaaaaaaaaaaaaaaaaaaaaggcaaugaacaaaagcauggcucuacgucuuccaaagugagaauucucccuccccuccgcaucccuccagaacuguagcucagagcccacgcugaaucugacuuuucucuuuucucucucucucccugcucccgagcagugaaguaaucuuuuuuuacugaccuuuucuuccauuuuuuuuccuccucuuuuccauugauuugaaauaucuauuuuaucauucucugcaucuuucucucucuauuuuuucggcucguguggauuucuuuuuucuuucuucuguuucuccccaccucucuuccuuugguucucuguucccauucccguuuuguuuuuuuguuuuuguuuuuguuuuuuucauuuucggugcugccaggggccgcaugccuuaccuggacauguaucagaugcugagacacaugucuccgccccugggucuggggaagaaguguccggccagaguggcuuacaagguagacuacccuugccgaccaccgacguccaggcacuggguuuuuuuuucuucuucuucuucuuuuuuuuuagugcugaccagaaacacccggccgacucucuuuuuccaacguuucucuucuuuuuuguuuuugauucuuuuuuuucuuuucucgagucaacugaucaugaccaucccuugauucuaagcagcacacuguguccguccuuucugaugagugucuucguguuuugagacuccauuauggccgacaugccggggggagggggaggggagcgcccagguccccuugcaccuggucucccagguaccaaauuggaaacaaacacgcuucuucagggagucaaaacccaugcuucccacuucugcccacccagagcggcccccaugcccaggcuggggcaggcgccuugcagagaggggcuuuagcccccgaaagcaggcgaggucccggguccccgccccugccacgcacaccugaagcugaucucugaccuagggccuuggggauucgagaccuuccaaggagcaccaagaaccucucuuccccucccuuccuuccccuggaguuucguccccagcccccgucccuaauccccccaagacaccccaacaugccucuccauuguuccagagugggcaggcggccgcagcuggaccccuggacgguggcacacugaugcaggccaugcacgcugccuuggcggggccuggggcgggcaggcaccauggccgacgggggguggugcaugcuggcugagagagcgagcguccugccgccaagcggcuggcccgggccaccccuccagaucccuguccuggaaucucccuuggugcccaaggacagaugcucuguucccuccauucauccacaagaaguucagggaugaccuuuaaagauucuccccacccaaaaaguauuaccccaucauccuauucucccauccaccuugaucuucccugcgucccuauccaucaaugcuauuuguaccugccccguguugccaccucauuccuuuccuuccucugugcaccccuccucaccuaaccuauaugucuccccuccuucucaaucaaagccggggacaagguugucccaccagcaucucagacaaugagccucuccuggcaccugucgcucugugccccucccugccgcccccccccccccccccgguuuuccucaagucgcuucucucagucucugcuuagaugaaugugugcgcaugugcaagagagggagggcgagcccuuccucuccuggucuuugugcaggaccaccauggguccauaagacaacuuugugcaaauuugaaaaaggcacccuuuccacagaacaugccuguuggaaaauuguugcaaucuaccaauguggugagaacaagacacuuuuuuucuaucaccugggaagcuguuauauuuaauauacaaaucgggggcugggcgugguggcucaugccuguaauccuagugcuuugggaggcugagacgggaggaucacuugagcccaguucgagacuagccugggcaacauagcgagaccccaucucuacaaaaagaaaaaauauuuuaauuaauaaauaaguacauaaaucuaucauuuccaagaugggagcccuuugugcgguguacaaccugcacaacugugcacaguggcccagucuauguguguuucucuauuucccaccuccuuccccacccuacccccaguguccccuccaguguccugcucuggauuuaccauaccccuccccaucuucaacucuguguuuccugcccacuugugucugaauccccacccaaguugcccucaccccccuucucugugccacuucagccugggcuggugcacaccagcccagcauccucucccaugccaccaagcaugguggacagagccccugccugggacauggggaaucuuuucuucccugggcuggaagggagugccccucaccccuucccccugccauugcacagagagccaagaucuggacaugccccugagauacacuucccacggagcuaugaaugagucucgagauuccgucugcaugcgccccugucugugcuguucugugucacagccucgcugcaugccugcgagg

SEQ ID NO: 15682 - RNA, 4787 nt, Homo sapiens
ccucgcaggcaugcagcgaggcugugacacagaacagcacagacaggggcgcaugcagacggaaucucgagacucauucauagcuccgugggaaguguaucucaggggcauguccagaucuuggcucucugugcaauggcagggggaaggggugaggggcacucccuuccagcccagggaagaaaagauuccccaugucccaggcaggggcucuguccaccaugcuugguggcaugggagaggaugcugggcuggugugcaccagcccaggcugaaguggcacagagaaggggggugagggcaacuuggguggggauucagacacaagugggcaggaaacacagaguugaagauggggagggguaugguaaauccagagcaggacacuggaggggacacuggggguaggguggggaaggaggugggaaauagagaaacacacauagacugggccacugugcacaguugugcagguuguacaccgcacaaagggcucccaucuuggaaaugauagauuuauguacuuauuuauuaauuaaaauauuuuuucuuuuuguagagauggggucucgcuauguugcccaggcuagucucgaacugggcucaagugauccucccgucucagccucccaaagcacuaggauuacaggcaugagccaccacgcccagcccccgauuuguauauuaaauauaacagcuucccaggugauagaaaaaaagugucuuguucucaccacauugguagauugcaacaauuuuccaacaggcauguucuguggaaagggugccuuuuucaaauuugcacaaaguugucuuauggacccauggugguccugcacaaagaccaggagaggaagggcucgcccucccucucuugcacaugcgcacacauucaucuaagcagagacugagagaagcgacuugaggaaaaccgggggggggggggggggcggcagggaggggcacagagcgacaggugccaggagaggcucauugucugagaugcuggugggacaaccuuguccccggcuuugauugagaaggaggggagacauauagguuaggugaggaggggugcacagaggaaggaaaggaaugagguggcaacacggggcagguacaaauagcauugauggauagggacgcagggaagaucaagguggaugggagaauaggaugaugggguaauacuuuuuggguggggagaaucuuuaaaggucaucccugaacuucuuguggaugaauggagggaacagagcaucuguccuugggcaccaagggagauuccaggacagggaucuggagggguggcccgggccagccgcuuggcggcaggacgcucgcucucucagccagcaugcaccaccccccgucggccauggugccugcccgccccaggccccgccaaggcagcgugcauggccugcaucagugugccaccguccagggguccagcugcggccgccugcccacucuggaacaauggagaggcauguuggggugucuuggggggauuagggacgggggcuggggacgaaacuccaggggaaggaagggaggggaagagagguucuuggugcuccuuggaaggucucgaauccccaaggcccuaggucagagaucagcuucaggugugcguggcaggggcggggacccgggaccucgccugcuuucgggggcuaaagccccucucugcaaggcgccugccccagccugggcaugggggccgcucugggugggcagaagugggaagcauggguuuugacucccugaagaagcguguuuguuuccaauuugguaccugggagaccaggugcaaggggaccugggcgcuccccucccccuccccccggcaugucggccauaauggagucucaaaacacgaagacacucaucagaaaggacggacacagugugcugcuuagaaucaagggauggucaugaucaguugacucgagaaaagaaaaaaaagaaucaaaaacaaaaaagaagagaaacguuggaaaaagagagucggccggguguuucuggucagcacuaaaaaaaaagaagaagaagaagaaaaaaaaacccagugccuggacgucgguggucggcaaggguagucuaccuuguaagccacucuggccggacacuucuuccccagacccaggggcggagacaugugucucagcaucugauacauguccagguaaggcaugcggccccuggcagcaccgaaaaugaaaaaaacaaaaacaaaaacaaaaaaacaaaacgggaaugggaacagagaaccaaaggaagagagguggggagaaacagaagaaagaaaaaagaaauccacacgagccgaaaaaauagagagagaaagaugcagagaaugauaaaauagauauuucaaaucaauggaaaagaggaggaaaaaaaauggaagaaaaggucaguaaaaaaagauuacuucacugcucgggagcagggagagagagagaaaagagaaaagucagauucagcgugggcucugagcuacaguucuggagggaugcggaggggagggagaauucucacuuuggaagacguagagccaugcuuuuguucauugccuuuuuuuuuuuuuuuuuuuuuuuuuaaagagacagggucucucucugucgccuggguuggagugcaguggugugaucauagcucacugcagccuccaccuccugggcucaagcaauccuucugccucagccucccaaguagcugggacuacaggcaugcgccacaaugccuggcuaauuuuuuauagagaaggggguucuugcuauguugcccaggcuggucucaaacuccugggcucaagcgauccuccugcuuuggccucccaaagugcugggauuacaggcaugagccacugcgcccggccaucacuguuauuucuacaguugggucacguucucugguuuggcugaggcuggucucugagggggccuagguggggagcaggggccagugccagggaggggaggagggcuaggggcuuugggaggugagggguggagggggagagaguggaggugaugguugggggagaaaugcaaaguuacaaucccccaggggauguaucugauuuggggugccguggagaccccaggaugggcagcuucagcuaagagcaagcaaagauggcugaaggcugaagggaaggaggaaauauguuccaugcuuuaucgagucuacaugacugcauucuguuggcuaagagaguuuucuaguuuaaugcaagaaagagagauggcucuguuuuuuuagagagagagagagauauauauauauauauauaugaaauauauauauugaagaaccccaagccacacucauuccauggaugcuagcagguuuuaguggaagucaaaccuugcaagcaacccuaugaggacauuucuugccuaagccgagagggggagauauuacucguaauaaacuguacauauccuuauaaugaauccgaccgcugaaaggagaagaaaggggguuagugcaggcaauggguucacacgggcucccugggcacacagcgaggucaugaugcccgaggcuggggugucccuggcuugaaggagugggagagacuggggacaagugaagguccccaguacauucccagacacuggggagacccagggguguaggaugucagucgaguucgggacugcagggcaccuccccuggggcucucucugcaucugccuccuccacagucuacaugggcuacaggggugggggggggcuuguggaauagaggccuuggggacagcauccaauugcugugaccuaaaaucaaaagaggaagaguuaggaaccagccaaagcccagccccagacccacggcucuccccagccucucggucucauggaguacuuguuugaggcuaugggaauagccaagaccaccuccugcccaccuuccucgugacggccuccucucuggugcugaggccagaggaagauggggcuuaggcugcugagggccccccaguaaugcuucuucaggccccaagaccagccugaacuaaauccucaguuaguggcugguggguuccagguauucagauaaagccucugaguguccuucaaggcuugguguugggugggcacucaauacacgugcacaagguggaacccacccucugaaaccauugcccgucaguggagagggaccccucuggugucuacccagaugggagcgcccacucccuuuguggccacaaagaugcaugggccccugaggcucugcguccuccccuggccuguauguccucucacucccagguucacgggucccagugggagcugaguucugcuacucugauguugcugccaauccugucugccaaggguaggccagcccuccuccccacacucucaagagaacugaggcugggaugcuguugguuuucucccuggagccuggcuaaugcauccucaccaucuggagacuucacagugagagacaggagagacucguaggaggagagggcucuucaggacaucucaugguugacgcccucccucauuucccagaaaguccaggguuugggcaggguuggcacccuacguguuuaaucugggguaugcaagggugaugauucuuauaucuucucuccugacugaaccugugagaccccugcuaggaccccaggaguucagugcuccagagucuggggccugaccuagcccguguuccaguuccagggagaggugaguauuguggcuggaggauucggggugacuucuuaccaagcugcggggucauacucggccca

SEQ ID NO: 15683 - RNA, 15017 nt, Homo sapiens
cuggaccccagagaaggccuaaguugaacuggugguggugagccaucaaugagcucauccgaccagcgagcucggcacagggccuggcccaggacgagugucccagagguagaucccugggccagggugugagugccugauuugauccccuuaacucuucucugugcccugccuucaccccgucgggagccuccaaaccaccaucaacagaguuuuacaugcucauucccucuaauucuucacccccagggagauggcacacagaacucaggcucaaggaguuggugccugggaggccaugguacuaauauauacgaugguugcugugaggucccauccacuaggcuugaaccaccagcuucuggccacaaaagguagagaaagaaugcaggauccuaaaauacccagguaacgucugcugggcugccucccuguagauauauaaggugggggugggcaagggccaccuugugauaaacaagaugccuaagcuagguguuccagacugucuccagcugcccacacaaacacccacuggccagugccuuugaacaguuggcagaggcuugcccaagggguagggucaggacucuagaggcuucagggaugaggugugagaaagacggaaccccuuaacacuugaguugggggcgguggggggcgcaucuuaguauauaccuucuggucacaccagcuuuuccugaccugcccccacauccccccuagccuagcccaaaaggcucugcucucucgacucccaaaacuccuacagcagucccucaccuuaccugaucgcccccacaucuagccucccccuccccacaucugaguccugaccucaugugacccccggaaaacaucucugggaucuccuauccgcccccacacgaaguaacuccgcccacacccgccgugccccacuuccugggcuucuccucagccgcccccaggccuguaacuugacccacccaccuccuccagcgcccaggcgguaccugcaggcccggccccuccccgccccccuccggccgcgccgcucuccucuccucccccacucggccuggccggagcccgacuccuccucccccucccccucccccuccggcauccacgagaaccuccucacuuuuccgccucggacccuccaacuuccccggauccccgguaccugccccggcccgaccuggcccccucccucgcugggagacgggggagcgguccagguacgauccugccgcccccaagcccugaagcucgggcuggacgcucaaggccgcccgcgguagcugggccuccacacacucgccugcccgggcacagugcaggcugcgggcccggcuccuccucgguccgagaaagcacccaggcccuccccacucagcccucgggccgccccggcuggaggaggccggaaccgggccugaggcgggccgccucaccugcgccguggccgcgcuccggggggucccggcgggcuccgcagcggcggcuggggccgggccugggcccggggcgcgccccgcugcgccggggccucggccuccgccuccgcggccuccgcggccuccgccucagcagcagcggcagccgcggcggccauucauugugggccaggccgccccagccgagcgccgagcgagcgcaagccgcgcugccgccgcagccaggccagggaggagcggccccggccccgcccgcgcaccgcccucgggccccgcccuccaggcgaggccagccgagcuccgagcgcgccccuucuaaccggcuccgucuccucucuaugccccugggggauccucgccaguacgucggcucagcucgaugguucgaauccuggccccgccaccuucuagucccgcgaccuugggcaagucgcucuaccuuuccgaacuuuaguuuccuguaaaacaaaaacaauaaugacugcuguuuauuguggcaggcacugcguuacauucuuuaugggaauuagcucguuuaaacuacacaguaacauuuuuuagugagaacugcuacagacacacuauagaaaauaaaggcagcugggcgcggugucucacgccuguaaucccagcacuuugggagaccgagguggguggaucgccugaggucaggaguucgaaaccagccuggccaauauggugaaacucugucucuacuaaaaauacaaaaauuagccgggcgugauggcaugcgcuuguaaucccagcuacucgggagacugaggcagaagaaucgcuugcacccgggaggcggugguugcagugagccgagaucaugccacugcacuccagccugggcgagacuccgucucaaaaaaaaaaaaaaaagaaagaaagaaagaaaaggaggcacagagaaaugaagaaagcuggucaagaucaucacacagcaaggaagugaugguaggugccaggauuuaaacacaggcucaaaagcgacaauaagaccuaagacuuuuaugaugcuuaccggaugcuagguucuguuagcauuuuaccugcacuaacucguuuacuucucacuacaacccaguaacaaaugguaaaaaaaaguucugcccauuuugcaaaagcgguaacuuaaguucagaguuaacaagucgcagggcgagcugagacuggaacccagguagccgggaccacuucgcuguccugccuucauacacugguuagaacuuuaccgagcgcuuacaauguuagagugguucuuugcacacuuuccaggaaucugucauuuaaucuuugcucuaucugagaaaccacgauucucauuuaauagguaagaaaagugaagccgcgggaguaaccugcccagagcaugugaugggacugagauucaaacccgguaaauccaacuccagagccugagucauuccugcagggugcucugaaauaauguguauauagcacccagaacacagaagaggaccaauaaguguuggguuucuccgcuuaccgccccuuuucugagccacaacuuccucaucugugaaaugggacuagggacguguccucucccaggggauccacugugauuaacacccccggaacagcacgaucagcgcgcuuccuuuauggcuuucauuuugaucccggccgcccaccguacguuuccucauugacuggccaaccacuaucaugugauucgcccacccacugugccaacauggcggcgcccagguccuaauucgggaaacgugcaccuugacuaauucgguuuucuguggcuacgagagcaggugaggacgggcuaggcagcgcggggagggauucggacucggggcgggccugcacgagggcaucggcuccacagggaccagucauccccaaaacgaggggauaucagcuuaccgaggccgcagguuuuccuagucccuaccucauagauauguaggacauccccgggcccggaaugcggcucucugacccucucugugcccucccccgccccccgaaccaggcuuggcgggcggaggcgccagcggaugucucaugcaaggaucgucucuguggcuaagccucacuuuccgcuccgcccgggugcucucuagagcccgguuuuucgaguggcagucuccagggcugccgaauacagcagcgauggagaacggcaccgggcccuacggagaagaacguccacgugaaguccaggagacgacagucaccgagggggcugccaaaaucgccuuucccagugccaacgaggucuuuuauaacccggugcaggaauucaaucgggaccugacgugagcaggggucagacguuagccuggcaucggcuagugggucaguguggauggcgggggcgggguaugagcuaguccucugucucccaccagaugugcugugaucaccgaguuugcucgcauucagcuuggggccaaaggaauccagagugaguggagguccaggcuucuggugggcgggggucacacaaguuuaucucccugccugggcucuucugccgcccaaauccagaggggcuucagccacauagcaggcccuggguucugcuccuucagccuuuccgcagggauuucagggacgauauuuuggagauuaaggggagguuucucagaggggaccuuguuauucucugacuugugccucuggguggcugcagucaagguuccaggagagaaggacacgcaaaaaguggucguggacuugucagagcaagaggaggaaaagguugaacugaaagagagugaaaaccuggccucaggagaccaaccucgcacagcggccgugggggagaucugugagguggggccugagcauaggagcuggcagcccuggaauuuagcgggagacagagggcuccuggagggggagagcuauaggagguggguggugggggcuccuuggggcccagaagaggauggagguggagaugugagggagguuuucugcuuacuccaacaggaaggccugcaugugcuggaaggccuggcagcuucaggccuacguuccauucgauuugcccuagaggugccugggcucagaucugugguugcaaacgaugccuccacccgggcuguggaucucauacgccggaauguccagcucaaugacguggcccaccugguacagccgagccaagcagaugcccgguagguucugggcaucacagccuagcucugggacaagccugccuggggucaaauucuggcucugucacauucucacucugugaccuugagugagugacuuagccucuuugagccccaguuuccuugucugucaacugagaaaauuaguuuuacagggguugcugugaugaguaauagauaauuaugguaugauccauacucugugccagaaauaaguagcauccuggucucuguuuuaacuucuuacacuccuuuuauucauucaaaugagccauaguauauccagugucugcuaugugucaggcaccguuuucaagaacuggaaaugcaucaggaaacaaaacaugcaaaauuggugaccuucgcaagaguuggcaaacuauagccuguggggcucacagccuuuuuuuguuuguuugcuuguuuguuuguuuuuugagauguagucucgcccuuguugcccaggcuggagugcaguggcacgaucucagcucauugcaaccuccgccucccggguucaagccauuccccugccucagccucccgaguagcugggauuacaggcacgugccaccacgccuggcuaauuuuuauuuuuauuuauuuauuuauuuuuugacacggagucucgcucuguugcccaggcuagagugcacuagcgugaucuuggcucacugcaaccuccgccucccagguucaagugauucuccugccuuagccucccgacugaguagcugggacuacagacaucugcuaccacacccaccuguauuuauaguagagaugggguuucaccaugguggccaggauggucucgauuuccugaccucgugaucugcccgccucggccucccaaaguggugggauuauaggcaugagccacugcaccuggcuaugccaggcuaauuuuuauauuuuuaguagagacaggguuuugccauguuggccaggcuagucucaaacuccugaccucaagugaucugcccaccucggccuuccaaagugcugggauuacagacgugagccacugcgcccggccuagccuaguuuaucaauggcccacaacccaagaauguuuuuuacauuuuuaaagguuaaaaaagaagacuaugcaguagggaccacauaugacucacaaagccuaaaauaccuucugaccuuuuacagagaaaaaaguuuuuacuuuucugaccuuacuagaauccaaauaguaaucacagacaaugaaaaguaauuagcugggcauggugacucaugccuguaaucaagcauuuugagaggccaaggcaggaggaucgcuugaggccaggauuucaagaccagccuaggcaacacagugaaacccgucucuacaaaaauuuuaaaaugaggucagacgcaguggcucaccccuguaaucccagcacuuuggaaggccgaggugggcggaucacuugaggucaggagcucgagaccagccuggccaacaugguaaaaccucgucucuacuaaaaauauaaaaauuagccaggcaugguggcacgugccuguaaucccagcuacuugggaagcugaggcaggagaaucgcuugaacccaggagguggaaguugcagugcgccgagaacccaccacugcacuccagccugggugacacagcgagacucugucuccaaagaaaggaaaaaaaaaauguguuaauacaucuauaaacugcuugaaauggugucaggcagauacgucuuauaucaguauuguuguuguuuuagauguguggacugaguuccacauggugcuuuuccuaaguaggaaaauugugcaguuuaauaaaugaccaaggccagugcaguggcucacacuuguaaucucagcacuuugggaggccgagguggauggaucacuugaggucaggaguuugagaccagccuggccaacauguugaaaccccaucucuacuaaaaauacaaaaauuagcugggcgugguggcacaugucuguagucccagcuacucuacucgggaggcugaggcgcgagaauugcuugaacuggggaagcggagguugcagggagccgagaucacaacacugcacuccagcuggcugacagagcaagacuccgacucaaaaauaaaauaaauaaauaaauaaaugacugagccaggacuugaacuugggaaucuggccccggaguucagacccaaaccacugugcuguacgaguuaauauguguaggggacagagaagguaccuggcgugggaggcugaggaccuggcccucuuugcacccaggaugcugauguaccagcaccagagggugucggagagguuugacgucaucgaucuggaccccuauggcagcccagccaccuuccuggaugcagcugugcaggcugugagugaaggaggugagguggggauggcacuggggugggagcagggcuugggguguuggaggguucucacugcccagccccucucugcaggguugcugugugugaccugcacagacauggcgguguuggcggggaacagcggggagacgugcuacagcaaguacggggccauggcccucaagagccgggccugccacgagauggugaggggcccucugccagccagccagggagaccgggggacaggugguugucugagucccuucccaauacacuuucccccuccucagaccugcucagcuuccuccaggcugauggccagaugcaucccaggcuguuaacgacaggcgugucuucaacccacauaguuccuaagagcauggcugauaaucauggucauuuggggacaguggcuuuggccaggacaggagugcauggccacauuauuuuaguuuucuguauuaaaacaacuuuucaaaaaaaaauuuuuuuuuuaaaggucguuuuuccaggacuggguuuaaauccuagcuuugcugguagcucugggcaagugacuucaccuuucugguccucggguuuuuuugcaucuguaaaaugggcacaaugauggucugaaggccgggcgcaguggcucacaccuguaaucccagcacuuugggaggccuaggcagguggaucaccugaggucaggacuuugagaccagcuggccaacaugguaaaaccccaucucuacuaaaaauacaaaaauuagccaggcaugguggcagauaccuguaaucccggcuacucaggaggcugaggcaggagaaucacuugaacccaggaggcgagguugcagugagccaagaucacuccgcugcacgccagccugggagggagaccccaucucaaaaagaaaaaaaauaggccgggcgugguagcucacgccuguaaucccagcacuuugggaagucgaggugggcggaucaugaggucaggagauugagaccauccuggcuaacauggugaaaucugaucuccacuaaacauacaaaaacuuagccaggcaugguagcgggcaccuguagucccagcuguucgggaggcggaggcaggagaauggcgugaacccaggagguggagcuugcagugagcugagacugugccacugcacuccagccugggcgacagagcaagacucugucucaaaaaaaagaaaaaaaaauaggccgggcgcgguggcucacgccuguaaucccagcacucugggaggccgaggugggcgguguucaagaggucagguguucaagagcacccuggccaacauggugaaaccccgucucuacuaaaaauacaaaaaaaaaaaaaaaaaaauuagcugggcgugguggugggugcuuguaaucccagcuauucgggaggcugaggcaggagaaucacuugaacccgggagguggagguugcggugagccgagauggcaccauugcacuccagccugggcaacaagagcaaaacucugucucaaaaaaaaaaaaaaaaaauggucugacccuauugagugucugaucaggauucaagaaggcugaguggcgaagugcagcggcucaugccuguaauccuagcacuuucggaggccaaggugggaggaucacuugaggucaggaaccugggcaacauagcgaggaccccaucucuacaaaaaaacccuaaaaauuaccuagguguggugguggaugccuguggucccagcuacucuggaggcugaggcaggaggaucacuugagccuaggaguucaaaguuauugugagcuuugauagugccacugcacuccagcgugguccacagagggcucuugcccuuguuccuaaaggguccugucaugaagucagcccgggaaaugcugucuccuuucccauaucagagucucacacuagcaggaaagcccuagccguuuugcuuuuuuuucuuuuuugagauggaguuucacucuuguugcccaggcuggagugcaguggugagaucucagcuaacugcaaccuucgccucccagguucaagugauucuccugccucggccucccuaguagcugggauuacaggcgcccgccaccacacccagcuaauuuuuuguauuuuuaguagagacggggauuucaucauguuagccaggcuggucucaaacuccugaccagccucccaaagugcugggauuacaggcaugagccaccacgcccggcccaggccccagcaguucuacagcaccuaguauccccacuuccugcccacagagcccuugggggcuggaacguggguccucaguacaugccacauggcacaccgauaaugcuggucagaauagguuggaucuaugcuuuccucacucguuuagugcccccagcagugccacagacagggacuguugugauuuugcagaugaagaaacugaggcacagagaggggauacucacuuguugagggucccacagccaggacuuucaggggugggcuuggaucccagggagcuggcccugagccuguacuugugaguaccacauagggcuccuggugggguggguggauaguggaggggaggcugacacccaccccccacccccaggcccugagaaucguccugcacagccuggaccuccgcgccaacugcuaccagcgcuucguggugccgcugcucagcaucagcgcugacuucuacgugcguguuuuuguccgugucuucaccggccaggccaaggucaaggccucagccaggucagcccgggggcagagagcggugguggauugagagaggagacaggaccuugcccugggggaucuggggcuucuuaagggacagagccagucuaagggaggaguuggggugucguggucacgcugggaacucguggccacugguaccccccacagcaagcaggcgcugguguuccagugugugggcugcggggccuuccaccuucagcgucucggcaaagcgucaggaguccccagcggccggugagcagggaggaaggagaagaaggggagucccaggguuuuccucccuccccaccaaccaccccucucuguuuagggccaaguucucugcagccuguggucccccugugacccccgagugugaacacugugggcaacgacaccagguagggcuaggccaggggaggcaaaggagcaagagggucuugaaggucauagucccugcucaccuguccccggugcgcccccagcuugguggccccaugugggcagagcccauccaugaccuggauuuugugggccguguccuggaggcugugagcgcuaaccccggccgcuuccacaccucggagcggauccgagggguccugagcgucaucacugaggugagagccgggcugugacggggaagggggcuccaccugugcccguccaucuccacucaugcccauccugucccccaucgcaggagcucccggacgugccucuguacuacacccuggaccagcugagcagcaccauccacugcaacacaccaagccuccugcaguugcgguaagagccccuggggucgggaggagccugucccagaccacaggguggccuggggcaaguccagggauucucaugcauagaacuugcgaggggguggggagaacccggugcacugucucauuccuguaaucccaguaccuugggaggcugaggcaggaagaucacuugaggccaaccugggcaacguaguaagacccuaucucuaacaaauaaauaaauaaauauauauguacacacacauacauauacacacacauacauacguauguauacacacacacacacacacacacacccauuagccuggcauggugauacaugccuauaguccuaacuacucaggaggcugaggugggaggaucauuugggccaggaguuugaugcuaaagugagcuaugaucaugccacuccagccugggugacaaaaugagacccugucucuuuaaaaaaaaaaaaaaaaaaaaaaaauuaggccaggcuuauuggcucaugccuauauucccagcacuuugggaggcugaggugggcagaucacuugaggucaggaguucaagaccagcguggucaaaaugguuaaacccugucucuacuaaaaauacaaaaauuagcugggugugguggcacaugccuguagucccagcuacuugggaggcugaggcacgagaaucacuggaaccugggaggaggaggaggcgguggugagccaagauugcgccacugcacaucaaccugggcaacagagcgagacuccauuuaaaauauaauaauaauaauuagaaaaagaaaaaggccaggugugguggcucaugccuguaaucccagcacuuugggaggcugaggcgggcgaaucacuugaggccaggaguucgagaccagcccggucaacguggcgaaaccccaucucuacuaaaaauaccaaaauauuagccaggcgucauggcacaucccuguaaucucagcuacucaggaggcugagacaggagaauugguugaaccugagaggcagaggcugcagugagccaagauugcaucauugcacaccagccugagcgacagagugagacuccaccucaaaaaaauaauaaauaagaaggccaggcacgguggcucacuccuguaaucccagcacuuugggaggcugaggcgggcggaucacaagguuaagagaucgagaccauccuggccaacauggugaaacccugucucuacuaaaaauacaaaaauuagcugggcgugguggcacaugccuauagucccagcuauucgggaggcugaggcaggagaaucgcuuaaacccaggaggcggaggcuguggugagccaagauugcgccauugcacuccagccugagcgacagagcgagacuccaucucaaaaaaaaaaaaaaaaaaaaaaagaaaagaaaagaaaugaacucuguagccaugagcccuugccgaagguagucuuaccuacgcuggucagcuugggcuuuggggucaaggaguccggcaucucccucauaaucccugcuguuccccaggucggcccuccuccacgcugacuuccgggucucacucucccacgccuguaagaacgcugugaagacggaugccccugccucugcccucugggacaucaugcguugcugggugagggcagggcugaccucaugcaggugggagggcaggugguggucaccuggaggucccuugggccuaguauucccuaaccucugaccucugcccccaggagaaggaauguccggugaaacgggagcgacuaucagagacuagcccagcguuccgcauucucaguguggagcccagguaggggcaagcacaugcaggagcggccagggcugcccacagacauggaagcacaugugugugcagacaacacagaugcugccccacacagacucgugcccauucuucaagugagauucaaaaucugcugacuggggcuggguagguggcucacgccuguaaucccagcacuuugggaggcugaggcagguggaucaccugaggucaggaguucaagaccagccuggccaacaugguggaaccccaucucuacuaaaaauacaaaaauuagcugggcauggugugguggugggugccuguaaucccagcuacucaggaggcugagacaggagaaucgcuugaaccugggaggcagagguugcggugagucuagaucgcgccauugcacuccagccugggcgacagagcgagacuccaucucaaaaagaauaaaaaaauagcugggugcgguggcucaugccuguagucccagcacuuugggaggccgaggcaggcggaucacgagaucaggagauugagaccauccuggcuaacacagugaaacccugucucuacuaaaaauacaaaaaaaaaaaaaaaaaaauuagccgggcgugguggcaggugccuguagucccagcuacucgggaggcugagacaggagaauggcgugaaccccggggggcagagcuugcagugagccgagauagcgccacugcacuccagccugggugacagaguaagacuccgucucaaauaaauaaauaaauaaauaaauaaaaauaaaaauaacuaaaucugcugacugggcugggcguaguggcucacaccuguaaucccagcacuuugggaggccaagacaggcagaucaccugaggucaggaguucaagaccagccuggccaacaugacgaaacccugucucuacuaaaaauacaaaaaaaaaaaaaaaauuagccaggugugguggcacaugccuguagucccagcuacucgggaggcugaggcaggugaaucgcuugaaccugaggcagaguuuguagugagccgagaucgcaccacugcacuccagccugggcgacagagugagacuccaucccaaaagaaaagaaaauuagcauuaccagcauaccagggguaacuuuuuguccauuuuguucacugucuauucccagcacugagaacaaugcaggcacacagucguuaaauaaaaauguuuauuaaggccaggcaugguggcucauuccuauaaucccagugcuuugggggccaaggcgggaagaucgcuugagcccaggaaugaaaccagccugggcaacacaguaauuaagacuccaucucuaccagaaaacuaaaaaaauuagcugggcauggugguaccugccugucgucccagcuacucaggagcuugaggcggaggcaggaggguugcucaagcccaggaguuccagacugcagcuuugauggcgaucgcaccacugcacuccagccugggcagcagagugagacccuguaucuuuauuuuauuuuuuuuuagacagaggcucacucucuugcccaggcuggagugcaguggugcgauuucagcucacugcaaccuccgccucccagguucaagcgauucuccugccucagcgucccgaguagcugguaucacaggcacccggcaccacgccuggcuaauuuuuguauuuuuaguggagaugggguuucaccauguuggccaggcuggucucgaacuccugaccucaggugauccacccgccucagccucccaaaaugcugggauuuacaggcaugagccaccgugccuggccgagaccccaucucuuuaaaaaaaccaaaaauguuuauuagaugaaugagagaauccugacaugagcagacaccucgugcuguguuguggaggcggacaggcccuguggggaguggggacacacucguguggcagcuucccccagccccaacgccccaccccugcuucccuaggcugcaggccaacuucaccauccgggaagaugccaaccccagcucccgacagcgaggacucaagcgcuuccaggcuaacccggaggccaacugggguccccggccucgugcccggccagggugaguggugguaagguggggguggggcucagccagggaaagaagggguaaagggcagauggggucccaccuacuccuccccucgcacaggggcaaggcggccgacgaagcuauggaggagagacgcaggcugcuucagaacaagcggaaggagccgccggaagauguggcccagcgggcugcccggcucaagacauuuccuugcaagagguuuaaggaggugaggucccuccucccuuuccuccacugcaggacacaugagucuccccuuugggcaacagggagagaauugggggagcuggggccaggcaaguguuugggagugggcuucccaucccaggaaaggaucccaucaggggcugcugagcuccgggcagggguucacacccaccaucuucccaccagggcaccugucaacgcggggaccagugcugcuacucccacagccccccgacacccaggguuucugcugaugcugccccugacuguccagagaccuccaaccagacccccccuggaccuggggcugccgcugggccaggcauagacugaaccaauaaagagaugucacgucaccuucucccgauugccugugguuuguguauugguc

SEQ ID NO: 15684 - RNA, 4649 nt, Homo sapiens
acgcgagagcgccugacccuucgcuaacgcgaccgugcgggacugggucggggucgguagggugcguccccgacuuggauucugcgccucuguccaagcgccgggagcgcagcagacgccgucgacgagcgucugccccugggucucccggaggggccgacggugagaaaagcgaagccuccccagccccuccuggccuccccccgcgaccccagcccggaaaaaaugaggcaccacuuggguccuaugacugcucugccauguugcuuugccgaccucgccccugggaaggggaccgggcaaggccacuuccagaggguugugggugauuuuuuuaagggucugcgggucccuugggggucgaugaucacccuuccggacccccgagaccuugccccugacgucuucacugguccuucuucgggggaguucgcucccgaacaugcgcagcacguccacugcccuuuccuugacggcccugggccgagucccuggugcccuccggcucagaggugcugccgcgugcggucaccgcaccucugggcucaaagcgguuugcuccaucuugaugggccgggccgcuccaccggggcugccgucggggucggccgggggcgcgggcugcgagcgcgcugccgccucggcccugcguccggauccccggcgggcgccgucgucugggacccggugcaccggccguuugcgaggcccgggagggguggggccugcggccagagcugcggcuuggucgcgcagcagccgcaccaggaagccgauguacuucauggcuaggcggagcaccucguucuugcucagcuuccggucgggcgggugcgucggcagcagcuuccucagcucggcgaaggcgccguuaacguucugcugccgccagcgcucccggcuguuggugaacacgcgccgggccaccuucuggggcuggugcccuguggacaaggagggccggguuggugccauggcccaaagggcggccccuccugcccucccgcuagacacgcagcacccucgugggaacuuaaacccaggccaugggcuggggcuuucuccacccaagggguccacgggcagcucuccccaccccucccaagagccauccagacaagaaucaucacaggcccggccuacggacaagggccugcuguaucugugacuaugggcaccuuuaugucaaugacugagauucccuaaagaaagauuuccuuguguuuguuuggucugggaagcuguccguggggcccucauucugauugugcccaaguacggcuggcuggguguacucaugggucugagagguccucucauuaugacugucuguguccugugucuuguaugacugugugagacucuuguuaugucucauggcugugguuaugugugauguugccauguggcuguuucacgaguggcugugguuguguggcugacucuuguguggccgugguccuaaguggcugugguccuguggcugucuugugugugguugugguccuguggcugucucuugcauggcuguggucuuguggcugucuugcguggcugcacauuccaguggagcugucauuuuguggcucccaugcccugguguggcaugcucuguuuugccgugacugcggcuacauggcuuggccuguuggguggcggugguuguguggggcuggcuaugggacugcgauuuugcacauggguagaaccuaugugggcuguucucugugugugcuggaagcacgucuccccgagguggaguagaggacagacaugagccccacacagagacggccaggccuucugugcacccacaagugcacauacaggcauacaaacccacaaggcacacaaacccacacucacccucagccagguccagcucacaguggcuuggucuccgcuucaaccggcugcuagggaagaugcuaaaagguccugcuggcccaauguagacacuguaaggggucgugggucacuaaugccuugugggcaaggacccuggcccccaauccccacugccccccaccccagauccccacugaccuguugaggaaggggugagggugguagugcagggccaaagugggcggggcaguucccaggguggagaguugcagcagcgggggccgcagagugcccagcucuguggugggcauggcuaccccugggggccugcuguggcccaggcugaucacugguacaccagguggcagccuggggggcgaggagccuccucgguggcccaccuccuccaccugcgggggcccaggcgaggcaggcuuaggggguggggcaggcgcugggcugggggcacacaccaucucugccuucucagucaugguggggcccaccucugccugugccugaggcgggcacauggaccccgacguggggguacucaccugugggaaagaaggcagccaguggggaggaggacuaggugccccgcucccaccugcuuagcucaagaaaccccucaaaugggaaggagggagggggagggggaaaggaggaggagagaaguuucaguaggcaaaggcagauggcgggggcaggcccagaaacuuccaggacacgggagggggguccuacguuagaguaggaggcgccccccaggugcuaggcagcgcacugucccugagcucuuugugacccaggaggggcgcuguugcccagccucugagcaaauauuccuucuuccagaauucccucaccucugcagccuggagagggaacaagacagggagccccuaacugauccugggauccccagaaaccccaagauuaacccuguuauccucagaucuaaagauccaacccagagacuccucauuaacucauugaugccaugugagcuuggaaucccuccaagauggacucugacccuucacggaaggcccccagcccccacccaggcugacccucugcaccucaagaaugacccugcgguucuucccauugcugucccugaaagugcuccauaauugcuugagugacccccacucccacugcaaacaucccccauagcaacccugugaccccacuacugacacuaugaccucaaaugcugacccuagacccccaaacacugaccccacugcccaguccaguccagucaugccccaacccucccucuggcuuggaagcccccauccucaucagcauccacgcuuuuuaaaauuuguuuauuuuuuuagagacagggucucccucuguuguccaggcuggagugcaguggugcaaucauagugcacugcagccucaaauuccugggcucgagccauccuccugucucagccuccugaguagcugagaguacaggcaugugccaccaugcccggcuaauuuaaaaaaaaaaauuuuuuuuguagaggcagguucucacucuguuguccaggguggucuggaacuccugggcucaagugauccuccugccucagccucccaaagugcugggauuacaggcaugcaccacaaugccccgcgaucauccacaguuuugcauacuguuuugacaucccuguuugcucuugguuccagaguccaggaugucccagcaaggugugagacuguuggccccucugcccugucuuccucagcuaggcccuggggaagcaggccuggccccucacuagugggucccugcuggugaaugaaugaaugaaggaaugaacaaaggaaugcaggcugggucccaggcccgggauccuccaccuuuaggcccgcuccccucuuaccccagcacuguucuugcagccuggugagugcccuggcucugucccgucagggcuggcagucugggccagggugugguuuccagcgucaggccaggcucugcugucucgcgaggguccggccucaaugcuccaggccccggcguugggccgcgccuccucgugggccucggaaggccaggauagccgaggucuccgcguaggucccccccagggaaagugagcggcucccgggccggcccgccuucuccccgcccccggcggcccgguuuccucccucucaccccuggcggcgcagcggccggaggaugcuggcccagugcagauaagggccaggcugccuggccgcgccugauaaggagccuggcugaccccggaggaaaccagcgggcggggaccuagcagcgcgggccucccggccccgcccccagccggcgcuggcaggacucgguccgccaccccucagggcuucgccuuccgcucccccagccacuguagggaccccgggccucuggggacccgggccccagggcagccggggagggaggugccuggaugcacgcaggggguaaacugaggcagggaagcugccuccucuuauguccgagucugcccuuuggcuuugcacacucccugcccgaaugucugugcugaugggggugagggagagcccuuuccggcccguuggggccgcgugacccugggcccccaccuccucuccucacccagccugguuccucuuuuuacagaggcccuucccuccucuccaccaccccuacccgggaguggggcacccaaaggggaacaguucuaacagucuggccuuggguguccagccugggcaggugucccaagcccucagcacaguauccacacauuuccaagcccaggagggugagaggaagagccaug

SEQ ID NO: 15685 - RNA, 3990 nt, Homo sapiens
gggcucccagccaggaggccccaaggaggaagccaggagguaaaccuccucauuuucuguguccuacauacgagcccaggagauggcaggcggacauagggccauauccagaaaaaguccaggccucuugcugccaggugggugcccagagagggaagaagaaagugaaggagugacagggcugaggucucagcucccacagccuccugccugauccuaucuccucagggcgaucuagguguucucauccugagcaccuucucaacugggacacugaagucagagagcagccccacggcagugggcaguuccuuuuccuggggagcagcccagguaccaccuguccccuagacccagcccuuccuuucuagaaagcggcagggaggcccagacaagguagcuacuugccgcaggagccugggcuccuuaggaguacucuucuccauccaggccccacaucaaccugggcucaugcuggcaaaaauccagagccugggcucagccaggagcugggagagaggagccggcaggaaggcagagcagaaggcugugccuucccgcucacagcuggcaggacaaaaggagaacugggccagaguuggggaggacucgggacaggcuuguguuguauguagcacccaugcacgugaggagugagaagugggagguugcucaggagccaggugggcagcccaggggcccggccugguccucgaugaggugcuacgugaagcaggggccggcucccaugcccacccgcugcugcaccuuggcccacuuggagagcguggggcugucacucggggucagcucuggccccuucaccuggccagcugccccuagauacucagccaccuccccaacugccccccuccggggccccccauuucucaccuggucugacuccagcaagcacaggcagcggguggugggugaaagccaugcgcggggagcugcccugagaggagagggcacugcagaaguccagcuuuccugacuucuuuagagaagccgggccuggggggaggaagcagcaacacagggcagguuuagcugggcuggggugggugcggggaaggcgggaagccagcagcucgcuccuucucuccucagccccuccccacugccccuuccuccacugugcucccuccugcugcuccuugcccagucccaggccuuguucuaggccugguuccgaggcccuguguguaggccagccaaggggugcuucuaaccagagaggaaaacgaggccccuggguaaugugggguggugugugccaggcagggggugagcaagggccccagccuaugcccuggcaagcagguaaugaagugaaagggugggaugcaggaccaacauugggaaaggagugcaggaggaaccccagggcgccagcuugagagccgggaagggguaaguuugggagggacaggcuggggucuaugccauggugcccggggccaugggagguucuggugggaagaagccagggccccguuuagggaagggagcacacagccaugagcccucaggagggacacaaugcccagcgagagagcagggacagaggccagaggaccuggagaguccuugggcugcucaggccuagccgggcugugcaggcagagccagaggggagaagacucccccagccaggggacccagaagcucagcugccauaggauggauaauuucagggcucugcccugcuucuggugccagagguguggguggcauucagcaugaaacaagggcacagagaacaccuuguuugaagucugucuuuagaaauucaucucugcccaguggccauagcauccaaaugacaaagcagggcccccagggggccagguucuucuggaaagaucagcucccaucuugggcugagcuuuaagguugugcccaggcugggaaggauaagguagaguuggggcagaucucacagcugccacccuuggaggacaaaucaagucaguuugggugagggguggaggggcugcagaacagagaaauaaagagccaucuuaacugcagagggaaggggcgggggaagggcgaacucccagccgccagcggagguguuaucuggcagcagcugugugccaccugauagcuggcacaguggggaggggggagcauccuaccagcugugcacagcuguccccauggccgcacagugccuccccagcuguucccuguccugcagcugggcugcuuaauuggcaauuuguugcagcccaugaaaacaacacacagcggggugaggggaaaagggagccggagggugcugcaggaggauguugaggggccgugcguggcaggacugccggaaggagcagaaaugcagaaauggcaggcgcaaaagcagacagccaagaaaggagagagcaggagccaggaagaggggggcuccucaggaauuaggucugggcacaggagcccaggagcccuugccccaggagccagcugcagacacaguccucuaugcaccccaggggcaguccuugcagaaggggucaccuacugaggccccggccagggacccaggauguagcccaagagucucccgggccuucucaacuccucucucugccucucaaggcuccccuagggaagcauguggcccaugcuggcccaagucccugccugccacgaggagagccugggaggggccccagagucacgcaaggaagccuucucacagaggccagccucugcuggccaucuagagggucuccagcccacucccucagccugaggccuggaggcgagcccuccuuuccuccucccaggaggaggagaagcugccagaacuugcauucguucuggggcagcagaaaagcaggagugcuucccagccccaccucgcuccaccccagacucugccugcccacuuggcccuucccaguaggggcauaucuggaaaacaucagacaaaguaccauuaggucagacccucaccuuuuggaggaggagaaugaugcccagggcccaggccuguccagagcagccaugcccugugcacaacccacacgcgugagucugcacucccaggcccugucacacccacagugaggauaaacacgggcuguaccacuggcacgucagcgggggacucuugcggccagccuccucacacacaugugcucaugcacaugcacacacacacacgcacguguuacaugcugucuuccagaguccucucuaggucugucugcacccucagucaagaauggaggugaagggggguggguucaacaagaagaagaucccuagaggagacugggaaggucugagcuggcuuccucuguacucucuccccuucgcuagcuucccuaccuggucucaaaaggacucugcucauucuucacuagacucugagccucucucugugaagcugggcccuugagaccagugguucucauccugggaggauuccaucccacuagggaacgucugacaaugucuggaggcguuuuuggucaucaaaacuggggguggggguuuugcugcuggcaucuuguagguggaggccagggaugcugcuaaacauccugccaugcacagaacaauccccuacacagaaugaugagcccccagggugagaaacugcuuucaaccaugaggccacgggguggggcaaccucuagagaaauaccaggaggggcugcggccaucccacuguggggcaccagaggcuuggcacccccucugcuucccaccgccauaccacgggcucugcugcugacucucacagcaccccuccucacccucaccuccacucccuuccuucagccugcucugcccucccuggaagaucaggaggcaagaaaacagauggguaaugccccccgacagggggacaacuggugggaggcucaccaggugaacugagaaggggacaaaaagacucugggcugcccuugcucugggucaggaucccccgcacccauaccugcauccacaucguugggccacccgcuggac

SEQ ID NO: 15686 - RNA, 8978 nt, Homo sapiens
cggaaguggucggcgcgcggcgcggcgcgccugggcgcuaagauggcggcggcgugaguugcauguugugugaggaucccggggccgccgcgucgcucgggccccgccauggccgucaccaucacgcucaaaacgcugcagcagcagaccuucaagauccgcauggagccugacgagacggugcgggccgggccggagcccgggggcgggagcgacggguuucggggguggggugggggcggggaggcuagaaucccaacgggaggggcagggaggacggcgcgggucggcccugcccagacccccgaccugcccgacuuuccuggaccccccgauggucuuuggcccagcccccagccgaucgggcggcgcuccugcgccggucuccgggcgaggccccacccccggggcgcuggccaggccccggcuccaaugucagcgcucucgcggggcgcgggagucacaagcucggauuccugggcaggccaagcucuccaagacugggcuccacguucccagcuuugcaggcgucuccuugggacacugguggucgaaucuaggaguaaugaccaggagauacugaguagugacgacaacaacgauguuaaugauaauaaacgggucucagucuuuauaauuuuggugguccguguuuguuggccguuuacuuuuuaucagucaccgaguguuguaguguuguuuuaccgcucugcaaaacgggcuugucauuggggaccucugaucauuuuacagauguggaaaccuagggauugaggaacuuugccacagucacacacaaguaauggcagagcugggauucaaauucgguucugccucgugugagcguccacgauauaaauauuaugcugccuuuuuagucaaaaguagaauuaggaccuaauucaaacauacugaaugucuauuggguacuuggcgcuuuuugcauagugagggagacauugaaguccacuuuuuguagaaaaggaaacacacauuuuuugauccgcucaaguguuuggcuuugggcaaguuaaccugccuaccugucugugccuccguuuucucaaauaucaaaugaaccggucgccugcuggcuuccgccuguaaucccagcacuuagggaggcagagggaagaggagcccuugagccuaggaauucgagaucauccuggcaacacagugagaccccguucucuacaaaaaaaagaaacaaaaaucaauaaauaaaaugagaccaauuaaacguauuucauaggaaacuuaaaagguaugacacauauacauuuacaguagcacuauuggccaggcacgguggcucaugccucuaauccugaugauuugggaggcagaggcaggaggauugcuugaggccaggaguuugagaccagccagucuaacauagggagacucuuaucuacaaaaaaaaauuauuuuuaauuagucuggaguggugguguguaccuuuaguccuagcuacucccaaggcuggacaagaguaccaguugagcccaggaguuugaggcugcagucagcgaugaucgugccacaucaauccagcaugggcggcagcgagauccugccucuuaaaauuaaaaaauaucacuauuaacuauuagucacuuauuguccaagguagaguguagagugggggacuguccccuuuauucuguuaauuauacuuuauacuacccgaaauuacauuuucuucacauuaguguucucucauugagagcagggacuuacuuguguugaguuuguucugugcuguggccucugugucuaaaacagcaccuggcacauaauggguguuuaguauaaguaaauacuguguugaauggcaugaugauugaaugaauucaaaucuagcaugcuuuagaugcugagaaagcuuaaaaaacccagcgugcuugccuuucugccaucagggcuggcaguuucucuguccuaaacuagaagggaaaagagaaucuuggggucuccagugacugucuguaccacucccucuaggugaaggugcuaaaggagaagauagaagcugagaagggucgugaugccuuccccguggcuggacagaaacucaucuaugccggcaagaucuugagugacgaugucccuaucagggacuaucgcaucgaugagaagaacuuuguggucgucauggugaccaaggugggugacgugugcuggcugggaggguggguggacgagcuggggagcuggcaaagagccugugugcccaggagagauuagcugugaacagggcggggccacagcggagcggguuguugggucugauaggguugcugaugccagcucccuuuuucuugcuguugcagaccaaagccggccaggguaccucagcacccccagaggccucacccacagcugccccagaguccucuacauccuucccgccugcccccaccucaggcaugucccaucccccaccugccgccagagaggacaagagcccaucagaggaauccgcccccacgacguccccagagucugugucaggguaaggcgggggcagcagucccagcuugggcccuguccuccuagcacauuccagcguccacauaaguggucccacacaccuggagggagggcaagccgccagaagccaggguccgauuucucucucuugaauuugcagcucuguucccucuucagguagcagcgggcgagaggaagacgcggccuccacgcuaggugggugggugguccccagggcagaggugacugggugccccagccaucagcugggccuugucugggugcgggagggccugggagcugcccuuuccucuuccuggugaccuaggcuuugcugcuuccuccacagugacgggcucugaguaugagacgaugcugacggagaucauguccaugggcuaugagcgagagcgggucguggccgcccugagagccagcuacaacaacccccaccgagccguggaguaucugcucacggugagguggggcuuccgccucccggggaggccuugagggaguacccgggcgucacugcccugaugggcgguugggaaggcaaaaccugcccugaaaagccuuuggguagugauucuagccacuaaaggcuucccacaggaggcuggaugugagugaugggugggccucuggagggcagggccgaggccucaucuguguccugccagggcauggaggaggguggcagcaggaggucugugcauuagaacuaaacaggaccccugacagggaauuccugggagccccgagccggaacacgguucuguccaggagagccagguaucggagcagccggccacggaagcaggugggugugcacaugccgcaucugcccuccagguaccugacucacauuacacuccaccccgcagugcuccuaggagcccggcguggugucugacugcaccccuuccuacuaccagcaggagagaacccccuggaguuccugcgggaccagccccaguuccagaacaugcggcaggugauucagcagaacccugcgcugcugcccgcccugcuccagcagcugggccaggagaacccucagcuuuuacagguguggucccaagggcagagggagcuagggcagccaccauuucccuucccugugggcaccagaguccauaacacguaggaaucguucuagguccggaaagcaggacuaagcacaugcuucccccacgccccugugcuuccugugaccuggugaccccccugguuucucagucuucccaaccaccuuguaaggugugggugcugucaacaucaccucccacagaagaagacaccggaaacuuagagcagccugucauucccagggucacgcagcugguagugugugugucugccuccugccucggggugggguccugggcuggggcucuggcuucacauacagauggugcugcguaaaugucuguaagguggcaugacgucacccaggacagcugugccccaguuggcucugggacaacucugcucagugaggcuccaucuugcccuugaagguucacaggaagagugggggaguggcccccugggugcaaguagguuccucuggguucucggugaagugccuaccggucuuggcucaggacccugcugucugacccuucuccucucacuucucagucccuugccagcuccuccuggucggucguguucuucaucugcacucagcccucccucauaguguccuggggccuucagucuguaugggaacccccaaaucuauguagccagcccaggccucucugaaugccacacuccauggcuggcuuaauuaacucuccaucaaagugcucccuagacuagacgucuaagacuuagaacagaccuccccaguccuccccgaucucugcaaggauuagcuugggguugcuucagccccaggcccuggggaucugcuggggucuaccccuuguccugucugcucuucccacucagccccucccugcacuccagcucucugguagccucuuccugggccucugccacugcauagucccacaguccacuuuucaaccaugaggcagaugacuaaaaagcacuuucuuuucuuuuuuuuuuugagaggaaaucucgcucugucgcccaggcuggagugcaauggcgcaaucccggcucacugcaaccuccgccucccggguucaagcgauucuuuugcccccgcccgaguagcugggacuacaggcgcccgccaccacgccugacuaauuuuuuguauuuuuaguagagaugggauuucacccuguuagccaggauggucucaaucuccugaccuaaugaucugcccgccuuggccucccaaagugcugcaauuacaggcaugagccaucacaccuggcugacugaaaagcacuuucuucuuuaaugugaaaaugaucagaugcauacaaugguagaguuauaucagagcuuccagauacccagguagggcacaguggcucaugccuguaaucccagcacuuugggaggcuaaggcaggcagaccacuuggucaggaguuuuagaccagccuggccaacauggcaaaaacucgucucuacuauaaauacaaaaaguagcugagcauggcggcaggccacuguagucccagcuacucaggagguggaggcaggagaaucgcuugaacccaggaggcagaaauuacagugaaccgagauugccccacugcacuccagccugggugacagagugagagugucucaaaaagaacagaaacaaaaaugaacaaaugaacuuccagauaccuaaauccaacacccagaugaguucacuuuuuuugguuugggggcugguaggugggaauagagacagggucuauguugcccaggcugguuuugaacucuugggcccaagcagucccuccugccuugccucccaaauuguugagguuacaggcgugagccaccacacccggccaaguucaccuuucuaaaagauccacagaccacgucuuuucccauguaacugucaccaccguggcuucccccugcucuagaaaaugggucugacuugggccuuccucucuggugucauugucugccuccucccccuucccuuguucgcuguuuuuuguuuuuuuuguuguuguuguuuguuuguuuuugagauggaguuucgcucuuguugcccaggcuggagugcaguggcgugaucucagcucaccguaaccuccgccuccuggguucaagagauucuccugccucagcccccagaguagcugggauuacaggcaugugccaccacgcccugcuaauuuuauauuuuuaguagagaugggauuucuccauguuggucaggcugcucucaaacuccugaccucaagugaucugccugccucagccucccaaaguacugggauugcaggcaugaggcaccgugcccagccccauucacucuguuccugcuucuguuucugagacuucccagaugcauccacccugggccuuugcacuugcuguuugcuuuaccuggaggaaacccucugcauccgccauacugcaggccucuccaccagcccucaucugcaguuccuuccuagccagacacuugcaguugucugguucauuuauuggcucacucacuuauuuuuugagagucucuugcccaggcuggagugcaguggcacagucucggcucccugcaaccucugccuccuguguucaagugauucuccuaccuuagccuucuugaguagaugggauuacaggcacgugccaucacacccagcuaauuuuuguauuuuaguagagacggaguuucaccauauuggccaggcuggucucgaacuccaggcuggucuagaaucaccugaagugauuauaggugugaaccacugcagccagccuauuuauguauuuauuuauucaagacagggucuugcucuguugcccaggcuggaguucaguggcuuacugcagccuccgccuccuggguucagucuuaugccucagccugccaaguagcugggauuacaggcgucugccaccacaccuggcuacuuuuuguauucuuaguagagauggggguucaccauguuggccaggcuggacucgaacuccugaccucaagugauccaccugccucugccucccaaagugcugggauuacaggugugagccaccgugcccggcuuauuucuuggcucacuuaaaagcacaucaucagcucuuccaggguagggcuugugucgacugcuauguuguguuuggccagaacaggcuccucuggauauuugccugacugaaugaaaaagcaagggcugugaugaccuggggagaggaggggaccagggcugugaauuaccuucccuuccccacccucuccugcagcaaaucagccggcaccaggagcaguucauccagaugcugaacgagcccccuggggagcuggcggacaucucagauguggagggggaggugggcgccauaggagaggaggccccgcagaugaacuacauccaggugacgccgcaggagaaagaagcuauagagaggguaagaggccuggcugaggggugacugcaggugggcaggaccccuacccucuccugcucacacuuaaccuaucuucccacaguugaaggcccugggcuucccagagagccuggucauccaggccuauuucgcgugugaaaaaaaugagaacuuggcugccaacuuccuccugagucagaacuuugaugacgagugaugccaggaagccaggccaccgaagcccccacccuacccuuauuccaugaaaguuuuauaaaagaaaaaauauauauauauucauguuuauuuaagaaauggaaaaaaaaaucaaaaaucuuaaaaaaacaagcaaacaguccagcuuccuguccuccuaaaguggccccuguucccaucucccgggccagacagcuguccccccguccuccuccccagcccagccugcucagagaagcuggcaggacugggaggcgacagaugggccccucuuggccucugucccagcucucugcagccagacggaaaggcggcugcuugccucuccauccuccgaaaaaccccugaggacccccccccauccucuucuaggaugaggggaagcuggagccccaacuuugauccuccauuggaguggcccaaaucuuuccaucuagggcaaguccugaaaggcccaaggcccccuccccagucuggccuuggccuccagccuggagaagggcuaacaucagcucauugucaaggccacccccaccccagaacagaaccgugucucugauaaagguuuugaagugaauaaaguuuuaaaaacuagcccuauggucugugccugcuggggcuccccgcgcccaccugucugggucuuggggggcuggcugggcacaggcaggcauggugacgggugccuggaagggggagaggagucugugagucccugcagauugaggcuuccggugucuccucccccagugugucauuuccaggcaguggaccccagcccaacguuacaaggacugcuucuccccggcccccaccaucaucaccacagucuguuuuggcuauacuuccccccccaccagccuuguaauuggcuaauuacuggagaugaauguugguaaacagaagccuucuucucuucugccaucugcuucuccauuauuugcccauuguacaccccccuuuuccucccacugaagccccaguuagucagcagggccuagagucccuguccccuuuugaguacagccaagugggggauuccccagcucuuaaguauugggggaggaaccaggggacccagagaggcacaccuugagaggacgcagaucucuucagggguacugccagguagcaggcuuuauugggaagggacaaagccucaggagcugggugccccagaggcugcugggucuugagccacagcugcagccaaugcagcagcucgcgccuccuucuuccguuucuguuuuuccuccuugaggcgcuugcgcuccuucuucucuagguccuggagcagcuccuggaagcgggcacuccuuggguccaccugguagcccaggagcuccugggccucagccugcagucgggcccuccucuccuugucagccugggccuucucccaguucucccgcugcugcugcugccaguucacaaucaucuguggcaucuuggccaugcacucugcgaugugcugcucccugcaggggagggagagugggcugugacacuggcacucagccagggcagagcccacccacccauaucucacccauaggccuuugcccacgagccugccuccucaacucccccaguagauuaacugucaggaaaagcccuugacaagugaagaaacaggaagagaugaugagaaaguuaccugugcaugaauuugaucacaagggcaugucaagccccaguaaaccccaggugccaaagccaaaucagcauuucacugagcugccuacugagcaagccaagugccacucccau

SEQ ID NO: 15687 - RNA, 6180 nt, Homo sapiens
gacggccaugggcauagaccaaugacaaaguggcaggggcgggcccaagggcugggucagguugguuugagaggcggguggguauaaaagugcaaggcgggcggcggcguccguccguacugcagagccgcugccggagggucguuuuaaagggcccgcgcguugccgcccccucggcccgccaugcugcuauccgugccgcugcugcucggccuccucggccuggccgucgccgagccugccgucuacuucaaggagcaguuucuggacggagguaacgccuggucccgccucgaggccgccccgacgacgcggccggcccccgauccuggaucugcguugucgcccguaauuaccguuuagagguccaacacgguggccucccgggacuagagccgcgggcgauuucucuucugcgucccuggggagcgcggagggcguagcggccucccgcggcgggaguuaggguuagcccgaggaucucugaaggcacccgacgugucaaacuagagguuggaauggggagugucggggaucuccuuuccuguccccagcagcuuguggcucucggcagauguuugguguggggggggauuagcacagccgcucugaccuaccccucuaaucccccacuuagacggguggacuucccgcuggaucgaauccaaacacaagucagauuuuggcaaauucguucucaguuccggcaaguucuacggugacgaggagaaagauaaagguaagagccuaggagugggugcucagauccgggaggacuuccuggcagaaguccuugucuguacacacacagccgggacaguccccuuggaggaggacagguggaggaagugggggagucuucucuauucucuaagucgaggguccucgcgagucaaggcccaacggugaccucacuaccgucccgucucagguuugcagacaagccaggaugcacgcuuuuaugcucugucggccaguuucgagccuuucagcaacaaaggccagacgcugguggugcaguucacggugaaacaugagcagaacaucgacugugggggcggcuaugugaagcuguuuccuaauaguuuggaccagacagacaugcacggagacucagaauacaacaucauguuuggugagggccugcuuccuggugcugaucucugucccauuaguuagagggagacccagaccccauugacuuucuuaauaaugauuuuuuuuggaaggggagcuaaaagaauaagucccagcaacaauuuauugcauuaugaucgcagaucuaggcuguuaauuuaauuugcguguuuguauauaguuauuucccaaucuuacuaaugaggauuuugaguucuagagcacugauuuuuuuuuuuucuccuuuaaacuuaaggcuccacccacagcccauucaggacagaaucagggucugaguuucucuucucagccuugacagacccgaguugaagaaccaggucuuccuuuuauaaagaggggugagagccucgagaugauggguagucucugacucuuaacuggaucugcuucacaccuaggucccgacaucuguggcccuggcaccaagaagguucaugucaucuucaacuacaagggcaagaacgugcugaucaacaaggacauccguugcaaggugugccugggggugguggcaaauggcugucauggggagauucagaggucagccucauugggggguggcccccgcucaccuucuuccuucuucaggaugaugaguuuacacaccuguacacacugauugugcggccagacaacaccuaugaggugaagauugacaacagccagguggaguccggcuccuuggaagacgauugggacuuccugccacccaagaagauaaaggauccugaugcuucaaaaccggaagacugggaugagcgggccaagaucgaugaucccacagacuccaagccugagguugguguuugggcaggggcucugcucuccacauuggaggguguggaagacaucugggccaacucugaucucuucaucuaccccccaggacugggacaagcccgagcauaucccugacccugaugcuaagaagcccgaggacugggaugaagagauggacggagagugggaacccccagugauucagaacccugaguacaaggugaguuuggggcucugagcagggcuggggcucacaguggggagugcaccaaccuuacucacccuucgguuuccuucucccuucugcagggugaguggaagccccggcagaucgacaacccagauuacaagggcacuuggauccacccagaaauugacaaccccgaguauucucccgaucccaguaucuaugccuaugauaacuuuggcgugcugggccuggaccucuggcaggugagacuuggaggaaaaaggaggaucccugggguaccucaagugcauaagaucacccaagaggaaagggacaggguaggcaccccaggugagucugacucaaaaaugguacuucuuguaaacaguacuuccuggucugucccugugaaguccucacagcaaccccuuuaagguuauacuugcugugcaccaaguacuuccccaaguacuuuuaugcaaaucaacuucuuuacccccaaagaccuagaagguggucagguaacccaguuaguuagcuggggcugggcacaguggcucacccuuacaaucacgguacuuugggaggcugagacagaggauugcuugaggccaggaguuacacaacucaaccuagcuuggcaacacagcgaggagacccuaucucuacaaaaaaaauuuuuuuuuuugagacagaguuucacucuuguugcugaggcuggagugcaauggcacgaucucagcucacugcgcccuccgucuccugguuucaagcgauucuccugccucagccuccggaguagcugggauuacaggcaugugcuacuauggaugccaggcuaauuuuuuuuuuuuuuuuuuuuuuugagaccgugccuugcucugucgcccaggcuggagugcaguggugugaucucugcucacugcaagcuccgcacgaccccccagguucacuccauucuucugccucagggucccgaguaacugggacuacaggcaccccccaccaugccuggcuaauuuuuuuguauuuuuuuuuuuaguacagacaugguuucaccguguuagccaggauggucuccaucuccugaccucaugaaccacccaccuuggccucccaaagugcugggauuacaggcgugagccaccucacccagccuuuuuguagagacagggcuucauguugcccagguuggucucgaacuccuggccucaggucaucugcccgccucggccucccaaagugcugggauuacaaggguuagccaccaugccuagccucuacaaaaacuuuaaaaauuggcgagaugucaugcauaccuguagucccaacuaccaaggaagaaggaugaucacuugagccuggggcaucgaggcugcagugagccaugauuaugucacugcacuccagccucggugacagagugagacccucucaaaaaaaguugggacuuggccggacacaguggcucacaccuguaaucccagcacuuugggaggccaaggcggguggaucacaaggucaggagauggagaccauccuggcuaacauggugaaugaaaccccaucucuaguaaaaauacaaaaaauuugccaggugugguggugggcgccuguagucccagcuacucgggaggcugaggcaaaaggaugacgugaacccgggaggcggagcuugcagugagcugagaucaugccauugcacuccagccugggugauagcgagacucugucccaaaaaaaaaaaaaaaugcugggacugaauuuuugucuguuuuggucacugaaauaccuucugugcccaagacaguucuggcauguaguagguaccugaaaaauaccugaauaagagagugagaaacaagaaacaggugcagagaacugaagucaguggcccaaggucauggggguaggaaaccacaaagcugggguuugaaccugggcaguacagcaccugagucucuccaucuuuuuuuuuuuuuuuuuuuaagacagagucuugcucugucacccagguuggagugcaguggcuugaucucggcucacugcagccucugccuuccagguucaagugauucucaugccucauccucucgagcagcuggaauuacaggcaugcgccacgacgcugggcuuuuuuuuuuuugagauggaauuucacucuuguugcccaggcuggagugcaaugaugcaaucucggcggcucaccacaaccucugcaucccagauucaagcgauucuccugccucggccuccugaguagcugggauuacagggaugcgccaucacagaccccgggcuaauuuuuuuuaguagagacagaguuucacuauguugcccagguuggucucgaacuccuggccucaagugauccguucgccaugaccucccaaagugcugggauuacaggcaugagcccgucccgucccuggcugucucuccaucuuuccaucuuuuuuuuuuuuuuuuuuuuuuuuggagauggagucucacucugucacccaggcuggagugcaguggcacgaucuuggcucacugcaagcuccgccuccuggguucacaucauucuccugucucagccucccaaauagcugggacuacaggcacuugccaccacgccuggcugauuuuuuguauuuuuaguagagacgggguuucaccguguuagccaggguggucucgaucuccugaccucgugauccgcccaccuuggccucugggcgaggauuacaggcgugauccaccucaccuggccucuccaucuuuuuaacugcagugucagcgguguuccuugucuucucugcagaugcaggcagcagaauauagugguuauaggaacacagguggaaacccuguccaaagcaagggcuaucggguaucaccucugaccauccuucccauucauccuccaggucaagucuggcaccaucuuugacaacuuccucaucaccaacgaugaggcauacgcugaggaguuuggcaacgagacguggggcguaacaaaggugaggccugguccugguccugaugucgggggcgggcagggcuggcagggggcaaggcccugaggugugugcucugccugcaggcagcagagaaacaaaugaaggacaaacaggacgaggagcagaggcuuaaggaggaggaagaagacaagaaacgcaaagaggaggaggaggcagaggacaaggaggaugaugaggacaaagaugaggaugaggaggaugaggaggacaaggaggaagaugaggaggaagauguccccggccaggccaaggacgagcuguagagaggccugccuccagggcuggacugaggccugagcgcuccugccgcagagcuggccgcgccaaauaaugucucugugagacucgagaacuuucauuuuuuuccaggcugguucggauuugggguggauuuugguuuuguuccccuccuccacucucccccacccccuccccgcccuuuuuuuuuuuuuuuuuuaaacugguauuuuaucuuugauucuccuucagcccucaccccugguucucaucuuucuugaucaacaucuuuucuugccucuguccccuucucucaucucuuagcuccccuccaaccuggggggcagugguguggagaagccacaggccugagauuucaucugcucuccuuccuggagcccagaggagggcagcagaaggggguggugucuccaaccccccagcacugaggaagaacggggcucuucucauuucaccccucccuuucuccccugcccccaggacugggccacuucuggguggggcagugggucccagauuggcucacacugagaauguaagaacuacaaacaaaauuucuauuaaauuaaauuuugugucucccuccugugucuccuucuggggaaagacagacuuaaggaaacccagcaguggucuuuuugggggggggggggguuuccaguauaucuccuuuuucagcuauugcuagagagguugcugaguguuccacaagauuccagggacccuuauuuaccccauaacccucaaaaccaacgggggaauggcugu

SEQ ID NO: 15688 - RNA, 2829 nt, Homo sapiens
uaaggacagagaggagcccucgaaggggcuaucacagccucagaguucacgaggcagccgaggaagaggaggcuugaggcccagggugggcaccagccagccauggccacagccgagaccgccuugcccuccaucagcacacugaccgcccugggccccuucccggacacacaggaugacuuccucaagguggggccuagaagguggggucuaggugggcuggcuggaauccagggccacagucacagaucuugggguccagaccugcaucuugaccugaaaucaagagacuuaaccaggacugagguacgcucaguccaggagaggagaucucagcuuagucuggcagggggugaggaggguggucuagggguuugagguucuaagugugaucuauuucgguaauagaaaacgaagguagccugggcaacauggugaaacccuaucucuacaaaaaauaccaaaaacauuaggccaggcaugggggcgugugccuguagucccagguacuccguaggcugaugcaggaggaucauuagagcccaggagauuaaggauacagugagcugcaccacugcacuccagccugggcaaaagaguaagacccuaucucaagaaaaaaaaaaaaaaaaaggaacgagaucuaggcucacagacaaucuuccagauaucagcgggaaaugaugagugugucugggggacauccaaaauuucggaauuaaucuuguuuugggagacagggaaggagagggauguucugggggaaaacuaagucaaggcuggcauccucucccccguccccugccaguuuuccaucuccagcagcucugcuaccccuucccccauccccgagugugguuccagauaguggaagucuuaucuccugucuccagccagaccugaucgguuucugucccuggagcuggggggggagcggggagaggggcgguuagaggggcaguguuggggaagugggacagacagacaggcaaacaagaccccuuuccaaagccucugcgucagaguguccagcccgcgaugucccugggcagggcaccccaguguccaccgaaccucgagcugccugcucccucccgcagugguggcgcuccgaagaggcgcaggacaugggcccggguccuccugaccccacggagccgccccuccacgugaagucugaggaccagcccggggaggaagaggacgaugagaggggcgcggacgccaccugggaccuggaucuccuccucaccaacuucucgggcccggagcccgguggcgcgccccagaccugcgcucuggcgcccagcgaggccuccggggcgcaauauccgccgccgcccgagacucugggcgcauaugcuggcggcccggggcugguggcugggcuuuuggguucggaggaucacucggguugggugcgcccugcccugcgagcccgggcucccgacgccuucgugggcccagcccuggcuccagccccggcccccgagcccaaggcgcuggcgcugcaaccgguguacccggggcccggcgccggcuccucggguggcuacuucccgcggaccgggcuuucagugccugcggcgucgggcgcccccuacgggcuacuguccggguaccccgcgauguacccggcgccucaguaccaagggcacuuccagcucuuccgcgggcuccagggacccgcgcccggucccgccacgucccccuccuuccugaguuguuugggacccgggacggugggcacuggacucggggggacugcagaggauccaggugugauagccgagaccgcgccauccaagcgaggccgacguucgugggcgcgcaagaggcaggcagcgcacacgugcgcgcacccggguugcggcaagagcuacaccaagagcucccaccugaaggcgcaucugcgcacgcacacaggugagggggcggggccccggacaugagaaagggcgcggcgcccgcuguaguuacaggggaagaaggguugcagagggcgggacuuggacuuggcuggccucugagagugagugccuccuuaaauuuugugcccuaggggccucacuuuguucauccuagucccagcccaggcugaguaaagggguguggccagaugcaggggacccggggacaugacugggcagacaguggcgcuuauggcuuccuuguccccuaggggagaagccauacgccugcacgugggaaggcugcggcuggagauucgcgcgcucggacgagcugacccgccacuaccggaaacacacggggcagcgccccuuccgcugccagcucugcccacgugcuuuuucgcgcucugaccaccuggccuugcacaugaagcgccaccuuugagcccugcccuggcacuuggacucuccuagugacuggggaugggacaagaagccuguuugguggucucuucacacggacgcgcgugacacaaugcugggugguuuucccacgaauggacccucuccuggacucgcguucccaaagauccacccaaauaucaaacacggacccauagacagcccugggggagccucuuacggaaaauccgacaagccuucagccacagggagccacacagagauguccaaacugucgugcaaacccagugagacagaccgccaaauaaacggacucaguggacacucagaccagcucccagauggcccuggacagcaggagagggugugggaugaggcuucccagagacccugggucuagaaagcggcuccugaaggucccuuauuguggcugauauuaacugucaaugguuauggguccuauaaaaaugccccucccagauaaagcuucagc

SEQ ID NO: 15689 - RNA, 2829 nt, Homo sapiens
gcugaagcuuuaucugggaggggcauuuuuauaggacccauaaccauugacaguuaauaucagccacaauaagggaccuucaggagccgcuuucuagacccagggucucugggaagccucaucccacacccucuccugcuguccagggccaucugggagcuggucugaguguccacugaguccguuuauuuggcggucugucucacuggguuugcacgacaguuuggacaucucuguguggcucccuguggcugaaggcuugucggauuuuccguaagaggcucccccagggcugucuauggguccguguuugauauuuggguggaucuuugggaacgcgaguccaggagaggguccauucgugggaaaaccacccagcauugugucacgcgcguccgugugaagagaccaccaaacaggcuucuugucccauccccagucacuaggagaguccaagugccagggcagggcucaaagguggcgcuucaugugcaaggccagguggucagagcgcgaaaaagcacgugggcagagcuggcagcggaaggggcgcugccccguguguuuccgguaguggcgggucagcucguccgagcgcgcgaaucuccagccgcagccuucccacgugcaggcguauggcuucuccccuaggggacaaggaagccauaagcgccacugucugcccagucauguccccggguccccugcaucuggccacaccccuuuacucagccugggcugggacuaggaugaacaaagugaggccccuagggcacaaaauuuaaggaggcacucacucucagaggccagccaaguccaagucccgcccucugcaacccuucuuccccuguaacuacagcgggcgccgcgcccuuucucauguccggggccccgcccccucaccugugugcgugcgcagaugcgccuucaggugggagcucuugguguagcucuugccgcaacccgggugcgcgcacgugugcgcugccugccucuugcgcgcccacgaacgucggccucgcuuggauggcgcggucucggcuaucacaccuggauccucugcaguccccccgaguccagugcccaccgucccgggucccaaacaacucaggaaggagggggacguggcgggaccgggcgcgggucccuggagcccgcggaagagcuggaagugcccuugguacugaggcgccggguacaucgcgggguacccggacaguagcccguagggggcgcccgacgccgcaggcacugaaagcccgguccgcgggaaguagccacccgaggagccggcgccgggccccggguacaccgguugcagcgccagcgccuugggcucgggggccggggcuggagccagggcugggcccacgaaggcgucgggagcccgggcucgcagggcagggcgcacccaacccgagugauccuccgaacccaaaagcccagccaccagccccgggccgccagcauaugcgcccagagucucgggcggcggcggauauugcgccccggaggccucgcugggcgccagagcgcaggucuggggcgcgccaccgggcuccgggcccgagaaguuggugaggaggagauccaggucccagguggcguccgcgccccucucaucguccucuuccuccccgggcugguccucagacuucacguggaggggcggcuccguggggucaggaggacccgggcccauguccugcgccucuucggagcgccaccacugcgggagggagcaggcagcucgagguucgguggacacuggggugcccugcccagggacaucgcgggcuggacacucugacgcagaggcuuuggaaaggggucuuguuugccugucugucugucccacuuccccaacacugccccucuaaccgccccucuccccgcuccccccccagcuccagggacagaaaccgaucaggucuggcuggagacaggagauaagacuuccacuaucuggaaccacacucggggaugggggaagggguagcagagcugcuggagauggaaaacuggcaggggacgggggagaggaugccagccuugacuuaguuuucccccagaacaucccucuccuucccugucucccaaaacaagauuaauuccgaaauuuuggaugucccccagacacacucaucauuucccgcugauaucuggaagauugucugugagccuagaucucguuccuuuuuuuuuuuuuuuuucuugagauagggucuuacucuuuugcccaggcuggagugcaguggugcagcucacuguauccuuaaucuccugggcucuaaugauccuccugcaucagccuacggaguaccugggacuacaggcacacgcccccaugccuggccuaauguuuuugguauuuuuuguagagauaggguuucaccauguugcccaggcuaccuucguuuucuauuaccgaaauagaucacacuuagaaccucaaaccccuagaccacccuccucacccccugccagacuaagcugagaucuccucuccuggacugagcguaccucaguccugguuaagucucuugauuucaggucaagaugcaggucuggaccccaagaucugugacuguggcccuggauuccagccagcccaccuagaccccaccuucuaggccccaccuugaggaagucauccuguguguccgggaaggggcccagggcggucagugugcugauggagggcaaggcggucucggcuguggccauggcuggcuggugcccacccugggccucaagccuccucuuccucggcugccucgugaacucugaggcugugauagccccuucgagggcuccucucuguccuua

SEQ ID NO: 15690 - RNA, 5474 nt, Homo sapiens
cacauaacuuaucuccuacaaauuuuaccacgugcauggugaucuggguuugcagucccauuuuacugcugaagagacccagagacgaucacagcucuuaaacggcauuugaacccaggcuggcuggugacaaaaugugggcuuugccuugcauggccagauuucuggauguagggcauccugggauuugcaagggacaaacggcauacccuaccccuccgaaaccgccuugagcgcaagcaggaaaagagcaggcacuaagcaugugauaagaccgccaccguguggcgaagaugagcaaccacagggucaguuucccaagccugagccugaagaaggaaggggguugcaggggaggacgaaaggacagagcacaccaacacagacucacaccuuucccuaauacuuuauugguuaccucuaggccugugugcggcugggugggcuugggggagggcgucacuauucagcuucuagguggaggcaugagaaggccuuggccuagcccuccagggucccauacuguggaguuuggaggggcaggucuggccuuuccugggucagcauagggcacccaggugggggcacagguggacacccagcacaggcaccuaggcaggggcacaagcucacuauccguuagccagccuaauuguguuuggagaaauauuccuugcugucauccacguugggcuuaaucgugucacugccaggcuuccagccagcgggacaaacugugggaagacacaaggaugcacaugaaggcuacagccccagguucaaggugaagcaaagcaagggccuguguugcagaagaaaaugcuggaagcaagugguccaggcccaggaauguggauauuaagauaaacccuccaagcccaguucaguauuuuuucuuuuuuuuuuuuuucagacagagucuugcucuguugcccaggcugaaguacaguagcaugaucugagcucaugcaaccucucccuccuggguucaagcgauucucaugccccagacucccuagcuggaauuacagaggugcaccaccacgccuggcuaauuuuuguauuuuugguagagaccauguuagucacgcuugucucgaacuccugaccucaagucaucugcccgucuuggccucccaaagugcugggauuacaggugugagccaccaugccuagccaaguucaguauuuucucuuuuucuuuucuucuuuuuucuuucuuucuuuuuuuuuuuuuuuuuuugagacagaguccuccucuguugcccaggcuggagugcaauggcgugaucucggcucauugcaaccucugccucccgcguucaagugauucuccugccuuagccuccugaguagcugggacuacaagugcccgccaccacacccugcuaauuuuuugguacuuuuagcagagacaggguuucaccauauuggucaggcugaucucgaacuccugacuucaggugauccacccaccuuggccucccaaaaugcuaggauuacaggcgugagccacuacaccuggccaaguucaguauuuucuagcugguguuuuuccuacucuuaauucuucaauuucuuuuugccacccagcucuccuuuuucuucuuuuuuucuuuucuuuuuuuuuaagauggagucuugcucuguugcccaggcuggagugcaguggcacgaucucugcucacugcaagcuccgccucccagguucacgccauucuccuaccucagccgccagaguagcugggacuacaggcgcccgccaccacgcccgacuaauuuuuuuguauuuuuaguagagacaggguuucaccgcguuagcuaggauggucucgaucuccugaccucuugauccgcccgccucagccucccaaaguggugggauuacaggcaugagccaccgugcccggccucuuuuuuuuuuuuauuuuuugagacggaguuucgcuucacucguugcccaggcuggagugcaauggcacgaucucagcucacugcaaccuccgccucucagcuucaaacgauucucuugccucagccucccaaguagcugggauuacaggcaugcaccaccaggcugggcuaauuuuguauuuuuaguagagacuggguuucuccaugucggucaagcuugucucgaacucccgaccucaggugauccacccaccuaggccucccaaaaugcugggauuacaggugugagccacugcaucuggccucuuuuuuuuuuuuuuuuuuuuuaaccaauaccccaucucuuaaaaaaaaaaaaaaagagaugggguauugcuauguugccuaggcucgacucaaauuccugggccuaagcaaucuucugccucacucuccagaguagguggaacuacaggcaugagacacagcaucuacaggcaugagacacagcaucuuccugucuuuuuggcuccuuuagucccaucuuugucccucugccccaccccuacagguuuuuuuguuguuguuguuuuugagauggagucucacacuggcgcccaggcuggagugcaguggugugaucucggcuuacugcaaccuccucccggguucaagggagucuccugccucagccucccaaguagcugggauuacaggcaccugccaccgcacccagcuaauuuuuuuguauuuuuagcagagacgcgguuucacuauguuggccaggcuggucucaaacuccugaccucaugaucugcccgccucggccucccaaagugcugggauuacaggcgugagccaccgcgcucggccuguuuguuuguuuuuuugagacagggucuugcugugucacccaggcuggagugcaguggugcgaucacagcuuacugcagccuugaccucccaggcucaagugauccuccagccucagccucuugaguagcugggacuauaggcaugcuucacaaaccaagcuaauuuuuuuuuuuuuugagacugaguuuugcucuguugcccaagcuggaguacaacggugcgaucucagcucacugcaaccucugccuccuggguucaagcgaacuccugccucagucucucaaguagcugggauuacaagugugcaccaccacggccagcuaauuuuuuguguucuucguagagacgggguuucaccauguuggucaggcuggucucgaacuccugaccucaggugauccaccugccacagcuucccaaagugcuggcaauacaaccgugagccacugagcccggccccuuuguccaccuugguugaaugucaggcguuauuugucuccuaccacauuagaaacauccugcagacaaagcccugagcugaaucuucuuuggggcccuaacacccaucuggacagguaagaggacaggcagugaauguuugcaugagugacggaggcgcucaguauguacccaugugucauguguguaucugcucaccuuccccaugcucgucuguguacuggaaggccuggaccagccgcagagccucauccacggagcgucccacaggcaaaucauuaacagugaucuggcgaaggacacccuugccaucgaugauaaagaggccccugaagacaucaggguucccagugaggagcugauagcucccacugccagagacaaggaagggacuaccaaccacccgcugcuagccacagggcugggggcagagaagacauuguacaggaguggucccagcaucacaggaauggggggcagggcgcucccugagccgggcugagggucccacaguaccuguaggcaaugcccucaucuguuuucagcacgccguaauccucagacaagcgucuggucacgucagcaagcagggggauguucagggggcccaagccucccucuuuccgggggguguugauccugggaguaggggagacagaguuggggccucaggaugccuggcacagcaggguccucacccugugggcccaaugugauaagcacuggaggccggagauaaggggcuuuagaguaggccgcugggagccucacccaccccacccuggguugggugcaaggacuguauccccauggcugggaagacugaguuugagaggcacagcuccagcuaaguggcuucacauguacuuguaacuugcagcaucacccagcagagagccuguguuaagaguccccauccuccucuagcugugucaugggguacagcccuucacuucggugaacuggaguuuccaucuucaugaaauagggcagcacagccucccuccugggaacuaaguacauagaguagauagaguugcaucugaguugcaucugcaacucuauauaccaggcaacuaguugucaaaugcuaauuacugucaucauccuuaaagacuugggcggcaauguuuccauuauuuucacgauggggaaacgcagguuccagagguugagcaauggccacgaagccacacugcuaggaccugagggugugagcuuagcugcaaccucccucuuuggccccugcucauaccaagccaggugggugaacugagaguccaccgagacgcccagcacuucacagcccagcuugcggaaguccucugcacgguugcugaacgcgaugaucucgguggggcacacaaaagugaaguccagaggguagaaaaagaggaccacguacuucccuggggaggagggacacagaggaguuagggcccagcuucucucaugcacggccccgcuucuaccugggcccccuccgggcggcgcucaccuuuguaguccgacagcuucaccucuuugaaggcgccaucaaccaccgcuguggccuugaagucaggggcuggcuuuccgaugcgcgcguuaccggaggccaugacugaaagcugagacccccgcccggucagugcgcccgggaagacacuuuguccucccaacccaaggucgcgcugcgugcugggcccuaugacugagucagcacggcggaggcgacagcacuaacccucacccucccggguacccggucuacgaggcccggaggcugccggagacccgcucuccugaccagagcacgagugacccagccacugccaccagcaccccacgagcgagucggccggagggcggugucgcaagcccccagcccagaaggagacagugaggcccgcacgagcagggggcgggaagucgggcgaucaggccugcgcugcaaggcuguggccucgguuucccccgcaaggacaaaggaggccacuauagcggauggaaagcaaaggcggccagcacuaaagucaggaucgggccaaagcagccugaaggggguccucccgccaggugcacuccggguguucauaccugcgugggcaaaggcuagacgcacggacgaucacacgcguggacccgcguucucagcgccaagugagcccugggccgcgaagccuuuuaugcccggcccgaaccaagacgugcacggcgcgggggagggagcggacgagcggagcggucggguccacugcgcccgc

SEQ ID NO: 15691 - RNA, 7441 nt, Homo sapiens
guagggguggggcagagggacaaagaugggacuaaaggagccaaaaagacaggaagaugcugugucucaugccuguagaugcugugucucaugccuguaguuccaccuacucuggagagugaggcagaagauugcuuaggcccaggaauuugagucgagccuaggcaacauagcaauaccccaucucuuuuuuuuuuuuuuuaagagaugggguauugguuaaaaaaaaaaaaaaaaaaaaagaggccagaugcaguggcucacaccuguaaucccagcauuuugggaggccuagguggguggaucaccugaggucgggaguucgagacaagcuugaccgacauggagaaacccagucucuacuaaaaauacaaaauuagcccagccugguggugcaugccuguaaucccagcuacuugggaggcugaggcaagagaaucguuugaagcugagaggcggagguugcagugagcugagaucgugccauugcacuccagccugggcaacgagugaagcgaaacuccgucucaaaaaauaaaaaaaaaaaagaggccgggcacgguggcucaugccuguaaucccaccacuuugggaggcugaggcgggcggaucaagaggucaggagaucgagaccauccuagcuaacgcggugaaacccugucucuacuaaaaauacaaaaaaauuagucgggcgugguggcgggcgccuguagucccagcuacucuggcggcugagguaggagaauggcgugaaccugggaggcggagcuugcagugagcagagaucgugccacugcacuccagccugggcaacagagcaagacuccaucuuaaaaaaaaagaaaagaaaaaaagaagaaaaaggagagcuggguggcaaaaagaaauugaagaauuaagaguaggaaaaacaccagcuagaaaauacugaacuuggccagguguaguggcucacgccuguaauccuagcauuuugggaggccaagguggguggaucaccugaagucaggaguucgagaucagccugaccaauauggugaaacccugucucugcuaaaaguaccaaaaaauuagcagggugugguggcgggcacuuguagucccagcuacucaggaggcuaaggcaggagaaucacuugaacgcgggaggcagagguugcaaugagccgagaucacgccauugcacuccagccugggcaacagaggaggacucugucucaaaaaaaaaaaaaaaaaaagaaagaaagaaaaaagaagaaaagaaaaagagaaaauacugaacuuggcuaggcaugguggcucacaccuguaaucccagcacuuugggaggccaagacgggcagaugacuugaggucaggaguucgagacaagcgugacuaacauggucucuaccaaaaauacaaaaauuagccaggcgugguggugcaccucuguaauuccagcuagggagucuggggcaugagaaucgcuugaacccaggagggagagguugcaugagcucagaucaugcuacuguacuucagccugggcaacagagcaagacucugucugaaaaaaaaaaaaaagaaaaaauacugaacugggcuuggaggguuuaucuuaauauccacauuccugggccuggaccacuugcuuccagcauuuucuucugcaacacaggcccuugcuuugcuucaccuugaaccuggggcuguagccuucaugugcauccuugugucuucccacaguuugucccgcuggcuggaagccuggcagugacacgauuaagcccaacguggaugacagcaaggaauauuucuccaaacacaauuaggcuggcuaacggauagugagcuugugccccugccuaggugccugugcuggguguccaccugugcccccaccugggugcccuaugcugacccaggaaaggccagaccugccccuccaaacuccacaguaugggacccuggagggcuaggccaaggccuucucaugccuccaccuagaagcugaauagugacgcccucccccaagcccacccagccgcacacaggccuagagguaaccaauaaaguauuagggaaaggugugagucuguguuggugugcucuguccuuucguccuccccugcaacccccuuccuucuucaggcucaggcuugggaaacugacccugugguugcucaucuucgccacacgguggcggucuuaucacaugcuuagugccugcucuuuuccugcuugcgcucaaggcgguuucggagggguaggguaugccguuugucccuugcaaaucccaggaugcccuacauccagaaaucuggccaugcaaggcaaagcccacauuuugucaccagccagccuggguucaaaugccguuuaagagcugugaucgucucugggucucuucagcaguaaaaugggacugcaaacccagaucaccaugcacgugguaaaauuuguaggagauaaguuaugugaagcucggggcugaggccccuguguagggcccaguuccuaguuccuaagacggcuuccucgagcugaaaggaacccagcccaguguagucuuauggggaagaggguggggacccagucuuaagagcagaaccaagaaugagagccugagcuacgugcagagugcagagucccugcugugagcucugccccaccccaggcuggaaagguugccugucugccccuggggugggaggguggcaguuaggcuagaaggcagguauuagcagcaaggcaggguucccaggggugcaguuuaauauugugugcguucaggaaaguaguuuugcuacucuaugccccaauuuccuccuacagaacagggcuaauaugcucauuuaauccacagauccacuauuaaugcugguacccaccuaauacccucuaagggucacucaucucccuuggaauuuaaucuacacuccuccccaaggccccugcucagucucccuugacaucugcccuguugugguucacuccauuccagacaggcuggcuuccugcuguucuuucacaggcucaccuggcuacaugaauuuugccauuuaagagcugcucccaaggccgggcgcaguggcucacgccuguaaucccagcacuuugggaggccgagacgggcggaucacgaggucaggacaucgagaccauccuggcuaauacagugaaacccccucucuacuaaaaauacaaaaaauuagccaggcauguuggcaggugccuguagucccagcuacuugggaggcugaggcaggagaauggcgugaacccgggaggcagagcuugcagugagccgagaucgugccacugcacucuagccugggcaacagagcgagacuccgucucaaaaaaaaaaaaaaaaaaagcugcucccaguugagcgggguggcucaggccuguaaucccagcacuuugggaggcccaggcaggcggaucaccugaggucagggguucgagaccagccuggccaacauggugaaacccuguuucuacuaaaaauacaaaaauuagccuggcauggugaugcacgccuguagacccagcuacuugggaggccaagcaggagaaucgcuugaauccuguggguggagguugcgguaaacugagaucgagccacugcacuccagccugccugggugacagagggagacuccaucuaaaaaacacaaacaaacaaacaaaaaacuguuaccucugaugcuguuguuacccaggauuuucucaggaccccacuucuucaaaucuguugaaaagucauggccaggcacgauggcucacgccuguaaucccagcauuuuggaggccgaggcuggcagaugaccucaagucaggaguucaagaccagccuggccaacgugcugauacccagucucuacuaaagauacaaaauuagcagggcgugguggcaggcaccuauaauccuagcuacuugggaggcugaggcaggaaaaucgcuugaacccgaaaggcagagguugcagugaaccaagaucgcaccacugcacucaagucugggugacagagcaagaaucugucuaaaaaaaaaaaaaaaaagucacugcaggagaagagcacuggcucacgccuggaaucccagugcuuugaaaggccaaggcgggaggacuguuugacccagcaguuccagaccagccagggcaacauagcagaccccaucucuacaaaaauaaacaaaauuagccaggcauagugguguaugccuguagcucuagcuaguugggaaguugaaguggaaggcuugcuugagcacagaaggucuaggcugcaguuagcuaugauugcaccacugcgcuccaaccugagcaacaggacaaagacccgucucuaaaauauaaaaaagaaaaagucacccuauuaaagguccauguucccacuccauucugcaaagcaucuuuccucccugccccaucauugccaccuugaccuuuuuuuuuuguuuuuuuuuuuuguuuguuuuaguuuguuuuuuuccucuuacuagcacuuaccaccacccccaaagaaccauguuugcuuguuuauuuauugucuugucuggagugguccaggcugugucuccagggucuaguuguucuagguauuguacaaaugaauugaugaagugucuguuccacucacccuacugccugucugguuucucuaccuguuuuucuccacugcucugggggcuuccaaccccgaagccggccagacucccucuaggcgggccagcagcaccagcacccccacccccaccuccacgugucccagcugcgcgggagggagcccagcgcgagggcgguggcggcgcccagcggcccgagcagccgccccggcaggaccagaccuggcagucgccccgcuccuggccuggcacccgugaggggaaacuggcaggcgggcgccgcccuuccuggaggggguggggguagaggggacggcgucggcaaagcagcggaggcagcagcaacccuccgccccggucaggucagacggagggggcgugggcgcggcggggccuaggcgccagugucuugaagguggcacagggguggcucccggagcccaggagcgcugcccgcccaccgcgggcgcucuggacccaggccuggggcuuuccgugcccgggcagccgccugcccgggaaaaucccggcccccuucccggcgccgcggcccugcccggcagagcgggggaggggauucccggaaucugcccagagaccgcggucgcgucacugggcagaaucgguccuuguaugggcagcgcuuccgcugcgucagcggggaaagccccggcgcgcgcggcugggcggggacgcgccugcgcacuccaagucucggccggagcacccugccuucagcuccugggucccuggaccgcgucccgcgccccaaccauccaacccuggagaucuggggacgcgggaagggugggacuccugggcugggaccacaagaugccugcgccgaaccgacgagggggacacauacaggaccgagccaccaacagcacugagcugggggcaaaccagugcuuuuuuuuuuccccccgcccucccagcuuggaaaaaaagacaacagaaauuaauaaagaaccaauuuuuuuuuuacuuaaauagauucaauaaaaagaacaaacacacacaaacacaaacacgucuuaaaauaaacucuuuagagacuaagugcguguuucuuuuccacaguacggugcagagaggggagggcagggggcggggguccccuucccaauguccccgcgggcuugaguaccaggcggcggggccagcuccgccgcgaucgcccccucuuccccucccuguuaaauacacaaauauauuauauucaauaugaaucgagucuguuuccagcagaaaaaaaacauacaaaaaaaaguggaagggggggcuuguaaacgucgagguggaaggacugggcgcaggguaggagggccggaguccagugugguuugcggcgccccuaggucccagggugggugcccaccgccugcucccuggaccccagugggaggcgugugcccagccguccaagcgaggggguguccguaaaggggcaggggacguucagaaggcgugucccuugaccccaagcagcagcugacagccguugcugacgugggucaugaccuucuguuugagcugggccaccugcucccggaggaggccggcgguacucgacagccccgcguucucggccuugagcgucuucaccuuguccuccaggcgcgcgaugcgcuccagcuuccgcuuccggcacuugguggccgccagccgguuccgcagccgcuugcgcuccacuuugaugcgcucuuggucuuccauguugaugggggacaccggcggcguggcgucccggcugcgcgccuccggcacggucugcgguuccuccuugaagguggaggcgccgcggcccaagcccagcugcgccggguggccaccggcgaagggcggcgcgugugggagguagcugaugguggucgucggguacgagcucccggucccgacggcagccccggcgccucccgaggacgcagaggcuggggaguagcugcugagguugguguaaacgggagguggcuccgggccggcguagacgcccccgggcccagccgggggccccccgguagcgcccagggacacguuggggggugucacgugguucaucuugugcagaucguccagggcuuugacaaagccgucggcgaagcccuccugcuccucggugacgccgcccccugcgcccccugcaccuccaccgcugccacccccgcggggguaaaaguacugucccggggguguaggcgucgucgugaucacgccguugcuguuggggacaaucaggcguuccagcuccgaagaggcgagcuugagagacgcgccgguguccgagcccugaccagaaaaguagcugccgccaccgccgcccucugggccggguccgcgagccccaggcgcuuugagacuccgguaggggucggccagguugaccgccaggcucgguuucaggaguuuguagucguguagagagaggccaccaggggcccggccguaucccguagcuguguaugagucgucgugguagaagggcuguuccauuuuagugcacauccgggcggcccaggcggucuggggagggucccugcggggccgcuccgggccucgcugcagcgagcggcgagcucuccgcugcggugaccggacugggugccuggucgcgcguucucgggggcuggcgcgggcggguagcagccagccggcagcugugcgcaaaagcccugucaggcuucccgagcccccgucgcccucucuggcgcgauagcuuuccuggcgucguuucccccagcucccagcucccugcuggcuccgaggcuggccuggccgcucucaaggucccagccgcucagccugagccacacgccuuuauac

SEQ ID NO: 15692 - RNA, 12685 nt, Homo sapiens
ugggcuugggggcggggcggggccugcgccuaggggggcggggcggggcggcgcucuaggccgagcgggaggucggggcugcgggcgcucgcugguggcggacccggaggcugcugcggcgccggggcuccguggccuggauugaauccgaucgggagccaugagcguggacaaagcugagcuaugcgggucucugcucaccuggguaggucguggggcggggcuaggggaaggugagcgcccgcuccucuugcccgggaucccuggcccugguucggucagucucuuggugcuggggcugggaggugcggggucgucgacuugcuggaccguuggacucuggcccgagcacccgcccccgucacguggcaagucugcguggaaaggacaggugaggccccgccccucugugguugguucacguggggcgaggacacaggugaauuggccuggucacguggugccuguggggcccaggugacucgcgauaccacccuggccuggacgcgcaggguuuguugggcagaggugaggugaggccacgcccccuccggucucaggugagcagaagccagucccucgcagagcugcuguggcggagcagcgcccgccccaccaugugagguucgcugacuggaaaagucugcaaaaggggagcgguucggcgcucccaggcccuaacucuuuccuuguccuuuccuuuaccccucaguuacagacguuccacguuccgucucccugugccagcccucaggaccugagcagcggccuugccguagccuaugugcugaaccagaugugaguggagcugaaggggaggaucccaaaagugucccccagucugcucaucccaccuucucgcccccagagaccccuccugguucaacgaggcauggcuccagggcaucucggaagauccaggucccaacuggaagcugaaggugacaaguggacuccugauuagaggacagacuggugaagagaugaccagggacgggccagcuaggcacauguccugggugaugggcaggaagagggacagaugucuggugaucaaccauuuguucauccauucaucuauggaguacucacccugugccaggccugggcauucagcaaggaauaacacagacaaaaaccugccccacacagccaucauucuagugacaagcaacacauacacaaccauaaaaauuaacuuccaggcugggcgcaguggcucaugccuguaaucccaacacuuugagaggcuaaaguggguggaucaccuggggccaggaguucaagaccagccuggccaacaaguugaaaccccaucucuacuaaaaauacaaaaauuagcugggugggguggugugcaccuguaaucccaguuacuugggaggcugagacaugagaaucacuugaaccugggagguggaggaugcagugagcugagauugagccauugcacuccagccugggcaacagagcgagacucuugucucaagaagaagaaaaaaagaaaaagaaaaagaaaaagaaaaaacuuuugaugccaguaguucugugaagacaacaaaaaagcagggcuuugagagagagcaaugagggcauagguggcugauuacaucagauggguuaaucuccaagugaaauuugggggaacgguguuccaggcauagggaauagcagauguaaaggccgugauuugggaauaaacuuggugugauggaggaauggcagagagggcagaacagagcaagagggcaagauuuguaggagaugaggucaucaggggccuggcaggccaugguggggguguggauucuauuuuuaagugcuguggaaagucaaggcaggguuuuagcagagcaaagaugcaaccuggcuugggcuuuauaaagcucccccuggcugcauggagagaaauaaaauguaggcagcaaaaguggaagaggagaggcagcuggugcacuaauccaggugagagguaaagauggauggguagggcugaaggaugguggggcagguggugagaagugacuugguucuggagacauaugaaggaagauggucaggcaggccgggcacaguggcucaugccuguaaucccagcaauuuuagaggcugaggugggaggauugcuugagcucaggagcuugagaccagccugggcuacauagcaaaaccuccucucuacaaauaaaaaaaaguagucgauugugguggcauaugccuguagucccagcuacugggaggcagagauaggaggauugcuugaccccaggaggucgaggcugcagugagccaagauugcaccacugcacuccagccugggugacagagccagacccugucuuaaaaagcuaaagcaaaaaaaaaaaaaaaaaaaaaaagaaacaaagauggucaggcagacaaaaggggcagacagccagacaggucaccccuagaggaaggcgcacgcagacagaauaggaugagaugagcagggaaggagaagugagguggagagaggaugggaccuacagauucagagugggaggccucugaacuuguccacaguuccuuguuccucccuaggucagcaaucugaagauggucuuacggagccuaguagaguacucccaggaugugaguaacuguaaagggauucaggggguugaguugggagaagggugggcccaugagccccugacacccccuucuccccagguccuggcgcauccugugucagaagagcaucucccagaugugagccucauuggagaguucucagacccggcagagcucggcaagcugcuucagcuggugcugggcugugccaucaguugcgagaaaaagcaggguauggggagcuuaggggguccccagggcuggccugaggaaauccuccuuccuccccaccucaccccugggucucagccucccccaccuugauccccagaccacauccagagaaucaugacgcuggaagaaucgguucagcauguggugauggaagccauccaagaggugggugggggcacucagugugcaauuggaaaaugucaggagaggggacaucucuagggcagagagaacugggcacagguccugcccugguaaggucuggacucugccuggaacucagcuggccagacaucucugucucaugugucugccagcuccucccagcucuaagucgcaaucuagcaggcucaagggaucuggcuucccucuguguuggaggcaggagggcagccucugggcugggguuauugggcagaacuggccuugacgggaggauggagagguucucagguuggauaguagauacuuugaaggcuggccucagauauccaguucauuacaaugccccuucccacuccucagcucaugaccaaagacacuccugacucccugucaccagagacguauggcaacuuugacagccagguaagagauuugggggaaagguguuccaggcacagggaucagcaaauccaaaggccgggaguuggggauaaguuugcugugauuaaccuugugacuuaaccuuguuaaagguccagaccccacuuacagaugcucaggguagccuaagggggaggggcuuguccuuaagccuguaagccacgcccaucuuccagggugcuagccacuuccuguaccaggucuccaguguucuggaaucgcucuuccuucagucuccaaccccagcccuguuuucuuuucuuuucuuuuucuuuuuuuuuuuuuuuuuugagauggagucucacucugucacccaggcuggagugcaguggcacgaucucggcucacugcaaccuccgccucccggguucaagcgauucuccugccucagccucccgaguagccaggacuacaggcacacgccaccacacccggcuaauuuuuguguuuuuaguagagaagggguucgccacguugggcaggcuggucuggaacuccugaucucagguaacccacccgccucagccucccaaagugcugggauuauaggcgcgagccacugcacccggcgccagcccucuuuucaauccugaggguuucuuggcccccuccauuuggccucuagagaucucagccucccuccccccguccuucuccugaaucccugaguuccucuucccccucaucucugcagucccgcagguacuauuuccuaagugaggaggcugaggagggggacgaauuacagcagcgcugucuggaucuggagcggcagguagggcccuagguggggcagggucacuugaguagccccucuccaagcccaagcucaucuuucugcccugcccgcagcugaugcuccugucagaggagaagcagagccuggcgcaagagaaugcagggcugcgggagcggaugggccggccugaaggcgaggguaccccaggucucacugccaagaagcugcugcugcugcaaucccagcuggagcaguugcaggaggagaacuucagguguggucagcuggggacugggccaggcaagccaggggaccgggggagggcagcccccucaugugcucuucccccaacacccccaggcuggagaguggcagggaggaugagcgccugcgcugugccgagcuggagagggagguugcggagcugcagcaccggaaccaggcgcugacuagccuggcccaggaggcacaggcccugaaggaugagauggaugaacuacggugagugguggguuccuggguccccaucacggggggcgggggguaaaccuguuuccagaguuccccucugaugccauagcagcucuguaauuuucaugugcccagugaacccccaauaugcccccuggacuccacagugccacccugagcccuacagaacgcccaaggccacauugcacuauccugaauuccaccauauccccuggaccccacacugccccccccuuaucccacaguaugcuuccaagaccccauagcaucccuguggccccccaaaacacaagaaccuccccuacaaugcucugcagaucccacugcacaguuugggcuucauaaugccccuggaucccaugguaccuucuaggacuccacaaugcaauuacuuugcacccccuuuugacucuacugugccuucuguaaccacaaagggcuccacugggccccuauagcaucucuguaaugcgaagguacuagugcaccccccaauugcacuucuaaggaccccgcaguccucuugucccauaccucccccaaugacuccaagguauccuuggcagaugcucagaccucucuaggcuccccaucacucccccuauaaccccacccucuguguccccacaauuccaccccaggggauaccugauuauaacccugggcuaaccauugcuguaaugacucucaacagcuccaggcccugauugaccccuaacccucaacuuucaugaccccuucaccuugaacccaaaagccucaggcugaacaacacccugugcuccaagggccacuccacaucccagcugaccccugaucagagcucucagcccucccccuucccucccacuccccuaggcagucuucggagcgugcugggcagcuggaggccacgcugaccaguugccggcgccgcuugggcgagcugagggagcugcggcggcaggugcggcagcuggaggaacgcaacgccggccacgccgagcgcacgcgacaacuggaggaugagcuacgccgagcgggcucccugcgcgcccagcuggaggcgcagcggcggcaggugcggcgggggcgggguuagggccggggccccgccccuggcagcaagucucucaccguuggccagcccuccgcccaccccugauccccucccuuauuuguacguaggccacgcucuccgggccucuucccuccacccacgcugcucuucugucuggguuaguaagcccagccuuucccuucccuuaaguaccgcuccucuaaauucuuugaugcccgccgcuucaccaugcugcuugauuuccuuggggcuaccuaaccauguaacaaaacucgugguaaauugaaaauauccuaaaaugcauaaaggccaggccugguaucccagcgcuuugggaggcugagccgggaggaucacuugagcccaggauuucgagguuguagugagcuguggcugcaucacugcauuccagccugggugacagggugagacccugacucaaacaaaagaaaaagaccgggugcgguggcucgcgccuguaaucccagcacuuugggaggccaaggcgggcaccccauaacuccuucuguaaccccacaucacuugaggccaggaguuugagaccauccuggccaacauagcaaaacccugucucuacuuaaaaauagaaaaauuagucugggcgugguggcucacuccuguaaucccagcacuuugggaggccgaggcggguggaucccgaggucaggagaucgagaccauccuggcuaacacggugaaaccccaucucuacuaaaaauacaaaaaauuagccgggcgugguggugggcgccuguagucccagcuacucgggaggcugaggcaggagaauggugugaacccgggaggcggagcuugcagugagccgagaucgugcuacugcacuccaggcugggcgacagagcaagacuccgucucgaaaaaaaaaaaaaaaaaaauuagccgggcugguggcgcgcgccuguaaucccagcuacccagaaagcugaagcacgagaauagcuugaaccugggagguggaaguugcaguaagccaagaucgcaucacugcacuccagccugguugagagagggagacugucucaaaagaaaaaaguaaaagauauuaaaaaaagaaaaagaaaaagagagcugggcguggugacucaugccuauaaucccagcacuuugagagguugagaugggagaucgcuugaggccagcaguucgagaacacccuggucaagauagcgagauuccaucuguuuucaaaaaauaaaaauuuuuaaauuuuuuuuaaaaaagaaaauccauugaacauacuuuaccuacugagcaucacagccuagccuagccuaccuuaaacaugcucagaaaacuuaccuuagccuaguuuggcaaaaucaucuaccauaaagccuauuuuauaauaaagcguugacuauauaacgcaauuuauugaagacuaauucauugcaauugaaaaacagaaugguuguauggguuccuacuauuaacauucacagucggcugggugcaacggcucacaccuguaaucccagugcuuugggaggcugaagugggaggacugcuugaggccaggaguuugagaucagccagggcaacagagggagacccugucucuaaaaaaaacaagcaaaaacauacacagcugaaagcaccauaguaaagucaaaaaaauaauaagucaaagcauccuggaucggggaccauuuguacucagccccugccccugcucccagcccugcuguccuuauuccuccccucucuguguucaggugcaggaacugcagggccagcggcaggaggaggccaugaaggccgagaaauggcuauuugaaugccgcaaccuggaggaaaaguaugagucggugacaaaggagaaggaggugaggcugagguuccacugcccaagccccacccugccaauucugggguagcccauuucccaggaggccgagccugacccguggagugucuuguacccugucccugcagcggcuguuggcggagcgggacuccuugcgggaggccaaugaggagcugcgcugcgcccagcugcagccgcggggguugacccaggccggugagaugaagccccaucccggggucuuaccuguccugguguacuguuuggguagaacagguugugucccagugcaugucuagguuggggacagagcuaggccaggcuggaggugaccagaaagaggugacacggucaaauugaagagagaggcucagggucucaggguggagcaaaggcuaaaaagcuuggccaacccucccgguucucuaucaagccggggauggagcuugugucaagccagacuguuggcugaacuugaagccccaaaagaugauccuugggaagaagacccuaggggcggggacaggggaugcgaagagaccugaagacuuuucucgcauucuucagaucccucacuggaucccaccuccacacccguggauaacuuagccgcagagauccugccugcggagcucagguauccuggggucacucaaaacucuggccccacccaggcuugccaaggcccgcccucagccccgcucccgcccucccaucuucugcuagccccgguugcuuggucucagcuccaggugccagccgggcuccuaggcccacuuacuccugauuuggcucuguccagcccuaccagaugacuuugccucucaagggucuauccuuaguacacaaauuauguccaacaccuggcuccaguuccugcacaaaaauccuaugcccuagccccgcugacuuugauccuuucccccagcguccaccccuguuaguguaaccucugugaguuucaguccccugugcccugccgggauuaacucucccaccccgggccaggcacgguggaucaugccucuaagucccagcacuuuggaaggccgaagcuggaggaucacuugagcccaggaguuugagagcagcuugggcaacauaguggcccucucuacaaaauaaaaaugauuuaaaaacccgaaaaacgaccgggcgcgguggcucacgccuguaaucccagcacuucgggaggccaaggcgagcggaucacaaggucaggagaucgagaccauccuggcuaacacggugaaaccccgucucuacuaaaaauacaaaaaauuagccgggugugguggcacgcaccuguagucccagcuacucgggagguuggggcaggagaaucgcuugaaccugggaggcagagguugcagugagccgagaucgcgccacuguauuccagccugggcgacagagcgagacuccaucucaaacaaacaaaaagccaaaacuaaccaaacaaacaaacaaaaaaaccccgaaaaacugucccauccuaguucuucccauuucugcuucccgcuuuccagcagucccaucccagcuguucgaauccacucuuguagcuccgccccugccuagccccacccacuaucccagcuuagagcuccguccacuuuaacccugggccgggaaccugaacccguaguagguccucggugcuccaaccccauggucuggcugggcucuuccccagggcucugucccgccccuagcuccacucucccugagccccagcgagccugcgaggugacucgacccuggcccugcucucuccucccgggucugcagggagacgcuccugcggcuucagcuggagaacaagcggcugugcaggcaggaggcggccgaccgggagcggcaggaggagcugcagcgccaccuggaggaugccaaccgcgcgcgccacggguuggagacgcagcaccggugagcgccuggggaccuaccugcgcggagcagggacagagggggccaaaagugggcacaggcacuaagcggccccccacccucgcaggcugaaccagcagcagcuauccgagcugcgggcccagguggaggaccugcagaaagcccugcaggagcaggggggcaagacugaagaugugagugucacccaccaccucccagccuggcccucccuugugccccgaaguaacccuccucucucucccaugcugcccgaugccccauacaggccauuguaaguaccaugggcccaggauggcacccccuacccucacccugggaaggaagaauuagggccucucuggaucccccacucaccuugccucuucucucucccaguccauuuugcugaaaaggaagcuggaggaacauuuguaagucgcagaaagagggaacuccucgugggggcauggauuugauauuaguggggaguuucuuaggcaugugccaccaugccuggcugauuuuuuauauuuuuaguagagacgggguuucacuauguuggccaggcuggucucggacuccugaccccagaugauccacccgcuuuggccucccaaagugcugggauuacaggcaugagccaccgcgccuggccugcuuucuuuucuuuuaccugucugcuauugaagagauuuguauucuagaaagaucccuggcugcuggauggagugcuugagaguagaagaagcuagcaagggaagaugguggcugaaccagcuugggagcugugggaugggaagaaguggacagcaggggcuguuccggggcauaccugcuaagggugcggaggguuguggcucugacagcuguggagccggugggaccagggcacacagccccaggcaugaggggcaggcagagagggcucuguggccauguaggggcauuucuggcuggcggggaggucuguggcuaccacugggacaaaagagaagccagcccggaggucagcccacugcugcucauccccggcccacaggcagaagcuucaugaggcagaucuggaguugcagaggaagcgggaguacauugaggagcuggagccacccacugacagcagcaguaaguaggaccuagugaccagaggguggggagaucccagagcccagcagcguggagcugaugggccaccucuuccgccagcagcccggcggaucgaggagcugcagcauaacuugcagaagaaggacgcggacuugcgggccauggaggagcgauaccgccgcuacguggacaaggcccgcauggugaggacgcuggguguucccacaaguugccugcccuggcuucuuacuuuuugugccuccuauugagucaaaccuccugcuugcacaucugugcccccaacucauaccugucauaccccaccauaagacagacuucugcaugauuccccacugcuacugauugucacauuaaaauacugcacagcuggcugggugccguggcucauggcuguaaucccagcacuuugggaggucaaggcaggcggaacaugaggucaggaguuugagaccagccuggccaacauggugaaaccccaucucuacuaaaaauacaaaaauuagcugggcaugguggugggugccuguaaucccagcuacucaggaggcugaggcaggaaaaucauuugaacccgggaggcggagguugcaguuagcugagauugugccacugcgcuccagccuaggcgacagggcaagaguccaucucaaaaaaaaaaaaaaaaaaaaaaaaaauuacgcacagccaggcgcaguggcucacgccgcuaaucccagcacuuugggaggcugaagcagcugaucccuugaggucaggaguucgagagcagccuggccaacauggcgaaaccccgucucuacgaaaaauagaaaaauuaggcgggauugguaacaugcgccuguaaucccagcuacucgggaggcugaggcaggagaaucacuugaacccgggaggcaaaaguugcagugagcugagagugcgccacuucacuccaggcugggcaacagagccagacuccaucacaaaaauaaaaauaaaaauaaaguaaaaauaaaguacuggcuggaugggcacaauggcucaugcuuguaaccucaacacuuugggaggcuaaggcaggagaauugcuugaugccaggaguucaagaccauccugggcaacauagggggacucugucucuauaaugaaugaaagaaugaaugaauacacacaccccaguaugucccaggggguuucaaggccaaagucaccuggcuaugacuuccucaaccuguaggucaugcagaccauggaacccaagcagcggccagcugcgggggcaccuccagaacuccauucccugaggacacagcuccgagaacgggauguccgcauccgacaccuggagguggguguccucgucccuuuacgcugccuccaacguaucuaggccccugacacuugccuccuugacagauggacuuugagaaaagccgaagucagcgggagcaggaagaaaagcugcucaucagugccugguauaauaugguaaguguggggucugggcucuaagaucucauggguagaauauugguggggggguccugugagcucaccugaccccaaccacaccuccuccugaagggcauggccuugcagcagcgagcuggggaggagcgggcgccugcccaugcccagucauuccuggcacagcagcggcuggcaaccaauucucgccguggacccuugggacgccuggcaucucugaaccuucgccccacugacaagcacugacagaccucacaaucaagccagccugggcuccacccacccuggcuuccuccagcucacauggcgcccagcacugggcuucagccaggugcucgagagcuuugaggccaugaucucugcucuucccucucccagauugguggggagggagggcgggagguagauauaggccuguucuuuuuagcaaugugauucuuguuguugauucucucucuggaguucaugugcugccucaggagacucugauuuuauauuugagaaaaauaaaggcguucaaucugcccuggcugugcucugggcaccaaggugagggagagaaagugggccagaggcuuagcccauugcuuuuaagaaaagcuu

SEQ ID NO: 15693 - RNA, 6695 nt, Homo sapiens
ucugaagcuacagccuagccgagggaggaggaccaggaaagggaggcacgcccacuccccagccccacccaacgccaaagccacccgcccauuccaucccugucccuguggguccuugcaccggccaccuucaacacaggugagaugagcccaggcuuggggaaauagggggcccugagggaagagggaaccugcgggcaggaaugcauccggaguccucccggggcggggaguggagggcuuggaaggcuggaggggaacggagagaggaaaggucaaggcggauccgggaggaaaagggaguggggggagccagggcaauuaagcagaaggugcacaggcuggggcaggggggcuaggggaccuggaggcuuagggacagggcuucagagggagugcagggagcagaaugggucaagacugggagcuggggaaguggagaagggggagccagaaauaggggcugagggagagaauuugggagagguggagccuugagaaccuagaaacucaggugcuggggacuugcggaauggggcaugcuacagguggccucugggugaaggggaucgggcagagggugacucgggagcugacugcagggacucaagggucuugguggugggggacggcaguuaccagagcccacggccaggaguccagggaaggggacagccugagaugaaggucagggaggggcacugggggcuggacuagacugaguaaagcugggaggagaaggcaacucaggcaagggucaggacugaagggguggcgggccggaacauggguggaaucccugugcucaguuauccccgcaccucuccacccacacccgcagcccccacccgggccacccacucucccuuggccacaccugccgggugccacgaugaccgucaccuacacagcccgaguggcgaacgcccgcuucgguggcuucucccagcugcugcuacuguggcgugggagcaucuacaaacuccuguggcgagagcugcucugcuuccuuggguucuacauggcgcugagugcugccuaccggugaggcugcccugaggugcucauguucuagcggagggggggcagcuauuauauauauauaauauauaaaaauuauaaaaauauagagauauauaaguauauauaucuauguuuuuuaaacugagauggagucucacucugucacccaggcuggagugcaguggcauaaucuucucuuacuuccaccucugccucccggguucaagcgauucuccugccucagccucccgaguagcugggauuaugggugccagccaccaugccuggcuaauuuuuuuguauuuuuaguagagaugggguuucaccguguugaccaggcuggucucaaacuucugaccucaagugauccuccugccucggccucccaaagugcugggauuacaggugugacccauagcacccggcugggggcagcuauuauaaaagaagccagggugaggggcacagcaagagagaucugaagcuggggauggagucacccuugugaccugugaccccucaucucuaucccgcagcuuugugcugaccgaagggcagaagcgcuacuucgagaagcuugugauuuauugugaccaguaugccagccucaucccugucuccuucgugcuuggugcgguccaaccccaagucccccguucccaugucccugagaaacccauauccauucaugccuuuugaggagcccccauuccugccccucugagauccccccccucaaauccaaccccgacagcacugcccacccauuuuuggauccauaucaugaagaugccagauguggcucuacacucugagaccuggggugucaccuggggucacagugcccccugaggugcccccaggagagcuccaucucacacacaggacuuauuccuggucacccuggggauucucaccagugucuguuguguuauuaggggggacaaaccccuaacccuccagggaccccauaggacuccauccucucaauuccagccugggggcauuucucugacaagucuuggaccccuagugaccacaagugacccuagccugcccaaggcucccugauguagacccuguccccaaccccuucagaaguuccuggcucaggggccggguguggcuacugugacaagccugaccagaugucucugauguacacccccacaaaccaggccccucuccccuuguuuuaggucccuaugccuucacagcaagcaacagucugcccacgugccccuaacaugggcucugugccucuauccccauacugggaucccaaugucacaucugaggugacucccaaguagccagugacccaaagggcugcucugccuuuuuuuuuuuuuuuuuuuuuuuuuuuuuuugagauggagucucgcucuguugcccaagcuggagugcaauggugcgaucucagcucacugcaaccuccgccucccggguucaagugauucuucugccucagccuccugaauagcugagacuacaggugcgccaccaugcccggcuaauuuuuguauuuuuaguagagacggaguuucaccaugcuggucaggcuggucucaaacuccugaccucaugauccacccuccucagccucccaaggagcugggauuacaggcgugagccaccgcgcccggcaacuguccuuucugaccucagggcuggacccccaaguucccagcccaaacguggucagguuggccagcacgcucggguuucccugaugcagaccuuacguugcccccucucccacaaccugggcccccaaaccccuggcccugguguccccacugagcccccauuccccgcuccccugcaggcuuuuaugugacgcugguggugaaccgcugguggagccaguaccuaugcaugccgcugcccgacgcgcucaugugcgugguggcgggcaccgugcacggacgcgacgaccgcggccgccucuaccggcgcacacucaugcgcuacgcagggcucucggccgugcucauccugcgcuccgucagcaccgcgguguucaagcgcuuccccaccauagaccacgugguggaggcuggugaguacucggccagaggcagggcagagaccgggcaaggaccagguggaggggggcaaggggcgagcuaucccugaccccuuuccuccaggguuuaugacccgcgaggagcgcaagaaguuugaaaaccugaacucauccuacaacaaguacugggugcccugcgucugguucuccaaccuggcggcacaggcccgacgcgagggccgcauccgcgacaacagcgcccuuaagcugcugcucgaggugggcccaaccaggaggucauucauauagaauaccagggaaauuguaccccuggagcugugucaacggcggcccuccaagcacccccacgaggccgauuucaaacacccucaccaggugcacucuuaccuccauggggcugauuccaaugcccuugaggggcagcuccugggugcaugguaccucauccaggugcacacucaccaccaaauacccucccuggaacccccaaagcacacucccaauucccaccaggugaccacccaccuccaucccacguaccuacacuuaauaucccugugugagcucaccauucaggccuccucaugaccuguauccacccccaggagcugaauguuuuucggggcaaauguggaaugcucuuucacuaugacuggauuagcguaccccucguguacacgcagguaaccccaucaugccucuuuuuauauucggugucaguggcccugaugccugguuuccaaggggaaaccaagaacuagcuaagacccccaucauaaugaugccuaauccuagccuuggaccccaaugaccccccugagcccugccccgcccugcccagguggugaccaucgcacuguacagcuacuuccuggcuugccucauuggucgccaguuccuggacccggcucaggguuacaaagaccacgaccuagaccugugugugcccaucuucacccucuugcaguucuucuucuacgccggcuggcucaagguaggugggugauccaggcuggaauuucguggguggggcgggcaugggguucccaaguuuccaccuaacugcucccucuccucucagguagcugagcagcucaucaaccccuucggagaggacgaugaugacuuugagaccaacuuucugaucgauagaaacuuccaggugagacucaguuuccaggugagacuuccagguggcgaccaucccggagugcccaacaggguucuggucccaccccugccaagucuugccaggucucaccccaaccauccuucccucugugguccccacccacccgaagggguccacccuguggucccggcggguugcccugcccccacuuuacccuguguguuugcacccguagguguccaugcuggcaguggacgagauguaugaugaccuggcugugcuggagaaggacuuguacugggaugcagccgaggcucgcgccccauacacagcggcuacugucuuccagcugcggcagccuuccuuccagggcuccaccuuugacaucacgugagccaguugggugggcagggccgccuggggcagggcuuauggcucugcggggcacaucugauugaaaagguuaaguggaaucaauucuggagauggggauaagagcuaaagucucaggacugugauaacgccagaagcuaagauaggagucaggggacaaggucaaggucugagacugggccacugacuggggacagagcuaagggcugaggucagcgaggaucagaccggucaguggugauuccaaaggagaugagggcugaggccaggagcacuggcucacgccuguaaucccaguacuuugggaggcugaggcaggaggauccuuugagcaagcccaggaguucagaccagccugggcaacauagugagacccccgucucuacuaaaaauaaaaaauuagccaagcgugguggugcacgccuguagucccagcuauucaggggcugaggugggaggauugcuugagucgaggaguucgaggcugcagugagccauaaugacaccacugcacuccagccugggcaacagagcaagagccugucucaaaaaaugaaaauaaaggccaggcgcaguggcuuaugccuguaaucccagcacuuugggaggccaaggcagguggaucacuugaggucaggaguucgagaccagccuggccaacauagugaaacccugucucuacuaaaaauacaaaauuagccgggcuugguggcucacgccuguaaucccagcuaaucgggaggcugaggcaggagaaucacuugaaccugggaggcagagguugcagugagccgagauugcgccauugcacuccagccugggccacaagaguaaaacugcauuucaaaacauaaaaauaggccgggugcgguggcucacgccaaggugggcagaucacgaggucagggguuagagacuagccuggccaacauggugaaaccccaucucuacuaaaaauacaaaaauuagccggugugguggcacgcaccuguagucgcagguacucaggaggcugagacaggagaaucgcuugaacccgggaggcgaagguuguggugagccgagauugcgccacuguacuccagccugggcaacagagcgagacuccgucucaaaauaaaauaaaauaaaauaaaaauaaaaaaggaaauggggcugagccacgacugagguugaagauccaaguugaagugcaaacacagggugaggccaggcucuggguuuaggagcuaagaucuuuggggauaagugggacaaagcgguggguggagucagggaaaucagcgcgccugggacccugcucugucaacaagaggcgaggccgcagcgcuggcccacugucggucccgcaggcuggccaaagaagacaugcaguuccagcggcuggacggcuuggauggaccgaugggagaggcgcccggcgacuuccugcagcgccuccugccggcgggcgcgggcauggucgcgggaggcccgcugggccggcgccuguccuuucuacuccgcaagaacagcugcgugucggaggcgucuacuggggccagcugcucaugcgcgguuguccccgaaggcgcggccccggagugcagcugcggggacccgcugcucgaccccggccugccggagcccgaggccccgcccccugcgggucccgaaccgcuuacccucaucccugggccugucgagcccuucagcaucgugaccaugcccgggccccgggguccggcgccacccuggcugcccagcccuauuggcgaggaggaggagaaucuggccugagaucuuagagcccagcccccuaaggacagggaaccaggucccugcacggcacccacgcaggugucccggucugcauaagccucgugugccuuuguaaaguccaccuacacuuuugaccagcucucgcugcccgcauguguuuggcgcugugcuaggggcgggaguucuuccagacucuuggaccagcccgcccugaccaccagcucuacuucccaacccccacugccugagaggucucuaucaguguccugccugaauucuuuccuucaagugaagaugugacugacuaccuccucgaguugucaugaggaugaaaga

SEQ ID NO: 15694 - RNA, 4096 nt, Homo sapiens
ggacgaggcgagucgggcgccaagcgcggggccggagcggccuucccggaguccuuugcgcggcaccuggcgacaaaauggcugcccgagggagacgggcggagccucagggccgggaggcuccgggccccgcgggcgguggcgguggcgggagccguugggcugagucgggaucggggacgucgcccgagagcggggacgaggaggugucgggcgcggguucgagcccggugucgggcggcgugaacuuguucgccaacgacggcagcuuccuggagcuguucaagcggaagauggaggaggagcagcggcagcggcaggaggagccgcccccggguccgcagcgacccgaccagucggccgccgccgcuggccccggggauccgaagaggaagggcgguccgggcuccacacuuagcuucguaaggagccgugggggugggggcgggcgccacggccugucuuggcagcgggagucggggcccgugaagggggaucgggaccgaaguccacuuuccguucugaaugaggggcccguccgggucacccgcugaggguguggaacuuggauucccgacaacuggggucuaggggcgggaguggggacuccaggagcuugcccgugggaacugggagcugaggaauugccuaggaaucagcacuguggagaaugaggaaacguggauaucaggauuccuguuugagugguacccggaccuugggucaugggaccaccacuaauugugaggaaagggaguaaauuuaagucuggacucugagcuauauguguuagacucagaccacguacuauguaaggacaauuacuuaucuaggacaauugcuugacuuccuuguaucuuauucgaccaaccuccauuuauugagcaauuuaccucgugcuaggcauugugcuaggugcugguaugcaguggugagcuuacagacaagaucgcugcuuuccuggagccucuggguuugccuacccucauuuucccuaguugcaaaaauagacaucauagcaucucuugauguggugaggguuuuaugaggugauccuggaaaagugguuagcacagagccugucuuccaggaagggcuaaacuggugguucucaauuggggcaguucccuccacccccacauuuggcaaagucuggagacauuuuugguugucagaacugcgggagggggugcuagugacaucuauggguagaggccagggaugcugcucaacuuccuaccaugcguggggcagcgcccucccacccccaaacaaagaauaauccagcucaaaauguuauuagugccagguugagaaacucuggauuaaguaaauagggcauauauugauuuuuggcucugagcuugccaugucugugguguuaagaucaagucccuguaguguggaggaaaaaguguugagaauaacaagacugggggcucuaguucuggauccagcaugugauuuugggcaaaugaucuaaccucugcaagccucaguuucuucauuuguuaaaaaugggcguggguugggugcaguggcucacaccuguaauuccaacauuuugggaggucgagguggguggaucgcuuaagcccaggaguuggagaccagccuggacaauauggcaaaaaugcaucucuacaaaaaaaaauuaaaaaauuagcugggcauggugccacacaugccuggagcuccagcuacccaggaggcugagacaggaggaucgcuugagcccaggagauucaggcugcagugagccaugauugcaccacugcgcucuagccuggaugacagaacaagagaguaucuuaaaaaaaaaaucggugugaaauaaucccagcaggccaggcucuguggcucaucccuguaaucccagcacuuugggaggccgaggcgggcagaucaccugaggucagggguucaagaccagccuggccaacguggugaaacccugacucuacuaaaaauacaaaaauuagccaggcaugguggugcauaccuguaaucccagcuacucgggaggcugaggcaggagaaucacuugaaccugggagguggagguugcagugagcugagaucaugccacugcacuccagccucgacaguaagacucugucuccaaaaaaaaaaaaaaauggaaauagucccagcagcacagguuacugaaugccugguugucugugaagacuguuggagccccuggagcgcaggaagcccucaaucaaugggagaaggugggauacaggaugaaaggcuagaggaagacucuuugaggcaaggguaaggaaggaaaagcgucaggaccaggguuggugugauaccugcgaguggagucccuucaugaaugggaguagcagucgucguugcaucuuuuucauuuguucauugaggggccauuuuggcugcacccucaaagaggccaugccaggcuaggcacagggaaggcaauguugcuugaugucuaaggaugcuguccagaggcuucgacccaccugacccugaaucagcuccauuguuuguuguuagcaugaccucuccugaaagacuuuccucaucuaugaaaagggggugguucuuuuuuucuuuucuuuuuuuuuuuuuuuuuuugagacagagucuacuucuuguugcccaggcuggagugcaauggugcaaccucggcucacugcaaccuccuccucccagguucaagcaauucuucugccucagccucccaaguagcugggauuacaggcgccuaccaccacucccggcuaaguuuuuguauuuuuaguagagaugggguuucaccauguuggccaggcuggucucaaacuccugacuucaggugaucuacccgauucuaccucccaaagugcugggauuacaggccugagccaccgcgccuggucaaaaagggggugguucuaacuuucaucuuaggguagcugugaaaaugaaaggagaugauacauccacagcacuuggcacagggcuuggcauacaguacaugcucaauaaagggagcuguugccaccucuuguggucccugcuagggagggugaggccuuggcguggaaagugagaacagagcuggucccuacugagguggacacucuucuugcucccugggagggcaccgcgggcccagggcaggcgcugagucgcgugugcuccucucugauugcugcgcaggucggccggcuggcggagcugggcgcggcgucaggacgggccaccaggccgggcuaggaagguguagugggccucagcgccgccaagggcggucccggcuccuguaaccguugcagucuucugucccuucacccaggugggcaaacgcagaggcgggaacaaacuagcccucaagacgggaauaguagccaagaagcagaagacggaggaugaggugagccagcuuggugcaggggguccacccacauugccuuucccuuccagcuuuugcgcccagccuucucccucccugucugguauccaggccuuuuaugagugugccuggcaggguaggagggcugucaauggguccccagauaacuugacuuuauaaucuucagcucaaacccagagucuucugggugacacugggaaugggucaccugucucagggcaguccugacccugguuccuggcacccccguccuaacccguauccccuuuccacagguauuaacaaguaaaggugacgcgugggccaaguacauggcagaagugaaaaaguacaaagcucaccagugcggugacgaugauaaaacucggccccuggugaaaugacgccccucccccaccugcccauggccugggacucucugcgauguacauaacuauuuaaugcagcggcagcggcgacagccuucccugagaggacuuaaaagcagaaggaaaccgagaugcuucccgcagccguggacgauucuccaggacucuuuuuuuaccuugagcacuugccucgugagacuucauagaacagugguuuacugucccccccuucucaccuccucauucucucuggcucuuucugucuuccucuucucacccuccucccuccccuuagccaucacuucugggaaguaaagaacuugacuuagugccggag

SEQ ID NO: 15695 - RNA, 4096 nt, Homo sapiens
cuccggcacuaagucaaguucuuuacuucccagaagugauggcuaaggggagggaggagggugagaagaggaagacagaaagagccagagagaaugaggaggugagaagggggggacaguaaaccacuguucuaugaagucucacgaggcaagugcucaagguaaaaaaagaguccuggagaaucguccacggcugcgggaagcaucucgguuuccuucugcuuuuaaguccucucagggaaggcugucgccgcugccgcugcauuaaauaguuauguacaucgcagagagucccaggccaugggcaggugggggaggggcgucauuucaccaggggccgaguuuuaucaucgucaccgcacuggugagcuuuguacuuuuucacuucugccauguacuuggcccacgcgucaccuuuacuuguuaauaccuguggaaaggggauacggguuaggacgggggugccaggaaccagggucaggacugcccugagacaggugacccauucccagugucacccagaagacucuggguuugagcugaagauuauaaagucaaguuaucuggggacccauugacagcccuccuacccugccaggcacacucauaaaaggccuggauaccagacagggagggagaaggcugggcgcaaaagcuggaagggaaaggcaauguggguggacccccugcaccaagcuggcucaccucauccuccgucuucugcuucuuggcuacuauucccgucuugagggcuaguuuguucccgccucugcguuugcccaccugggugaagggacagaagacugcaacgguuacaggagccgggaccgcccuuggcggcgcugaggcccacuacaccuuccuagcccggccugguggcccguccugacgccgcgcccagcuccgccagccggccgaccugcgcagcaaucagagaggagcacacgcgacucagcgccugcccugggcccgcggugcccucccagggagcaagaagaguguccaccucaguagggaccagcucuguucucacuuuccacgccaaggccucacccucccuagcagggaccacaagagguggcaacagcucccuuuauugagcauguacuguaugccaagcccugugccaagugcuguggauguaucaucuccuuucauuuucacagcuacccuaagaugaaaguuagaaccacccccuuuuugaccaggcgcgguggcucaggccuguaaucccagcacuuugggagguagaaucggguagaucaccugaagucaggaguuugagaccagccuggccaacauggugaaaccccaucucuacuaaaaauacaaaaacuuagccgggaguggugguaggcgccuguaaucccagcuacuugggaggcugaggcagaagaauugcuugaaccugggaggaggagguugcagugagccgagguugcaccauugcacuccagccugggcaacaagaaguagacucugucucaaaaaaaaaaaaaaaaaaagaaaagaaaaaaagaaccacccccuuuucauagaugaggaaagucuuucaggagaggucaugcuaacaacaaacaauggagcugauucagggucaggugggucgaagccucuggacagcauccuuagacaucaagcaacauugccuucccugugccuagccuggcauggccucuuugagggugcagccaaaauggccccucaaugaacaaaugaaaaagaugcaacgacgacugcuacucccauucaugaagggacuccacucgcagguaucacaccaacccugguccugacgcuuuuccuuccuuacccuugccucaaagagucuuccucuagccuuucauccuguaucccaccuucucccauugauugagggcuuccugcgcuccaggggcuccaacagucuucacagacaaccaggcauucaguaaccugugcugcugggacuauuuccauuuuuuuuuuuuuuuggagacagagucuuacugucgaggcuggagugcaguggcaugaucucagcucacugcaaccuccaccucccagguucaagugauucuccugccucagccucccgaguagcugggauuacagguaugcaccaccaugccuggcuaauuuuuguauuuuuaguagagucaggguuucaccacguuggccaggcuggucuugaaccccugaccucaggugaucugcccgccucggccucccaaagugcugggauuacagggaugagccacagagccuggccugcugggauuauuucacaccgauuuuuuuuuuaagauacucucuuguucugucauccaggcuagagcgcaguggugcaaucauggcucacugcagccugaaucuccugggcucaagcgauccuccugucucagccuccuggguagcuggagcuccaggcauguguggcaccaugcccagcuaauuuuuuaauuuuuuuuuguagagaugcauuuuugccauauuguccaggcuggucuccaacuccugggcuuaagcgauccacccaccucgaccucccaaaauguuggaauuacaggugugagccacugcacccaacccacgcccauuuuuaacaaaugaagaaacugaggcuugcagagguuagaucauuugcccaaaaucacaugcuggauccagaacuagagcccccagucuuguuauucucaacacuuuuuccuccacacuacagggacuugaucuuaacaccacagacauggcaagcucagagccaaaaaucaauauaugcccuauuuacuuaauccagaguuucucaaccuggcacuaauaacauuuugagcuggauuauucuuuguuugggggugggagggcgcugccccacgcaugguaggaaguugagcagcaucccuggccucuacccauagaugucacuagcacccccucccgcaguucugacaaccaaaaaugucuccagacuuugccaaauguggggguggagggaacugccccaauugagaaccaccaguuuagcccuuccuggaagacaggcucugugcuaaccacuuuuccaggaucaccucauaaaacccucaccacaucaagagaugcuaugaugucuauuuuugcaacuagggaaaaugaggguaggcaaacccagaggcuccaggaaagcagcgaucuugucuguaagcucaccacugcauaccagcaccuagcacaaugccuagcacgagguaaauugcucaauaaauggagguuggucgaauaagauacaaggaagucaagcaauuguccuagauaaguaauuguccuuacauaguacguggucugagucuaacacauauagcucagaguccagacuuaaauuuacucccuuuccucacaauuagugguggucccaugacccaagguccggguaccacucaaacaggaauccugauauccacguuuccucauucuccacagugcugauuccuaggcaauuccucagcucccaguucccacgggcaagcuccuggaguccccacucccgccccuagaccccaguugucgggaauccaaguuccacacccucagcgggugacccggacgggccccucauucagaacggaaaguggacuucggucccgaucccccuucacgggccccgacucccgcugccaagacaggccguggcgcccgcccccacccccacggcuccuuacgaagcuaaguguggagcccggaccgcccuuccucuucggauccccggggccagcggcggcggccgacuggucgggucgcugcggacccgggggcggcuccuccugccgcugccgcugcuccuccuccaucuuccgcuugaacagcuccaggaagcugccgucguuggcgaacaaguucacgccgcccgacaccgggcucgaacccgcgcccgacaccuccucguccccgcucucgggcgacguccccgaucccgacucagcccaacggcucccgccaccgccaccgcccgcggggcccggagccucccggcccugaggcuccgcccgucucccucgggcagccauuuugucgccaggugccgcgcaaaggacuccgggaaggccgcuccggccccgcgcuuggcgcccgacucgccucgucc

SEQ ID NO: 15696 - RNA, 23365 nt, Homo sapiens
aauucucucucuuuggcucccuccuuccgcgcgagucucuggagaagccgcagcgcgaguugccgccgcugcugcccggggccggguaagugggccucacucagagcccgacccucuuggccccggcuugcgucgacccccgccgggcaccgagccugcgccgcgcgcggcccgggcgucggggccgcgcccgaccgggaaaggccgggaagccgguugggcccgauccuccuggcagcuagaacgggccgggcgggggaggggggaaccgagcagagcuuaggggguggggccucggagccaggccaugucggggcuccucaagaagagggccagugggacugcuggggucgggcuggaggggaucugauugggggaagcgucuggggacugcuuggggccugauugggggacgucgcgaggaucggguguguguaggggccuguuucgguggggcuugguugggucugauugggggaggccgcacugaaaaguugagcgggguggggggaggggagcucguuggguccugacagggaggggcgucagacuucggccuagaggguuuucuuggaucugacuucgaggcguugcugggauccguugaggggaaugccccgggggguguuuacccaggccgaacugggggaggcugcaaggaucggaccaggggguuacugacacgaggugguggggggcucggccgaacuugacugggagaggcaacagagauccgucagcagggguuacugcugacagggucggagggaauuucagggagaggcuuggccagaccugauuggggaaggcgacugggaucgguccagggggcuccuauaguggguuggccgggcuuggcuggcucucauucgaagaggcagcagagaccuaccuggggacugcuuugggccugauuaaggggaauccuuagaauuuggcuaggccacagagggggauaucuggcauccacugagcuugaagggcaggaacaggggacaggagagaucaggacgaucgucuugggagggcgcaucuggggaagcucagaaauuggacuagggcaggaggccucugggaucuggcagaaguuaagggcagagugucgggggaaggggacucuucagggacugugccugcauagaagagaccacgggggccggggcgcuaucacggucuggggcggggccccuggauguggaggcggcugggcccucgcccagccgcugcgagggagguggaagccuucgggcucggagccggggucagcggcaugggccacccugggacgagggcucuucgcugggucccaugaggauccgccgggccccgccgccgccgccuguggcccguuuccacauccccccucccgcgcucccgagcccgcgacugcgcggccgaggauggcgcagcuggcggggaccccgcacuugggcgggcguggaucggaggccuccgccuguccgccgagggcguucccgucgucaugcggccaccgcggccucaggggcuccaccugggucucacacggagccccagagacccagcgcugaccccggccccuaccuccgcagcuugccuugcgccauggacuggcagccagacgagcagggccugcagcagguccugcagcugcucaaagacucacagucgcccaacacagccacucagcgcaucgugcaggauguauccuuccuuccuuccggggcugggggagccggguagaugcgugcaguuuccaaaggccagagagagaaagagagggacugacuccccuaguccccagauuuuuucugcugugcggaggaucugcccuggacagagaaggauuacaauuccugggucccauuuccagagcugcggggauuguuauagaaaaugaugaaaauuccuaauguucaucgaacgcuagcaucuacuccauuaacuauuaaaguaggcccuggcccaacgggguggcucaugccuguaaucggagcacuuugguaggccgaagcagguagaucgcuugggcccaggaguuugagaccagccugggcaacauagggagaccccaucucuacaaaaaauacaaaaaauagcuaggugugguggcaugcacauguagucccagcuacuugggaggaugaggugggaggauggcuagagcccaggagguagagguuguggugagcugagauugugccacuguacuccagccacccugggcgacagagccagacccugucucaaagaaaagauauauaggccaggcgcggugguucacgccugcaaucccagcacuuugggaggccgaggcggacggaucaccugaggucaggaguuuugagaccagccuggccaacauggagaaacccugucucuacuaaaaauacaaaaauuaagccaggugugguggcagaagccuguaaucucagcuaauugggaggcugaggcaggagaaucgcuugaaccugggaggcggagguugcagugagcggagaucgugccacugcacuccagccuaagugacagagugagacucugucugaaaauaaauaaauaaauauuuaaaccaugagcaugacucaccccaaaauuuggauucccucuuuuaaaaaaaaaaaaaaagucuucauggccuguuaguggggaucgcugacuaguagcugccacuuuaagaggagugggauucuccuucccucuccugcucuggcugggucuucaggaguggaugggaaacucagacauuuccacccaacuccuuguaugauuuuuuuuuuuuucaagauggagucuugcucugucgcccagacuggaaugcagaggcgcaaucucggcucacugcaaccuucaccugcuggguucaagcgauuccccugcgucagccucccaaguaguugggaauagaggcacgcacacaucaugcccggauaauuuuuuuguauguuuaguagagaugggguuucaccacgcuggccaggcuagucucgaacuccugaccuugugauccacccgccuugaccucccaaaaagugcugggauuacaggcgugagccaccgcgcccggccccuuauaugaauuugacgugucugaggugcucugugucauugugggcuuauuagggagcgggaucccccaggagcuggcagccuggucccaguggucagagauagugucagguacauaaugaggggaccuggcugggggaaggccucugucuuccaagucccuuaacagccuggcagaaacucaaacaacucaaucaguuuccugacuucaacaacuaccugauuuucguccugaccagacucaagucagaagguacgcccucugcucccuuccaugcgaucgggacccugcuuucucccccugggccccugaaccucagccuuccuccucccagaugagccaacgcgcucucucaguggccucauccucaagaacaacgugaaggcacacuaucagagcuucccacccccuguggcagacuucaucaaacaggagugucucaacaacauuggcgaugccuccucgcucauccgagccaccauuggugagaggggcagcggggguuggccucugaggacacacugaacucucacuucucagcauguuaaguguagugcuucauggaaugcucuggcacccucuaugguaguacuauuacuauugccauuugauagaugaggaagcugaggcgcugagcuauuaagggaccugucuggguaagcagcagaagucagaaacagcugaggcagugcagggccacgcucuggaaccacucccuccugaaacaguccuucuuggcucugagacagucaugcaacaucuagaauuuuguguucggccuugggcugagugcuaaggguauagcaguuaaaauaaugcagguauucauguuucaggugcaacggaauuagguuuucagcagagccuuuucugacucuuggaagguggccugaggaaguuacagaaagaugacuaagaauaggcucacgccuguaaucccagcaacuuugggaggucaggguaggcaaaucaccagagguugaguucaauaccagccuggccaacauggugaaaccccgucucuacuuaaaauacaaaaaacuuagcuggccaggcaugguggcucacaccuguaaucccagcauuuugggaggcugaggugggcggaucacaaggucaggaaaucaagaccauccuggccaauguggugaaaccccaucucuacuaaaaauagaaaaaauuagcugggcgugguggcacucgccuguggucccagcuacucgggaggcugaggcaggagaaucacuugaacccaggaguuggagguuacagugaggcgagauggcgccacugcacuccagccuggcaauacaacgagacuccaucucaaaaaaaaaaaaauuagcugggcgugguggugaacaucuauaaucccagcuacucaggaggcugaggcaggagaauugcuugaacccaggaggcagagguugcagugagccgagauugcggcacuacacuccagccugggcaacagagcaagacuccaucucaaaaaaaacuaaauaaaauaaaaacaaaaaaaaugacuucuggcugggugugguaacucacgccuauaguccuagcacuuugggaggccaaggcaggcggaucacuugagaucaggaguuggagacuagccuggccuacauggugaaauuccguuucuacugaaaauacaaaaaauuacuugggaauuacagcuggugggcaccuguaaucccagcuacucgagaggcugaggcaggagaauugcuugagcccgggaggcagagguugcaguaagccaagauaaugccacuguacucuauccugggcaacagacugagauuccaucucaaaaauaaaaaguaacuuuuaguccugcaaaaacccccucccaggccaguaguaggauguggacuuccugagcucauucuaugugccaggcucuuugcuaagucauugaaacuuacugauccaggcugagcacaguggcucacgccucuaaucccagcaccuugggaggcugaggcagguggaucaccugaggucaggaguucgagaccagccuggccaacauggugaaacucuaucucuacuaaaaauacaaaaauuugcugaguguggcagcgggcaccuguaaucccagcugcuucagaggcugaggcaggggaauuaccugaacucgggagguggagguugcagugagccaagauugugccacugcacuccagccuggacuacagagugagacuccaucucaaaaaaaaaaaaaaaaaaaaagagagaaaaagaaaccuacugauaaccuuaguuaggaggcugguuuucuuuaucucuucugagggcuggaagcacugaggcacacagaaugaggggguguggcuaaaguuccacaauccucacuguguaccuacccauugcagggagcaccuuucucucguugaguuuccacccuugggaaacacugccaucucauggcagcaaauaccaucucugcacuuaacagaacccauauccagcucugucaccagauaugugcacuguccuggcaccucagaugccugcuguauguaacuccuggauaucuaauaggcaguacaagcaucccugccaccuuccugcccuuaccuccuuucccucucucaucaugccuguccuuacgccaggccuuugcaccauagaguccccugccucagaugcccuuuccccagaaaccuggaugauuccucccucgccuccuucaccuccuucaggccuuggcucagauaucaagaugucaccucaacgaggccugcucuggccacccaauuuaaaguugcuaccuucaccuacagcccuuucucaccaucuuuucugcuguauuuccccccuuaguccuuggcauguggccccucccaguuguuuguuuuuguuuuguuuguuuuugaaauggagucuugcuccaucccaggcuggagugcuguggcgcgaucucugcucacugcaaccucugccucccagguucaagugauucuccugccucggccucccaaguagcugggauuacuggugccccccaccacacccagcuaauuuuuguauuuuuaguagagaugggguuucaccauguuggccaggcugguuucgaacuccugaccucaagugauccacccaccucggucccccaaagugcugggauuacaggcaugagccacccaugcacggccccucccaguuuuuuuugcuaauuuaucuuuacuucauagcuugcuuccagcucccaagggugaggauuuuguguuuugcucugugcugugccucagggccuggaacagaguugacucacaguaaggcucagggugccuacugagucaaggaguacccuucuaccuaugucaaggccaggagcgguggcucacgccuguaaucucagugcuuuuggaggccaaggcaggaggauugcuugaggccaggaguuuuaggccagccugggcaacauagugagaucccaucucuacaaacaauuuuaaaaauuaguugggcgugguggcaugugccugcagucccagcuacuuaggaggcugaggcaggaagauggcuugaggccaggaguuugaggcugcuguggacuauugauugugccacagcaguccagccugggcaacagagcuaauucuaucucuuacaaagaaaaaaaaaaggaggggggauguagagggcguacaugggcuagggaacagaaaggcagcacuggggguguccagugggagggggaggugcuaggcagccccugcccagccucaggcagcguccuuucccggccgccccaggcauucucaucaccaccaucgcuuccaagggugagcugcagauguggcccgagcugcugccccagcucugcaaccugcuuaacucggaggauuacaacacuugugagguaggcaagaagccauggauggccagagcgaguacuggggggcugggaccaccacccaccacccacguuugucucucugccccucugcacucagggagccuuuggagcccugcagaagaucugugaagacucaucagagcuucuggacagugacgcccucaacaggccccucaacaucaugauccccaaguuccugcaguucuucaagcacugcagucccaagauccggugggugcagcucccugggggcuuccagggagccuggagugggcagggucagggugacccacgugucugcuccccgccaggucccacgccaucgccugcgugaaccaguucaucauggaccgggcccaggcgcugauggacaauauugacaccuucaucgaggugggccgcugggcugggggugggcagggcgaggacugagggccccuacaacugacccuguuccucccugcagcaccuauuugcccuggcuguggaugaugaccccgaggugcggaagaaugugugccgugcccuggugaugcuucuggaagugcggauugacaggcucaucccccacaugcacagcaucauccaggugugcauggucaaggccagcccaggcgggcaggcagggggccgguggcaggggucagggagccacccccagccaggccaggccucagcuucuccccccuaccacaguacaugcugcagaggacccaggaccaugaugagaacguugcccuugaggccugugaguucuggcugacgcuggccgagcagcccaucugcaaggaaguccuggccucccaucugguccagugagugcugcugcugcccacuguccuaccccagcuucgaccccuugcuaugccucugccuucccuucuggucaccugcugugcuucucucaguccacauccuugucaguuuacauucaguauauauuuauguguaagugguaagaaugccacuuuuugaagacuucaaaauuagguaacugauagguggaaagaaaugaaaaaucaauggccacaugugguggcugacaccuguaauccuagcacuuugggaggccgaggcgggcagaucacaaggucagaagaucgagaccagccuggcuaacacggugaaaccccauuucuacuaaaaauauaaaaaaauagcugggcgugguggcaggcgccuguagucccagcugcuugggagggugaggcaggagaauugcuugaacccaggaggcugagguuguagugagccaaggucgugccacugcacuccagccugggugacagagcaaaacuccgucucaaaaaaaaaaaaaaaagaaaugaaaaaucaacaaaggcuucagggguauggcuguauccaggagcucaaaggaugugaaaggcaucuuuguggucucagaucugcuucccuuguguuggcuucauucuuaggcacaaccuucccucuggguagugcuguagccuucugugcccuuccagcuuaggaacuucagaguaaagaaauuuucgaccaguguuuccaacaaaaguccuaaaacugacccuccuugacaaacuuggauugcuugccucucuccaaaucauuuuuuucuuuuuuauuuugagacaagguuuugcucugucauccacgcuggaguggagugucaaaaucauggcucacugcagccuugaccucccagcugaagcaauccuccuaccucagccucccaaguagcugggauuacaggcacaucccaccacaccuagcuaaucuuuucuaaguuuuaguagagaugaggucuugcuaaguugcucuggcuggucucggaucccuggccucaagcaguccuccugucuuggucuccuaaaguguugagauuacaggugcgagccacuguacccagcccccagaucauuauuauuauuauuuugaaauuucuguuuuugagacggagucucacucugcugcccaggcuggagggcaguggcacaaucucggcucacugcaaccuccgccccucggguucaagcgauucucuugccucagcuuccugaccuuguguucugcccacuuuggccucccaaagugcuaggauuacaggcgugagucaccacgcccagcauauuguauguuuauuuauuuauuuauuuauuuauuuauuuauuuaucauucauuagaggugaggucucacuauauugucccaauuggucucaaacuuaugggcucaggcaauccuccugcauuggucucccaaagugcuauaaugacaggugugagccccugugcccggccccaaauuauugauaacagucuagggcugggcagacggcuccuggggagugaugagaccuagaugagcaggugaugaaggcucugucacuuacaacucugggcugcagcugaggggcuggcugccuagucuguuugcuccccuacucuggcuagucucugcccuaucucaggaaaguggccaggaauaggaccgcaugucccugccuuaauguugugcuagggaccaggcacuguaccaagauuuucaguguauucaggggucuauaauccacugaguggccaggccugggucaagagcuuuccugcaggcugagugccauggcucacgccuauaauccuagcacuuugggaggcugaggcaggaggauugcaugagcccaggagcaugaggcuguggugagcugugaucgcaccagugcacuccagccugggugauaggguuacguagggaccagccccacagggucggugggucucuuccugugugcggcgaugagagaguguagaaauaaagacacaagacaaagagauaauagaaaaggcagcugggcccgggggaccacuaccaccaaugcgcggagaccgguagugaccccaaaugucuggcugcgcuguuauuuauugcauacaaggcagaaggggcaggguaaagaaugugagucaccuccaaugauagguaaggucacaugggucacguguccacuggacagggggcccuucccugccuggcagccgaggcagagagggagaguagacaaagagaaagacagcguaugccauuauuucugcauaucagggacuauuaguauuuucacuaauuuacuacugcuaucuggaaggcagagccagguguacaggauggaacaugaaggcagacuaggagugugaccacugaagcacagcaucucagggagacgguuaggccuccggauaacugcgggcaaaccugacugaugucaggcccuccacaagagguggaggagcagagucuucucuaaacucccccggggaaagggagacucccccacuuuccuggucugcuaaguagcggguguuguuccuugacaccuuuugcuaccgcuggaccaugauccgccugguaacgggcgucuucccagaugcuggcgucaccgcuagaccaaggagcccucugguggcccuguccgggcauaacagaaggcucgcacucuugucuucuggucacaccucacuauguccccucagcuccuaucucuguauggccugguuuuuccuaggcuaugauuauagagcgaggauuaucauaauauuggaauaaaaaguaauugcuacaaacuaaugauuaaugauauucauauauaaucauaucuaagaucuauaucugguauaacuauucuuguuuuauauuuuauuauacuggaacagcucguguccucugucucuugccucggugccuggguggcuugccgcccacaggguuagacccugcuucuuaagaaaaaaaaaaaaaaaccuuucucuggaggcaggagugguaucauuuauauccuaaucauagcggcagagacuagauuccgauaauuccccagagggaaauggaucaauuugcaccuagcaguaccaucaugcucugcagggucugcucuguggcugauuggggggcuggucacucuguuggcaccuguuugccuccuccccaagcugugccuccccccaacuuuugccacggccccugcauccccauaaacagucccucucugugcagguugauccccaucuuggugaaugggaugaaguacucggaaauugacaucauccugcucaaggucaggcagggcccacccagcaugggugggcaugggcgugggugucgcggcugugguccccaaaguacuuaacagucugccugucccccagggggauguggaggaggaugaggcuguccccgacagugagcaggacaucaagccacgcuuccacaagucacgcacggucacacugccccacgaggcugagcggccugauggcuccgaggacgcggaggaugacgaugaugaugaugcucuguccgacuggaauuugagugugugccccugccugggggugguggugggguggcaagcccuggacucccucuugggaggugacuagaagcugaggcagaagcugauuagaagcugaucguggccgggcgcaguggcuuacgccuguaaucccagcacuuuggaaggcugaggcgggcggaucacgaggucaggagaucaacaccauccuggcuaacacagugaaaccccgucucuacuaaaaauacaaaaaauuagucgggcguggugucgggcgccuguagucccagcuacucgggaggcugaggcaggaaaacggcaugaacccaggaggcggagcuugcagugagccgagauagcgccacugcacuccggccugggcggaaaaagugagacuccgucucaaaaaaacaaaacaaaaaaaaagaagcugaucgugaagauucugagcaugaucucugauccugggagugcagucaaggagggucggccaccugccugaggggccgcccugagccuccccauuguucccccuuccccagggaagugcucagcggcugcacuggacguccucgccaaugucuuccgggaggaacugcugccccaccuacucccacuacucaaaggccuccucuuccaccccgaguggguggucaaggagucgggcauccuggugcugggcgccauugcugagggugagugcgccugaucucugagcccugugcuggcaugagacuguagggcuggcccacauuacuagccacaccaaugccucaguucucccuggaggccuacucaccccacuccaaacagcucugagaucucaauucuccccuugguuccugggccugaaaggaaccccuggagccccacagugcaaggccucuuguucauucuugcaggcagguaguucuuucauguuguaagcauaauuacagcaacaaugauaauaacagcaggcacagcugcaugcuugccucgugcacuuauguagacaaacauccuuggcccucaccaccaccugaugagcugggugccggaucccaguuucgaagauggggaaacugagguacagaaagauugaugccacuuccuuacagucacucagggugugucugggccuuaaaccuguuccuggcugccgggcuggccugccagagucaguaguaacccgugguaggugguguuucaucaaauucaaccugguguucuguaaucggugggguuuucaggcucccauggucccggugggacauaaaacuuguuacaggagggcuuugugaguccguuggaggcaucauauaccauugccucagcauccagaccugugccaaaaauuucaggcauggcagcaaaaacccucaaccuuguaagcuuucaaaauuugucuaaaauuugucuaguuacuguggugcacgccuguaaucccagcuacucaggaggcugaagcaggacaacugcuuuagcccaggaguccgagaccagccugggcaacauagggaaacccucuuucuacaaaaaauuuuuuaaaaaggccaggugugguggcucaugccuguaauccuagcacuuugggaggcugaggcaggcagaucguuugagcccagguguucaagaccagccugggcaauauagugagaccucauaucuaccaaaaaaaaaaaaaaaaaaaaccugauaaaauuagccggcguggugguaagugccuauagucccaacuaacugggaggcugaggugagaggucaaggcugcagugagccaugauugcgccacugcguuccagcauggagaacagacugagacccugucucaaaaaaaaauugucuaaagaaauguuucgacauguaauauguguuuaauguaucucauaucucauguuaauaggguauauaucacacaauacgcuuacauauguuaauagauuacauaagcuguguuauuuauuuauuuauuugagacugagucuugcuuucucgccaggcuggggugcaguggcaugaucuuggcucacugcaaccuccgccuuccagguucaagugauucuccugccucagccuccugaguagcugggacuacaggugcaugccaccacgcccagcuaauuuuuuuguauuuuuaguagagacaggguuucaccacguuggccaggauggucucuaucuccugaccucaugaucugccugccuuggccucccaaagugcugggauuacgggugugagccaccuugcccagccagccaccacgccuggccucuuuuuuuuuucuuuuuuuuuugagauggagucucccucuuaucgcccaggcuggagugcaguggugugaucuuggcucacugcaacaacauucugccucccggguucaagcaauucuccugccucagccuccagaguagcuugggauugcaggaauucaccaccaggccuggcuaauuucuuuuuuuuugagacggaguuuugcucuuacuguccaggcuggagugcaauggcgcaaucuugacucacugcaaccucugccucccgaguuccagagauucuccugccucagccucccaaguaguuggaauuacagguguccaccaccgcaccuggcugauuuuuguauuuuuagcagagacgggguuucuuucacuguguuggucaagcugguuucgaacuccugaccucaggugauccaucugccucagcuucccagagugcugggauuacaggcgugagccaccgcacccggccuguauuacauguuuaugguaaaaagaucuauaggaguugagcucaaacugguaaacauagaucuugugucuuggauuauuggcaaugugcuauuaucuuuguucucuuuaaauaaaagagcagaguucgugauauuuuaaaaaaaaaaaaaaacccugggugugguggcuuaagccuguaaucccagcacucugggaggccaaggcggguggaucaccugaugccagggguucaagaccagcauggccaacauggcaaaaccccaucucugcuaaaaauacaaaaauuagccaggugugguggugcauaccuguaguccuagcuauugggaggcugaggcacgacaaucacuugaaccugggaggcagagguugcagugaguggagaucacaccacugcacuccuccuugggggacagagcgagacucugucucaaagaaaacauuaaaaaauuguuaaaaauggcugggcacaguggcucacgccuguaaucccagcacuuugggaggccgaggcgguugaaucaacugaggucaggaguucgagaccagccuggcuaacacggugaaacuucgucucugcuaaaaauaugaaaaauuagccacacgugguggcccacgccuguagucccagcuacuggggagguugaggcaggaaaauugcuugaaucagggaggcggagguugcagugagccaagauugugcaacuguacuucagcuugggcaacagagcaagacuccgucucaaaaaaauaauaauaauaaauuaaaaaauuaaacaaaaauaaggagaaauagaacaaucauaaacggccagacaccuauaaucgcagcacucugggaggcugaggugggaucacgugaggucgggauuuuaagaccagucuagccaacaugguaaaaccccgucucuacuaaaaauauaaaaauuaguuggguaugguggcgggcgccugcagucccagcuacuugggaggcuuaggcaggaaaucacuugaacccgggaggcagaggcugcagugagcccagaucacaccacugcacucuagccugggcaacagagcaagacuccaucucaaaaaaaaaaaaaaaaaaaaaaaaaaaagaaaacucacaaacaucuuaagaacuguuucaaaugcaaagugcuuuuauuccauuugggucacugcugccccauaaaaccccacucacuauguaacggagccaauuuugaauuaacacaugaauucaauuaacacaugaauuaaugcaugaauugaauuaacgcaauaacacggagcucuuuggcugggcgcgguggcucacgccuguaaucccagcacuuugggaggccagggcggguggaucacgaggucaggagacugagaccaucuuggucaacaugguaaaacccugucucuacugaaaauauaaaaaauuccccgggcauuguggcagaggccuguaaucccagcuacuugggaggcugaggcaggagaauuguuugaaccaggaggugaagguugcggugagccaugaucguaccacugcgccccagccugggcgacagagcgagacucugccucaaaaaaaaauaaagauaacccggggcuuugggaugagaggcuucuguuguuuccccuccugugccugccuuuaccuggcucugugaaaugagucugggccagugauuuaaacucuaagccucaguuucccuauauguugugugcggcugacucuucucuccauacgguggguguggcugggcccaaucaaacugcccccucuugguucccuuuccuuguaggcugcaugcagggcauggugcccuaccugccugagcugaucccgcaccugauccagugccugucggauaagaaggccuugguccgcuccaucgccugcuggacgcugagccgcuaugcccacuggguggucagccagccacccgacaugcaccucaagccccugaugacagagcugcucaaacgcauccuggauggcaacaagaggguacaggaggcggccugcaggugacccuggaccccugaucccacagcccccacucucccccggccacccucugggaagugaugacaccugugacuguugauguggaacugauuuaucgcguauucguacuggcugauccugaguugcccuccccaacugcccauggcccagugucaccugccaugguccacugagcccccgcuucauccucccucccaccagugcuuuugccacccuggaggaagaggccugcacggagcuggugcccuaccucagcuacauccuggacacccuugucuuugccuuugggaaauaccagcacaagaaccugcucauccucuaugacgccauuggcacccuggccgacucuguaggccaccaccucaaccagccggugagaccccagagcggcucccgccucccgauccccgugccccugggcauccagugaccugguggcaaccccguguugcacgccagggacguggccgugaccucgacaggcagacagacagacccggccccgcccucgcccugcucccagucuagugggggagaaagacaguuaugagacagcgugguaagugcugugcuucgggaaccaggaggugguaacccaggcucccggggggugggguggggcgggcggugcuuggacaggugagaagaaugaaggccucgaggucuggccagauggcaggccuuucagggucccaugagccacggugaggcgcucaggccucaucacucgggcaacagguaccugagucacagucugccaccccgacccagggagcgcccauuucgugcucccucuccaggaauacauccagaagcugaugcccccacugauccagaaguggaaugagcucaaggacgaagacaaggaccucuucccccugcuggaggugagugggcuccugccccucacccgaaacccauccugcccacccugccugaguucuccccaccugccuuccucccugccagugucugucaucgguggccaccgcccugcagaguggcuuccugccuuacugugagcccgucuaccagcgcugugucacccuggugcagaagacacuggcucaggccauggugagcaacccuaggcccgucaccugugcuucugcauuggccugccucgggccugcuccacuuacccgugccccugucggcaucugugucuagauguacacccagcacccugagcaguaugaggcucccgacaaggacuucaugaucguagcacuggaucugcucagcggccuggccgagggccuggguggucacguggagcagcugguggcccgcagcaacaucaugacauugcuguuccagugcaugcagguggguggggacccuggacagugaugacacccagcagccugcgugggcugccccugguggggagucagggccugguugugcccaaaggaaaucagggaaaaggugcuguucuaauuauuuuaaagaguaauccuggaggccgaggcaggauugcuugagcccaggaguuugagaccagccugggcaacauagugaaaccccaguucuaaaauuaaaaaaaaaaauuuuuuuuaaagcaaacaguauugaaaauagaaaaugugaggccaggugcucacgccuauaauccagcacuuugggaggcuguggcaggugaaucacuugaggucaggaguuugagagcagcuuggccaacacggugaaauccugucucuacgaaaaauacaaaaauuagccaggcauggugguaggcgccuguaaucccagcuacuuggaaggcugaggcaggagaauugcuugaacccaggaggcagagguugcagugagcugagaucaugccacugcacuccagccugggcaauaaacugagacucugucuucaaaaaaaaagaaagaaaagaaaauagaaaaugugaaagcccaagucccugccccagcacaguuggcucucuguaucuguggguucuacaucccaagauucaaguaaccucagauugaaaauacucagaggaaaaauuacaucuguacugaacgcauacagaaguuuguucuuguuauuauucccuaaacaauacaguauaacaacuauucccauacuguugacauuguauuagauauaagugauuuagagaugaugcuaaguguacaggagaaugugcauaggugcauaugcaaacacuaugccccccccaccgccccccaccuguuuuuugagacagagucucacucugucacccaggcuggagugcaauggugugaucucggcucacugcaaccuucaccuccaggguucaagcaguucuccugccuuagccucucaagaagcugggacuacaggcgugucccacuaugccuggcuaauuuuauuguauuuuuaguaaagacaggguuuugccauguuggccaggcuggucucaaacuccugaccucaagugaucugccugccucggccugccaaagugcuggagauuacaggcaugaaccacugcgccuggcccuaacacugugccacuuuauaucaaggacuugcacauccguggauuuuuauaucugcagggaccuggaaagaaucccccacggacacugagggaugaccguuggggcacugccaucucccauuugcagaugugggcuggaggcuagggagguuaaggaacagcuaggagcucuagaacuggaaaguggcagaggcuggacaugcaccagggacugugcccccugagcuguccugguuagaaggaggggagccuagccacacugaucuuacuugaauccccaggacucgaugccugagguccggcagagcuccuuugcccuccugggagaccucaccaaagccugcuucauccaugucaagcccuguaucgguacgacacucgccuugucccuaacccaugaccccagccccggccucaagugauggagagcaauacccggggaugacugugaccacauugggauguauucguacugucugauggggccugcuggacuagguccugcagcuuacccuggcuggcccuccuucucagcaccccuguuucuccccaccagccgaguucaugcccauucugggcaccaaccugaacccagaguucaucuccgucugcaacaacgccaccugggccauuggugaaaucugcaugcagaugggugagugcccugcaaguggcaacacgcgccccccauuagccuguucucaaccugggggcgggagccuagcucugacugacagcuuccuucaaggcaagucucuugggggucgucagggguggagccaagcagaaaggucauuugugauuggcuucucuaaagaggagggauaggagggcuguucugauuggaccguuuuguguaguuggcuaaaagacucauucggauugguugggugacuuuggcuuuuuuuuuccuuugacuugggcagcguguugucaccuuagcgacuccagagaagccucuguuguuuggagggugugggucugucccugguuggccagggauucuggguggggauuagccggagaaggucuuuuguuuccucacugguagugguuggccagucucuaguuggaacuggggcgaguagugagugagguggggcggcccccuggccccuguggguggcgggggcugugcagggcucugacugggugcucccccaggggcagagaugcagccuuaugugcagaugguccucaacaaccugguggaaaucauuaaccgacccaacacacccaagacacugcuggaaaacacaggugggcaccuggcccggcugcugccugcaccccugccugccuucuggaggugggguucugggcugggaagggcaucagaaagagccuugucaaggaaccaaggagggugucuggaaguaccuggaaggggucacugggagaagccccaagaaagaugcagccucaggcugggugcaguggcucaugccuguaaucucagcacuuugggaggcagaucaccugaagucaggaguucgagaccagccuggccaacauggugaaaccccaucucuacuaaaaaauacaaaaauuagccggggguaauggcacgugccugcaaucccagcuacucgggaggcugaggcagguugcaaugagccaagaucaugccacugcacuccagccugggcaacagagcaagacuccaucucaaaaacaaaacaaaacaaaaaaaaacaaaaaggaaagggaaaggaaagaaagaaagauagaugcagagagaccugggaagugacucaggugugaugaggaggaccccuggcugggccaagcuugggggaccaggguggcugcaguagccauucccuuggggcucauggggcggggcuuggugccuugugccagaggccccgccacguaccgucccggggccgcucgggguugcaggucgccugacgagucccucugccauuccagccaucaccaucggccgcuugggcuacgugugcccccaggagguggcacccaugcugcagcaguucauccggccuugguguguguccacgugucaagccugcuguguggugggcgggacuggcccaacccccucccucgccugugcauuuccagccccaucugccuacugacucccugcccugccccacccccacagaugcaugucccaggcccacucacugauccccagugacccagcccuccacagaugcaugcccagccugcccucugaccuccagcugcucaccuucccacaggugcacgucccucaggaacaucagggacaacgaggagaaggacucagccuuccgcggcaucugcaugaugaucggugucaacccggggggcguugugcagguuggggcagcugggcucugagggcaggcgcgggcgcugggcucgggcggccccucaccugggauccgucacguuucaggacuuuauuuucuucugcgaugcuguagccuccugggugagcccgaaggaugaccuucgggacauguuuuauaaggugaggcucugucugggcccugaucuaguuccgggagcaggcaggggugagaccaucugguaacaauggggccuggggaugggggaagaggcgcacuccccuuguucugccccugccuaccccucaccaccacccuccccacagauucuccacggcuucaaagaccaaguuggggaagauaacuggcagcaguucucugagcaauucccgccgcugcucaaggagaggcuggcggcuuucuauggggucuaggugaucauggagacugccagguaaggagacugcagcuggcaagucagcacugucuugggggccgaaaggucccaggccaugaccuuccuccucccccugcagguuucugucugcgucgucgucggagggauuacuggggagugcgcugcauccggaagucgcugugcccugguugagggggguuagggaggagugagugggacucaaauccagaugccuuccccguccguccguccguccguccauccguccacuugcccuccuggcagguggguggggccaccaugcucauccuacaaacggggaggugggggggacuucuggugggcaagggccccugggcucuaauagggucaucucuggcagcccacuugggccagcuacgugggagggaggaauuacacagcugaccgaauccggcuucggaugaggugagggaggagcaggucaggaggggggcccucguagggacgcguacacucacacggacacacauggccacacgcaugugcgggugccauaaccggcgaggcugggccagccgcuccaccauuuccccgacugcauggagacaguagaauuagugaaccccugaguuaacccguaaggccuuccguguaaccugcaucuagaguuuaagaagcuucugcuguuuugccggaauuggcggugacuggggagggcuggguggguggggggccucaggcgggaucucggggcggggggaggaggauggugaccuugggagucgcccugucagcacgcacaugcuugggacccacuccacacacucccugccagcuuuguugcagccucagcugguggugucuccguccuuauccuagccuagcucgcagggugagaaccacuggaguggcuggggcuggccagaggucaccguuucuccuuccugugugcuccaguggcuuuugaagacacuggguugggaccuuuuuccugaagagagcuggguguagccagagcuacuggcaccuaccccgagcaucucucucuguaagcagcuucaggggcaguccguuucucugugcuucugaaacccccuucucacguuucaggccccaguuuuaacucaaggccuggggcaggggcguuuaauugaugaugacagaggacacagguuuuugccagcaaaaaggaaaaccaaggcuugguggaagggaaaggugguguguccccuguucccuauuccaucucccugggacuuccugcucaucauaguacccagugagcccagagauccuacuagacugggucagcaauucuagagaaccuuccggaauagucugggaacauggucaagguggaaggggcuccccuagagaggguggggguguaguuacuucccaguuggccagaaaacugggccuugcagacccccuuagcauuuuuucccuuuuuuuccuucccugcuuucuacuucuuuggggagccccuuguguuuuggagucugacuggagucucgcauccuggggccugcuccauccaucccuccugggcgccagacccuccauccaagcccugugucuuuccauagucagggucaggcccugcaucuauuccaaggggcacucaguacacauuccauaaauuagcugggugucccugcacgcccaccccaugaaacucgagcaggucucuggaagccauuuguuaaaaaaaaaaaaaaaaguuuuaaaaauaccuuuuaauuuucugguaauuccaguucuuugaagcauccucugcugggucuugggguguguggauggauuggcugucugaugggauugguaaccccucgcuacucaagauggggggauacaaacaccuucagggaaggggagccugguucuucucguuuuccuuuuuuuuuuuuuuuuuaaaaaaaaacuauuuaauuuuuuaauuuauuuuugguuguuuuuugcacaaugaaguuucagcuucucaaccuucuccccuacccagggcuguggacccagacuggccuugagccacagucccucuuucccuccucacccucuucccccugcgggcucccgggucuguccauuuguuacugugcugugcuggggauuggcgccgagguggcgugagauuccacuuguguagaacuuuguugaguaaagaucaguuucuugugaacucc

SEQ ID NO: 15697 - RNA, 7652 nt, Homo sapiens
guggcagaggcuggacaugcaccagggacugugcccccugagcuguccugguuagaaggaggggagccuagccacacugaucuuacuugaauccccaggacucgaugccugagguccggcagagcuccuuugcccuccugggagaccucaccaaagccugcuucauccaugucaagcccuguaucgguacgacacucgccuugucccuaacccaugaccccagccccggccucaagugauggagagcaauacccggggaugacugugaccacauugggauguauucguacugucugauggggccugcuggacuagguccugcagcuuacccuggcuggcccuccuucucagcaccccuguuucuccccaccagccgaguucaugcccauucugggcaccaaccugaacccagaguucaucuccgucugcaacaacgccaccugggccauuggugaaaucugcaugcagaugggugagugcccugcaaguggcaacacgcgccccccauuagccuguucucaaccugggggcgggagccuagcucugacugacagcuuccuucaaggcaagucucuugggggucgucagggguggagccaagcagaaaggucauuugugauuggcuucucuaaagaggagggauaggagggcuguucugauuggaccguuuuguguaguuggcuaaaagacucauucggauugguugggugacuuuggcuuuuuuuuuccuuugacuugggcagcguguugucaccuuagcgacuccagagaagccucuguuguuuggagggugugggucugucccugguuggccagggauucuggguggggauuagccggagaaggucuuuuguuuccucacugguagugguuggccagucucuaguuggaacuggggcgaguagugagugagguggggcggcccccuggccccuguggguggcgggggcugugcagggcucugacugggugcucccccaggggcagagaugcagccuuaugugcagaugguccucaacaaccugguggaaaucauuaaccgacccaacacacccaagacacugcuggaaaacacaggugggcaccuggcccggcugcugccugcaccccugccugccuucuggaggugggguucugggcugggaagggcaucagaaagagccuugucaaggaaccaaggagggugucuggaaguaccuggaaggggucacugggagaagccccaagaaagaugcagccucaggcugggugcaguggcucaugccuguaaucucagcacuuugggaggcagaucaccugaagucaggaguucgagaccagccuggccaacauggugaaaccccaucucuacuaaaaaauacaaaaauuagccggggguaauggcacgugccugcaaucccagcuacucgggaggcugaggcagguugcaaugagccaagaucaugccacugcacuccagccugggcaacagagcaagacuccaucucaaaaacaaaacaaaacaaaaaaaaacaaaaaggaaagggaaaggaaagaaagaaagauagaugcagagagaccugggaagugacucaggugugaugaggaggaccccuggcugggccaagcuugggggaccaggguggcugcaguagccauucccuuggggcucauggggcggggcuuggugccuugugccagaggccccgccacguaccgucccggggccgcucgggguugcaggucgccugacgagucccucugccauuccagccaucaccaucggccgcuugggcuacgugugcccccaggagguggcacccaugcugcagcaguucauccggccuugguguguguccacgugucaagccugcuguguggugggcgggacuggcccaacccccucccucgccugugcauuuccagccccaucugccuacugacucccugcccugccccacccccacagaugcaugucccaggcccacucacugauccccagugacccagcccuccacagaugcaugcccagccugcccucugaccuccagcugcucaccuucccacaggugcacgucccucaggaacaucagggacaacgaggagaaggacucagccuuccgcggcaucugcaugaugaucggugucaacccggggggcguugugcagguuggggcagcugggcucugagggcaggcgcgggcgcugggcucgggcggccccucaccugggauccgucacguuucaggacuuuauuuucuucugcgaugcuguagccuccugggugagcccgaaggaugaccuucgggacauguuuuauaaggugaggcucugucugggcccugaucuaguuccgggagcaggcaggggugagaccaucugguaacaauggggccuggggaugggggaagaggcgcacuccccuuguucugccccugccuaccccucaccaccacccuccccacagauucuccacggcuucaaagaccaaguuggggaagauaacuggcagcaguucucugagcaauucccgccgcugcucaaggagaggcuggcggcuuucuauggggucuaggugaucauggagacugccagguaaggagacugcagcuggcaagucagcacugucuugggggccgaaaggucccaggccaugaccuuccuccucccccugcagguuucugucugcgucgucgucggagggauuacuggggagugcgcugcauccggaagucgcugugcccugguugagggggguuagggaggagugagugggacucaaauccagaugccuuccccguccguccguccguccguccauccguccacuugcccuccuggcagguggguggggccaccaugcucauccuacaaacggggaggugggggggacuucuggugggcaagggccccugggcucuaauagggucaucucuggcagcccacuugggccagcuacgugggagggaggaauuacacagcugaccgaauccggcuucggaugaggugagggaggagcaggucaggaggggggcccucguagggacgcguacacucacacggacacacauggccacacgcaugugcgggugccauaaccggcgaggcugggccagccgcuccaccauuuccccgacugcauggagacaguagaauuagugaaccccugaguuaacccguaaggccuuccguguaaccugcaucuagaguuuaagaagcuucugcuguuuugccggaauuggcggugacuggggagggcuggguggguggggggccucaggcgggaucucggggcggggggaggaggauggugaccuugggagucgcccugucagcacgcacaugcuugggacccacuccacacacucccugccagcuuuguugcagccucagcugguggugucuccguccuuauccuagccuagcucgcagggugagaaccacuggaguggcuggggcuggccagaggucaccguuucuccuuccugugugcuccaguggcuuuugaagacacuggguugggaccuuuuuccugaagagagcuggguguagccagagcuacuggcaccuaccccgagcaucucucucuguaagcagcuucaggggcaguccguuucucugugcuucugaaacccccuucucacguuucaggccccaguuuuaacucaaggccuggggcaggggcguuuaauugaugaugacagaggacacagguuuuugccagcaaaaaggaaaaccaaggcuugguggaagggaaaggugguguguccccuguucccuauuccaucucccugggacuuccugcucaucauaguacccagugagcccagagauccuacuagacugggucagcaauucuagagaaccuuccggaauagucugggaacauggucaagguggaaggggcuccccuagagaggguggggguguaguuacuucccaguuggccagaaaacugggccuugcagacccccuuagcauuuuuucccuuuuuuuccuucccugcuuucuacuucuuuggggagccccuuguguuuuggagucugacuggagucucgcauccuggggccugcuccauccaucccuccugggcgccagacccuccauccaagcccugugucuuuccauagucagggucaggcccugcaucuauuccaaggggcacucaguacacauuccauaaauuagcugggugucccugcacgcccaccccaugaaacucgagcaggucucuggaagccauuuguuaaaaaaaaaaaaaaaaguuuuaaaaauaccuuuuaauuuucugguaauuccaguucuuugaagcauccucugcugggucuugggguguguggauggauuggcugucugaugggauugguaaccccucgcuacucaagauggggggauacaaacaccuucagggaaggggagccugguucuucucguuuuccuuuuuuuuuuuuuuuuuaaaaaaaaacuauuuaauuuuuuaauuuauuuuugguuguuuuuugcacaaugaaguuucagcuucucaaccuucuccccuacccagggcuguggacccagacuggccuugagccacagucccucuuucccuccucacccucuucccccugcgggcucccgggucuguccauuuguuacugugcugugcuggggauuggcgccgagguggcgugagauuccacuuguguagaacuuuguugaguaaagaucaguuucuugugaacuccuuagucuguggcuuccuguguccuuggcuuugguagugaagaaaugucgggggcaccggggauacuugagagugggaagauagacgaaugugaaagauggaagauuaaauuuguaacauauaugaaaugugcagcucauucucugggacuucagcucacuaagggugagccauuagugucacagcccagguucaagaugccccucugccguacucuaaacugagugguaaggggugaggccuugccgcacucuuaucaucagcugacccugggucaagguuuucauagaagguucagcccagccccaggccgaggguaauuuaauuaauauuaguuacaauuacucaggcaaaugagaaguaguuucagcuguggggggaaaccacaaucuucagaauaaaaucuuucuuuuuuuugagaccgggucuugcuccgucacccaggcuggagugcaguggcgcaaucauggcucagugcaaccucaaccucccuggcucaaccaguccucccaccucagccacccaaguagcugggacuacaggugcaugccaccaugcuggcuaauuuuuguauuuuuuguagaggggguuuucgcuauguugcugaggcuggucuugaacuccugggcucaagcaauccaccuacuuuagccucccaaagugcugggauuacaggugugggccaccgcccccagccaaaauaaaaucuuacugcaaccuugguguggcccaaagaccaacgugggaaaauuuaaaaauacugacacacauccaauauucaacaaauaaguccugcauucuagugagaggauagaguauaaaaaguggaacugugcuaaguccuauagagaaaaacaggaaggcagagagaauggugggggaaacgguugaaaucuuauguagggugaccugcaaaggccacacugagaagacgauguuugaacagagccauggagagaagagugucaaguagagcaaacagcaaggacugcgcagaugaccuacguggauugguuagcugccuggcucaaaagaggcuugcaguaaauaccugcaguuuuuuuguuugagacggaguuuugcucuuguugcccaagcuggagugcaaugaugccaucucggcucacugcaaccuccgccucccaggcucaagugauucuccugccucagccucugagcagcugagauuacaggugccugccaccacacccggccaauucuuuguauuuuuaguaggaagggguuucaccuuguuggccaggcuggucuugaacuccugaccucaagugauuaacccaccuugccucucgaaguggugggauuacaggccugagccaccgcacccggccaacaugcuguuuuaguaagugugauguuaggccgggcgcaguggcucacgccugucaucccaucacuucgggaggcugaggcgggcggaucacgaggucaggaguuugagaccagccuggccaacauagugcgaccccgucucuacugaaaaauacaaaaauuagccaggagugguggcgcgugccuguauucccagcuacucuagaggcugaggcaggagaaucgcuugaacccgggaggcggagguugcagccagccgagaucgcgccacugcacaccagccugggugacagagugagacuccgucucagaaaaaagaaaaagguagcuuuccaccaggcgcgaugguucacgccuguaauccugguacuuugggagaccaaguugggggcggauggcuugagcucaggaguuccagaccagccuggacaacguagugaaacccugucuuuacaaaagaauacaaaaauuagccgggugugguggugcgcgccuguagucccagcuaccuggggggccgagguggaggaucacuugaguccagaaagcggagguugcaaugagccaagcacuccgcuuggaggacugaacugcuguccuccaagguuggguuggggaauggggucuggagagguaguucugaggccccaguuccuuucucaaaaaaaaaaaaaaaaaaaaaaaaagucacuuaacugaugccucugcaguguaacugcauauuucuggcucugggaaaagaggcaagaguuccaaucucuacuccuugaacucggaaaggggccuuuggguuucuaagcucagugucacauauaacagaugccuucguuaaagcaguguuuauuuuaugucuaauuuaaagagacagggucucacuauguugcgcagguuggaguacaguggcacaaccauggcucacugcagucucgaacuccuggacucaagggauccuaccccuucaccuuccugaguaucuggaacuacaggcgcgcgccaccccgccuggcuugaguuucguuuuuagcuagaguuggcuggcucucgguaucggcuaguuuaaaaagcgcagaaacaggaaccugcauuuuccagccuaaggccgacgcaguugcaagagacccuguaagcggggcgauguucuguauuaagccagugucugacuucgucgcuuccggugggcgcauaaacgucaucagacagcgccggaagugcccucgugcugccuaggagacaagacgcgaggccggcagcgcccacccggucgcaauggagcuuccccuagggcggugcgaugauucccgcaccugggacgaugacucggacccagagucagagacagacccagacgcgcaggccaaggccuacguggcccgcguucucaguccgccaaaauccgggcuggcguucucgcgccccucgcagcuauccacacccgccgcguccccgagcgcuucggagccucgggccgcguccaggguuucggccguaagugagccgggccuucugagccuucccccggagcugcugcucgagaucugcuccuaccuggacgcccgccucgugcuccacguccugucgcgggugugccacgcgcuccgcg

SEQ ID NO: 15698 - RNA, 326 nt, Homo sapiens
uucauaggauggcauagggcuucuucuccuugaaggaguugguggcggccgggaugcccacaaggaaggggucauucuuggccugcuccgugcagaacuucagcagaucggcggccaucuuuggacaccugcagaccaacugguucagccagaccagacccaggcaugcaccuguccccuggcccauguguucccaccucuucccgccuccugcacuggccccgacccucaccuucacuuggucgaugccugccuccaucuggagcugcuccacugcccagagggccugcccaaugucacuguugauggccaccuugcuggacauc

SEQ ID NO: 15699 - RNA, 1613 nt, Homo sapiens
uguuuaucacuuccggguucaucauuuuggcauuucggugaucggguuggaacuauugaagcccgcuuucagguucuuuuccccauuuucccuuugaaaggaagacuucuggcuucuccuaaaucuccguucucuggguaaggggaguccaagccucugucaugaggaacggaaaugcgagggccucggguguuacucuaaaauccgcccucagcuugcacgccggaagcugcgauuccugcagcggaagaggcgugaucuggccuucgacucgcuauguccacuaacaauaugucggacccacggaggccgaacaaagugcugaggugaggaccccagcgucgugggcacggguucggguuguggguguggaucggggcccugggaagcgccugucuaucccgggggcaggaccugagcgccccugacccucgagccugucgcagguacaagcccccgccgagcgaauguaacccggccuuggacgacccgacgccggacuacaugaaccugcugggcaugaucuucagcaugugcggccucaugcuuaaggugggcgggguugagcuucuauggguguaguuggaccugagaacgaggcccgggggcggguuuggaaugaagcggggugucuugucauugcugauggggcgggaccugagaucggccgggaguggggcugcgaugacgcugggccgagaaagccccagucuuuggugaagucaaggauucgagucagguuggggauguggcagauuggucugcgaguggggccaggcuuugaagcaacuuggagaggaguuguggaaaaagggcagggucuuaagcaugugggaugucagagucucucuugguccugagagacgcaggccagacaguaggacuagaaaccacguaucuagaguaugccaugagcaggugggacugaggaauuccggguggggcaaggucccagcugcaucagauggaaucagugggcaugaucuggugucuggaaagguggcuucggggacucauuguugugccuuucacuaaccugcccacccacuuaccuuucccuagcugaaguggugugcuugggucgcugucuacugcuccuucaucagcuuugccaacucucggagcucggaggacacgaagcaaaugaugaguagcuucaugugagacuugcccuacagaacaagugacucuugaguaagggguggggggaccccagccuggccauccuagacugacaccucucuccugucucaggcuguccaucucugccguggugauguccuaucugcagaauccucagcccaugacgcccccauggugauaccagccuagaagggucacauuuuggacccugucuauccacuaggccugggcuuuggcugcuaaaccugcugccuucagcugccauccuggacuucccugaaugaggccgucucggugcccccagcuggauagagggaaccuggcccuuuccuagggaacacccuaggcuuaccccuccugccucccuuccccugccugcugcugggggagaugcuguccauguuucuagggguauucauuugcuuucucguugaaaccuguuguuaauaaaguuuuucacucuggcuguc

SEQ ID NO: 15700 - RNA, 1613 nt, Homo sapiens
gacagccagagugaaaaacuuuauuaacaacagguuucaacgagaaagcaaaugaauaccccuagaaacauggacagcaucucccccagcagcaggcaggggaagggaggcaggagggguaagccuaggguguucccuaggaaagggccagguucccucuauccagcugggggcaccgagacggccucauucagggaaguccaggauggcagcugaaggcagcagguuuagcagccaaagcccaggccuaguggauagacaggguccaaaaugugacccuucuaggcugguaucaccaugggggcgucaugggcugaggauucugcagauaggacaucaccacggcagagauggacagccugagacaggagagaggugucagucuaggauggccaggcugggguccccccaccccuuacucaagagucacuuguucuguagggcaagucucacaugaagcuacucaucauuugcuucguguccuccgagcuccgagaguuggcaaagcugaugaaggagcaguagacagcgacccaagcacaccacuucagcuagggaaagguaagugggugggcagguuagugaaaggcacaacaaugaguccccgaagccaccuuuccagacaccagaucaugcccacugauuccaucugaugcagcugggaccuugccccacccggaauuccucagucccaccugcucauggcauacucuagauacgugguuucuaguccuacugucuggccugcgucucucaggaccaagagagacucugacaucccacaugcuuaagacccugcccuuuuuccacaacuccucuccaaguugcuucaaagccuggccccacucgcagaccaaucugccacauccccaaccugacucgaauccuugacuucaccaaagacuggggcuuucucggcccagcgucaucgcagccccacucccggccgaucucaggucccgccccaucagcaaugacaagacaccccgcuucauuccaaacccgcccccgggccucguucucagguccaacuacacccauagaagcucaaccccgcccaccuuaagcaugaggccgcacaugcugaagaucaugcccagcagguucauguaguccggcgucgggucguccaaggccggguuacauucgcucggcgggggcuuguaccugcgacaggcucgagggucaggggcgcucagguccugcccccgggauagacaggcgcuucccagggccccgauccacacccacaacccgaacccgugcccacgacgcugggguccucaccucagcacuuuguucggccuccguggguccgacauauuguuaguggacauagcgagucgaaggccagaucacgccucuuccgcugcaggaaucgcagcuuccggcgugcaagcugagggcggauuuuagaguaacacccgaggcccucgcauuuccguuccucaugacagaggcuuggacuccccuuacccagagaacggagauuuaggagaagccagaagucuuccuuucaaagggaaaauggggaaaagaaccugaaagcgggcuucaauaguuccaacccgaucaccgaaaugccaaaaugaugaacccggaagugauaaaca

SEQ ID NO: 15701 - RNA, 20747 nt, Homo sapiens
cucuuuucucuccggaacacccagggauccuucucaaccaggcuggaucccaucccugguacuccagggguauuuacccaacgucccaauccccacaguauaggacucuucaucagauccuccucuuaggcaagcuagguccuuccaggacccuagcgcugaagguccaugggacggacacccuggauucccauggacacacuacaccggcuaggaaaacccggcccccuuaggaaaagcacuucugcuccuaccggcauuaagaggcauuccgucuuggaauuccggcauuaagaggcauuccgucuucauagcccgugagacgccagugucaccuuuagcccaaccagugcccugaggguggcauuuuccuaccuuccuguaacgacccccgggauugcccagggcuacagccucucucccgugagccuccagaccgcgcccuggccccgccccccaccccgauuggcccggccgggucugggggcggggcguuugcccggccuuuccagggccggggaaccccaggaggaagcugcugagccaugggcgccuacgcgcgggcuucgggggucugcgcucgcggcugccuggacucagcaggccccuggaccaugucccgcgcccugcggccaccgcucccgccucucugcuuuuuccuuuuguugcuggcggcugccggugcucgggccgggggauacgaggugaguggggccuccgagcugaaacguacaggaggcagagugaaacccagaauacagucuagaggugugggugggucuguccugugggugucuagugaauggcugaugauaugacaguguggucugagugcgugcuuugugucauugcgaggucuggcugugcgcaucugaguauaggacugugucugauuguaccugccuccgugucuccgggaugcuugccuagacuuugucugcacuuaacugugggauuggaggggcaggagguggcagggggugagcaguguauguguggggggaggugcuggcugagagcugggacucuggagucugccugaaauuccagccuagcucuuacacuuccugagugugugacguugggcaagucaccuauccucucuaagccucagugccuucaucuggaaacuggggauaacaucaccccaccucccacgguggccgucugcugucggcaaaugcugaacaaacaucagcuacuucuauuauuauuuucccggagugugaaugagagcugcccugugggguugugcaaaguggaguuguaucuaugagcacaacuauguauguguguguccugccugggagggccuggccuccucugcacauaggcgagaucaggccucucugagucacucaccucuagaucaagacuuacucugcagcccccgaccucggggguuauugacaagguauguguguuuggggucccugugcagacaugccccacagugcagccgaacaugcugaacgugcaccugcugccucacacacaugaugacgugggcuggcucaaaaccguggaccaguacuuuuauggaagugaguagaggauggggacuggucccugggauccccauggucccuguaaucccucuggguccuggacauuaggguggggccagugcuacccuaauauccaggguuugggcuccucugucuaggaauaacccccuuggcucugcuguucccugagagccuuaucccuguuauccacagucaagaaugacauccagcacgccggugugcaguacauccuggacucggucaucucugccuugcuggcagaucccacccgucgcuucauuuacguggagauugccuucuucucccguugguggcaccagcagacaaaugccacacaggaagucgugcgagaccuugugcgccagggugagccuaccccaaggaagugaaaagaggaagcccagcccagcuucugcuucugcaucucugguuucugagauuugucaugccacgugcaagcuguauaacaugcgugucgcuccgccugccuggacucuccauuuggagaccuccuauacaucccacaaagccccaccugcugugcauccucugggaagccugccaugcagggggccucuuucccauaucugggaacuauggccugggagcgaccccucuuguccuuccgccagaaauguguacacaggcaggcuuucacauucccaguaucacccacccuacucccacuccuggcucugaccgcugacccugaccuugccuguccuggcacagggcgccuggaguucgccaaugguggcugggugaugaacgaugaggcagccacccacuacggugccaucguggaccagaugacacuugggcugcgcuuucuggaggacacauuuggcaaugaugggcgaccccguguggccuggcacauugaccccuucggccacucucgggagcaggccucgcuguuugcgcaggugcgacccgggaccucucuugggcccacuucuucacucacucuggcuccucccucgcccagucaaaccccgcccucucccugcaaucucacaaggaccaggcccaggccuaggccuguugaagcccugccccuugagugagccguaaagccaguggcuuuugagcucuggccucagccggcuaugcccagcccaggcugacccagcuccggcuggcuccgcccucuccccuaauaggccccucuugguguucuggccccacccacuagcucggguccuggcuccucccuaaaccggguggcaaguggaugccuaggcugccuuaaaaacagguucauuaccugugcucagaccccauccauccucaggcuguggaagggggaaccucauuccuggagucaggccugcucugcgcuuugacagugcuggggaggugaaccuggguucugauguuggacccgcccucucccugcuagcccaagguggugaguucugaaacuuccccaagcuuggaaauaagcuggaggccucucuguuucagcccuacguguuuuuguuuuuguuuuuugagacagggucuugcugucauccaggcuggagugcaguggugcaauccuaacucacuauagccucaaucucccggauucaagcgauucuccugucucagccccccuaguagaugagacuacaagagcgcaccacuacgccuggcuaauuuuuaaauuuuuuguagacagucugcccguguugugcaggcuggucucaaaaacuccuggguuuaagugauccuccuguuuuggccucccagaaggcugggaucauaggcaagagccaccacaucgaccuagcacugcuuuuuaaccugugcucugaccugccccucccaagcagaggggaguuugguggugagagggcugggcacuaauucacacugccuuuuccucccucauccccagaugggcuucgacggcuucuucuuugggcgccuugauuaucaagauaaguggguacggaugcagaagcuggagauggagcagguguggcgggccagcaccagccugaagcccccgaccgcggaccucuucacugguagggggcuuggugagggcagggccagccauggugccacacacucagaagggcccugggcuugauaucugcucuguugucacuguccuggaauuccuauagucugggaacaaaggcccugcauuuccuuuugcauugggacacaaauucugaagcccauccugggugggacauggccggcuuugaaaccagggaaggucugggugaugggccaccccuugaacuuggugugaccugcaggugugcuucccaaugguuacaacccgccaaggaaucugugcugggaugugcugugugucgaucagccgcugguggaggacccucgcagccccgaguacaacgccaaggagcuggucgauuacuuccuaaauguggccacugcccagguaacccugguguccagaaccuucgaguccgguauauacaauacaaugagcucuuuccaugguacaggcauccccuaacacguucuccuuauuuuuaauuuuuuugagacagucuuacucugucacccaggcuggagugcaguggugcgaucucggcucacugcaaccucugccuccuggguucaaacaagcacauccagcuaauuuuuguauuuuugcacuggggucucaucauguuguccaggcuggucucaaacuccugagcucaagugaucugcuugccucggccucccaaagugccgggauuacaggcaugagccaccgcaccuggccucuauuuuuaacauuuuuauuuauuuauuauuauuuuuuuuuuuuugagacagagucuugcucugucacccaggcuggagugcaguggcaugaucucagcucacugcaaccuccgccucccggguucaagcgauucuccugccucagccuccuaagaagcugggauuagaggcaccugccaccacacccagcuaauuuuuguauuuuuaguagacaggguuucgucauguugaccaggcuggucuugaccucaggugaucugcccgccucaaccucccaaagugcugggauuacaggugugggccacugugccuagucuauuuuuaacauuuuuauugagaauuccuuuuuuauuuuuuuuagacucacucugucgcccaggcuggagugcaguggcacgaucucggcucacugcaaccuccaccuacuggguccaagcgauucuucugccucagccucccgaguagcugggauuacaggugcccaccaccaugcucggcuaaguuuuaugucuuuuuaguagaaaggggguuucaccauauuggccaggcuggucucgaacuccuaaccuuuugacccacagccuuggccucucaaagugcugggauuacaggcgugagccaccgcguccagccuuuaacauuuuuauaauuaaaaaacauuauuuuuucacagagauaaggucucaccauguggcccaggcuggucucaaacuccugaacucaagugauccuccugccuuggccucccaaagugcuaggauauaggugugagccaccaugccuggcauaacacguucuccuuaaaaaaauuuuuuuuuccuuucuuuaaaaauugauggcugggcaugguggcucacgccuauaaucccagcauuuugagaggccgagaugggcagaucaucugaagucaggaguucaagaccagcauagccaaaaugacgaaacccugucucuacuaaaaauacaaaaauuagucgggugugguggcgcacgccuguaaucccagcuacuugggaggcuaaggcaagagagucgcuugaaccuggcagguggagguugcagugagccgagaucacgucacuucacucuagcuugggcagcagagugaaacucugucucaaaaaaaaaauuguuuuagauuaauuuuuuuuuuuuuucuugagacagggucuugcuguguggcccagguuggucuuaaacuccuagacucaagcgauccuccugccucagucuccugaguagcugggauuacaggugugagccccuguaaucauguucucaugcccccuggaggaagaugcuauucuauucaccaucacaaugucccccuccuggauuuaugugcauuccucauuagaagagauagcauaggcugggcaagagauagcauggcauggugacuggaugcccucuucuagguaguggguccaagagaacugcucaacaacugguggcuacuuuuaucuguguccccacgcucccaagugccauacccccacccaugccugugcacccaacauccuugaccccauauacaucaaaacacagcuauacacagggauggcccaggauccucuggcuucaggacuccccucuugccugcagggccgguauuaccgcaccaaccacacugugaugaccaugggcucggacuuccaauaugagaaugccaacaugugguucaagaaccuugacaagcucauccggcugguaaaugcgcaggucagugcgccuacccugugguacccuugugcacaugugcgcuugcauccgggggccuuggguuaugugcauagcucucagugcugucuuuguuuucuauuguucuauuguggucauucuauaacaaaugaccacacacuuagcagcucaaaacaacagaaauacauugucuuacaguucuguagguaagaaguccagcaugaggccgggcgcaauggcucaugccuguaaucccagcauguugggaggcugagccgggcagaucacgaggucaggaauucgagaccagccugaccaacauggugaaacgcugucucuacuaaaaauacagaaauuagcugggugugauggugcgugccuguaaucccagcuacucgggagccugaggcaggggaaucucuugaauccgggaggcggagguugcagugagcggagauuguaccacugcacuccagccugggccacagagaaagacucugucucaaaaaaaaaaaaaaaaaaaaaaaauccagccugagucucaccaggcuauaaucaagguguuggcaaggcuguguuccuucugcagucucuaggagagaauauaauuuccuugcuuuuuccaacaucuagaaguuacccacauucaaaaucuauucuuggcuccaucuucaaagccagccacauagcaucuuucugacccuguuucuguaaucacaucccuuucucucauucucaccucuucugccucucucuuccacauuuuauuuauuuacuuagagacggagucucgcucugucgcccaggcuggagugcaguggcgugcucucggcucacugcaaccuccgccuccuggguucaagugauucuucugucucagccucccaaguagcugggacuacagucgcgugccaccacgcccagcuaauuuuuguauuuuuaguagacaggguuucaccauguuggccaggauggucucgauuucuugaccucgugauccaccccgcucggccucccaaggugcugggauuacagaugugagccacuguguggccuaauuucccuacuuuaaguuuggcugaugaacaaccucaauuccaucugcaaccuuaauuccccuuuugccauguaaucuaaugugguaauagguucuggggaucaggacauggacacuuuugggcaguuaucauuuuacccaacacagauguguuaguguuuugcacuaaguggccuguggcuguggcugugugcacagucagucacucucaucagcacagaaacuugucuccccucucccaucucagacaccccuucccaucaaucuuguccucacuacggugcaaucuccauucccaccuuccacucgcucccagcacugcuauuucaccaaaacagcucuuuuaugucauuuauuuuuauuuauuuuuucuuuuuaaaauuuuauuuauuuauuuauuuauugagacaagagucuugcuuugucacccaggcuggagugcaguggcaugaucuugccucauggcaaccucugccuccuggguucuagugauucuccugccucagccucccaaguagcugggacuacaggcaugugccaccaacccuggcuaauuuuuguauuuuuaguagaggcaggguuucacuauguuggccaggcuggucucaaaacuccugaccucaggugauccguccgccuuggccucccaaaguguugggauuguaaucugaggugggcggaucacuugaagacaggaguuggagaccagccuggccaacauggugaaaccuugucucuacuaaaaauacuacaaauuaggugggcgugauggcacucaucuguaagaccagcuacucggcaggcugaggcaggagaaucgcuggaaccugggaggcggaguuugcagccagcugagaucgugccacugcacuccagcuugggcgacagagucagacucagucucaaaaaaaaaaaaaaaaaaaaaaguuuauugagcaccuacuguguacauugggggacacagcucgugcaaaacaaacauccuuuuccucacauaggucacuuucuuguuccuccaccuugcucaggugaaagugcaccuccauucauuauaaaaauugugucuaggccgggcacgguggcucaugccuguaaucccagcacuuugggaggcugaggcgggcggaucaugaggucaggagaucgagaccauccuggcuaacacggugaaacuccgucucuacuaaaaaaugcaaaaaauuagccgggugugguggcgggcaccuguagucccagguacucaugaggcugaggcuggagaauggcgugaacccaagagguggagcuugcagugagcugagauugagccacugcacuacagccugggcaacaaaguaagacuccgucccaaaaaaaaaaaguuguguuuuuugguaacaaucugacaguccugcaaaacgauuauuccugcccuauaaugucacacuuaguuuuuccacaaaaguuuuuaauaauaaaguuggaauuauuguaaaaguuuaguaaaauuucagguuuauucuugcaucucugaaauccuuuuaaaaaaggcuaguggucauguuugacuucagccaaaauucauuuucacacccaaccauuggcuugcacgccaaauauguauuuagagaaacugaaccuaugggaugcaugaaugugcacacauguguggaagugugggcccccaggaaggugcggacucccgagggcucacuccgucgccucccccagcagcaggcaaaaggaagcaguguccauguucucuacuccacccccgcuuguuaccucugggagcugaacaaggccaaccucaccugguauuuggggaaacuggggagcuuggggggguuggcaugccccgugggucaugacccugcccucaaugccccugccgcuguaggucagugaaacaugacgacuucuucccuuacgcggauggcccccaccaguucuggaccgguuacuuuuccagucggccggcccucaaacgcuacgagcgccucagcuacaacuuccugcagguggguaggagccgggcuagagggggcaugcagccccgaggcccgacaggcugggcgccccaacauaccccucugccuccaggugugcaaccagcuggaggcgcuggugggccuggcggccaacgugggacccuauggcuccggagacagugcaccccucaguaagugucgggcccaagaggggaagagguuugcggcugaaguuggaaaccaccccuaggccgccccccucgaguuucuucuuuuuuuuuuuuuuuuuuuuuuuuuuugagacggagucucgauuugucucccaggcuggagugcaguggugcgaucucggcucacugcaagcuccaccucccguguucacgccauucuccugacucagccucccgaguagcugggacuacaggcgcccaccaccacgcccggcuaauuuuuuguauuuuuaguagagacgggguuucaccauguuagccaggauggucucgaucugaccucgugauccgcccgccucggucucucaaagugcugggauuacaggcgugagccaccgcccccagccguccucgaguuccuucuuaaagccucuaagaauccugcccgccagcaccggaccuuucgcuuccccuuggggucucagcugagucccacagaaccucaccggacucauugucuaugagcagaugaggcgauggcugugcuccagcaucacgacgccgucagcggcaccucccgccagcacguggccaacgacuacgcgcgccagcuugcggcaggcugggggccuugcgaggugcgcggggcgagacuugggagacacggggguggagacaggaaggggcggggccagggccugggaaaggggacagagacaggugugaggcguagccgagagcccuguggcggggcuacaagggcucgugggggcggggcuuguaggaggcggggaaagauacaggaacggggcggggcuuuggaggggggaaggaggcggggcgugggcaagaggaggcggagacagcuaugggguauagucaagggcagcaggguggggcuagaagggguuuuggggcgacucuugagggaggcgggacagagaccggaacggggcggggccugaggagaggggaggagucaggccuggcguccugaacccaccggucccuuugcgcucuuccgcagguucuucugagcaacgcgcuggcgcggcucagaggcuucaaagaucacuucaccuuuugccaacagcuaaacaucagcaucugcccgcucagccagacggcggcgcgcgugagccgggacgggagggguggaucuagggcagaugggcuuuagaggggguaguuggaaaauguuuuuggaggacuauacaggagugaaauuacgugggcugcgaagcugggucagcagagagaacaacgcaucucgagggggcuuggccuuaagugccgugaccacacuaggaccagccagggguguuucugugcaaaguggguggguuuggagaaggccugcugugacccaugcccucucugacccccgccuccccaguuccaggucaucguuuauaauccccuggggcggaaggugaauuggaugguacggcugccggucagcgaaggcguuuucguugugaaggaccccaauggcaggacagugcccagcgaugugagcccaaacaacgaauauucccccgcugggacuccucccccagugggcauuuccucaucgcccccauggauaucgccugcuuccaugaauaccucccacucaugcauaucucuuccccccucuuguaucuucucccucugccccuuaauaucagucuccccuugggaacauaugccuccugugagugguccucccuuuuuuuuuuuuuuuugagacggagucucgcucugucacccaggcuggagugcaguggcgcgaucuuggcucacuucaaacuccgccugcuggauuauaggcaugagccaccgugccuggcugguccuccauuuuaauaccccgcuuccccaggaaaauuuauugcuguuuauggacaucuccuucauuccagaaaacguccucccccaaaccucuuccucccccgagaaccugccucaaggguuucuuccccuacuuccuccuucacucccccgacuccauggucucuccacccucccgguggguuuuuuuuuccaccuggugaaucuucucugcaaucauuuccuuggaaucugacuguccccccaccacacacaccuccauuuccuuuccccaucucaggacucuuuuccuuccuugaguuuuuugucuccaugcauguauagcuuuccauggguacucuugacucaguuucccuccuccuuuauccgaggugguaauauuucccagcucagacagccaggcgcacccuccggagcugcuguucucagccucacugcccgcccugggcuucagcaccuauucaguagcccaggugccucgcuggaagccccaggcccgcgcaccacagcccauccccagaagauccugguccccugcuuuaaccaucgaaaaugaggugagaccccauuucaauccccuuuccugcuccugugacaaauuugaagugucauggugagcuguguggacucugggucagcaggucccuaggcuuaugaccuccugucacaacuccccucauuguguguccuugagcaagugaccuuugucugagccucaguguccuuuccugggacuguuaugaggacccagugugaucaugggugacacuugacagacaugucagaguugguggcagguggugguucgcaauuuuggcagggacguuucagggaagguguucccgauaaaggugacauuuaagauaugaccugagggagggagccguguggcuauuugaaggaagagagauccagguggggagagaauaacaggcauaaaagccuucgagcaggagagugugcagaauuccaggagccacaaggagcucaguguggcugaagcagggugaacgggugacaggucagaccuugagggccuugaggaccaacaggaagacuuuggcuuuugccagucauuguugcucaugugucuacuccuagcucuuugggaggcugaagcgggaggaucacuugagcccaggaguugucccagcuaauugggaggcccagaugggagguuuguuugagcuggggaguucgagguugcagugaguaaugauugucccacuguacuccauccuggcaacagagugaaacccugucugaaaagaauaauaauaaaauaggccaggcaucguggauuauaccuguaauucuagcaccacgggaggcugagguggguggaucuacugagcucaggaguuugagaccagcuugggcaacauggugaaacccagucucuacaaaaaauuagcuggggguggugguacacgucuguaaucccagcuacuugggggcugaggaaggaggauugcuugagcccagguggcagagguugcagugagccgagaucaugccacugcacuccagccugggugacaaagugagacccugucucaauaaaauaaaauaaaagaaguucugcaguaggacuguucauguuaggaagaaaacaucuuuuucauauuuuuauuaaaauaaaauaaaagaaguuaaaacguucccacaggccccuaaaagucuugugaguucuggcauugugguucacacaucagaugcccaaguuggcccugguccgcagcagaggagggcuuugaugggacuuaggguaucacaggugugcucuggcuguuguggggaacagacuguaggcagccaguguggaagugcagggaccuggaagggguugacugcacuggcccuggaaggcccugguaagagguggugagguugaaaauaagguugggggggccgggcgcgguggcucacaccuguaaucccagcacuuugggaggccgaggcaggcagaucacgaggucaggagauggagaccauccuggcuaacacggugaaacccugacucuacaaaaauacaaaaaauuuagccaggcgugguggcgagcaucuguagucccaguuacucgggaggcugaggcaggagaauggcgugaacccggaaggcggagcuugcagugaccugagauggcgccacugcauuccagccugggcaacagagugagacuccgucucaaaaaaaaaaaaaagaaaaaaaaagaaaaaaagaaaaggcuggggugggcacguuggcucaugccuguaaucccaggacuuugggaggcugaggcuggcaggucaccugaggucaggaguuugagaccagccuggccaacacagugaaaccucgucuguaccaaaaauacaaaaauuaacugggcguggugguacacacuuguaguccuagcuacucgggagggagaggcaggagaaucacuugaacccaggagguggagguugcagugagccgagaucaugccacugcacuccagccugggggacagagcaagacucugucucaaaagcaaacaaaaaaaaaaucagguugaauggcugggugugguggacugcuugagcccaggaguuggacacuagccccaggcaacauagugggacccccaucucuagaaaacaaauuuaaauuuuuuuuuuuuuaauuuaguagagauggaguuucacuauguuggccaggcugguaucaaacuccucaccucagguuauccacccaacuuggucucccaaaguucugggauuacaggugugagccaccacgcucggcccuaaaaaaauuuuaaauugagaaaaaaaggggccaggcguguuggcucaugccuguaaucccagcacuuugggaggcugagggggggguggaucaugaggucaggaguucgagaccagcauggccaauauugugaaacccugucucuaauaaaaauacaaaaauuagccaggugugguggcaugugccuguagucccagcuauucaggaggcugagucaggagaauugcuugaacccgggaggcggagguugcagugagccaagaucacgccacuuucugcacuccagccugggcgauagagcgagacucagucucaaaaaaaaaaaaaaaacaaaaaacccaggccaggugcaguggcucacgccuguaaucccagcccuuugggaggccaaggcggguggauuaccugaggucaggaguuggagaccagccugaccaacauggcgaaaccccgucucuacuaaaaauacaaaaauuagccaggcaugguggcaugugccuguaaucccagcuacccaggaggcugaggcaggagaauugcuggaacccaggggcagaggcuguagugagcagagauugcgccccugcacuccagccugggcgacacagcaaguuucugucucaaaaaaaaaaaauaaaaauccggcugggcacaguggcuuaugucuguaauccuaguacuuugggaggccaaggugagcagaucacuugaguucagggguuugagaccagccuggccaacauggugaaacccugucucuacuaaaaauaugaaaauuagccaggcgggguggugggcaccuguaaucccagcuacuuggauagcugaggcacgagaaucacuugaacccgggagguggggggugcagugagccaagauugcaccacuguacucuagccugggcuacagagugagacucagucucaaaaaaaaaaaaagaaaaaagaaaaauuaaaaaaagaaaacacacacacauacacacacaaacccaucuguggacccuuuucugcccagcacauccgggcaacguuugauccugacacagggcuguugauggagauuaugaacaugaaucagcaacuccugcugccuguucgccagaccuucuucugguaagggaagaucaccaggccugaggguggggugguggugcucggcauggagcuagggccccuuaccugacucucaccugccccaacuccagguacaacgccaguauaggugacaacgaaagugaccaggccucaggugccuacaucuucagacccaaccaacagaaaccgcugccugugagccgcugggcucagauccaccuggugaaggucagggacuaggaaugaugagugggcaguugggaauggggaaguuauggagcccaagaggguggugggccauguguagagugaggguaggggaggauuuacuuuuccuucagaucagugggcuaagacccacagaucagcgggggaaauauuugaggguccuuccauagaauugauauucauagcuggucguaugagagucuccccauaggacacaucauacaaagccauucacaucugcuguggacguuuacauacuuaguuuuggaaauuggggguggggcauucccacuuggcccaugaaucaggagagccaaauaucacugcuugaagaauucaccaaagucuguaguaagaggagcuucuaucuggagugaauauuugagaguccacccuuggauugauuggguuugggugagucucagggugaaugccuaugggugcaucuggcuaggaacagugguuucccagggccucucauugauguuugacuuucauagaugacaaaacucacauuuguccacauucaagagccucgcguuucaugugagucccuuugagaugaaugucugcauaucuguauauaguuuugccuguucuaacagaguuacccaaauuaacugugacuagaauaagauagaagauuauuuucuucuaacaaaaagucuggcuguuaguccagagaaaguggggugguuccauaaucacccaggaccuccucuucuaucuuguugcucugccuuccccaauauucaguuuccaccucaugguccaagauagcugcugaagcuccagccgccacauuuguguuugagucaguagcagagggacaggggcaaggaacauuguugacaccacuuggaucacuuucuauggggcaaacuggucacucagcuacugauagccucagggaagacuggacaauauagucuuuaucccagguagccaugugccaagcuagaauccuauucuauggggcaauggugaacaggaggcguuuaugccacgcucaagagugaugugguaagccagaugcaguggcucaugccuguaaucacagcacuuugggagacugaagcaggaggaucgcugagcauaggaguucaagaccaggugggagcauuugcugauuaggugccuacauagugaugcccugucucaaaaaaaaaaaaaaaaaaagaggccgggugcaguggcucacgccuguaaucccagcacuuugcgaggcagaggcaggcagaucaucugaggucaggaguucaagacaagucuggccaacauggauagaaaccccgucucuacuaaaaauacaaaaauuagccaggggugguggcagguaccugcaaucccucuacucgggaggcugaggcaggagaauugcuugaacccaggaggcggagguugcagugaggcaagauugugccacugcacuccauccugggcaacaagagcaaaacucugucucaaaaaaaaaaaaagaaaaaagaauuaugugggccaggcgcgguggcucacgccuguaaucccagcacuuugggaggccgaggcgggcugaucacgaggucaggagaucgagaccauccuugcuaacacggugaaaccccaucucuacuaaaaauacaaaaaauuagccgggugugguggcgggugccuguagucccagcuacucgggaggcugaggcaggagaauggugugaacccgggaggcggagcuugcagugagccgagaucgcgccacugcacucccgccugggcaaaagagcgagacuccgucucaaaaaaaaaaaaaaaaaaagaauuauguggcggugacugaagguugaccuugauguaggccuuaaugggguuuauggccaggguugggggacauuuguaggacucaccucugcucagguacagacugacauccaccucacccgugugcccgcagacacccuuggugcaggaggugcaccagaacuucucagcuugguguucccaggugguucgccuguacccaggacagcggcaccuggagcuagaguggucgguggggccgauaccuguggggugaguggcacaggcugggagagggguguggaagcaagggcagagggguuuauccaaggcucacaaccuugccaucccauuggguacagcgacaccugggggaaggaggucaucagccguuuugacacaccgcuggagacaaagggacgcuucuacacagacagcaauggccgggagauccuggagaggagguggggggugacugagagcacugaggggguggucugugguguguuggggcccagggguggugagggaaauuugcugauuacaugagugugggagacagaggacgaagggagagugaagggcgggggagccaggcagggugcaguggcucacgccuguaaucccagcacuuugggaagccgaggcgggcagaucacaaggucaggagaucgagacuauccuggcuaacauggugaaaccccgucucuacuaaaaauacaaaaaaaucagccgggugugguggcgggcaccuguagucccagcuacucgggaggcugaggcaggagaauggcgugaagccgggaggcggagcuugcagugagccgagaucgcgccacugcacuccagccugggugacagagcgagacuccaucucaaaaaaaaaaaaaaaaaaaaaagaguuggggagccagaucccaagccugaucagcucacccccaaccccaggcgggauuaucgacccaccuggaaacugaaccagacggagcccguggcaggaaacuacuauccagucaacacccggauuuacaucacgguagcucucccccauccugcaccuccccaccucgauagaaagggaaucaccccuuaucugcagcaucucaaagcugccugggguugggguugacugcccucuacuuucacccuucaacucccaggauggaaacaugcagcugacugugcugacugaccgcucccaggggggcagcagccugagagauggcucgcuggagcucauggugagugggucagagccccauccgagccaggguccucccaaccuggaccccugcuggaccuugaaggcuguuucuggcccaguucucugcuuucaggccccacuaagcugaggacuccguuucuuucuuuucuucucuuugagacggaguuuugcucuuguuguccaagcuggagugcaauaguacuaucucagcucacugcaaccucugccuccuggguucaagugauuguccugccucagccuuccgaguagcugggcuuacaggcacacaccaucacgcccggcuaauuuugguauuuuuaguagagaugggguuucaccauguuggccaggcuggucucgaacuccuuaccucaggugauccacucaccucggccucccaaagugcugggauuacaggcgugaaccaccgcucccggccaaggacuccauuucuguguguggcuuuuccucuccguuuuucuccaucuccugcccaggcucccuccacgcucuggcgugccauauccaggccccccuguuaggcauuuaccuccuuccggccugguucccaugccuacuuggauccugccucugcugggguugcccuaccagacccucaccuucauccucauccguuccucccacccuuuaauuucuuuugacauucccacacgcccuuacccaguuucuggcccaaggacacccacaaacccacgacucucacccccuccuggccacucuccccccaggugcaccgaaggcugcugaaggacgauggacgcggaguaucggagccacuaauggagaacgggucgggggcgugggugcgagggcgccaccuggugcugcuggacacagcccaggcugcagccgccggacaccggcuccuggcggagcaggagguccuggccccucagguggugcuggccccggguggcggcgccgccuacaaucucggggcuccuccgcgcacgcaggugaggggcagcgggguaggcagagaggaccggauugaagucuaccagggagccggguuugggugcggaguuuccuaggcucagcggggauccauuuggccauaauuagccccaaacccucgggccaaccccauccccugggcaguccccgcccagugccagcccagucccaaccccccuggacuguguagaggcacagcccuagcucaugccccuaaaccaccaacucaccuccggccccgcccauuucacuuuagccccgcccucucaccgcccccaggcucuguccugccucacccagccccgcggcuucagccccgccguaacucccaaagucucaggucacaucaguucugcuccaucgggacucgaacccuaagcuugggaccgacccaucuccccauuggcucaguccucccugucacggcccuggccgcuccucucggcugagccuugccccucuccggcgaaaccccgccccuacaaccuagcccugccuccugaccuggcucggccccgcccuucuccauccaggccccgccccucuccaacucagccccgcccucucucccgcaguucucagggcugcgcagggaccugccgcccucggugcaccugcucacgcuggccagcuggggccccgaaauggugcugcugcgcuuggagcaccaguuugccguaggagaggauuccggacguaaccugagcgcccccguuaccuugaacuugagggugagaagggcaaaauugagaaggagaucggagagaggcaagagagagggagagaagagaaaccuggcuuugccccaacucaucugggcccauccccuuccccgcaggaccuguucuccaccuucaccaucacccgccugcaggagaccacgcugguggccaaccagcuccgcgaggcagccuccaggcucaaguggacaacaaacacagguggggcccuggucagggguagggaagggguggagucuuaccuggggccggcaggugggggcaaugugugaggcaugggauguuggccaggacccaaaaaggucaugaggguauggggcagaguccagacccagguuaggggcuuaaaggaucugaaaugggugcggcaaaccaggaaugggucuugagguuugugggugcuguuuagucccaagaacaagauuugaaaauccccauccaugucuaguucugggaggguguucaucaccccuggggucagauugaggguacgaggacaguggccagauugaggguaugaggacauuggaccugggggugguauucggggccggggaagcagguuaagagucugggauugaggcccuggagacagauucggggauaugcagcugugucuagacccaggggaggaagcaucguggggugagucagaggaagucugcaccuccucacuccuccuucccccugcaccucuccaggccccacaccccaccaaacuccguaccagcuggacccggccaacaucacgcuggaacccauggaaauccgcacuuuccuggccucaguucaauggaaggagguggaugguuaggucugcugggaugggcccuccaagcccaagccuccugcuccgggggcagaccagacucugacucuccucuuggggcugcugccauuaaaacgcuacuacuaagacucaggucgcucugug

SEQ ID NO: 15702 - RNA, 9304 nt, Homo sapiens
auagaugaggcauaaaaaaguuaauuaauuugcuaaagguuucacaggugauaaguggcugagcaggguuuuaaagucugauuugaguuuguggucuggugggcaguguggcucaguggacaggaaccugggcuuuuuccuguagagaagacauagcuuuuagcauaaggauucccccaaacugaugacaaguacaacuugaaugcauauauaaauaacauuuauuaacuuaggcuguacaauauauugauuuagucaaauaaaaaauaccguacacaaaaauugaaguaaaaucuguaagaugccauucagacugaauuuuauauucugaauaagacaagggacugccauucacuuaaagcaaaauggcuccaauuccguuuaucuaucuaucuaucuaucuaucuaucuauccaucuaucuaucuaucuaucuauaagucucgcucugucacccaggcuggaguaucuaucuauuuauuuaugagauaagucucgcucugucacccaggcuggagugcgguggugcaaucucggcucacugcaaccucugccucccacguucaagugaugcuccugucucagccuacugaggagcugggauuacaggcaugcaccaucacaccuggcuaauuuuuguauuuuuaguagagaugggguuucaccauguuggccaggcuggucucgagcuccugaccucaggugauccacccaccuuggccucccaaagugcugggauuacaggcgugagccacugcgcccggccuccaauuccauuuuguaggaaagcacauaaggcuauaccaaucaggcacuguggcuggucuaaugcucacaccaggggccagcccacugcccagacuuagccuccagguaggcugcuuugcuauuuaaaggcaacagucuuaggauccuuauuauaaaaguuuaaacaaaaucccaaagccgucaagucuuccuggagauggcaauguacuaucaguuuggaauguauaccaguuuggaagcugaaaucacucugcuguagccuuuugagcacuggcagcauuuuccaaaauuuuucuuuuccauucuucauaauccugugucagaucuucaucuuucugugguuuauguggcaucuccucuaccuucuccauuucugacagaaaauuaucaaaagcaauuucaaaauucuuagcuuagaaaugaaauuuaaaaaaagguaaacuuguuuaaauugucuaaaauagaaaagauacugaaaugacauggagaaacagcaguuaucacuuuuuuuugagauggggucuuguaauguugcucaggcugcacucaaauuccuagguucaaaugauccucccaccuccaccucuugaguagcugggaccguggcugggacuauaggcucacacuaucacaccuagcuuagcuaucacuuuuuucccucccuuacacuccaagcauuccaagacaucuaauaauagcuaacgucuaucaagcacuuaacuggugcuugauaggcacugaaccaaguacuuuaaauagcauuauuucauuuaaccccuacuacacuccguaauaggugauaauauuaaucacauuuuauaggucaggaaauugaggcucacagaaauuauacuuucuuagaaucccauagccagugguugggcauaguggcucaugccuguaaucccagcacuuugggaggugaagggggcgggucacuugagcccaggaguucaagaccagccuggguaacauagugaggucccaucucuaucaaaaauacaaaaauuagccaggugugguagcacaugccuguagucccagcuacucgggaggcugaggugggaggaugguuugagcucaggaggcggaggcugcagugagccgagaccgugccacugcacucuagcaugggugagagaaccaggccaugucucagaaaaagagaaaccaaaaaaccaaaaucaaacaaacaaacaaaaaaaccaaaaaaucacauagccaguaggugguauuaaaacaauaaugcagccauuugccugagauugucuuuguagcuaaagcucuuauaagcaaacuggaaccuaacuuggaaacauuucuuuugucgggggaaaagaaccuccgaaagacaaaaauaauccccagccaaucacaaacagccaaccagcugacuuguuauacaacuagggacuucccaucagaccaugcccagguuuaagacaaauaccuagcuguagcugcccaggcuggucucgcacucaugggcucaagcaauccucccgccucagccucccaaagugcugggauuacaggaauaagccacugugccagaccagccauauucuuaauuacccaauaacgauguuacuuccauuacugauugcuuggaaaacuggucuuaucaaaugauucacagucagaauguacuuaaaacuggacuccugucaggcaagcugcuagagcagcacugggcuguucacugcauaaaaugucaacgucaguaccguguuaguaaaacuuacccuuugcuggggcuucaaccacuaucuucuuucucuuccgugguggaguagcuacaucuccagguucuccuuuaagaaguguuaucaagguuaauuuuucuccuguucucaauuucaguauuugggcauguuuuggaucacaaauaaaauuagacaucuuaacugaucaaauaugaggagaagagaaaugaucuuagaccucucuuuugggccucuugucagacuugagaaucauuuuccaggcauagauucauggaaucauagguuagaaacaucaauaaaaacauaccugguccacauguaauacggaauuuaggaagcagccaguuuacauauuugaaaauauuugacuuuuacaagcaaaaggacuacauuuucaaaugacgcauucuugaacuacagaauacuuacugucgaccugcuguccaaucuucucuaguuguuuacacagucgaucaaauauagcuuuuuuuacaccggauguggcuaccauuuuguuuuuauccacuuucagcuuuagaauccuacaaaacaauuucauaaguugcuuuucucaagaccuguacaguuuucuucucugggcaaccagauaaucaacuuauuuucuuuuugaccaugcuuccagagccucugucuaguuuuuuuccuucauuccaaacauguuauuaucuaugcuaaguuguuuaguuguuuauuggacugagaguuaaaaugcacaugggaucuauuuuauaacaaaaggggcacauaaaagacauuugcuguagugcuucaugacuuuuagaacucuuuaguaaaucucagauuaauuuaaugaaugacaaucauaggacuuuuuuguuccacucauuuuaacucacaggauauuuauauuacaggaauguaacaaccccaccccacccugaaaauaaacuuuccuaauaagacuccacagcaaccacuaauuacaaacacaaaauaaacuuuuucuucagaauagaccugucaagaccuuuucuuacucagcguaauaugguuucaaaaguagaguugacuauucucacuguuuucuacaauaucagcugcacucccuccguauaugcacauacuuuuguugaauugaagagauguuuuccauaaaugccaauuaauacuccuagguauguaccuaauagagccaagcauaccaaaauuaguggguagguagugagaaauccauucuuuaagggccaacuacauuuuguuuucuaaggaguuuucuggcaagauaaaaauaagauaacuuuagacaaagauuaucaacaauuacuaauauuuccaagguaacauuucagcauacacauagauaacccacaauuguaagauucagaugugauaauuuaucacuaaaauguuauaaauuccuugaagaacaguuguagccaguguuuuguuuuuuuuuuaagagacaguguugugggggggucagccccccgcccggccagccgccccggccgccccuacugggaagugaggagccccucugcccggccagcugccccguccgggagggaggugggggggucagccccccgcccggccagccgccccguccaggaaggagguggggggggucagcccccccgcccggccagccgccccguccgggaggugaggggcgccucugcccggccgccccuacugggaagugaggagccccucugcccggccaccaccccgucugggagguaugcccgacagcucauugagaacgggccaggaugacaauggcagcuuuguggaauagaaaggcgggaaagguggggaaaagauugagaaaucggaugguugccgugucuguguagaaagaaguagacaugggagacuuuucauuuuguucugcacuaagaaaaauucuucugccuugggauccuguugaucugugaccuuacccccaacccugugcucucugaaacaugugcuguguccacucaggguuaaauggauuaagggcggugcaagaugugcuuuguuaaacagaugcuugaaggcagcaugcucguuaagagucaucaccaaucccuaaucucaaguaaucagggacacaaacacugcggaaggccgcaggguccucugccuaggaaaaccagagaccuuuguucacuuguuuaucugcugaccuucccuccacuauugucccaugacccugccaaaucccccucugugagaaacacccaagaauuaucaaaaaaaaaauaaauuaaaaaaaaaaaaauaaaaauaaaaauaaaaaaaauguaaaaaaaaaaaaaaaaaaaaaagagacaguguugcuguguugccuaggcugcaguguaguagcgugaccauagcucacuauaaccaagaacuccuaggcuccagugagccuucagcuucagccucccgaguagcugagaagccaggacuggaggcaugugcugacacccagcuaauuuuuuuuuuuuuucuuaagagauuggggucuuauuaugcugucuaggcuagucuugaacuccuugccucaagcaguccuccugccucugccucccaguguugggauuacaggcgggagccaccacgccuggcccaaccaguacuuuuuaaaaaauaugagcagaaaaaucacaugugaagacuguuuuaaugacagauaucaucucuuacaaaaggcagacugaaaucagaauucccagcauauauauacagcugcuauuugcuaguggaauucuggcaacacuaguuccaaguuguuagcuacauuaugggauaaacugggaauauagucacuuggccaauauuccuaauauuauuucuaggggaaaauaugcucugaauugauaucaacuaaguuagaaguauuccuuggggaugaaaaacccacuuguaaauugguaacuuuucugaauguuuaaugaaauaccuacuugcaugcugaaagcagugcagcagaagugaaaaguggccuggauaagucaagauccacuugcugugucuggggaagacuggacucauagcuaaaggagaaguuauugcagaauuaucuguuagaaaauauuauuugaaaagagacugaaaguaucaaccagaacuuacaagcuuuuaaaauggauaugugugcugucacuuaacacgagucauuuuuuuuaagacugaaaauuaaccagaacaggacaauggauaauuuguaucuaucaguauaaauuuucuggucccccccaccgccaccgccgccccgccccaagacggagucuugcucugucauccaggcuggagugcaguggugcaaucucggcuuacugcaaccuccaccuccuggguucaagcaauucuccugccacagccucccgaguagcugggauuacaggugcaugacgccucgcccagcuaauuuuuguauuuuuaguagaaaugggguuucaccauguuggccaggcuggucuugaacuccugaccacaugauccacccaacuuggccucccaaagugcugggauuacaggcgugagccaccacgcccggccuauugguauacauuuucaauuaagguucucuaugccccauaccuuuuuaguaucuuugaagccauguucacugcuucuauacagcuaaacuguacagcuaggucucuuauuccaauauuugaauucaggcccaguaaacacucaaaagauuuaagacagcucugauaugucuccuuguucaaaccagaaaguuuaauuaaauaagccugugaaaggaaaaacacauacacaaaucauaaaaaccuuaaguucuauauauuaguacccuuaaacacuuguuuaauaagcaguauaacuuuucaaaauuaauuuuguggcaagucacucuaccuaaagguuuagcuucauuuagucaaaaaacugguaaucaugucaggcugaggaaguacugcuuucaaagaguucaaacuaugcaaaggcaggcagucaugcauaugcacagaugauuuaaaauuauaacacaauauuaauauagucaaaauaggcaguaaaaaaccacaggaaacacacagaugguuacuuguguuuauacaaaggugcuaacguguaauuuauugggaaaaggaaggagagaaguagcgggaguggaguagggggcgggguggugagagagagagagagagagagagugugugugugugugugugugugugugcaggagagaaagaggaaaaggaaacuaggaaaagaaacaggaggauccacugugggaaaccagcucugucugggagacuuaaggaaaguuucaauguaacaauaaggcaaggucauguaagacaaauaggaguuugccagaagagcauugcaggaaaaaaacaagguauugcauuuucaaagccacaaaucauugacgugcagagucuguuaagagaauacugcagcuugaggccaggauucaagagaggcuggagaguuugauggucaucaacaaagcuuuguuuuuaguauuaccauuuaaugaguguaucguuaugacacaggugcuguguuaaugguguuauguacauuuaauccucauaauaauccagcgaaauuggauauuuuaucuucacuuuauggaugaggacacuggaggcuaacagagguagcuaguguggagauuugaucucaacaugaaacuccuccugacugaccccaaagcuuguucucucaaacacugugacauuggaagaaaagcauagggguuuggaaauacgugcuuuaaaaggaggguaaugcuagcagcaauguggaagauggccucuagccgagaaagagguggucagggaaaacagugaagaguaaagaaaacauggcaaaaaaauauuuuccaaugcaaaaugauucuacaguauuuccagaauaacacacaagaauacccaggacaauucuaaaacaagaguuuuuacuaggguuuaguucaaccaaaaguuaaaagagcuucaauguugcacuggauuauucagacauucggugggaccuacuuacccuguccaaggggcacuucauccaggaagcugcaagguccaggcacaugacugcacugcuggucuccguggugcgugcggagaggccgacacacuucacccgggacaggcgcaaguacuccucugcuuuccugguuaaaagggcaguguguucgcuacaacuuauucagaaguuugcucaacacguugguaaacaaugaauacagccugguuagcuucacacuaagccuaacuccuguggcucguuuaucuggggcugggaaugaaggucauauccucuggugagaggaagacagaaccagcacugacuccaaacaucacugugcucaaaugcuuucaggcaaaaggaaguuaaauuuugacaaaaaaauuacccuucuuuccuccuuccauuacuggaacaagcacgaacuaucagagacaggcagguuagaccaggguuccuccuuuccuccuauuuccuuuaaaucaguaguucuuaaacuugaugguaggcgaaaaucaccuuggggacuugcaaauuacugggucccaggccgaguuacugaucagcaggcuugaggugggacccaagaauuuguauuucuaacaagugacaagaugauauggcuguugcugguccaggaaccacauuuugagaaccacuguucuaaaugacuaccgaguccugcagguuugucuucaaaucuuuuaagugcuguuuuccuugccuucccucgccugacugcuccacguuuuagcuacaauggcuuuauuucgaaccccggaucccgcuucccaucucaacgcuuuuacaggagcugucgccccugccugggcugcucuugccauaucuuuccucgccuagcaucugccaucaauccggccucagcgggaacggcgccugcuuuuccgaguuuuguuuguuucuuuguguuaaaggcagccgcuaggccgcgcuccaccccaagcccaguggcucaggagcauugcccgguuaaggucuacacaguccucgcccuuacagacagcggggucugcgccucguugucggguuccccgcuauaaacccgacugcaguaggcguuggcggaaugaacggaaaguucucccuggcucauuuuucuacccacggacagggcuggcuguucccagggacgugugccaucgccguuugcuaucgcccuucuugccaucucauucaagcucacggccgagaaguuuuucuugaaguaggcccuaaaccccgcccggccccagcgcuccccgucacucccccgccgcccgucgccugggaagggcgcgggccucaccugagggcccagggccgcgaggcggaagcccagcccuggucuugcgcggccgaacucaccucagcaugucgggcucggcgaggcccaggcgcggggcuaggcgcccgaucagcuccgaccccauggcgccggcacuaaagcgaacaauucccgugaacgccgcgggucaacgaaacccgcgcgcaaaggcugcaccggccagugagagccaggccccacccccggcgcaucuggauugguuaggacaggacguugagaccgucccacaaaccaaucagggucuuccuuuugcgcaugcgcaucaauagcgcaaucgccaacgcagaugcggugaacguggacuugucggcucccccuccuuccauuccuucuugacaaacucaucacacacugccuuucccuccuguugucuccugccugccgccgggcgauccccacugcccugcacugcuccgcccacucucgcacgcuguggugagauuggcuggcgcucagguccguccaucuagcguuaagugacagggccaauaagcacg

SEQ ID NO: 15703 - RNA, 847 nt, Homo sapiens
cgaauaauuuaauuuuaauguuaauuuaguaaguaucagucacggacagauuggaaaaagaaaaacaucugaucccucaucuugauagugaguagcacugguuuacacagcuaggcugcuccuugaaggcugacacugcauuuuauucaaauuuuccugacagugggacuuaggcaauuauauauugaauaaauaaaugaauuuucacucugcugcuggguccaguggucucauaaaaugucuaucauaauuucucaaugauuagccuugguaacaucuacuuaaguuuauuaaaugccaggauccacgcuacgcccuucaccauucauuccccagccuucgcucccacggucucuguggggauggggcgugcccagcacuacggcccgcccuaccuaugcauucguuggucgaacucgacgcccguuacugccgagucccgcccaggccuugcccccucguagucggccaggccgagaggaggcguggccacugccgcgccggggcggucuggcggaggggggggaggucuccccucgucucgugauacucugggcgagcucgcgggcgggcugugggucgcgagccgccgugggagcgcgugucgcgguccccaggagccgccggccgacgcuccgccccgcccccuuggcgcccaggucccgcgcgagcucgcgcacgcgcgcgcgcgcacccgccagaggcuuguuugaggcccgcggggacugggcgggcggaggccgggcugccgaagugugaggggaggagcccgagccgucgcugcugccgccgcuaagggagaggagcaugucugcaacucgagccaagaaagugaagauggccacca

SEQ ID NO: 15704 - RNA, 46968 nt, Homo sapiens
cgacgguggugggugugcgagcgcaggggccgggcggcgcgggcgccgggcgcggggaugcggcugugggcgccggggccggguagcugcuccaggcgcgcgagcuaaccgagugcggcgagggccuaccaggggcgacaggcacguugcaugcaugccuugggcgcagccuuugcgaaagccgguugggugugcguuggugcuucagcggcgccguggaggguccgggucgccgggggaugggcaccagcgccgaagccaggcuggcaccgcucgcugaaagagcccuuggcugggcuugugugggggagugcugcacgccugggcagugcgcgacguguuuguucuuuuucucuuuuugugccaggguuucucuccgcaagcgcgcgaugcagcgggcggcggcgcugguccggcggggcugugguccccggacccccagcuccuggggccgcagccagagcagcgcggccgccgaggccucggcggugcucaaggugcggcccgagcgcagccggcgcgagcgcauccucacgcuggaguccaugaacccgcaggugaaggcgguggaguacgccgugcggggacccaucgugcucaaggccggcgagaucgagcucgagcugcagcgggugagcgcgcgcugggccccggggaggcuggggccgcugagcaagggaaaaaccgcagcagccccagcugggguccuucccacgacguccacccccauggccagcuccucagucagccaagccuggcuaaaacgagagaaugcccccucccgcccguucacuuacuggugcccagcaccgggcacucagugaggccuugcaauacgguucacuuguugaauugaauucgucaauuguugagcgggccgugcugccaggcaccgcacguugugugucugcccuacucucguggaaccaagguccaguggagagaggaacauaagcgaaugaagaaagaagcaauagagucucagugauaaguucuuggaaaaaaguaaaacggaagaggguugggaugggggcggugggagggaaaccauuuuagguaggaggggagacgggguggggggggcucugcggaaaguugguucuguuccccagucucuuucuccgugucuuuggccuuuagggucuuugccaauccugauucccggaagagagucggcagaauuccuuccuuuaggccccucuggagccuuggccgaccagccacuucuguggucuggggacagucaccgagguggggaaccagagaguugggccugucgggcuuugguaagggggcccugggacuuucuucaucuugguggucggccggcuggcuaggaucuuggcuugaguuuauagcuucauguaaggugagcccacagccaggaaggauuucugccuccccacaaccaggaugucuggggugggugauagaggggucccuaggaccuaggagagaguuauagccuggguggaauucaggaggcagagccaggagggguuaucuuaaaaaguaaauacuccuaagauuuguaagaagcuaauaaucaccuagcugcuugcuagagagagucugacugagaauagaagugggaaggaggguuccuugaucuugcccucacccgggucacuagugucccaugaaugcauggcaguaagcuucagggggaucaugacacuuggucccauuccaguggggacuuggggguuuuaaugagcuccugggccuccugagaccuuguugagacacucaguucugcugacucaaaacagugagcuggacaagucagaguccagucuccugcggacuccuugcagggcuaaguuuaaagcuggccgggaggaggcuggcuuuguuucugugccucccuggcccagaggugggccgggcagagaacacaggcuguugaugucuggcaggcuggagcuggcccuccuugacgcaacagccucccugcuaaaacacagcugggauuaacgcguuccugguuuaucacguuacagcugauuucucugguuccugagcuggcagggguuccaggaauuaccucugccuuuugcuaaauagcaacuccugugcuggcuccaugaggcuugaggaugaugaggacagaagggcacugucuuugccuugaggaaucugacugccacguuguucucugagccugaguccccuuccccggauucuuuaagaauguguugggauuuuuuagcaggcagaauacgugagagccuuccaagugggagcagugcugugagcaaccgcaggaaguuggggaguucugggcauuuggggaagggggcuggugcuguaguggaacacuaacagagggaugugggaggugaaugagacagaaaagguggacuggagucuugugugcugggauuaggaugucauggugcguuuuggcuggaguugggaaccaggaaggguuuccagcagggguguguauugaugauugcaggugggcaaauuucuuggucacugggccagggacaucucugauuucugagacagaagcuccacacccccauauccuacuccugaguuaguugaguuuuuuuggccaccuacauucugugguaguuucauucaagcgcaucccuucucauucucuucucacugugagucucaguuccccggcugugggugcuggccagaccagcuuagauagccucauugaaacccuuccuucuugggagacagccuugcuuccccuugccagcuuaaacagugcccuucuugcgagagccacauuuccccaguccuuucuuuuuauuucuggcuugccuucuccuugugcagcuuugguuuuucugcuucuguuuugaacugucgugaucaaaacugguugguuagaggccggccacgguggcucacgccuguaaucucagcacuuugggaagccaaaguggguggaucaccugaggcaggaguucgagaccagccuggccaacauggggaaacccugucucuacuaaaagcacaaaaauuagccgggcauggugguacacgcuuguaacuccagcuacucggcaggcuaaggcaggagaaucgcuugaacccggaagguggagguggcagugagccgagaugcacuccagccucggcaacagagcucagagcgagacuccaucucaaaaaacaaacaaaaacugauugguuagagaugggaugggcuaggauuuguagggaguagggugacuuggggugaauccugggccucagguucccuagaguauaaacagauguggccuggcugggccuggcugggccaggguuuccccugcccucaguuuuauaccuccuuguccauucaaaacuguccuuggggacucagggugacucgugacucuuggugguaccaaggccuucaugcugucuauggaauucuuucaccagguguucugcaaacaaugugggccguuuggcuggacauguggcucugguguuugacuuuggguggcuggccaagcugagucccuauccuuuuugcuucucugguaguggagccugaaggagguggggaggucggcuaagggcugugaaaggggccauucuccugcagccccagcucugugcucuuagaggggccuugcuucucccugacagcagcuccaaaggggagaaccuaucuuagcuuuucagauccugguguucacugcgagcagcacuuaaaaauaagcugcaauuaaaaggaguuuugaaaagaucugacaguucuuccucaaccuacuuuuucccuugcuuuauugggggauggggguuggggauugguacaaguggagacaggaauggcuuugcuucugguuguaaggcaacagucagggcagacauucagaacugaggggaagacugacaauuacugguuacaucaguguguguugcauccaaacaaagguaaaagcagagggugcuaaggcacauggcuauaguuagcuaagaacuaagauuggaaacccugugugugccaagcacauguguugaaucucagucauuguuuucuguggcauuuagaugcuacuuuauuuauuuauugagacugcgucuaauucugucacccaggcuggagugcagugaugcgaucucaucucacugcaaccuccgccucccggguugaagugauccuccuuccucagccucccgaguagcugggauuacaggugcccgccgccacacccagcuaaauuuuuuguauuuuuaguagagauuggguuucacuguguuggccaggcuggucuugaacuccugacuuugugaucugucugccucagccucccaaagugcugggauuacaagcgugagccaccgcacccggccagaugcuacuuuauuuuuuuaaagacagggucucgcucuauugccuaggcuggaaugcaguggcacaaucaugacucacugcagccuugaacuccugggcucaagccauccuccuaccucagucuccugagcagcuuggacuacaggugugcaccaccaugcccggcuaauuuuuaaauuuuuuauagagacuaggucuucuuauguugcccaggguggucucaaacuucuggcuucaaguaauccucccaccuuggccucccaaagugcuggguggguagguaugagccaccacacccagcuacuuuuuccuuuguaauuauuauuaaauaauaauacuaauuguuaauuauagcuguucagccaaacagcccauacuguuugcagagcaccuggcgaaaggauuccauagcucugucacccaggcaggagugcaguggcgcaaucucagcucacugcagccucaacuuccugggcucaagcgauccuuacacuucagccucuugaguagcugggaccacaaggcguaugccaccacgucuggcuaauuuuugcauuuuuuuguagagacaggguuugccauguugcccaggcuguuaauuuuuuuuuuuuuuuuuuuuuuuuuuaaagagacagagccuuguucuuucuccuaggcuggagugcaguggugcaguuauagcucacuguggccucaaauuccugggcucaagugauccuccugccucagccucuucagaagcuaggacuacaggugugugccaccaugcuggcuaauuuccuuuuuuguagagaugggaucucgcuuauguuguccaggcuggucucagacugcuagccuugggugauccucccaccucagccucccaaagcgccaggauuaccugugugagccacugugcuuggccuagaugcuacuuuaaaacuuguagugcaggcuuccaauaggaugaacccuccgccuacccagccugcccaagucagucaccacacauacgcugggcucugccuuugugugcuaugggccuuagacaagucauucagccuugguuuacucuucugcaaaaugugaccaguuuauuucucugaaagacuaguuugagauguuaaugauaaugcuuugaacagcugugaagcuaauuagaccugccaagucuuccuucugaagcuaaugagaguggucuggggauaagaagugcugaaggucgcuugucuuucccacuuccugaggcucugggucugggaaguguucuguggggcuugcucuuuccuccugggccucugccuugcugucuugagcaacucgcacuauccuguuuggaguuuauucagcuuucaccccugcuucugccuuggaaucugggcuucuauaguugaccaccccacggaugcccagaguucaggggccuacacccugucuucccugccucagugaucuggcagcucagcccuggaggcucuugccugcacucucagucacagacguguguagcugcagcuccgguuucuucugguuucacuugucuuucuguuuugggaccagaucuugugcugagccucagcugugaaauggaccuguuuucugggacuguggggucuaguugguguuugucuuuggggccucuugcuggagcuuucugcccgcccuagccccagucagugcccuuuuugggaucaggagcccgggagcauuuucacauugugcuccuaggccugggaccugcggguccucucucccacacccugccauucuccuucccugcacccccuucuuauucuucaccagccugggcucaggaggguggcggucucaucugugcuacucauggcugucacuggggcaugggugaccaguauuuguugaauuggaggaaaguucucugccauccuuucugcccacaggccaugugaagugaccagagccaucccuugcauaaggaaacagccuugugccuguuuuuuucuccccauuuuuauugagggggagacaaauauaauugacaaagaaaaauuguauauauucaagggacacaguguggugguuuaacauuuauauacauucuauauguaauaugauauggaaaugauuaucacagucaauuauuaauacuccauccuuuaccacacauagucaccaucugugagugugcgccugagacacuuaaguccuguucucagcaaauuucaaguaaaaaauacagguuuuuuguuuuggcuuuuuuuguuguuguuuguuuuguuuuugagauggaguuucgcucuuguugcccaggcuggagugcaauggugugaucucggcucaccccaaccucugcuucccggguucaagcaauucuccugccucagccucccgcguagcugggauuacaggcaugcgccaccacacccagcuaauuuuguauuuuuaguagagaugggguuucuccauguuagucaggcgggucucgaccucccaaccucaggugauccacccgccauggccuccuaaagugcugggauuacaggcaugagccacugugcauggccgaaaaauacaguauuauuaauuauagucaccaugcuguacauuagauccccauaacuuauucauauuuuuuuaaauuacuauuuuuuugagacggagucucgcucuguugcccaggcuagagugcaauggugcaaucuuagcucacugcaaccuccgucucccggguucaggugauucucuugccucagcuuccugaguagcugggauuacaggcaccugccaccacaccaggcuaauuuuuuuuuuugagauggaguuucgcucuuguugcccaggcuugaguguaguggcgcaaucucagcucacugcaaucuccaccuccugacuucaagggauuacccugccucagccucccgaguagcugggaugacaggcacacaccaccaugccuagcuaauauuuccugaccuugugauccgccugucucggccucccaaagugcugggauuacaggugugagccaccgcgcccgggcaguagauguauuauuuaugagguacaugagauauuuugguacaggcauguaguguguaauaaucacaucaggguaaaugagguauccauccccuccagcauuuguccuugucuuacaaacaauccaauuauauauacucuuuuagcuuuuuuuuuuucaauguacaauuauuauugacuauagucacccuguuguggugucaaauacuagauaauuccuucuacuuuuugguacccauuaaccauccccacuucuccccacccaccccuacugcccuucccagacucugggaaccauccuucuaugcuccaucuucacgaguucaguuuuuaaaauuuuuuagcucccacaaauaaguuacaacuugcaaaaugugucaucuuacaacugaaaguuuguacccuuugaccaacauugccacauaugcacucccccaaccccacugcuggcagcuaucaccucugcuuuuauuaguucaacuuuuuuagacuaguuuaacuuuuuuagauuccacauaugagugagaucauacaguguuugucuuucugugucuggcuuuuuucacuucacauaguguccuccagguucauccauaauuuugcaaauggcuggauuuucuuauuuuuuaaauggcugaauaauaguccauuguguauauguaccauaucuuuauccauucaucuacugauggacacuuagguugguuccauaucuuggcucuuaggaauagugcugcagugaacaagggagugcggacaucucuucaagacaaugauuucauuuccuucagaucucuacccagcagugggacugcuggauccuaggguaguucuauuuuuaauuuuucgaggaaccuccauacuguuuuccauaauggcuauaccaauuuacauucccaccaguggcgugcaggguucccuuuccccacacccucaccaacacugaucuuugaacuuuuuauaauaaccaugcuaacaaguaugagaugauaucucauuguggcuuugaauuguguuugauuagauguuuugcaucuuuuucauguaucuguugacgauuugugugucuuuuguggaaagacucuucacauccuuuguucauuuuuacaucagguuuaaucaguuuuuuuucuugaguuguaugaauuccuuauuugcauauauuugauauuuggauauaaggaucccauuaucagauauuuuguuuacaaauacaguugucucucaguauccaaggaggccuucccucggauaccuaaauccaaggaugcucauauaaauggcguaguauuugcauaugaccuaugcacauccucccguauaauuaaaucaucuuuacagccucuauagauuacauauaauacguaguacauauuguguaaauaaugguucaacucuauuguuuagggaacaaugacaagaaaagucuguauguuuguguuuaguacaggugcaggguuuuuccugaauuuuuuguuuguuuguuuguuuuuuguuuuuugagucggagucuugcucugucacccaggcuggagugcaguggcgcaaucucggcucacugcaggcuccgccucccggguucacaccauucuccuaccucagccucccaaauagcugggacuacaggcgcgugccaccacgccuggcaaauuuuuuuguauuuuuaguagagacgggguuucaccguguuagccaggauggucucgaucugcugaccucgugaucuacccgccucagccucccaaagugcugggaauacaggcuugaaucaccgugccugacccuuuccugaauauuuuugauccacgguugguugaguccgcagaugcuggagccacggaugcggaggcugacgguguucccuuccgugggccgccuuuuuguugauuguuuccuuugcugugccuuguuagaauauccauccgccccugacccucaugcuggugcgaggccuguggguuggggaggacaguuauucucccugcuaacacccuaugaaauaugccgucccuagagcugggggguuggugcccuccccugaucccugcuugagccaaagcggcgggaggggagcccucccugggaaggaccuuccgugcaucugugccgcacaggggagguggcucugggagggauaugugcagguggauucgaagguggcucuagaaugccgugagaggaaucaggaugcugcggcuccuuagucccucugagcuggcagggcccugagggcagggcaggggcgagguucccaugggugcugugccugugggcucuggaccagucacucugggagucuaccccagggcucuugguauuucccaucccauguagaccuugaguucccggaugcaggagugugcucagaacaguuucuucugcaugguggcccuuggcugggugggcugguuucuucacccauucaggguagccaguguccugacccccagcucauccaucauagcaaaguguccaggaucugcaggcaccaagacccaagaauggaggugcuguguucccaggcuucgcggcagcggcccugcauuggucgagcagugcggggggagggcacgggaaaggaacauucagggcucuguuccaggcguuauucucucccuguguugggcuggcccagggcccacagcuguguguugguuccugggccucacaacugugacagauuuacucccugugaagaaugggcuguauccacaucccagaaaucacccagguucagcgagcuagaccuggggucugcaacaauucagucaggcugagcaaggaccccaugccaggagcccaggccagugccaagcaguggaucgggcccgucccuuugcacacagaggcuuggguaacugcccacacccucaaccuuuugggauccuggcugugggaugagugugggggcugcacaccccugcagccagagccucuccagagugccuguacccccaugcagugggcagugcugcccuggcucuccagacacaguggcugcgucuggaugccacugggaaucuuuuuuuuuuuuuugagacggagucucgcucugucgcccaggcuggagugcaguggcgaaaucucggcucacugcaagcuccgccucccagcuucaugccauucuccugccucagcgucccgaguagcugggacuacaggcgcccgcccccacgccuggcuaaguuuuuguauuuuuaguagagacgggguuucacuguguuagccaggauggucucgaucugcugaccucgugauccgcucgccucagccucccaaagugcugggauuacaggcgugagccaccgcaccuggccgccacugagaauccuuauccauguuggccagacacugaagaacucagcagaugggccacaaggggcuuagaggacccccuuccccgagaaacauagcuuguaggacuuacgcccuguuuaugaugguccagagccacuuccggggcaucuucagucccccaugccuccuugcuuagggcuuagggguggcacacuagggccagaaaaacauguuuagcugcugcuuuugucucucaagccugcugguuuguuguuguuguuuuuaggagacagggucaggccaggcgagguggcucacacuuguaaucacagcacuuugggaggcugaggugggccaaucauuugugcucaggaguucaagaccagcuugggaaacaugaugaaaucccaucuccauuaaaaauacaaaaauuagccggguguggugaugcuuaucuguagucccagccacuugggaggcugaggcaugagaaaugcuugaacccgggagguggagguugcagugaaccgagaucacaccauugcacuccagucugggugacagagggaaacccugucucaaaaaaaaaacaacaaaaaaaagggucucacucugaugcccaggcuggagaguagugacguaaucauagcucacugcaaccuugaacuccugggcucaagugugauacucccacuucagccuccccaguagcuggggcuauaggcaugugccaccaugccuggcuaauuuuaauuuuuuguagagacaaggucuugggcaacuugaaaguguugcccaggcuguuguugaacuccuggccucaagggauccuccugccuuggccucccaaagugcuggaauuacaggugugagccaccacguccagccacugguuuuuacuuaagguguacauuacugauuuugaaaaggccaugucuucuaaaguugcuuuuauucacacauugcaugaaaaggagaaaagacaagugucacaagcacagaguuauaucuguaaaauuuguauuugggguaccuuuggggaaggggcagcuggagacaggacaaaggccaggcccucccacccgggcuguggccaccaccuugcugagcccguuuuuccucccacugugacccuggugaccuuguuccugggccggcuuuuguaagaugauauuuguacucugcuaagggcuuucacacuguuuguuucagguaauccuuucagcugcccugggaaguccuugaaccuguuguugacugcauuucucccaguggcugauuggguuuaucagggaaaugugcaggauucccacguuuccaggucccuguaauucucuaugucaagcucugcuuucgccuuugcagcagccaugguguccuucugucaccuccccagugaugucacaagggucuuggacuucucucugugaucucucuucugugcuacacacauugcucaggcaguggccucaauuugcucuucagucagucuuuuuaaucccugaugcuuuuuuuuuuuuaaugugaaaaucagcccagauuuuucauucugcaaagaauggguugcaagaaaaugacccugaggauucccugcugauccaugucuuccgauggggaggguguccucagugucccuggcuagucauuuagaccauugcgguagagcugcgccuggggcaggaugcagaggagucugggacccugugugccugacauuuggcauguucugcugcugaccccugccucccucccacacaucuggcccggagcugccuuuuagacuucccugugugguggcagucaggcagcggagcagcagcuguucgggaugcuugggcagccagaaaagcucuuccagcccuucuggaaagugggaggcagaggaggagcauagugguuaagaagagugaccuuggaauccgucuuccuguacuuauauucauucccagcacuuacauuaaucaguuauguggcugggcacagugguucaccccuguaaccccaacacuuugggaggccaaggcggaggaucgccugagcccagaaggucggggaugcagugaaccaugaucacaccacugcacuucagccugagugacagagugagacccugucucuacaaaauaguaacaauaaguaauaaauaaaauuauguuggucaggcgcaauggcucacgccuguaauccuagcacuuugggaggcugcgguggguggaucacaugaguuggagaccagccuggccaacacguugaaauccugucucuacuaaauacaaaaauuagccgggugugguggugcacgucuguaaucccagcuacucgggaggcugaggcacgagaauugcuugaacccaggagguagagguugcagugagcugagauggcacuacuguacuccaucuugggcaagagagcaagccucugucucaaaaaaauaaaauuaugugaccuugaggaaguuucuacccuuuaagagccuugauuuccucaucugucaaaugggauuaauacuaguucuuccucaugggguggcugugaagguuaaaugagaccaggcaugucaaaggccuggcaccaagucagauacuugguaagccucaaaauagggcuguuuauuaauauccugcgggaaccuugccuggccucuggaauccaggguuuaagaguuucuaaguaaccaccuguugcuuucucucugcccaggguaucaaaaagccauucacagaggucauccgagccaacaucggggacgcccaggcuauggggcagcagccaaucaccuuccuccggcaggugagccgcccccaggagcagaggcugcaggagggcagggcccugggcugggcgggccgucauaggggccguccucugcccccucgauguccaggcccucccagccugauacccucuggcugucucccuuagccuccuuccugccuuucugagguuguugaaaauucccagaccuguuuugggguugcucugguguaggagccucccagggagacucuuccacaaggcgggguccugggagcugaguuaggaacuuggugggcaaaggcaguggugggguaggcggcagcccagaggacagggaaaggcuggcugggcugggaggaggcgucggggggcagcaggaggugucauggugggggcaggauguggcuucccacuugagacccuccugggugugagugugggcucugcugcguaccaguuggguggcuuugggcagguggaaguuggcagagcgccgccucgggagauugccgggccuuggugaggcgaugagugcagaggccuccuggggcccagcacaggagcuccagauuggggacggccacugugagccgcugcaccccuggcugccucugcagugacccagcucccuccucaggcuccaggagaaggcggcuuccauguuucagucugagcacuaaccucgagagugcugccugggccgggauugugggauuaugggauuggugggcuggaggcgguggggugggagaugccccagggcaggacagaggcgggagacccagugugugacagcuuuuucuagaaggacugaggccuguuuuguuuuauuuagguuuuguuuuuguuuuuguuuugucgcccagguuuguuuuuguuuuguugcccagguugcaguacagugguaugcucucggcucacagcaaccuccaccuccuggguucaagcaacuuuccugccucagccuccugaguagcugggauuacaggcaugcaccaccacgccuggcugauuuuuguauuuuugguagagaugggguuucuccauguuggccaggcugguuucaaacuccuaacuucaaaugauccgccugccucggccucccaaagugcugcgauuacaggcgugagccaccauaccuggccuguuuuauuuauauuuauauacauauauauauauauauacguauauauauacacauauauauacacacacauauauauguguauauauauacacacacauauauguguauauauauacacacacacauauauauauauauauaacacacauauauauauauauauauauauauauauauauauauauuuuuuuuuuuuuagagacagagucuugcucuguugcccaggcuggagugcgauugucaugaucacugcucucuguaaccucaaacuccugggcugaagcaauccuccugccucagccuccugaguaucugggacuacagguguaugccaccacacccagcuaauuuuuaaaauuuuugguagagacagggucuugcuguguugcccaggcuggucucgaauuccuggacccaaguaauccuuuccugccucaaccuccugagccacacugggauugaggcccauuuuggaucaaaaugcagugcugugugugguuaagguucaugggcuagggccaucagggagguugagccccaagaacaccaguucccuguucccugccuuguucucuggggcagagggcuggggaggggcugggagggcucagcccacagccccugagggaguugucacagggcagugagggagaggagcugaggcuggcccuggucugaggggcgcucacugggccucccucccacagccacugcugcugacccuuggagcaggccagcagcccuggauguuagaguccccaugcugggcccaggaaggggaaaugaaucagaccacacagaguggcucugccagggaaaugaggugggaggaggccagagggcccugacuucccuggagcgugagcuuugaaggggagggccaagugagaguggccucucaggagagguccccucaugggccuggguuuaaguuguggcaggcuucagaacaggccuuacucagccuuauuugcuggagacguguucccagguccagcccugccacugugcauggcaggcccagccucuccagccuggugccagcugccucuagccuucacacaucuccucugaccugcgcaggugcaccugggaggcgggcaggccagcucagugcccauugugcagaugaagagaagcugggcuccaugaagccaggcgcucgcugaagucaccccacuggugucagagccacaaguccugacccccucagugcaccuggcuuggcuccucagugccagccucaacuugccgggcgagcugggguuaccagcacuuuuguacacauuugcuugcuuaauccucuuaauuugugggguuggggugauguucucuguuacagagaagagaaagcugguccaguuuucaucuagggaggaaagggggugaugaggaaugcagggggagggggccuagggcguugagggagcucaggcugggaguaggggguucugcagccaugcuccacccagcugggcaucgccugcccccugcucugcaaaccccugauugugccuugggugugugagcccacugucccuagcggaagagcuugggccaggggcgaaguagcagccucauucugaucauuggcuucucuuccagcagcccaggucauagugcaucccaacucucaacuucuccccuucugcugcagagagcccagcgucuuccccucccacucccaagcucccacaggcugaguccucgcagagaggcuugcgucagccccaucccugggagcugucauccucccaguggccucugugcuccuccuggagcucuaggagugggggugcugggagcucagccugugucuuguucccccaggugauggcacuaugcaccuacccaaaccugcuggacagccccagcuucccagaagaugcuaagaaacgugcccggcggauccugcaggcuuguggcgggaacagccugggugaggccccaacuugccaggccccuaggcgugaaaugaaugaguguucccaggcggccccagccucaagcggaggguccugcaugcgaaugggugugugaacguguguggguggcugacagcacacagaguaaacaaaaaauagcguccucuucccacucacaccuugcuggccucguuuauuaagcaggcggugccggugccaccuuuaggugcaagugccugcaucaugccgggugugggugcuccuccugggagccagccucauuggacagcagcugagccugccuucgucacagcagguuucacccagcagcuggaggccagguagaaacgcagugcucaguuuuguucagcauccuugccucucuguggccuccagcucugaacaugucucugcacugucuuggagauggcagccaauugcuagggaagggaagcaccuugggaccccuccagccccuuucucuggcuuucuucagucugauggugccaguacccccugguacuucaugguguuccccucaagccggcccucacucauccuuucagggacccaugccccaaugucugcauccugacguggcaccaggcuccacagaguggaccuggaacuuggccccuguagaugugaagaugauucucucccuccccugcggugauggaguuccagccucugggccuccagguuuuuguucugucauuuucuuuccucuguuuauuucugcugguuccuucaugcagcacccacgcugggaauccagcuuccuucgcccugaggaaaacugcuguuguucuuagagucuuccuaggauaugagcccugauguucccgaaaguggagcugaggguggggacagauucccguggcuugcucagcaggggaguggccccccuuguugucuccaucucccgccacccccgccaacuuuuucugcuccgucccuuauugacggcccugugcuuacccuccuggcuguggccccccugcccucccuuugagucuggacacugucucucucaggagggggccagcugccccuugcuuucccaccugccagccuggauggggugugggcuggggccuugugugccaagaccuaaaccacaggcuggcagaaagcagcccugcagcccagaggcccggcuuccgggcuccuuuccccccugcacccucugccuggccccaagggcaaagguguuucccaaagaccccguggccaugggccuaaaacuccuggaagcccccaacugagaggcagggggaggggaaugugccuuuugugugucugaugcgagugucuggggaccagguacggauuuuuguuccacgugcuaagccucaucaacagguuuuugcaacuucgugugagccagagcugggguaguggggcugagagacugugucccugugaguucccucgugggguauuacagcaaaagaccaguuggcccucaugguuuuugggacccacccuaagcccuguuccaggaccucauaaacaggugagguaggaguccuuggagucucucucauccuucagccaggaaguacuuuguacccaccuccucggcuugcaaggaagguucaugugugcuaaagccccuuguuagcuguagacaagcccugcccauuccagggggcaggacagugugguccuucgcgugacagggacauaguggugucgcucucugucaccuacgcucugggcagccugagcacuuuucugcccacaggaguaaaaagaaauggagcaugucacuaugcuccauggccacccugacccacagggagauuauuaaauauguauacaaagucuugaagcucauccagagauuuuauuuauuuuuuugaaacagagugucacucuguugcccaggcuggaagugcgguggcacgaucuugguucacugcaaccucugccucccggguucaagcgauucuucugccucagccuccugaguagcugguacuacaggcacgcgccaccacgccuggguaauuuuuguauuuuuaguagagaugagauuucaccauauuggccaggcuggucuugaacuccuaaccuccugaucugcccaccuuagccucccaaagugcugggauuauaggcgugagccaccgcgccuggccacucaggauguguuuuuaucauacccuuuaaaauuauuucuugggccgggcgugguggcucacaccuguaaucccaguacuuugggaggccaaggcagguugaucaccugaggucaggaguuagagaucagccuggccaacuuggcgaaacccugucucuacuaaaaauacaaaaauuagccaggcauuauggcgggugccuguaaucccagcuacuugggagacugagacaggagaauugcuugaacccaggagguggagguugcagugagcugagaucaugccauugcacuccagccugggugaugagagugaaacucuguccccuccaaaagaaaaaaauauauauuauuucuuagcagggcuucauguuuuuguuuuuuuuuucuuuuuuccuuuuuaagagauagggucuuuccccgucacccaggcuggagugcaguggugcaaucauagcucacuguaaccuugaccuccugggcucaagcagucuuccuguaucggccucccaaguagcugggacuacaggcacacaccaccacacucagccaacuuuuauauuuuuuguagacauagggucucacuguuguccaggcuacucuugaacuccugggcucaagcaaucauccugccucagccuccagaguaguugggauuacaggcauaagccaccacacccagcaacuucauuuauguucuguuugacgagcaauuugguucucagguuuguccuggaucucaaugggguugagguaaaaccuagcaccugccugggguggggcaggagcugugugcccuugucaagccccucccugaguacauaccaggcuguguucuagacaccaaagacacuggugagcaagguggguggagcuucugugcucacaaagcuaucagauuugggagaaacaaacaugaaaaagaauauauacgaauguguaaucacuaguucucaugagaucucggagagagcugcaggauuauaacgaggggcucuaauggagaggaagagcuuaaggggaaacguggcauucacgcucauggggaggaugaguaagaaccugcaaaugcaugccggaccagcgaacagugugugcaaaggcccuaaaguugggaccuccaugugacugaaugaaggggcccuagggcagugguguucgaugaggugggaguuuggcaguggguccucagcaggguguaguggagcacagcccgcagugggcaaggugcuccgagagaaaugcacagaagaaacggguaacagccccugcccuggaggaaccaagagucaagagucagcguggggagggcagggcugcuucuguacaaaauaacuggaggggccagcacaguggcuuacaccuguaauccuagcacuuugggaggcugaggugggagaauugcucgagcccaggaguucaaggcugcagugagcuaugaucgugccgcugcacaccagccugagcaacaaagugagaccuugucucuuaaauaaacuaauacauaauaaaguaacuggagaaauuauaggcugagagauuggcuggagguggagcagaaucuuuagggcaggccuccgggagacagacuagaaaugagccuagaaggaucagugugguuuggagcauaacgugagaucugaagaaaaagaaacccaggagccuccuuggaaggguagaaagucugugacccgcagaaguaacauucagagaagcagagggcuugcuaaugggugaaggccuggguguucagggaaguggaugcucuuagaggcaggaagaaugggaggccuugaggaggagaagguggggcauugaaaaggggugaagggaagcaaggaguccuagaaggucucucuuacagaagcucagaaauagcaacuaaaucaccuauugggggagggcucuaacaccagcaucugcaccuacccuuuuuuaaacuuacaaaauacuccaaauguauuagaauacucaaaauaacaugacagaagcccaugcccaccacccagagugacacaaguuaacguuugccaguuggcaccuuagaguguugguuuggcuguuccuuuuacagcugugcagagcccaaugcugcgcagagaggcugaggcagagcuaggggauuccaguucagggcuuuuuuuuuuuuuuuuaaagaccgucucaaucugucgcccaggcuggaguacaguggcgcaaucuuggcucacugcaaccuccaccucccggguucaagugauucuccuuucucagucuccugaguagcugggauuacaggcaccugccaccauaccuggcugauuuuuuuuagagaugggguuucaccauguuggccaggcuggucucgaacuccugaccucaggugaucugccugccucaaccucccaaagugcugggaguagaggcgugaaccacugcgcccgaccccaguucagagcauuugacuguguuccuccucgaugccaggccuggacugaugcaugcugaggccccagaggagaaucugcuacuuccagucgccauccugccuccugggggugguuuuugcaguaaccacagaaggaauagucugguuuucuuuaaaugcaguguaaaauucaaaagaucuaaaagaauauacaaugaaacaucugccuuccacaucugacccccagcccccaugcacuuccacagggaauucaccucaccaguuugagucuucuuccagagagaucuugcaccuguacaaauacaucuuuccauuuuauuuucaaaaaccuaaauagcggccugacauuuaaaaaaaucuuuuuuauggagguaaaaauguuaacguacagcuggaauaccuuucacacaugcacacaucgaugucuccccaccaggcucuggauacggagcugccaacccccuguacacucucucaugggucuuucuagucaauacccccaccccagagcaguuaaccacugcucagcuuccaggaccauucguuaguuuuaccuguuuuugaacuuaguauaaauggcuuucaacccuaaauggcagcgggaggguauguucacaugggacuggaggcuggaggaugccuugcagucccaggguucugugguugaugcuggucagagcccugggugccuggggcuggccaguggugcuaaugugggguuuuuguuuuuauuuuuauuuauuuuuuugagacaggguuucacuccaggcuggagugcaguggugucaucauagcucaccgcagccucuaccuccugagcucaagcaauccucccagcucagccuccaaguagcugggacuauaggcgcaugccaccacaccuggcugauuuuguauuuuuuguagagcugagguuucaccacauugaccaggcuugucucaaacuccugggcucaagucauccuccugccuggccucccaaaaugcugggauuacugcgcccagcccagggggugcuauuuuggagccuaaguguuggcccacucucucaaguccuauggaaccauguguaggcaaccaugguaaaggcaugggaaucccagcucuagugacugacauugucacagaucacauauaaauccgaggaggguggguggaacaguuguggacaccauuugacugaguagaagccagggccuagaauaauguguaacgcauaguagguacucagucaguacugggugagugaguggaugaguggauggauguguggguggaugaguagauggguggauggauagagggguggguggaugaagccaagacaggugguuaagcaguuucccacaguuccaaagcaaugggaguugggccccaccccgagacccucaccccaaacaggcaucccucuaauuauauggauguuaauuauauugacccuguggagccagacauccugccucuguuacugucuugccugcugucuuacaggguccuacagugcuagccagggugucaacugcauccgugaagauguggcugccuacaucaccaggagggauggcggugugccugcggaccccgacaacaucuaccugaccacgggagcuagugacggcauuucuguacgugugaggguggcucguuguuauccgguguuuacccacaugaagagcagccuugccuguuagggcccagcauuggaauuggcuagcagggaggguggcagcacggguggccacccucuggucccccagcccuggcagccugcagucuuugccucuuuuagucuucaugagccuagacacuacugcagccucgauuucuguccggagugcacaccagcagguccagcugcagagaagccgggggacacccgaggguagccacuggccuuucugugguucugcacguacugguguuccuccugugccaggugcuggggagacaaugggaaaccaaacacaucauuuggccucugccuacacaggcagagcagaccagcugauaucacaaaaauaaaugcacaucacaagcuuuuaguuucucuucugcaguagagaaggacaggguguuaugggaaggagcagugggaacuccgaccugguggagcgggggcaggaagucuccaaggaaggccgaguagacaccgaccugagggacacacaggagugaacugggagagggggugugcucugagcugaaggucacugugugcagaggccuagagcuggcaggagucugagugcugggaacuggagaugcugggggaugagugcacagcaagggucggaguuaccaggcgugggcuggcaaggcagcuggcaccaguacagggccuuagaggccaugcugaggauuugggucauugugcuaagaacaacagggagccacugaaggguuugaaggagaaggagguggagcaguuagauuucuguuccuaaguuuuaauuuuggcugggaggggcacaggaggcaaaaggagguaucucgggcuggggucagcuaccgauggggucggggagggcuggggccagugguuacuugcagucuggagugcaguggaguuacuugcaguggagucuacaguccugggcuugggggacugguggagccugcaguccugggcuugggggacugguagagccugcaguccuggguuugggggaccgguggagguuucaguccugggcuugggggacugguagagccugcaguccuggguuugggggacugguagagguuucaguccuggguuugggagaccgguggagccugcaguccugggcuugggagaccgguggagccugcaguccuguguuugggggacugguggagccugcaguccugggcuuggggaagugguggacuacaguccuugcgggggacugguggagccugcagucccggugggggacugguggagccugcaguccuguguuugggggacugguggggccugcaguccugagcuugggagacugauggagccugcaguccugggcuugggggacugguggagucugcaguccugggguggggggacugguugccugccuaucccuuucugcacacgccucccagggccuggaauggugcugggugcugucaacucaucuguucucagggagccaugugcugucugaacgcuuccuuuaauggggcuuuguuuccugaccuguaaggcucuuguuuguugagugcuuuuuuccuuucccaaagccuuucuuacacguuaagcucuuauuggagcccaugggaaauggaggcccagagacauuaaguggucuaccugccuagagucaguucuugugacauuugggacucuaacauuggagcuccagcuaccaaucacaucaucuuccauugccuucugcugucaaggccucucuugaaucccagaaaugcccagugugggaagagguccuggaggagggaagggggcguguccacaagauucaguggaaagaaucaagucauuguacuuuaaaaucucguggcauuuuuguagcaaggaacugagucugaaaaaggaccuaugcccguguuuaagguggagacucucccugcagaggguuuugucuaauuaauucaaugaauuacuggcacauccaccaauaccccaaaggaaucccauggccugguuucucagaaaucuucaacaagcauccugcucagcuuggaaaacaggucaaagcgccaccugguggcaguagauggguauuuuaucccauuuuaagaguccccuguuggggugggugugggguggggucuuuccaaccuugggcacuaauacugauaacacacauuccugggccccaccccugacauagggaaucaggauuacaggagcagggucagaauaauucugagacagggcuagugugggaacuauuuuagaaguauuaaaaauacaaguauugagucuguuuaaaaauauauauuuuuaaaagaaaaauaauauuuuuaaauuuuuaaguagggagguggaggucucacuguguugcccaggcuggucucgaacucuuggccucaagcgauuuggcugccucagucucccaaagugcuaggauuuuagacgugagccaccgugcccagccuaaguacugagucauuaacuacacguucugcacugugcugagaacuuuagaauguuguauuuugcuuacuccucgcagcugcccucauuuuacagaugaggaaacugagacucggggaaguaaagcgacuugcacagaguuggacuggaggcaugcaguggggccacgggugaaaggcuaggucagggaugggaaguagugcuggcuuucuagaugugaauucucuguugcagacgauccugaagauccucgucuccgggggcggcaagucacggacaggugugaugauccccaucccacaauauccccucuauucagcugucaucucugagcucgacgccauccaggugaauuacuaccuggacgaggagaacugcugggcgcugaaugugaaugagcuccggcgggcggugcaggaggccaaagaccacugugauccuaaggugcucugcauaaucaacccugggaaccccacaggucugcacuuuacuuccucaccaguuucguagaggguggggguggcugauacacuggcugucuagaaaccagaguuaaauaauuggagggucucucugccccuaguuucccuuccagauuugcuaaccuaaagccaugaaauuugccacaggccaccucaagaggugaguaggccaggugcgguggcccaugccuguaaucccagcacuuugggaggccgaggcagauggaucacaugaggucagaaauuggagaccagccuggccaacauggcgaaacccugucucuacuaaaaacacaaaaauuagcagggcaugguggugugcgccuguagucccagcugcucaggaggcugaagcaugagauuugcuugaacuccagaggcagagguugcagugagcugagaucacgccacugcacucaagccugggugacagagcgagacucugucucaaaaaaaaaaaaaaaaaaaaaaaaaaaacuuagccagguguggugguacaugcggucccagcuacuagggaagcugagguggaaggaucgcuugaacccaggaggcagagguugcagugagccaagauuaugccacugcacuccagccugggcaauagaaugagaccuugucuaaaaagugaguaaaugcagacauuuucuggggcaguuugaauaauaauuauuauuuuauagagauugggucuuacucuguggcuccaggccuggcugaagugcaagugguaugaucauaacucacugcagccuugaacuccuggagaucuuccugucucagccuccugaguagcucagacuacaggcagcaccaccacgcccagcuaauauuuuaauuuuuuauuuuuguagagacagggucuugcugugugucccaggcuggucuuaacuccuggccucaagugauccucccaaagcacugggauuauaggcaugagccacugcacccagccaggguuguauuguuauuuuuaagacugguuuuuuggguguuuuuuuccccuguucuucauuugcaaagacuugccuccuugagauuauuuacucacaaacuuaccguuaaucauaggccucauuuuaccgucacucuuccuuauuuuucugaacuggauuugagaaugcugguguguguguugguuuuucuuugauacagcacugcuguguaccuuuaaggccugagaggaaaaugucauauucaaaacaaaagcaacuaaaccaaaaaaaccacuaauuuccagaaguugaaaagcacccccaauuuugcauauuuuucuuuaaaaaaaagucugcaguccugccuguuuugaucuuucugggccgcugccuucauaugcccccagugcuauuuggacacagggaacaagggcuccucucuccuccuuuguugagauaaauugggucagggccaaaaugcauuggaguugguuguggaaucuguuucucgggaacaucaaaugaugcuucagucagcugaaaacaccccuugaauucccgagugcagaaaaugggugcagcuggcgauaccacuggcuuguuuaccccagcuccugggagugugggggauaaagauucaguaggaaaauaacauagagcuggcuucucaauccugguuguacguuagaaucacaaagggaacuuugaaaaaugucaaaauugaggccacacccuaggaucucugagauaucgguagccugugcugccgaggcugagacccacugccucagaagcauggugcccaagcugcggggccccacuucagacacuuggauguaauugggccgggguaugguuugagaguuugcaucucuaacaaauucccaggugauacugaugccgggcccaggaccacacuugggguagcaaguucugcaacaucuugggaaagacacuguaccuaguccacaucacagagucaacacauucuuggccagguguuuacauaaaucuuuucaccugacugagaagaagucauuguaccagagaagucuccugcucugaguaaagaggucauuuucuauuaaucugauauauugacauaaguaauuuuuauaaagaauaacuuuaugagugggcaggaccuggccuugcucccggggucuucacugugugagagucagucagcugugagaagagggucucuggaaaauagaaacccaccugugaugaccauaugucuugucuggaccacacacugugaccaggguggcuuaaaggugucagaguggacuggguucuuaaaccaggacccuuuugguuucaagacagaaacccaacuugagacugaagggauuggaggguggaacuguggagugcaggguugaagcagugcgccugagucagaguccgugucacaggagccucgguacccuccucagcuguaccuuccucuggguugcaguccucaggaagaauccauccuuggaguggcuucagcacuuucagccauugccaucagcugagcugccuuacagccgagccucuuccagaguuucaccauucccaaguugggucaccugcccauuccugaaccagucaaaucccugggacucugauuggcagcucugugucccaggccucccgcuggaguuccccauaggacagugguauuaggccauucuugcauugcuauaaagaaauaccugagacuggguaauuuuuaagaaaagaggcuugauugguucacaguucugcagacuguacaggaagcauggugguaucagcuucuggggaugccucaggaagcuuccagucaaagcggaaggugaagggggagcacgcacaucgcauggcaagagcaggaacaagagagagaaucagggcggggcaggggaugccgcagacuuucagggucugcucccuugacccaaacaccucccacuagacccaccuccaacauggggauuacauuucaaugugagauuuggguggggacaaacauccaaacuacgugaacagucgugaucugucacucaaaggaggaugcucagucaccagcuacagauguucccaucagcuuuuggggaauuaauuuggcccagccucgaaagguacuugggagaccccucuccagccuuuggggccuguaucaaagccaugucucaugucucccccagcugugcccuggcuucucuaaugccauuuaugacauucccuucuccugcgccacuguucaugcacuuaucuguucacuggcucagcgggcaugcucugaggcgcuggagagaacuaaguucugcccuuauccucacgcuguguguaacagcaguauuauuugcacacacugggucucauuuccuuuacugggcugaagucuuuuuaaggcucugguucuugcuuagucacuuguguuuccuuuagcauuuagugaacacagcuuuucuggugcucaaauccugguuugcauuccaacaggauaaaguuuguggcaucacaagcauggaagggcaagaccaggaggaauuacaggcagguucugcuguccucagaaaccagcccuucucugucugugagaauaguggcugguuucuuauagaagcuggggccugccacccuccuggcaucccagaacccugagcuuuuuaaauaggaagccuaguuggugcuuucuuggcagaagaaaaguugguccguuaguaaaggaauugguucauugcuuagcuaguucaagauagaaauucuaauggaaucaugccacagucuuacaagguacguguguauguuuuuuccaggcauauuuuuuauauuuuuccauagaccagaauauagguauuauuaacaaaaagguaagauacucuauauacuguuuugcauauauauauauguauguauauauauauguacacacacacacaguaauaggcuggguacagaggcucaugccuguaaucccagcacuuugggaagcugagguugguggauggccugagcccaggaguuugaggcugcagugagcuaggaucauguaacugcacuccagcaagagugacagagcaagacacuguaaagaauauacauacaugcauguauagaaacauauguacacacacuuagauauauauguaauauacacaggcauauaguaaacaaacauagcccuuguuaagaaguuagcaagccugauuauaguggugguuuuccagaggauauugugagcacaucagauauucccggugccacacucaaagcaggucucaggaaauaccgagggaaggucccauuucuaccucguugcguuuacuccuucccucaccuguacccauggcauuucgugugaacggauggaucacuaucuugcuguuugcacucauuucucuaaaaugggggcugggugcgguggcucacgccuguaaucucagcacuuugggaggccgaggcggguggaucacuuggggucaggaguucaagaccagccuggguacaugguaaaaccucuucucuacaaaaaauaaaaaaguuagcugggcaugguggcuuacgccuguaguuucagcuauucgggaaggcugaggcaagagaaucacuugaacccaggaggcagagguugcagugagcugagauugugccacugcacuccagccugggugacagagugagacuccaucucaaaaauuaaagagaaauaauaaaauguguuguaaguguucucuguuagcguugaguccugcagcgugcucaucuuuagugaugcaugguagcagcugacaggagacaccaaagcuggugcccaggcccauucacuuagcauuuauucugcaguuauuuuuugagcaucuguugagugcugucuuccagggcagacgaugagcggggagaggccuugucccugccuuguggagcucaugggugccucucuggggagaaagaagcuaacucuucacccgguggccacagccaaugcgagucucuucaccaucugcugcuggugugcaguaaugggggggagggcacaagcugauagauuuaacuccugcaguuguauuuuccugcucuuuguuuuauuuuugagacagggucuugcucugucacccaggcuggagugcaguggcacagucauagcucacugcagccucaaacuccugagcucaagcaauccuccagucucagccucccaaguagcugggacuacagccauaagccaccacaccuggauaauuuuuauuguagaguugagguguugcuguguugcccaugcggucuggaacuccugggcucaagcgguccucccacccuggccucccgaagccgcugggauuacaggcgugagccauuguagcaggccuuuucucccugcuccuuaugaugcuuccaugccuuucuguucugcagcacagacauaccacacacacaccacauacacacacaccacagagacguacaccacacauagacacauacuacaaacacugcacacagacacccacacaugcacaugugugugcacacacacacaccaccacaccuacacaaauaccacauagacacacaccccaccacaccuacacacacaccaaauacagacacacacaccccaccacaccugcacacacauuacacaccauacacagacaccccaacacaccuacacacacaccacacagacacaaacacacucuuacaccccaccacaccuacacacgcaacauauacagacacacaccccaccacaccuacacacacaccaaauacagacacacauaccccaccacaccugcacacauuacacaccacacacagacacaccucaacacaccuauacacacaccacacacagauacacacacacucauacccccaccacacccacacacacacuacagacucacacacacaccacauacacacaccccacacacaggcucauauacccaccacaccuacacacacacccccaucacaccuacacacacaccuacacacauacacagacacauacaccccacaccacacuacaacuacacacacaccacacagacacacacacacccaccacaccuacacacacacacaucccaccaugccaacacaccacacacagacacaugcacaugugaguguaugcgugcacacaccccaccacaccuacaaauaccacaccacaccuacacacaaagccuucauaaaaauaagagccgggccgggcgugguggcucacaccuguaauuccagcacuuugggaggccgaggcgggcggaucaccugagguuggcaguucaagaccagccugaucaacauggagaaaccccgucucuacuaaaaauacaaaauuggccaggcaugguggcgcaugccuguaaucccagcuacucgggaggcugaggcaggagaauggcaugaacucgggaggcggagcuugcagugagccgagauugugccacugcacuccagccugggugacagagcgagacuccgucucaaaaaaauuaaaaaaaaaaaaauaagagagccaggugagaaccccuucucccucgcauaacuggcugaggagagucagacacacaggcugcucuucugggcgucccuggaggccgacuacaccaucaugcauggcagcuggggaggggggccucugcggggaggguguucuaugggucucaagggaacacagggcacugagugauucuggaugggcuucugaccuggggacaauuuaaacagcauuacaaccgacauuuugguuuucuuggggauuuuauaggccagguacaaagcagaaagugcauagaagaugugauccacuuugccugggaagagaagcucuuucuccuggcugaugagguaagaauguccccacucagagggagugggcacuagcuuucucuucuagagggagggacccagcccccauuguucugcagccagagagaacugucuugguguuggaggaaugauucuggccuagggugaggauauuuaguuuuacaacuugugggacugugacuuaauuuaccccuuuauugguuuguacucuugguuguaaauuucagaaauucagcccaaaucacuuaagcuccaaaagaaaaaggaaaaagaaaaaaugccaguggggucacagguacgcagcuggauccaggggcuuggaccuuaucuuucagguccucuuucccuuuucuaccccucuguguuggccucauacacaggccuguuaucuuuucagccuagagauucccagccuagaaagagggcuuuuugcccuggugguugcagcaagucucagaauugagcuucauugguucagccugagucacacgcccauugcugaaccaaucacugugauguagggguuccaguaugcagauuggccaggcccagagcauagggugggcccucugcuuucuucucccaaaccuccagauagagaaccaaggaggguuauuccuugagggccaauugagggggcuccuacccaacaaaggaggguggguucccaguggcagaaaugacugacgcccacuccucauaaagcugcaguucugugccucccagcgcuucuguaucuacugucucauuuaauucgcuuacaucucaggaagggaucuuaacccgguaccuguugcuucuugaacuccaguucuggaaccagggucugcucauucuuuuucuguuuuguaagaaagaaacugagguuccagcaaauccucuuuuuauuuccucuucauuucugcaugguuuccggcgagcugcagcuucuagcccgcugccuucauuucuuugcuccuugucacccccccacacaugccacacacauaaaugcagacacacacacacgcauacacacacagacauacacacauauacauauguacauacagacacacacagacacacguacauagacacacacacauacauacacacacagcuuacccaucaaauuguugccuuaauaguagaugggccugauaucuucauuucuaaaggagagaaagggcagcagagagacccauggguuuccucacaaccugguauacagaacuuccuucugggucugggaagaggaggacgaggaggacagggccuggcuuggcaauggagccagcuugacccuccgacugauccccagggccccagaaaggcucaguuucucugaucuccaaaauagauggggaauuaaccucaaaggccagggugggugucugccagcugugagugcuggacucgggacuggaaagaaccaaacggguauaaaugcugcucuggcagggaaaaguggguggaagaacacaaugauuccacucgagugggggguuaaguguugcaaaggaaacccaacaggguuagcucuucaaauaggaggucagaggaaagggccacuaaugccgucgucaccaguguugguaaagcaaggaagcaccgugcuuuaggaggagagucugcuugggaggaugggggucucagcaccaucacuggucagaugggguggaagggaagucuggggauuggguggggacgagugugagagaaaucaagugagcuccugagcugucucagcauccagccugaggccuugccuccuugcuuauuccagaaaguuccuucaggcacacuuggcucaucccuggaauggcacaggaggcugggccggcugggccucauggcccacagcaccugugcccucccuugccuuggccacacugggcagcagccucuuugaggacccuuuggugaccgucccugccgugcccccgcagguguaccaggacaacguguacucuccagauugcagauuccacuccuucaagaaggugcuguacgagauggggcccgaguacuccagcaacguggagcucgccuccuuccacuccaccuccaagggcuacaugggcgaguacgugggccucccuucccucugccacugcugggccugccagauccucacgcugccggcuccucugcccugccccgugguccacccacuuggauggagagaaggcugcccuuaucuguugcuucugcugcaucuccccagugggagagccguggugugagaacagcccugguacaggggcucaaauaagggcgugcucagagaagccugacaacggacaaauggaguggaaacaggacuacauggcagcuugcgacaccugguguuuucucugucacuuguuccgagguugacugaugucugagaggucagggagggcagauagagcagacaaacagaugcuguuaggcugacuggcugugcucugggugcagggcugccuuaggcacugugugaccucagaggcuaaagggucagcuguaauccugugucuguucauucagcuaauguuuacugagcacuuacgaugaguccggcacugaucucagcaccgcggaugccgcagcgaacacccuccugccggcacaaagcguggguucuagugaggggggagagcuguaggcaaaugaguaaaucgugcgucccacggagaacagucauuaggagagagguagggguggggucgaaggcugaaguggugcagccucacugaggaguuggcuucugaguuaaaccccgaaggagugugguggggaacugugcagauaucugggggaagagcauugcaggcagcgggagcagccugggcaaagacccugugguagcagcacaccugcugugcuggcagaacacaccugccauguuggcggaacagccaggagcuggaaaggagggggcacgggggcaguggcaggaguggagaccugagaauuauaggaggccaggucaccugguccacuuugcugauuguauuuuucacuuguguucagcaugagauaggagcuguuggaggggguguggccuugcuuagcugguguguugcuccuucuggcugcugugugaugggggauggggacagaggccaggaggcuguuacagucucccaggugagauaucgugcaccagacagagauggggagaggauccuggauguauuugaagguggaguugauaggaauugugaguggaaaagacaggugugggagagaagagucaaagaugaauccuggccaggugcaguggcucacgccugugauccaagaacuuugggaggccgaggugggaggaucacucgaggccaggaguuugagaucagccuggauaauauagcaagaccccuucucuacaaaaaaauguuuuaaaacucagccagguuugguggugcgcgcuuccagcuacucaggaggcugagaugggaggaucgcuuaagcccaggaguuccaggcugcggugagcugaugacgccacugcaugaugaaucuuuaguuguucaaacaacaggaaggaugguguugcagucaacagaugaggaaggcugagggugaagcagguuuaaggggaaagagcaggaguuugguuuuggaccuguuaaacugaaacaugccagcuuggcguccagguggagagagauguguaagucuccaggcaggcugaccucuggugggugguuuaaguuugggagauguccgggugugaauuguaagauuguuggagcucuaagccuggacacaucucauacguacauggagugaggccugggccugggcccccacugcuaggagguuaggggaaagaggaggaagccacagagacugaggagagaccaguggguuugcagcaaagggcauguguucccaacguggugggguccuauucugugccaggugucggcauggggagggcucuugguuguuaggcuggaacaguguaagcgugaagcucaaaggaauacuuccgccaggucaagggagcaguccccuugggauggcugccaaacuguucuugggcuucuuugaucugggcgcaggcuaacaggcuggucuuucuggucuacccuguagcaguucuggcuccuugcuugacuuccuuuugcucuguagcucuuuuccuaaacaaaucuguucucggugaacucaguuuucaaacucaagcauguuuaccacacacuuauccauugccccaucucaguuauugauuacacuaccagucagugcccugauguugggauccugagucgugcccgguguucucagaucuggaugaauuagggucugacugcuuuacucauuuugauucucugcucaucagcaaaggauuaagcagaaaguucuuucuuuccauuuuuguuaccagacacuuuucugagauguuagaauuuaucuucccaccuugaaacguccaguccagggaucagaugggaaucuuugccaguuccguucagcagugugaucccaaaagcaugguuuuuuugauuuuuguuuuguuguuuugagauguaaucucgcucuggagcccaggcuggagugcagaggcgcgaucuuaguucacugcaaccucugccucccggucuugguucaagcaauucuccugccucagccucccaaguagcuaggauuacaggcaugcaccaccaugccaagcuaauuuuuguguuuuuaguagagacggguuucaccauguuggccaggcuagucuugaacuccugaccucaagugauccguccaccucggccucccaaagugcugugauuacaggacugagccacuucacccggcucccccaaaagcauguuacuaagcaucucauugugucaggugcucugaggcugggggugggggaugcauggaggaaggugaccagguuccugccuccaggcaccugcguuccuguggucguuagugugaacguuugcagccacacaccagagaaggagauguauguugcugauuuggucuggaaagauuuuuuuuuaaaacucaucauguguccucagcuuauuuucauaugauuugauuuauaauuuggcuauaaauuacagaacuuggcacggugacucacgccuguaaucccagcacuuugggaagcugaggugggaggaucgcuugaggccaggaguucaagaccagacugggcaacauagcaaaacccuaucucuacauacauaaaaagugaaaaaaauuagccaggcgugguggcacacaccuaaagguccaccuacacacagguguggcacacaccuacagucccagcuauuugugaggcugaagugggacuauugcuugagccuaggugguugaggcugcagugagcuaugaucaugccacugcacuccagccugggugacagaaaaagauccugucucuuagaaaaaaauaggaguuuguacacaaucaucacuguuguucaccuuccauuggcaagaacucagccacaccuggccauuugguguugggugugggaaugcuuucgauucuggcuguccaaauggcacuuuguugaggucuuucuauaacuggugguccucucccucucuuuggcccuccaggugugguuacagaggaggcuacauggaggugaucaaccugcacccugagaucaagggccagcuggugaagcugcugucggugcgccugugccccccagugucugggcaggccgccauggacauugucgugaaccccccgguggcaggagaggaguccuuugagcaauucagccgagugaguccacugugaugcgucugcaccccuguggccggggucacgagaguuccugcugggccaguggccagccugucuccagguggccagacagcagccuccugaggguguggccugcaggugcacucauggcucuucagagccugaaccaccccuaugaguugaagucuggaagcgcagcugggcauuguuuggaaguaggaggacugugagugugugugggcaggugaacccuuccucuuccucauggcgagugucgaagagggaagggagcuguguccugauaacacacuggggggacucaugaaacugaaaagaagacgaggagguagaggggcgcagcaucgaucccaggcccccacccgccucugccaaccuguguccucacagcuugacaggguccuccagcucugacagcuuugaccaguucaaacaaaggaauuuaugggucaaguaaucuagaagucagcucccaacugguccaggcucacuucuuuuuuaaaaaauugugguaaaauacacauaaagucgaccuuuuuaaccuuuauaaagugcucgguuuucuggcauucaggacauucacaauguugugcggccaucacugccauccaucuccagagccguuccaugaucccacacugagcucuaccuguuacccacuaacacccuacccugcccuccccuuagccccagcagccacccuucuacccccuucucucugcacucaccuccucgagauuccucauauaaauggagucauguuggccgggcguagcggcucaugccuguaauccaagcacuuugggagguuguggcaggcggaucaccugaggucaggaguuugagaccagcccggccaacauggucaaaccucaucucuacuaaaaauacaaaaaucagccgggaugguacaugccuguuaucccaacuacucgggaggcugaggcaggagaaucacuugaacccaggaggcggagguugcagugggcugagauugcgccauggcacuccagccuggaugacagagcaagacuccguuuaaaaacaaaaaaaguagagucaugucuuauuugucuuuuugugacuggcuuauuuuccuuaucaugauguccuccagguccaucuguguuguggcccgugucgugauuccaggcugaaccaugcuccccacguggacaggccacauagugcuuaugccuccaucugcagcccacaccuuccacgccacuuggccggcggcaccuguggaagcccuggacggugacugugcuccagccguggacauacgcccagcucaggcccagucacugaccuugacuugcucugccuggguccugugcugcaugcacaccacacagacagaggguggggcgcgcuggucccccccagaugcauugguggggcccaucugcagaagaaugggcauguguccuagaagcauguucugaggaauuccguccagagccaaguccauacagacugacaggcaacaacugguuuuucucauuuucuggaaagacauccugguacgagaauagaacccaugacacaggcugcugggcucuacccuuuggccuagaacucccuggugucugugugccccacaccccagggcacguggcagccucccagggugagcgcuguggaagaauuugugccgggagauguguuccacccaccucccuguuuugcugugcucaggcucacacaagcucuucuuuggucagucugucugauaccccagugucgaaggaacagaccaccccacccacuccgucuguguggugugcauggggcaugugacccaggcagagcaaaucugagucaacgcaugggucagaggggacauguguucaaagcuggagcaaagucaucaucugggauuuccgcaagugcugcaggaaagaucaguggcuggagugaaucuuuauccagagauacugacugcugugcuguuuccaucucucaucaggagaaggagucgguccuggguaaucuggccaaaaaagcaaagcugacggaagaccuguuuaaccaagucccaggaauucacugcaaccccuugcagggggccauguacgccuucccucggaucuucauuccugccaaagcuguggaggcugcucaggucuggggcaugggcugggcuggcucucucuuaccagguucaccugagaugcuggguugggggccccugcuuaucuuggggagcagaagugcuggcccuggaggcucggaacuguaugcaccucucggccagaggguguugaccguguaaagaugacagguucuuggaggcccagcugugugcuguguugaugggcaaacaugaggugggccccaggggaaaggagcugaucuggacucugugaaugcugcugcucccaagggcggugcccaggugagaugccugcgggggaagcagcaggagcuaccaccuccacccagccacugcauucuggagcagcgcuucccaaacuucagugugugcaccgaucaccuagggccuuuuuuuuuuuccuuuuuguggagaacgggucucgcuagauugcccaggcaggucucaaacuccugggcucaagccauccuccugccucugccucccuaagaguugggauuaccggcuugagccacugugccuggcuuguuuguuuuguuuuaauuacauuuuuauagagagagauggggucuuacuuuguugcccgggcugguugcaaacuccugggccucaagggaaccucccauuucagccucccaaagugcuggaauugcaggcgugagccacugccuggcuuguuuuuuuguuuuuuguuuuuuuuuucugagacggagucuugcucugucgcccaggcuggagugcaguggugcgaucguggcucacugcaagcucggccucccggguucgcuccauucuccugccucagccucccaaguagcugggacuauaggcaccugccauaacacccggauaauuuuuuguauuuuuaguagagacgggguuucaccguguuagccaggauggugucgaucuccugaccuugugaucugcccaccucggccuccugaguaccuuguuaaacacccaagucuaggccccauccuagaccuacagaaucagaauuccuaguguuaggcugggugcaguggcucacaccuguggucucagcacuuugggaggcugaagugggaggaucauuugagcccaggaguucgagaccagccugggcaacauagugaaacccucucuacaaaaaauuuaaaacuuagcuggguggugcaugccuguggucccagcuccuugggaugcugaggugggaggaucgccugagccugggagguugcggcuacagugagcugugaucaugcuacugcacuccagccugggcgagagcaagaucucuucucuuaaauaaauuuaaaaaaaaagaaucccugggccaggugugguggcucaugccuguaaucacuuuugggagcccaagguagguggaucaccugagaucaggaguucaagaccagcuuggccaacacggugaaacccccaucucuaaaaauauaaaaaaaauuagcuggacaugguggccugcaguguaaucccagcuacucuggaggcugaggcagggagaaucgcuuaaacccgggagcuggagguuguagugagccgagaucacgccauugcacuccauccugggcgacagagugagacucugucucaaaaaaaaaaaaaaaaaaaaaggaauccgugguguaguccgagcgcgguggcucacgccuguaaucccagcauuuugggaagcugaggcaggcagaucccuugaggucaggaguucgagaccagccuggccaacauggcgaaaccccaucucuacuaaaaauacaaaaauuagccaggugugguggcacaugccuguaauuccaguuacucaggaggcugaggcaggagaauugcuugaacccaggaggcggaaguaguggugagcugagaucauaccacugcacuccagccugggugacagagggagacucuguugcaaaaaaaaaaaaagaaucccugaugauagaaccugagaaucuguaguuaagaggcuccccggguggucaugcaaaccagugugugggaagcaguguugagagugccucagagaagcucguuccaugaaaauugugugcagaccccagggccccauuuucagaggauuaugcagcuugaccugcaggaagccacugcugaugccuguugaguggcugccuggggaugggcacugcccgaugacgggcaggaggaccacuaccuacaccuggcuguccugcaguaguuuucaggugucugugccuggcaccagccaccagcaguaucccagcgucuggcccugguccucuaggagcggaaggggagaagggcacugccgugggagagagaccugccauuuagauuacauuuggcuuugaggguugaaugguguguuugcaaagccaggaaugaucaugagcucugucugcucccauaggcccaucaaauggcuccagacauguucuacugcaugaagcuccuggaggagacuggcaucugugucgugcccggcaguggcuuugggcagagggaaggcacuuaccacuucagguaugacuuccucuccgcacuaggggcugguccgggucuuguccagggaaauguggacuucuugacauggagcagaggacuacuucaaagagagaggugcggagacccuguccucucucgagucaccccuacucuguccugcugcagacccaagcucagacccugcccagggauuaagaaaaucugggugguugucugcucaggguuauauucccugaaaggucuuccuugacuauucugucucuccccucugccaucggucccaucgcugucugaaauguuccuaguaggguguuuucuuauuuugcuguccguuuucaacucugcgauggcagcacacagcugccagugccuggaguggugcuggcaugugcuuaguagcuccuggcagcacccugggccauggcacugccugugaucccagagccugccgaggaacugcaggggaauuugcuccacucaugcccagggcauaccccguucuggcccugcauggaugggaaugccggugcccagagcugagcuggcuggagcagagguuuuccacugaggccaguucucuucagaacaacaucuuccccauacauguugcucucagaggucuccugcggcagaugcuaaaaaaaagaaauggcaugagcuguuagcacccggagccaagucuugacuuaggcaagguuguggguuguguccccugauggacaaaccuuguccgguuggccuucccaccccuggucaggcucaucucggugguugauggcuugaugagaaagugauuuaagcaagagggcugccaggaaggccagggagcauuuuggugcaccagagggagguguuaguuacuguggcaacuuggaaauuccuuuggagcagaguugugacuggagggugucucacugucagacugacuagagauaaaaaaggccccucagguaggagugaaaucucucucucaaacucuaggaaagcccgagucauacucuagagaaaguucugaucaguggucaaaauguuccagagggcugagugcaguggcucacacgcuuugggaggccaaauucaggauggcuugaguccaggaguucaagaccagccugggcaacauagcaagacccugucucuacaaaaaauuguuuaaaaacuagccagggauguuggcgcaugcccguaauccuagcuacucgggaggcugagaugggaggaucaccugagcccaagaguuugaggcugcagugagcuaugaucacucuacugcauucaagcuggggcagcagagugagacccuaucuccaaaaaaaaaaauauggccaggugcaguggcucaugccuguaaucccagcacuuugggaggccaaggugagcagaucaugaggucaggaguucgagaccagccuggucaacauggugaaaccccgucucuucuaaaaauacaaaaauuagcugggcgugguggcaggcaucuguaaucccagcuacucgggaggcugaggcaggacaauuguuugaaccugggagguggagguugcagugaucgcgcaauugcacuccagccugggcaacaagagcaaaauuccaucucaaaaaaaaaaaaaaaagugaugcaggccuucugcaguaauggguggauaugucuuagccuaaaugcugcuccaguuuauugcuuuuguucacguguauuacuugggugaaaaaaccaacaugugaaugaaggggaaagugguccaagugcugggugcuguccgggcuggagcugucgaagcagaccaggcagaccucccucuuccauuccuagaggcaguuuagcugcuggauucguuccucucccaucuugcagagcagccaggcugacacuguugucucuccugccaggaugacuauccucccuccaguggagaagcugaaaacggugcugcagaaggugaaagacuuccacaucaacuuccuggagaaguacgcgugaggacgccugagccccagcgggagaccuguccuuggcucuuccucccaaugcccgucaggcugaacucgccucccccgugacucugccucgggccucgcagaggccgcuggucacuucgucaucauuuugccccuggagacgucuuucuuugugccuugauguugagagcgccucucuuuugagcaaacaagcauucuauaugcaaccagaguagaggggaccugcucagcaggugugaccaggguucucugaaucuguuauuguuuuugcuucuggaaaguucauuugggguuuacaacaacuaggauguguugggugagauguuucagaucuggagaaaugagcaggugucgggaaaugugugacuuaaccguggugagggcuggaaauccaaacucaccaccaugaucugugaaauaaagcccuuagcggugugaagcauccgguccuuugaacagaagggccuggaaggccccuggggcugagaaaggguccgcccgguggccuggaggcaggcgccgggagcgcaguagcacguggacugggcaggauguugcacuagcuugggguagaugcugggggcugcggccacggucagagggccccacugugaggcgugggugugagccaggcugcaggaggaacugggccuccgcuucccagcaacgcagccaggccugagaauucugugcgcccggcgggcuuugggaaugagggguucccuugaacaugcguaggcuggaaccccgucugagaggucucccugaauuucagugacacauagugcagcccggcagugucccacuuccguggagagagccgcuggaaugguguggacccaucccgcgggugaccggugccuguucuccccugaccgagccugugagcacaucgcccccugcuggcgacagcggggaaaugagggcugaaaauauccuccccacaagggcaauccccgggaccugccgagcagccaaggcccuguccuuucuugaaugguggcgagcugaaucuggucgguuuccuagcuuuuaggugguaaaagugccuggcagcuuggcugccguggaggagucagucgugguuggagguucauugccgugcuuucaugcagaguguuuugccuucauguuagcuuccggcuccccucccaggcugcagacucugaccuguggcaucaggcuucucccaguacaggagggugccaucccccagcaugcggcuucucugccauuagcagcccugggcgggccgaccacacucgaggcugcggugcuacgggcuuagcccucgccucccucacugggagcuuccccauccucccugccuuccccagugggaaguuagggaagcucaggagccugggaccccgcaugucccaaaaugggauuggagaagcuggagagaaagcagaagaggccgaggagugaggcagcagccucuaugcugugauuuccacaccggguccgugcagaggaaacagaaacucccaacuguccuuacccaccgacaucacagccccuaugaagaaaguagccacaaucucaaauaacaaaagggaauguucuaaaacuuuuucuuccuuaaaaaauggagaaaauugcacuugugcuugcugugugguauauaaaccaggauuagucccagggucgugagguuucuggugaaaagguuaaaucguagaagcuaguauauuuuuuauauuuuuguaacaauugcuuuuuucaugggggaggcgggguuaguauuuauaguccuaacaaguccaguaauuuuuuauaaaucuucagauuauaaacagccccuaaaaacuuuacaacguuuacacaguuuuuuaaaaagagacuguauacacuugauuugcuuucaaaauaaauaaggucagcuagucuaggagguuaacgucggguaggaaugcugaucaugauagguuugguuuucuacagauucuguuccggugccuuuccuauccaggcaccaccugagaaaguugucauuugaggucgcacuuggaaguuacaucugugaaguuucugucauucguccagaucuguguguguagcaugugcugaggaagcacgugcugggcugugccucagacagugcaucaccgggcacccagaggcuugccuggcuauuccuguucugguguguguggaguguuggggaggaacagaugcagaucaaccuguggcuguuuucccgucuagguucucacagguaucuccugacagagguacuuaacaauggcucugcuggaaauuucuauaaauaaaauguccaaaauggugacugcg

SEQ ID NO: 15705 - RNA, 536 nt, Homo sapiens
uuuuuuuguuguuguuaagcaaucauuuuauugcuugaguacauagacaaauuuaugcuaccagggcagaggcuguagaugauucauauuuccaauugggagggaggacucgcuuggucuuguaauaucgagccaaguggugaauccagcucucuaucagaaucagauggaauuuagcauucuuauccuuucuguuccucucaagaugcuuuugaacagcaacugcuuucuuaauuaaaugguagagaucuucagggagaucaggagcaagucccuuagacuuaagauuucuuaagauuuuauugccugucacaaaacguacuugugcaacacuaugucagucucucaggaucacaccaauuugugaaggagucaggcccuucuuggccacuuaguaaaucugcuccuucacgucaucagaugucaacuucagccaaguggggaugcuguggcgauagggcaaagccaaccgggacgggcccuucccaggagcaugcaugcgacccaugauggcggcagucaggcagugaagugug

SEQ ID NO: 15706 - RNA, 4457 nt, Homo sapiens
uuuuucuuuaaaucccuuuaaggccccuuauuucuucucauucacacuucccuggggccuaacagaguagaagggaaacuguugggcagaaacagaaaaguacucggguccacuccucacucgcgaagucccuaucuaucucugugggucccggaggcacagggcugcaagggcgcccgcuagagcugcuccacggcuuaccggauugcaugcggagaagaaacgggcccggguuucaacagaggccccgugcuccgugaauuucuaacucgaaccagccgcugggauaaauccgagaaacguuguuuauugugcuauuauuaacuuucccuucuccccacgccccuagaggaaauaaaauucauuccugaauauugggccaggaaaacguuucucugaaaggaaccacaacugcaggggaccacccggcugcagcucccagcucccggcccuucgcccuaggcugcccacucgcuccggcucccgaccuccccgcugccgaagcaacugggucagccuuucagacuuaaaacgaagucguuuauuucauuuuugcuuucacauuauguuccgauacaaucaaaacuccuggacgaaccucuugaauaaaguccugugaaugagcggaaucauagguccugggcgcccgaguaugcggcggguggacuccggauucagaggcgguguauaaaacauacgcugcuucgggaacugcgagggggacgcggugggagacauccggggacagaaggccugaggagucugccgcuccaggcagggucguuuggguccucaaacugggacuauuccugaugcauuuggaaugcaaagaaaaaaaucaaacuucgcuccugggccggcggccgcgccuggccuagcaagauuucggccacauuucuuacguuuccgccaaagcugugaacacaggcgaaugcagugcugguccccggccuggcgcaggaaggagcgcaaggccggcuuugcaaggaagcccucgcgcccaggccuuucuaugguugcguucccccaagucuccugccuuucggaaccucgcccuuuggcaccccagacccccaaccucgcagcuggggaagaugcggauuuuagaaagcuguuucagaaaaauaaaagucccacuucgacuuuauuagauuaaagcaaaauuaaaccuugacuauucacacguauguuacagaggaagaggaggcguccggaagaagcuccuuggcguuucguggagucacagagcacgacggcauugacaagcaucagaacaucaagcagccuuagauuucacgaucacuccgaauagaacauagaaauacggaaacacagccaguuuccacugggaagaguucuucguauacaaaugauauauauuuauauuuuuuaaaccagucaccacuaaggugaguccuuucucugcuaacaagcagccgaggauacuaaguaucuucagcuaauuaauuugagcaguguuuuaagaagagcaacacuugccaaauuaaaacuaccuuccccauccaaaacaaaacaacaacaacaacaaaacuuuaccccuuuccaaacugaaaaaaaaaagguuggggguguguaauauaucagauuucaguaggcagaaggauucagagggggcuagggagaaagauuucagauuauguagugaaauacaaaguuucuuuaaauaaauugcagggaacaugaaguugggggauaagaaacaaugacaaggcagucucuuucuugauuacugcaacuggaaugggggaggcgaguuuauuuuuggaaaugggagugcgcagagcuaagcgaaauuuauuucuccuaauaaggaaauggacaaaguugucccacagcuggcgcgcaccuuuuuacccagauacaguuagagaacauguaggaaguuucaagucgugcugcuuucucgcccucuuaauuucagccucuuucucacuccccuuccugccuucgcccucucccugccucccuuccggcuacgagccagucagagaggaaacaccaggaauccggagaaggucgaguacuuccagccccccaucaaguuuccccgcuccagcuugagguaugcucggucgccuuucuccauuuggauuaggacuccguugcuggcggccucccgggucacguccuggucaccagcgaaggcugaaaucaccggccacccguuuagcaugaggcucaccugagaaagagaaaggcccgcuucagaggcgcaaccuaggcaggcaccgaagccgcgguggagcgaaccuccuccuugcuuggcuaacagccuguaaggccuggaagcacggagaggugggggguggggggggcgaauggaggaaaaggggcuuugcagcuuacugcugaggcuccaguggggcgaaagaccacacaucugggugacaggaagggccuguccccaaaacgggaguugcucuuauuccaguuucucaaaugagcgcgccaagcgaaucucgacugugcucugugauccaauuuaauaaacccaugagguggcucuagcgcccugagaccuuugaccucucucccguuuccccucagccucaaaaaacaaacaacaaacaaaaaaaacccagcaacucaggcuccuucuggcgcuaccggaaaaacaaaaacgaacaaacaaaaagccccugaucccuccuggacccagcugccaggacacaguggagaagccacugugauuugugauuagaagucucgcaccgagcggcacaauguauuuccuccccaaaccacgggcucaauucccucccccauccagccgcgcccgccaccgccugguuuugccccugugguggcaccgucagccaagggccucgcgcccucuccccagcugugcgucccaccucucucggcgcccaagggaaaccuggacaucuuuggggacccggagagccggcgagugauugcugggacacggcuggagccgggagagaguagcacuacgcccccucccucccuccucucucuaccccucacccuccggggcuaaaugcugcuagcucaaaaacccacaguccgcacgggguggggauuggggacaagugggagaaaacgggggccccguccguggugcugaagacaagcacgcaagccgcaucgcaggcuucugagccggggcaagggguaggguguacugucgcggugcuuccuggggaguccgggaaggcuucccaagcggcagcugucuggggcgcuaacaacagccguuacaaggaagucccugaaauccagggaacccuucggagaggcccggaaggcagaagcagaaaauucugucucucgggggauggggcuggaucccaagagccagagacagggaaagcagaggacaguugaagccacagaacugagaggccccgcuaucugucccuccaagcagcccgaaguacaugcagccgccacuucugccuaccaccuccggacagcccgagcaccccugaggccaguaaccccccuacggggccagggcccggcacgaggcgucggcugaccuguaugguuugucuguuguagacuuuuaccacguggaaguuaaaacuguagaucccuuugcgcggggcgaugaaagugcugcguucugaaucaaaguuguucccaauguucacuaguaccuauaacgagacgggaacgaaggggagugggcaggaaucggucccggacugucguccccgcgccuccgcagagcccuuggagaggaccgggcaucggucuuccauccaucccuccuucaccagcccaaucugcacgccgcgggaggaaggaacacucaccuggucgaaguagaugaucauggugcgauuacucaucucggacggcucgugguuggugcuccugauggcagagaaagccaccuuggcgcugccagagcgcacagagaugcccagggcagugcccguggggucggacgugggguuggagucgcacaccaccaggcacuugcccuccagcacgaugggcuccgucucauucugcccgcgggccgggcccgccagccacgcagcccccagcagcagcagcuccaggacgcccagcaucgcgccgccggcgcccaccccgccccccacccccagggcugcucgcgccagccgccccccccgucccagucccgcuccgaagcccccuccucagcuccgugcgcagcuccgccgccgccgcucuggacacuacaccucuuccucgcacuccgggacuagcguccccuccgcgacuagcguccccuccgcgcuguguucccggagccccucccgggccucaggggugccgcggcugcccagccgcacuuggaugcauagccgcugcugcucggucccgcugcugccgccgccuccugcccgcacccgccgcugccgccgccgccgccgcucugaauuauugaugcagccggcgcugcagccggagcgggcggagagcgcgcgccgggcaca

SEQ ID NO: 15707 - RNA, 4457 nt, Homo sapiens
ugugcccggcgcgcgcucuccgcccgcuccggcugcagcgccggcugcaucaauaauucagagcggcggcggcggcggcagcggcgggugcgggcaggaggcggcggcagcagcgggaccgagcagcagcggcuaugcauccaagugcggcugggcagccgcggcaccccugaggcccgggaggggcuccgggaacacagcgcggaggggacgcuagucgcggaggggacgcuagucccggagugcgaggaagagguguaguguccagagcggcggcggcggagcugcgcacggagcugaggagggggcuucggagcgggacugggacggggggggcggcuggcgcgagcagcccuggggguggggggcggggugggcgccggcggcgcgaugcugggcguccuggagcugcugcugcugggggcugcguggcuggcgggcccggcccgcgggcagaaugagacggagcccaucgugcuggagggcaagugccugguggugugcgacuccaaccccacguccgaccccacgggcacugcccugggcaucucugugcgcucuggcagcgccaagguggcuuucucugccaucaggagcaccaaccacgagccguccgagaugaguaaucgcaccaugaucaucuacuucgaccaggugaguguuccuuccucccgcggcgugcagauugggcuggugaaggagggauggauggaagaccgaugcccgguccucuccaagggcucugcggaggcgcggggacgacaguccgggaccgauuccugcccacuccccuucguucccgucucguuauagguacuagugaacauugggaacaacuuugauucagaacgcagcacuuucaucgccccgcgcaaagggaucuacaguuuuaacuuccacgugguaaaagucuacaacagacaaaccauacaggucagccgacgccucgugccgggcccuggccccguagggggguuacuggccucaggggugcucgggcuguccggaggugguaggcagaaguggcggcugcauguacuucgggcugcuuggagggacagauagcggggccucucaguucuguggcuucaacuguccucugcuuucccugucucuggcucuugggauccagccccaucccccgagagacagaauuuucugcuucugccuuccgggccucuccgaaggguucccuggauuucagggacuuccuuguaacggcuguuguuagcgccccagacagcugccgcuugggaagccuucccggacuccccaggaagcaccgcgacaguacacccuaccccuugccccggcucagaagccugcgaugcggcuugcgugcuugucuucagcaccacggacggggcccccguuuucucccacuuguccccaauccccaccccgugcggacuguggguuuuugagcuagcagcauuuagccccggagggugagggguagagagaggagggagggagggggcguagugcuacucucucccggcuccagccgugucccagcaaucacucgccggcucuccggguccccaaagauguccagguuucccuugggcgccgagagaggugggacgcacagcuggggagagggcgcgaggcccuuggcugacggugccaccacaggggcaaaaccaggcgguggcgggcgcggcuggaugggggagggaauugagcccgugguuuggggaggaaauacauugugccgcucggugcgagacuucuaaucacaaaucacaguggcuucuccacuguguccuggcagcuggguccaggagggaucaggggcuuuuuguuuguucguuuuuguuuuuccgguagcgccagaaggagccugaguugcuggguuuuuuuuguuuguuguuuguuuuuugaggcugaggggaaacgggagagaggucaaaggucucagggcgcuagagccaccucauggguuuauuaaauuggaucacagagcacagucgagauucgcuuggcgcgcucauuugagaaacuggaauaagagcaacucccguuuuggggacaggcccuuccugucacccagauguguggucuuucgccccacuggagccucagcaguaagcugcaaagccccuuuuccuccauucgccccccccaccccccaccucuccgugcuuccaggccuuacaggcuguuagccaagcaaggaggagguucgcuccaccgcggcuucggugccugccuagguugcgccucugaagcgggccuuucucuuucucaggugagccucaugcuaaacggguggccggugauuucagccuucgcuggugaccaggacgugacccgggaggccgccagcaacggaguccuaauccaaauggagaaaggcgaccgagcauaccucaagcuggagcggggaaacuugauggggggcuggaaguacucgaccuucuccggauuccugguguuuccucucugacuggcucguagccggaagggaggcagggagagggcgaaggcaggaaggggagugagaaagaggcugaaauuaagagggcgagaaagcagcacgacuugaaacuuccuacauguucucuaacuguaucuggguaaaaaggugcgcgccagcugugggacaacuuuguccauuuccuuauuaggagaaauaaauuucgcuuagcucugcgcacucccauuuccaaaaauaaacucgccucccccauuccaguugcaguaaucaagaaagagacugccuugucauuguuucuuaucccccaacuucauguucccugcaauuuauuuaaagaaacuuuguauuucacuacauaaucugaaaucuuucucccuagcccccucugaauccuucugccuacugaaaucugauauauuacacacccccaaccuuuuuuuuuucaguuuggaaagggguaaaguuuuguuguuguuguuguuuuguuuuggauggggaagguaguuuuaauuuggcaaguguugcucuucuuaaaacacugcucaaauuaauuagcugaagauacuuaguauccucggcugcuuguuagcagagaaaggacucaccuuaguggugacugguuuaaaaaauauaaauauauaucauuuguauacgaagaacucuucccaguggaaacuggcuguguuuccguauuucuauguucuauucggagugaucgugaaaucuaaggcugcuugauguucugaugcuugucaaugccgucgugcucugugacuccacgaaacgccaaggagcuucuuccggacgccuccucuuccucuguaacauacgugugaauagucaagguuuaauuuugcuuuaaucuaauaaagucgaagugggacuuuuauuuuucugaaacagcuuucuaaaauccgcaucuuccccagcugcgagguugggggucuggggugccaaagggcgagguuccgaaaggcaggagacuugggggaacgcaaccauagaaaggccugggcgcgagggcuuccuugcaaagccggccuugcgcuccuuccugcgccaggccggggaccagcacugcauucgccuguguucacagcuuuggcggaaacguaagaaauguggccgaaaucuugcuaggccaggcgcggccgccggcccaggagcgaaguuugauuuuuuucuuugcauuccaaaugcaucaggaauagucccaguuugaggacccaaacgacccugccuggagcggcagacuccucaggccuucuguccccggaugucucccaccgcgucccccucgcaguucccgaagcagcguauguuuuauacaccgccucugaauccggaguccacccgccgcauacucgggcgcccaggaccuaugauuccgcucauucacaggacuuuauucaagagguucguccaggaguuuugauuguaucggaacauaaugugaaagcaaaaaugaaauaaacgacuucguuuuaagucugaaaggcugacccaguugcuucggcagcggggaggucgggagccggagcgagugggcagccuagggcgaagggccgggagcugggagcugcagccgggugguccccugcaguugugguuccuuucagagaaacguuuuccuggcccaauauucaggaaugaauuuuauuuccucuaggggcguggggagaagggaaaguuaauaauagcacaauaaacaacguuucucggauuuaucccagcggcugguucgaguuagaaauucacggagcacggggccucuguugaaacccgggcccguuucuucuccgcaugcaauccgguaagccguggagcagcucuagcgggcgcccuugcagcccugugccuccgggacccacagagauagauagggacuucgcgagugaggaguggacccgaguacuuuucuguuucugcccaacaguuucccuucuacucuguuaggccccagggaagugugaaugagaagaaauaaggggccuuaaagggauuuaaagaaaaa

SEQ ID NO: 15708 - RNA, 56636 nt, Homo sapiens
cgcggcagcaggguugggcucucgccgugagucgacgaagggagcgcgggcgcgcgcccgcguccgcgcacugagagucgccucggccgcucgcuuucucgacucccgccucgcgccucgauccuguuccgccucccucggcccuccugcccgcccccacucgucggcccucagguaggaggcggcgcgccccggggucgggaguggaaucgcuggaggcugcgagucgccugcccgccugugggcgcgcccguugggaggggagcgccccccagcgggcgcgggcgcgagggcagccggcgcgcugggcgagccuggcucagggucccggcggccggggugcagggcgcgugcgcgcgcggcggggcggggccugcgcggcucuggcgggcgcacguggugcccgggagcugcugggcgggcacucaccgcggggacucggugcggagccggggcgccgagugucuccgugucccucugccccagccggcggccgcgaugguggagcuuggccucucgcucucucccgccucuccagcgacugcucugccggccgcggaggucggaucgagcggucauucauucauuuguuaauucguucacuuauucaggggagaucauugaaccccuacggaguaccggguacugggccgggcgcugaggacgcggggcugagcaaaagcagccgaggcccaccuucgugccccuuaaaacccagcgugcggggcggcaacgaguacugcuuuucuguuuugcacuuaaaauuuacauuuugcauccguacuuuuuauuuacugugcacccuuacggcaugcuuuacgcacccguaccugcaccuccuagccuugaguguagacaccagauccugagaugggcgauuuuucgagaauaauuuuuacccuaaguggauuuucgugccacgcauggacuuggaacuacacacacguaguccaaaacgugaaagucaaaaugcagcuuugccaaguggcagggagaaaggagagcugagaagaugaggagaggaagggcgcgcuccaggcuuuccagcccgggugcgguagacguagcccugaaggaugaacccaggcugguaguagggcggcgggagggcggggggaccugucagucaaguccaaagcagaaacgcggcgccggaucccagucagaggccggcuggaacgcuucccacaggcuccuggcgcuccgguccccaccaggcgaccuugauccuggcgugcucagcggagccagcgcagcgucgggagcuggagagacgcggggcgccggcugagcgcuccugcccucugccucugggcuagccucuggcccggccucccggccucccccaggguacgcucucccccaagagcgaacaccagcuuugggaucgccagcagccacgucucugcuucuagaucucuuuuuuuuuucuuugagacuuaguugauagcuguuuaaggaauuauguggaggaaaucucaccuccgacccccgcccccguugagcacggccggccagggucgcugggugggccaggaggaaagaaaggggcggggaagaagcagcaauuuuacuuuaaauuaaaaugacacaaaaauauuuuuucaacucagaucuuucugagacauccccagaaagcguugcaagcugugauuacaccuaaugugagagcaugaacuaauuuaagaggugagagcugcauaaugaggcugccucccguguagcagccaagacuggcagcucuggcggcgcgcuggaggggaccgggaggggcacccuuguagaaccagucccuggcgcccugggaucuucucagugcccuggcgcuguguugucggucacuccacagauauuacagggugccuccugaaugccggguugcaaucaagagcaagagauggggcgagugaaagagccuguuuucaggagcucagcaucaggaugacgauuaccuagagggaggugguggccagccucccccucuucucuucaugcugaggcucuggugggcagugcccaagccugaacugccaucuguaugccagugguuacccaacuuguauuuucagucuuagccucucucugguccagacuugucauucuaagggcccuuuuucacugacucacauugucuccucccucccugccuuccaaacucagccuuuuccuuuuucccuuucccacugacaacagcugcacgacccccccgcccccccacgaggugaaaauucccaagaaccccaugucuaaccuaacucccucucuauguccuguugcuugagccauucucauuaggcugccuguucggaguucauuaucuccuaauuuuucauccaggaauugaugaagaaucaccuacugccucucccacacacuguuuauucuuucauuugaugauaucuguuaagugcccugagauauguaaccuccacuucccucccauauaagugagauuucacguugauuacuuccuuggcuuuccucaucccuuauccacauagcauguguucaaaauaaugaauauuaauuuaauguuaauagauaugugcuuuccugaauugugaggauuaaaugaaaucauguauauagggaggaaaauccauuagaaaccucaaaagcaguuauguuuauuuuugcuauugucacauuguuagagucagaauucuuuuagcugcaagugacaaaaccaacucaaacuggcuuaaggacuuuauugguugaugcaaaaagccucggguuaggucuugccauuuaagguagggcuggauccaucaauccggguuaccaggaucuguuuucuaguuguggcuucauuuucagacaaguuguuuccauaugauagccucauagaagguacuaccagcuuaguccuagcaagaaaaaagaguacuuacucuucaauauuugcagcagaagucccaggucuguucuuaugagggcaguuugagucacuugcucuucucugaacguggagaaggcacuguuuagaugauggagguuggauucaggugcauccccuggaaugggguuuggcauuagcuucacguggucuagaauaaagggguucuccaaaggaaaauuaggguaggaaugcugaguaagcagaacaaacagaugucuacuuuaguccuucccaaagggugagcugcaauacauugcagacuaucagaauggugaugaacacggaugcaguagccaagaaaauagauguguguuugucguggucuuuuucagucuucaagaucucaguuaaacaugaagucaaccacucacuaugauguuauuugagguuuagcuuugaaguggaaauguaccacaaauaguagagccagauaaauacaaauaaauaauuuuaacaguccauucuaaaagauuucuuugguaauauucuguuggaauugauuucuaucuuuucauuuguuagguuccuggaaagugaaaauuucauuucuuuguggacagguaccuaaaaugucucauuauucaucaauuaaugaaaaacaaaugaaaauuugagagagauauucugaagaauaaaaggaucaaguugggucauuucuaaaauguaagauuauaagguuuaacuugcuaagacuuuugagggguugaauuauugguaaauuauuauagaaccacuuaucugaggcuuuuaaaagugauguguuacagagauuuagggaacugcaagauugcagauaaagaauuuauacugucaacuguucuauacuuuaccuucugcuuuaaaugcggccuuauauuuugaagucaaacauuuauuuucucucacugcguucugaauuuccuaccacagugcauuuugagaaaugaauauaacagcagucuucauagaugccauauucauggcaacucugucccccgccaacaccacacccuggaaaaaaaccaacuuucuauuguuggaaugagguaacauuuucaggaaaagggaaccauuuucucacaggauauagaacaaauucaaccuuuuauuaaaucaaaauggauucucuaauguuuauacauaucauauaggauuucaucucuuucaaucuugguucaaaggcccagacaguaccauucccuaguauuuaguccauuugcucauaaagcagaagagaaaagcuacuuuguuccgaaggguguuagauuuaggauuccaagguuauuucaaauuaaugccuggaacuagacuauaaaaugcaggaaagauucuaaguuguucaaagaugaaauaucuuaacuuucaccaaaaacucugucuucuggguauuuuuuguuuuucugccuuuccagauuuauuuuaaauacaacauuuuugcuguuuacauuuuuaaaaguuacauuucaaaauuguucauaauuggacacuuucauaaaauguaggcaaaugcaguuuuacuuuuuaaugaaggacaagucuguugauaacauuuugauucuuaaaauuuuuuuuaucuuauaaaaaugaaacaaugcauuuaaagugucuucagcucuuauguuaauaccaaauuauacauuuucuuagcccauguucaggagagacaauauaucuuccaaauuaagagaagcuggcaccauuuuuaaaacaaggccuugaaucugcugugguaugugcugguaggaauuuuguaugaagcuguuauugaaguagaugacauuaaggucaaaggaaaaaaaaaacagaaaauaauguaauccuacagagcugcucuuaagaucuugagagaaaaaccacguagguaacaucaaacacuaguuggaaucuuuccaagaaguaauuaucugugugcuguuuguggugguugauuaugggaacaaaccaagguuuagccaauucagcaaacauuuauggagugccugcaaugugcaugucacuguuuuaaggccugugccuacuguaaaggugacccacacaugaugccugccuugcaggacuuggaguucagcgauaauaagagaugcauaccugaaaagccuauuuaagacucuuccgguucuacaaagaaggcuucuugaaagugguagcuuugauuacucuuuggauuuauuuacauuuauccuauaaucagaagguauacaaaacagacucacacauauauaaaauuaauagauuagauagcauuuaaacaaauauuucagguagguacuucaaaugcauuugacauuuaucaaagaaaugguaagugcugucauccguggguggcuggauuaacaugugggacuacuuaucaccaauuuuguuagggaucuuagggaaauuccuggaucuuauauucacaagcaauuguauaaauacuucccacagcucagagaccuaauaggauggggucuuagagaaacaucuuuugagccacagacuucuuuguuaccagaaggaaaaugaaagaagaaauuuaaauaccacuugaagagagguaaauaaaugagaaauggggcugagagggcggguauuuuuuuaaaaauucauuaaauggaaaaauccacaaauguuaauucugguagauuucuuagaaauuacaucagaggagcaugcuuggucuucccacccucauuaggccucagugacagguacuugaacaacugagccccuaaugugcaugcucccccaccccugaagccagucucugcccuccucuucccuccucuugccccuggaagcugaucgccaccaacuggccucuggguggauuuggccaauggaagcaccuguagagggaagagagugagguuaggauauuucuuccugcugucuccgugcuucccugcagagagugugaagaaaugacccugaaaagccucuggcagaggauucuucuuucaggauggugucgccuccucagcagcccauccuccuccccuggacucaagcucucauuccaguaacacuccuuccuccuucuccaucuucagggggagguuugccagucgguggguucuaagcauaucucgcugauuccccccaacccugccgacaccucuguaggucgucccuucauuaaaaucucuccauuugaacuaucugaguuuaauuccauuuccuccugguaucucagugauacacgguaucaguacaaaaaucucgcuucaccuucagaaccaacagauuugagacauuuuauccucuguggaaccauuaguuauuuugucauugguuguaucagaaaaaaaaaucaggaaugcaaauccuucuuuauuacagauucagauuugcauauuaccaauguuauauauuuuaaacaaaacuauucaucauaaguuuuaaaaauuaacuacuggaguaguuaaugaaucugaauguaauuauguagcuuucauaauauuaaaguaaaaauacuaaaagaaguauuucuuaaagaagcaaaugcucaaucuccaaguaaauuuuauucuaugcucuuccgguauaagaauauguuaauaucuugaaaaauaucauauuauuuugugaacucauaaagcuauuuugaguuuuuguaaaaugaaaaccuuaccaaaauguauuuuauuguuggaaagcuugaccguuacugcuguuuaauuuuuugagcuuguaaacuuuauuugugcauguuuucaacaaagaaggauuuuauuguuauuacauaaaacaggugauuucuagauuuuaaaaucacaaauugaaagcaaggcacaauaauauauauuucaagauauagguacuuaggaggcauccuuuuagucaucuguucaauguagccaucuauuuuacaccuacugucuacuauuguuugagguccuugccaaaguauugcaggcuaguuaggaaacauaaaacaauuagaaaguaaucuaugacaaguaagcuaucuauaaauggcaaugaaggguagaacaaauucaaugaaaauaucuauuuaauccuaguguuuacuggucuagaagaauaggcugaguaaauuaguauuucucuggcuguugugguaacacauugcaugcuauaacaguuuuaaguaauuacaggugcauugaaauuuaucuauggcuuugucaucauauucuaaaaugucaugaguacuuuuuucugaccucaauuacuaugaaauugguuuccaauauuuaauuaaccaagaauaucaagucuauaggguauuauuaaggugagacuucuguagccuuuucaauaaagaccagaauuuuggagugccuugaaccuuaaucauugaucuuuaauucuuauuaagucaacugcccaccuuuuaaagacugaggcccaggaagaguaaguuucucugagacaaugcauacaguacagugcuucuuggguauuggcucuaagaccagaugcaaagaaaggcuaaaaucccauuucauuguucauuaggugagaacccuuuguuaagcuguguaaccucugugcauaguuuccucaucagcaaagucagaaaaaguauguaccugaaggacugauuguaaggcugggaugagagaauccaugugaucagcccucaccaacaggugcugcccaguucaugagugcugcugcuguccugcccaaguacccagcuugcagagugccagaguuagagucccagggguguucuccacagcugcaugcuugauccaggccuaucaggugaguuggcucuuggcuagugguuuuucuucucuugcuguacaaaaguccagacaguaaugucuuuuuuucauuuuuauagauauauuccauugaaaguccucauucucaaauuuaaaacaaagacuuuuuguguaccucaauagcaaugcacacacaguuggcuucacaaacauauuguacauuucuuuuuuucauauuuauucaacaaauguauauugacuacccaccgugugacagguguuauuuguugacggaaccaggcaucaucagcaaacaaaacugacaaagcuuccugcccucuguggaaggcaucugaggaagagacuggauuuuguagcaacauguuauucucauuauaaacuuuaucauuggaauacuaaagccaaaucaucccccaucuccuugaucaggauacccacuuaaucuaggcagcuacacaauugugagagccuuuguuuuuuucugcugaaacauccuuaaaaagauaccucacaacccaagauuuggcuuuucuuaaauacgauuuuuaauuuuuuucauuucuaucuagagauuuaauuggaaauggaaaaucaucaauuuuccaauuaaaugucuguuccaaucaacauuauaccuuuuagguugucauugucauuuuuaaguuuaagcaacuuuaaggauuuugaaucuggcugccuguaaauuaaaggugaaaguaaucauuguguuggauuggaacauuuugucaauugagagugguuuccuuguucuuaguguaugaaaaguuuauuuuucuaauguagauuaauaaaggagauaaagaaaaacaaaaugagugauuuaugugugugagaaaagaaccauuuccucaaggauuaaauaaaauucauaccuuuuguuucuuuugaaaaguuuuuaaaauaaauuuuaaugaauguguccuuuaaauauuccuuuaaaaauguauccuauuuuaaaauggacucucugagagaaggaauugauaccuguguuuaaaaucaaaaauagcaugcauagagacuguuuuucuaguugguugaagcuuuuuucccucuccuuuacaucagugaaccagcaucuugcccuucagacccuacagcacacucuugggcucaugaaguguaugacacauccuccuugggggaucggccauguccucgcucucaugaccacaugaauucuucuguaugucuuuucucacagcugaguacucucuuccugacccccuuguggaauggggaaaggaggcugugacauugugcuugugcaaacaauaauugagagcuuuccgagucuccugcaucuucauaaaugauuuuuuguuuuaugcugggacaguaguucuuuaaauagaauauucucccauggaaaucgcccacaaugcugagaguacaccuugcaaaagguaagucuagaauauagggugccuccucagcauugcccagaagcugaaguuaggacucucuagaauaccaaaaacaaauuuauagcaguucauuaauguaaggaauuaugaaaacugugugccaccauuauccauagaugaaacaagagccaccacgcaagcacagacacaaagcccugaagaugaagccauugacagggcucucauuuauucuguagaaacccacuugccuguuuuugaaccaguuuucuuuggagcauaugucucacugugcaaccaaagugguguuuauauccuagucacuuggcaaaaauucugucauugcuucagggagauccauuuuaggccugaagcauggagcugguaauagaugggauuugguacuucugaagaaaagacccuacugcaaauuuagagaguuaauuuuuucuuuuguuccccauaauauuguugcuagauagaacuaccuuuuuugacuagaaguuaaauauagaggccuaaaucaauuagguaacucccacucauucuaaaugagaacauguuuguuuuucuccaacgagaugagaaauauuugaggcgcuuccugauaucucuaucacccacugcauuuuuucacuugauguauauuuccccauguauuugggauaauuuucaaauaauugcccuuuagaaaucuacuugauauuaaauguaaaaaaaaagcaagaugcaaaauuauuauaggaugcauuuacagaaauuacaaaauuucuauaaacuauuuauggaggaagacuuauagaguauaugucaacacauugcuuuauuauuguccuugguuaugaguaugguuuuuuugaaaccugcuuuguacuuuggguguuuucucaccauugguacaauugaggcauuuuucccucuucuucaaccuugcaaaucacacgugaggaugcucauagaagugccucucagacaggcuguuguuuugcuuucaccaauaaaucauuuauaauuagaaguagaaaacuauucuuuccagugcaaauacaucccuuucaaaagcaguucucuuuuugugaaugaugucuagugucuaagaaacgaggguaaccuuuauuauaugcauugcucuaaucgaagcauuguuuuuugcggugaacucaagguuacauguuuaagaaaagcaucggguuaauuccauuaggaaaagugucuuauucauaaaccuuuagccacuggaaaaacaccauuaggaggccacacaaguguguauagcuggauagaauuugacaacuggcaaaacaaaacaauagccuacaauugcagagugcugucuguuuaaaaaccaacauaucuuucaccaacaaauacauauucaccucaacacgagacuuucaugugguuauuaauaucaaauuuuugaauguccaaauuuuggaguguagucuagcagagguaaacugauuugccuaagguccuucaacugucagagguagaauuauuuucucucuccuggcucuaaaaccuguccagauucuccugcaacacuguccuucaaaaacacacuuccgcugacuccagugcuggugaugucaugcuuuagcuaguaguuagaggugacuuaacuuuaaauauggaaucuuuuuuuccuauuaagcaaugagguuuaguuugaaaauucuuagagaugauaaaccccucuccuuuuuuucuuccuucuccucuuuuguccugaacaauguuccauauauauuacugccagaaacagauucuugacauuccuguuaugcuuuuccacaucuuguaaucauuucuacagcuguuagcauugccaacaauuauauuuccacuuuuaaaaaauuguuacaaagaugcagagagaaaagaggaaagccaaggaauaaacuacaggcaauuaugggauauuuuugugaugugacauuuugggaacugaggcagcaucacugauacugcacuacuuuuuaauaucuagauuuuaaucuuuuguaugaagauaaaauucacaugccuuaaaccugaccacaacauaauagggcauuuauuuuucuaauuuugauaccauccacauuucuuaacuauaagaagaaugcuuauguuguaccagguuauaugauguugccaagaaguagauguguaccauuuacuaauacauccuuuuggaaaaugcguauuaauaacauauuaaggaguaaauugacguugugcaaagugagccugugaguuuaaauguauggauuguacaccuugcucuuccuaauugcagauuuaacaggauuugaugaccuaaugaguuuauuucugaaugauuuauauuucuuugucaguucaaugauuuaguauuuuaaauuuuuuuaaaucacauuuuauugagauaaugcuauuaguguuucuuucccaucacuuaacaaaguuaagucacuccucucccaccccacuuuuguaccuaccaauguuuuuuucacaguuacaggcugauuggcuugacgugucuuaggauaccacccaaagagagcuucauuuuauaaauaccaagcucauuuuccuaaauauuuucaaaaagauagauuuauccucauauaguaaauucagauuaauaauuuuggaaagggucaugugaccaugguauuacauggcuguggaagacccuccaagaucuuguuuugggauagaaggacucagacauccaaacuuuuaaauuaaugaacuuauuaaauucuaaaacuuuguaacaguguuaauuugagaaguauaauauuuugcuuaaggucuguuuugcuuugcaaaaugcaucuccuucauuuucauauuauguuggaagcuuagcaugaaagaacgugccucagaggaaaccauagguaagcauacuuuaacaaaaguuagugucaucauguuugugucuuugccugugguuuuuuaaauguauaauguuuaacguugauuuggcuaucaaauuacauuuucuuuuguuaaaaaauucuguaaauuagaaauguacugaaucauuuauuuagcagacugaagguggguaauguuggcugaacagguuuaagccacaguaauuugaaaauguaaauacauaaaauaaugucauuucucuuccacucaauguuucuucaccaaauaaaguccagccugcucugaauuuguugccaguaggaacaauguuacagugaaucaugguuuaauauaccuugaaaauggcacaucuguucugugauagcuuaccaauuuuagccucuuuauaaaauacgaagaguuugucaaccagaauaaucuagaaccuggcaauucaaauaccauucaaagcaaauguuuuaucuaauaacuggaacuaaauguuaggccucaugacaguucaauauuuacuaaauaaguuuaauaacaggguaagcccucaguauccagagcagagacaagcacaccauauuuacacauacaaauucugccuuuagccaucugaaagggccccgaacuauugcagcaagcaaagagucuuugcauuguccuaaaauccauacaauacuuuauauuuuacacauuuuaauagcuaguuuaacaaauaacaaguaccaugcuuaauucucugcaugcauuauuucaacuaauuauuggaauaaucuuauaaaguggguacuuucgucucagcuuacaggugagaaaacaaaaguuaaauagaucgcccagggcucugcuggaacguguuaagcagggauuucagccuguccagucagaccccagaaguuguguucuuaaccauuagcaacacaucaucccaggcaggcccuacaugagccucauaaccaauuuuaugcuggauaguauuaucccuauuucacagauggcaaaacugagguccagagacuuuaagugaccuacccaaaauuacagucaugagcagaggcacuggaauguagggccuugacacucuaccucacgugguccucuuuccuguuuuggguaguucuccacuaccacuacucauuucugaugcuggaaaggcuguguuuuauacauuucuguuucuggcuuggaacgaaacacucugggucucugcuugaucaguguccccucuaaacugcaccucacuacaguagggauggcauaagauacuucuuuacacagcaucuuuuuguucccaccucacccccagagcuguaauagguagagccagccaaaugucaaagggaugauuugucuugucaccacuaguuucccuuuucucugccuuguauguaacaggaauauucuuuaguuccuccuuauguucuaaagcaccuccccaaccuaaaaauagaagaggaguugugggucauuuacacuuuagugugaauuugcccuugugacuuugccaaggcuguugugccuaacccuuucaaucuaacagcagaaugagagucucuggacuauccuggcuccuucccugagaagaaugaacugggaauuguuggucuagacaucaagacuaccagagaccuauugcucagagauguuugggcuguacaauuucuguagauauggcaucuggagcagccuuuucuaagcaauggcauuaucauuccaggcucucucgcucuuuccaucucuccaccagguggacucuugcccuccaccccuuccaauuugucagugauucagagaacauucuccauccuuccaaugauuacauuccuucaucuugcuggggcgccaauucagugauggagcggcucuugggagcagccuuggcuuauagugcagcucucugcuaccuucaacaggcugguauucggggugcuuagaugugacugguuguacgcacguguguguaugugcauguguguacagcaguaagagcuuucgagguagauacuugaggaagccucagacaucuagccccauuacuggggcaaugucuuacuuggguuuuuccagaaacagaccuggagaccaggauucaagugccagugguauauuugggaugugaacccugcaaugcugguaggagaguggagaagugaggcaaggaaaggaaggccgucaaggggcguguuaggaggucauucaccaccgcagguagcccgcuggggaccucugggagcaaguguggcgcacaagccucagcauuacugcccugugccuugaggaguaagggauaaggauuuuccccaccaguucccuguaguccuuggugagagcuucugggguggagguuaaggucuuuaggucagagaaauuuucuuuaguuucggaaaaaucuuucaggccgagguccagacacucacuggaacacacugaagugguuagguccaagggcuguaggcagagcucccauauccaucugcagagguguuucagguggaaggaguggagacagccuucucugcuccacacugucuucagcaaggguuucuguaucugugcauugaggauuaaauuauucacauggucagagaagcccaucaccacugauaguuauuguagguauggaaaacuaacgacuaagaagggagaaaaauauaccaagcaguuggcuuggcugaacacaaguaaagacucuuacagucacuggugugaacugcuuauuaucaaugucugauuacagugcugcauacuaaugauuaugcaugucauuaaaugugucagauuaacuuuguuauaaaauuuaugacaacauuaaauuuuauucacaugcucagccuucauaauuuauugcuuauguagcaugguuuuaacuucagaaaaaccuccaagacaguguugucuugaugacuacacugcuuauccgugagucuaguuuuccuguucauuugaaauguucacauuacauucagcucugucucaagcacugagacagagcuggaaucagugcccagcgauuccacuugccgagugauugaggcugggggauuacuccccucucuuugugaauucucuugcuguguguuauugauuaauucaaccaacucuuaguugacccuaaccaugcaacauguauugugccaggugguguggauuuagaauauggauuagacccucauucuguccucaaggaguuccuggucuaguagagaaucacaucacuuuauaguugauuguucaagaaggaagcuuguucaaacaugaauaaaagacugugcaucuucugacuuuguagguguggaauaacaaagaucuguuccuuuauuggguuuccagaaaacaucuccaaagcuauaccagucaucauuuugugcuuucagaaaugaguaacauuguaggauaguacuuauugcuuguacuuagcuuugugugcuagcugagcauuuguaaauagaaggcauucacggguaaaauguguuuccuuuagccaaaugcacaaugguagugccuuucuagaauccaagcuaaagaugucgucacaugccacauccacacacuucuuagcaaaaauccaacuagaagaacuuugcuauuuacaacaaaggcaaaugcugucaagaaguaggcuuaguaccacaggaagcggagccaaauguguucuugaaauuuauaaguugaccugaaaauaauguuuugggaagccauggcuugccguugucagcugucaaaauugagcuuggcaggagaaaucagggucaggaacagaauagagauagucaaaaagagacagaacagagagagggcuacuguuguuucuggaguccagugaccacccggguucuagugugguacuggcaguggacuaaauaaguggauccacccuaagguggagagaagguucauauggagauaauuuaaagagcugacuuuuagcccuuccaaagaauuacauguuccuaacugccaaccuaggaacauccuggauuaacuugcaauuuaaggcugugguauaccuguuucaaauaaaauagcccugugaauagcauggaagucaaaugauaucaacuagguuugaaacaaccuccuucucucuuuugaauggagcagugauuaaacgcaagacaucagcuuagaaaaugcauguauuagcaaacgccuaagaugaggaaagaucugggcaugcccugaagccaaugcaauuuuucuuucuccaccccaaaccugugcuacgugaugaauuuacaguauuaaaaacauugcugccgccuacuucuuccagcugggacuucaggaccaucuuugaauccuccucggcucuccacacccagcagugcagcaacuccucaucucucucucucuuucucucuuuuuuuuuuuuuuauuuuuuuugagacagagucuugcucuguugccuaggcuagggugcaguggcacaaucucggcucacugcaaccuccgccucccagguucaagcgauucuccugccucagccuccugaguagcugggacuacaggcacgugccaccacaccugacuaauuuuuuguauuguuaguagagaugggguuuuaccauguuaggauggucuugaucuccugaccucguggaucugcccaccucggccucccaaagugcugggacuacaggcaugagccacugugccuguccuaccccucacaucucuuuaaauauuuuucaaauaucugccuuccuuuucaaucucauggacuugguugugguuauggccucuugugagaggguuucuugcuuccauuuuucuccggcuucaguccaucuuccaaacccaugucagcggcuucuccugcuugcacagaaaaugaaguucagacaguuugcauuugagccuuggcucacuuucccagccucaccuccagugacccccuucucugcccuaccccaguccuucuuagcccaucuuucuucucaggacacaccaggcaacuucaugccaccauuccuugcguaugcucuucucuuggcccagcucacuaccucucugaaauguuccaaaacgcuuccaggcagaauuaaucauuuugugucuguauuccaaaaaccaggguuccauucucuguuuaucauggugaugauaguuauuuacuugucacucuuaguuagcuuuguaacaccuagcacaguaacugaaacaguagaugcucaaacauggauuuauuuuuaacuuaaaaugagauggguauuuuaggaugccagaaucuuugggucaaaaagauguggcuuaguuuucaugucaggaacggcucuuaguucaagcagugaaacaacccuggcucauucaaacaggaagggaaaaaauucaaggcuguugaguugcucacaggcucugagggguucauggaggcagaugcugguggccucagcggaaggagcaauacacagacucuccacagagaacccauucugccacugcugcugggugcagagucugguugcaccuaccacgccccaagccugaugccagauucugcugcucccucuggaaacugaugucgcucccagugcagcugccaccccagcccaaauggauucccugcagccccuccuuagcccaugucaugccaagagucagugccaucugauuggcugagccuggaucacaugcccaagcccuagcugcaagagaggcugggaaagcaagcaucuggcuucuguggaguuguuggucucugccccccaucaagacucaugagguggcugggcacgggcaugguggcucacaccuguaaucccagcacuuugcggggcugaaacaaggggaucacuugaggccaggaguuuaagaccagccugggcaacaaagugagacccccaucucuauagaaagaauaaaaagaaaaaaaacuuaggcaugguggugugcaccuguggucccagcuacuggggaggcugaagcaggaggaucacuugagcccaggauguugaggcugcagugagcugugauggugccacugcacuccagccugggcaacagagugagauccuguucccaccccaccaauaaauucaugcauacauacauauacucuugaggcgggaaauccccagauucagcucagaugcuggggugacagaaggugcaaaaagagugacagauguccacuagaacuuucuuucagaacaccagaacccugguuaagagcuuccuuugaugguauguccgagacuuagcaggaaaagcauggcaugcucaaauugaguaacuugagaauugaauaaagggaacauuuacaaaggaugggcaggaugcagggaagccaccaggaacagcugcacuccaaggccaguaacacuggggagcuuuuaccaccccaggccugaaggggcaaggaguggggcaguuaccagaccuggagacagacacaggguuguguguguggagaggucccuggcaggagccaagacugcauuagaaagacacagccagcccugggcaauuccucgguagggaguaagugcuccaauucccccuuccuucccuaugguccccugcugaggcuucccacaagccccaugcggaagccagagggccagggagccccacuucucaaaaugagcagaguauguugaagaagggcagagaguggauccggaggaacaaguagaagacaggcugcccaugaggcuucaucauaugucaccaacauuuuucuauucauuuuauucaauaucuacuuuggggaugucacuucacauuuuaaguaccugagcccacaagaucgaugugaucuuaaaguguccuucuccuauugaauuuaacaagcugcuauuuuccccucguuugcuauucagaaugcucuaucauaugguucaacaauuuguacuauuaaagguuagcaaaugccagccaaaaauucauuuuuuuccuuccugggcuugggaaaagaggaugugacaugugaccugcacaaacacaaugucaagaaucucccuuuacaagucuccauguagaaauccucucuaggauuugugucagcacacgagaucuccugcugcucaucucugccuccucuucauuaauaucuagccuccuaaauaacgcagauagaagaauggucauaaaauugagcccuacacaauuaccaguagcuauaggccuccccaaggauucaggcacuguaacccugauucuuucaaagcaucugguaacuugugcuagaauaaccauuuacuuuggaaaagcauaccaaggagaaagcuucauccuuugucuuugcauagaugguggguuccuuuacagaauauggaaacugauuguuuucccauaaaccucaacuaggagaaugagguaaucauguguuauuuagauaaaagaauguucaccuuucuuuuuuacaaaaauuaugguaauagaauuauuuuuuaaaugcaaaugauggagaaguacacagcaaagggcaaaagucacccuuucugugugcccacuucccuugguccccccucaauauuaacaauaugccagaaaaagcaagauuguucuaaccacaugauuacaagcuguguccucagggacugcugaggauguggucuuggaacaguauguacucuacuucuccuucaagguccaggcagcccuugggucuucaagcccaagacagaaaguucacuuuguaucucacucugggagaacaacacccauuugcaaagcuguaaacuugggugguguaucaugacagccacucgcaggggacucuagaggcacuucuaucuauuuacuuaaguguuaauuguacauuucugauuuaccacuguccuaccaaaacaggaauuugcuuucuuauuuuuuuuaaaaaaaaggauggaggaaucaacuaacaauaaauaucugaaauuccuagguaugauuuuuggcauuuguagccaucaauuguuugccaggagcagaauguguaugcuuuuguuagagugucaugaaaugaauauaacugauauuuaaugugaacauaagaaauacuuguuucccuggcuaacacggugaaaccccgucucuacuaaaaauacaaaaaaauuagccaggcgugguggugugugccuguagucucagcuacuugggaggcugaggcaggagaauggcaugaacucaggaggcggagcuugcggugaaccgagaucgcgccacuggacuccagccugggcgacagagugagacuccauuucaaaaaaaaaaaaaaagaaaugcuuguuuccaguauuacaccaaacacauagaguuuucuauauggauuuuagggauguguugcaaggauuuugaaagcugccucucugugcuuuguccuucaggaagaaaucccugaccuggcucacccuggcucuucuccucucuugacuccuagaucacauggugucaguaucccucauaauagccuguacucaucugaucccaaguacuguaaaugagcuggcuuuugcguaccaggcucaucuuagcagauuccaaguuccuggagggcaaggaauuuguuccaggaugacacauagccauuugacugaguucuuccauccuucuuuuccauagcuuuccuacaagacccuaaaccuuugucuccauuacaacuauggcaaauauccaugcuggaugaauacaaaugccuacccuuggcagcugucuccuucacccauagccuauucaccacagauguuaccuccuuaaaaaacacaugcacacacauacacuauggaaugaauccaucuacuucuuuauaucuucauugccacaacuuuauccaaccacugucaucucuccuaggucacuguaguagccuuccaguugguuucccaucauccauucugaagggcuuccaucaguucuuuacacagcagaguuacauuuuuaaaaugcaaaccugaucguaucacuccuuacuuaaaauuguucaauagcuuccuauuuaccauucaggaaagacaacacuuuuccuacagcauagaaggucuugcaugggcugaccccacuugccucuccagcucgucuuauuuauaagcuccccuuugucucugacccccaguccaaucggccuucuuccaauucuucgcuacuuuccccugucccugagcucuugcacaugcuaagucucugccuggaaggcucuuccaauccccuucacuuaguagaaucuccuauucaucauucucuguuaaaucaacacuuuaugagugaaaccuuccuuaaggucccuuguguguggauaacuuugccaugcaccuguccuuaagauuuccacaguugguaauuaagcaauuauuuuuugagcauuuguuuaaugucuauccuagaagacugaggucugugagggcauaugucaaauccauuguauucagauccaguuuuuauucaucauuaugucugccguaccacaucuggcauauaguaaacucuuucauaaauacucucuuaaaauacagaaagaggucaggugugguggcucaugccuuuaaucccagcacuuugggaggccaaggcaggaggauaacuugaggccaguaguucaggaccagccuaggcaaaauagcgagacccuguuucuacagaaaauacaaaaauuagccugucguggucccagcuacuugggaggcugaggcgggaggaucacuugaacccaggaguacuuggcugcagggagcuaugaucaagacacugcacuccagccuggguaacagagcgauacuucaucucuuaaaaauaaaaucauaaauaaaauauaaaaaaauaaaauacauaaagaggggaaagaaggaaaggagggaacagaaaguaggaacagaguaaagaaggugggaaggaaguugaaagauuguuaaaacaccaguucaggugccuacuuuuaaaacuacucaagugcuuccacacuuacuacuuaaaauugcuucuuuguuguugccguuuugcuguggaauuugcuaaaaucaguuucuuuuaauaucuuccuuuggacuacaugcuguguauaaaaauaaauguuugucauguagauccucuuauucagccugauucaaauacccagcugccugcuggauaccuccaccuggauuucccaccaaccaacaugugcaauacuuaacucauuguaucccuuucccucaaaacucugaucuccuucucauugcaauauccucguuaaugacguuaaugacuuuacaucccaccaggagcuagauuccuugcuugcugacuggacauccagucaaucaccaaaucccacugauuugcccaacaaauaccuugccuaccucuguauuccugcugccaucuugcuagugcagucacuuauuuugucucaccugaaggauugcaguaaucuaauuggccucugaguuccaaauucaggaaccuccagcccaaccuccccugaauugcccccagaguucuuucuugaaugugcaaaucuuaucaugucaguuucuauagauaauuccucaaugacuggcuauugcccuuggauuaacagggaaacauaacauggcauucaaggcauuuugucccucauccugugucuugcucuccagccuuguaucucauugcuucuugaacuccagucacauggagcugcuugcccucucugcaccaaccacauggugcugauagacaccaccaugcauuuauacaucaugcucgccuggccuggaaugccuccaccccagccgaucuggcagacuucucauccuucaaguucaaaugaaguuacucucuuuguacuugcuuuguuccuugugacaggaauggggcaggaagucugguuagagguuacugauacgauccagcugagacuaggguaguagcuggggaaagggaguggagaaggccugagacaugcucuaaauguagaguuuucaggaccugccgauggauuggaugugggggugagaggaggggagggauccaggaggaauccuaaucagaguaggcagcuaccacagcaggaacaaaauuauaaggaaaaagaauuacauacccguuauccacuucaacagcuaucaacuccugaaucaauuuuuuucccuuuauaaucuuaccugccucuuugcccugcccaccuuuacacacauaauagauuauuuggaaacaaaucccagacauuucauaauuucaucuguaaauauuccaaccgcaucucagaaauaaaaaggcucuuucaaaaacauaaccauaggcugggcaugguggcucaagccuguaauuccagcacuuugggaggccgaggcagguggaucaccugaggucaggaguucgaggccagccugaccaacauggugaaaccuugucucuacuaaaaaauauaaaauguuagcugggcauggugguaggcgccuguaaucccagcuacucaggaggcugaggcaggaaaaucgcuugaacccgggaggcagagguuguggugagccaagaucgcaccacugcacuccagccugggagacaaagcuagacacugacucaaaaaaaaaaaaaaaaaaaaccacacacacacacacacacacacacacaaaacaaaacauagcccaaacauaaccauauaauaucacuccuaaaaacauuaaugaagaaagaacaaaugaaaaauuaauauuaggacuucauaucaccagguauacauuuaguguuuacaguuuccuguuugucuuauuuuuuucaacuauuuuaucucuuuguuguuuguuugaauugggaucuaaauuguccuuguauauugauucauugcuguguuccuuaagucucuuuuaaccucccaucaugucucucuucucucccuucccuucccuuccugccccucccuuccucucccuguuucuccccuccccucaccucccccuuccccccuccccuccccuccccuccucuccucuccccucuccuccuucccuucccuucuuuuuucucccccacuuuuuuuccuauuuuguuguuuucauuggcauuguugcuguguuaaagaaaccuggauguuuguuuuauaaaauaucagaaauucucugauugcuucuuuauggugcuguuuaaccugucccugugucuccucuauuuccuaugaauuggcuuuauaagacacagggguuuuauuguuuuguugccuuuagaaggggacagcaagauuguuucauugauuauguuuuauaccuccaucagcaaguucauaaugucuuguaaucucuauuuuuguggcauuaacagcuauugaugauuauugccuauaucuguucauuuauuacagguugcaaaaauggcaaucuguaauaaauauucucauucuauuauuuuucucuucaugugucaacuuaaauauucuguaaagagaaaauuuuccccuucccccauuuggcuaccaugggguaaaguuuauacggaauagguaggauaugugcuuuauucuucccugugcauaccaguuuucaaauaaugagguguuuccuggcaucuuccaaaggugugcuuguuacuguuauaauuaauguuauuaagaguuuauguguuaaauauguuuuauauggugauugcaguuauuguauuuuacaauauuuaaauuguucaaucuuugaccaguggaagccugaucaagucagcucuggacuacuuuugacauggcccuaauugucuuugauagcuuccuugcuuucugguauguuccagguucaacuuauauauauccuacccuauaccuggaaucagccauuucucuuaggauuccugguuccuuuuaaugggaaauauuauuuacagaccacauucugagcaguaagugugcucauugcuucugggcugguuauuauuuacaguggacaaagauagaaaacacaaguuuuuaaacaaaaaugauuaauccauucugauauguucaauucaaauucaggacaaucauguuuuuacuuuacuucauggaccucauacccacauucucccuucuccuaugcugaaaaucccaauucuaaauaauuccaauguaauuacuaauuugcuauaucccacacaacacacaaucagccucagaguaauuauacaaaaacugugauaacaauauggcuaaugaaaacauuucaauuuuuuuucucuuuguccuucagauauaucccacuaaggauguacagucaaauuauuguguuauagaauuacuuggaaucauuccucuguguguaccuauacuaccaacuguuuauauaguuagguucacuugcuuuauuuugcuuuaaauuuuuaauaauucaucuuuaaauuaaauuuaauuuaucguuauaaaaauauuugcaugauugcaaagucaaaaugacaaaacaagagcuauucaaaguccagcauccccucauuucccucucuuuuccuauaaauaaccauuuaaauauaugauuuauccuuucccuuuuuauauaagaaaauggguugacauauuuuucuccacugugucauucuuacuugguauauccugcccggugaugaccucauggugacaaauacaagucucuguauugggcuucuggcucuaaguaccaaauaaggacagccaacgaguguuuaauaggaaccugcagauucucacuccucucucucauaugccacagcuggucugucaggauauaacuucaacuccaaauucugaccccuucuuaccaccucacugccaccaucauggcccagggacaucaccugcugcugggauuaucacaguggccuccucacuguugucccugugucccccgcucugugcccuguguuuuguucucaauacagcagccaucaggcccaggagaacaaggauuuucucauggugaccagagcauuccuucuuccuccaccaugucccgauggcucuggaaguaagagaugacaagggccaugugguacuuccuuucaucagguagacagccgacagauauaauaagcgcuugcaguuuauauaauguuuauuauguuaauauaagcuuugcauauaucaauuaaguccuuuaaucccuacagcaacccagugaggauggcuucacaauuuuccuauuauuagagacgaagccauugagacacagauggauuucaaaauugcuuacaaccagguaguucacaagugguaggguugggaucaggauccagggagucuggcucuagaguccaugcuuuaagccaaugcuguccaauagaacuuucagugaugaaggaaauauuccauaucugugcuguccaaucugguaaucucuagccacaaauggcuauugaggacuugacauguggcuaguuugacugaggaacugaggaacuuuuuuuuuugaaacagaguuuugcucuguugcccaggcuggagugcaguggugcuaucucggcugacugcaaccucugccucccgggcucaagugauucucaugccucagccucccaaguagcugagauuacaggugugcgccaccaucccuggcuacuuuuuuauuuuauuuuauuuuauuuuauuuuauuuuauuuuauuuuauuuuauuuuauuuuuuguauuuuuaguagagacaggguugcacccuguuggccaggcuggucuugagcucccagccucaaguuuaucugccugccuuggccucccaaagugcugggauuauaggugugagccacugcaccugaccaggaacucaguuuuuaauuguauuuaguuuuaauucauuuuuauuuaaaugagaacacauuguuacauguauuagacagcucagcucuaaaccacuauacuauugugcuuuuuauauaugaccagaagaguggcacagaguuauuuaacucuuauuugcaacuguuauuuaaaaccaaagauacaacaucuuuaugggauuccagcugccaccugugaauuugaagucuucuaaacaaugucauccauaaucuaugaaacauaugccucuguaaugucaaagcucuguuagaccaaaaacaguuauccaaauacauuauguuccuuuuuauugaaggaaauggaggaccaaaguguucugacucucauuuguccuuacuuaagagcauaauuguguaagauaaaaauaaagaaaagcuaaucacaagagguagaucaugacauugcagauuuaguugaaauuuacaaguuauauuucuauugauuuuuucauuguauuuuuuuauuuuggaaaauugaaaauguauaaaacuauuuuaaaaaagaagaggaaagaaaaauccaagaaaucuucaccaacaggaauuaaucacuggcauauuugagucagucuuuuuuccuauguauauaauauuuuuaaaacuguauggauuaauucuucccuuuuucuaaaagaaaaagcacauuauugacuuaacccucccccaccuugucuaucacauuaaucacaguaacucuccuuagucuccagaaauagacacuguucugaacuugguguguaugcuuucagcccauuuuguaaacuuuuacauguauauucacauauccuuagaaacacauaauauuguugaugugggaauuuuuaaaaaacauuuauauaaaugauaucacacuguauguuguucugcaacuucuuuccacucgucauuuuugagcugugcgcauuuugauaauuuacaucuagagucauucuauaacuauuauauccuaggaacacaccacagauuauucauuucuugcugguggauauuuagguuuugucaguuuuucauuauuucaaauuauguugcagugaacguccuuguacauaucccccagugcaucugugcaaauauuucucugugcagauaauuuuaagauuauagaauucacucaucuucaauauuacuagguccuuccaaaguaccuccaacuuggcuaugauguagacucccaccagcagcauaugaaagcacucauuuccccauacuuacaccaacaucugauaccgaccaacuuaaacauuuugcacauuugaaguaaguagcuuauugugguucuauuuugaguuucuguaauugcuagugacguucaacauccuuccauguugauuggccauuugaauuuccuuuucugugaaauccuugaaccuauuauuuaugcuucuuuguuuugaguugcuuaucuuacugacuuguaggaguuguucaucauuucugguuaacagucuucucuuacuaggcauguugcaaauauuuacucccuauguauagcuugucuuuuaaccuuuuuaugauguauuuugucaugcagaaguuuuaaguuuuagauuuaaugauggcuucuaacaggcuucucucauucuuguugaacugguuacaagccuuguuaaaucuucauguguuaaauucuaggaaaagagaggagauucgugugugacuugcugauuuauuggcugauugccauuucucagagaaaaauauuuucuugugcauauuuauagcauuuccuuaaggagcaaaguccauuuuuauaucauugugaauguuuuguuuuggugguaaugauuuuuugauaucuaauaauaaaauguugacagugguaaaauccuugugauagcuuauaaagcaagaauugauuuugcucuucauugcacacucuuugaaaguguauauucauggcucuuuuuccuggauuuuucuaguuauuuugaucugcuaucuauaauuauacugaaaaugaauuucauauguuuaaaaauuauuuuagauaucaucugucuucaggcagaagucauagcagacuggaggcagucuaccagcuuuaaaucccagcucucccaccuauuaucuggaaaccuuaggcaaaccacuuuaauuuuuugcuucucaguuucuuaaucugcaaaaugggguaccuguaaaauaacagugcaagugucaugggacuucugugaagauuaacugagugguaacacuucagaggguccuggagcagugcuuggcauagagaaaacauucuacagggcccagcagucauugucccucaacuaccuuaagauucauacaaaugaggagaaacacuguagauuuagugcucucuggaaaguauauucaagucaaagagcagcugacgucucuaauugucauuucauaugccguuagugacaccgaaaaauagaccaauacagacaaugacgagcacaacugaucuauaugaaacuaucauuuauagauucuccaucacacacuuucagccacccaagcucagugcuuucuuacuccaaacacuuaaaaaacaaguuaaaaacagacaaaaaaacucacaaaagauauguccuugaaccacagcuccaaaagucuggcccaucacaagugugaugguagaguuaucagggucagaauguguuuggccccaccugccccaggaguccgcgaagcuccgugaaggcaaaggccauguccaugccaaccacauguugguggaauucagucauuucuaggugcuuagcgucaggugggugccgccuucauucuuuguuuuaacugacaaauaauuguguauuuguggggcacaaugugauguuuugauguaugugugcaauguggaaugauugaucaaaucaugcuaacaaauccaucaccucacauacuuaucuuuuuuuguggugacaacacuugaagucuccccuuuuaacaauuuggaaauauacaaugcauuauuacuuauucuagucaccauucugugcaauagcucaguaaaguuuauuccuccugucuaacuaaaauuuugcacccucaucucucaccuuuuucccuccaacccccuuucccagccucugggaaccaccauuguacccucugcuucugugagcuugauguuucagauuccacaugugagaaucacaaguuagaucauguggcauuuguccugugccaggcuuauuucauuuaguguaauguccuccaaguucaucucuguugucaaaaauaacagaauuuccuucuuuuuaaaggcugaauaguacuccgucuuguacacgcacguuuucuuuauacauucauccaaugacgaacaccucgguugcuuccauaacucagcacugugaauucugcagugaacacggaagugcaaauaucucuguggcacacugaguucagcuccuuuggaucucuacccagaagugggauugcugggccccaugguaguucuauuuuuaguuuucugagaaacuuccauguuguuuuccaucacggcugugcuaauuuaccuuccuaccaacagugcacaaggguucccuuuucuccacagccaugcuaacacuugucuuccaucuuuuuuuauaauagccauuuuaacagguaugaaagaaaggggccccuuuguucuuuccaaacguuuuucaugugcucuguccccagccccuggcuggcuggaugccgggaucagggugugugaaugcccuuccacagcuucccaggagugcugggcucagggugggaagagcugaguuugaggcccggucccuuacuaacgaacaauaauuaauauaaccucucuggcuuuagggagucuaggggacauguggucaucaaagauugagugaaauuaacaugugaaaugauguaacaaugugggacuuuaaauagugaaagcggaauuucaccagaaauuacuuugauggccacaacuagauguuaaaaugaaagcugacgcauacuuaugacagaacaugagccacauuauuuuauuucugcauuucugcacucucuccuuacuuugguaaaucauuuugaaacaagcaccccccacccugcagcucuuccauucaugaaugaugcaauauugagcugugauauuuucagaaguguuugcuaagcauuggcagcuuaacuaaaagcauccucucuauuuugcucuuggaucacugcucucaccuguuaacccccagcagaaaaucugccugcugaacaauagcuugcaaacgcagcguggcacucggugccggugccggcauaaaggagucagcgagcagggcguugggucagcuugcuguugagggcaggcuguuuuuguuggcacaucccuuuugugaaggauguaguccuuguucuaccaucuguaccaggcugcacaccaucuauuuauuugcuauccuugaacuaacgggguauuuucccccagccauaaauggguuggugugagagaagcuucuccugcugagggacucacuucugcaccgcauccucuuuguuaaucuucugcaaaauaaggcaguuuucuguugaagagaaagcaaucaucaauuuuucauaagagcagcaaaguugugaauaucagaggaccucuugaauaaagagcuuagagguuccagugagagacgaauaacaaagcccuggggggaagaaaaaaguauauccuuuuuuauacuauuuaucaucaacuccccccuccacgccccugcccccccaucauccgcaguuaggaaggaagaagccauuuaugcaagcuaacaguccuucaaaccucaugaaccuuaauuuuaauccuuaucagugccuuuuuaaaugaauaauacagugaccuucagcuuuguccuauauuaugugagguugauucguaaagacugcuuuaguuuuuuaaauuaaggcagaagcuauauguauucuacucaauucuagcauuagugcugucccaagaguggcauuuauguucuuuugcuucuuugguauaaauaaauaucaaaguaggaagaccagugugaauucuacaaggaauaauaaacuaaaauaauauggcauugauuuuguucaggaugucuaaguguguuuuuaugauuguguauuuuuauagcuuuuucacacaagugacaugaauucugggcaauuaaaaaggacaugaauuucaaggcauuuaggaagagaaucuguuuucuaauagcugugucuuuuaccaaguugugguuuuugagaaaagcauugucgauuucagaccuccaccuucagaaacuggccaguuauugccauuuuguauuguuuuacaauauuauugccaugagacuacauuagagaacuuuguuuuggcugcuaaagugcaauauguggauauaacaaucuaauaaagaagcagagaaagauuccuuuacacugcauguguauuaucuuuuugaguuucuucugaccaaggguucuuagacuguagcuuugagucuuauuagugaggucucaacccuuccuacuguugagggaggcaugggccccaggagcgugugagccuuggacagucacagagacaauucguuuacaaaugggaggggagcccaacguggauggcuuuccacaugaugaauuuaugacaacucauguugucacaaauuucaguaaacuaacaguagcagauccuaugcugcugggcuaacuucucuauccccuucucucaguccuucuuagaucauuaguguuauuuuuuuaucaacuuuuuguugcauuauauaaauuacucaaguauuacuuaaauuacucaaguaauacauaaauaucagcaacuugaaaaaauuaaaacauuauagauaaguuaaaaaucaccuuggaccucuaccaccauacaaguuccuauucccccuccucuccucaauacccuccaccuucccaguaacaauuaccaguuuagucugaauccucugaaauauuuuuuguauauuuaagcacagugcugugaaucuauagcacuaagcaacuagauagcauuguuuuuuaaaggcuuuuuccccuauauaggcauaacauugaaugugucugcagcuggcuuuuuacuaauauuucuuuaagaucuuuccauguuaauucauauagaucuaccucauuguuucauaauauuucauguugugccuaugcuguaauuuauguagcuuuucuccuauucaggggcauuuguguuccaauuuuucucuauuaaaaaugccacuguggugcgugacuucuuaugcacaugagugccucucuagguuuauaccuacagauggaauuucuggguuacagaaugugcacauuuuagauagggucaaaucgcucuccaaaauggaguuaauguacauuucucuuauuacuaaugagaucgaaccacuugucauauguuuauuggcuauugguauuuccucccuauuauuugcuuauucaaacacuuugaccauuuuucuauuggguuauuaauuugucuaauuacuuuguaggaguuauguguguaugcauguguauauauacauacacacauauauauauacacauauacacacuguauugugauccuguaucuguuacauaugucagucucccagacuuuggccugucuuuucaauuuguuuauggugucuuuugucaccauuguuuuugaccuagauuuauauuuuucaaucuuauucuuuuuuucuccgaauuuccuuguaaauaugcuguaauuaucauuguaaacuuauuauacauugcuuauuagagaaauaaccagauucauuugggguuugaagcugagacucugugcugacuccuugcuguccaucccucaguuguaggggagccucauguggggaggguguggucauagcuacugaaauccauuuccagcaaacuaggaugauaaagcagcuuuggugugaauguuuucuuucacaaauguauguggauugaagguuugaaguuugaggcaacauauauguggagagggugagcgcauucauuauaugugggaggguuuuuucauuuuuauuuuuuggguuuuuuuuuuuuucugguguaauugggaaggaaaagaaacagcucagcacuuucccugccaucuacuuuucagaaacuaugggcccacaacucccaaggcuguauucuagguuuuauuguauacuucaaauugggauauaucucaaaacaguugcauuuaauugggagauuauuaaaaagcaugagcaaauucagaguuucuugcccagaaaaugcugccaauguccaaccuaaaugaggacauucuucccuuccuguuucacaguccugccaggagccauaugaagaaggcaagccaguacagaugauggguacaccggggcucagacuucaccacuaugcaauauacacacauaagcaaucugcacuugcacccccuaaauauacacauauaaaauaaauaaaaacaaauuuugauaaagguaaaccaggucagggcuuuuaccagacugcuguuccccaaacuucaguuauuugcaaaccaucuugacaaauguugccauaacaacuuuccuccuauuaauaugcuuaauauucuucuaauauuaauauccuccuaagaauaugcuuaauauucuucuuaaacuaccuacuuauuguuuguaaauuuauuuaaaaggauaaauuuaaccuuugucacuggccacagauggaaaaccaguuucacuuuucauauauaaaauagacaguaaccaugaaaacaaacacaaauacaacaaucaaauauuagugaaauacucugagccggaggucugagaaugaaaucuuuuaacaagaguucuuguuuaaaaggcuaccaaaccaacauuuuucuccuugacauaaauaggauugaaagagaauugaaaaaggaacaacuuuucccacgagacuuggggucauaccgauuaaaaucuugcaucaacuuagaaugaaucaaucauacagaauuuugggugucugcauguucuuguuggugugaggucaucaucuguguauccagagcacauacuuugcccgacuaccuuguccccacaccauuuggcuucacacauaagcauuguuccgucagagucaaagagcaacaaggcucuuugucaccaugagagacagagagagacagggcgagguggggggcaggagggagagagcacaauaaauucagucgaauugaagcuuauauugggaagaaaacagccggcuacuagcuguaauauagacguucauggccauauguaaagugcagccauguuacucaaggauccauuuaauuuguucugggcucugaugucaccaugcacccacugagguguuuuuaaaacacauugagaucauacauauaguuaaaaacaaucaaguaauaccaauaggguuauuaaaugauucccuauuaaauuuauuuccuaccccaucuuuuucuucucucaucguacuuccaaaggcagccaguuuuaacccauucuauugauaggccuucuggugguuagcuccacauuuauaaauaauaugcuuacaccuuuauuuaguaguuugccaccuuaaaccaauaucuaucaaauuuuugcuaugucagaugagaauuuaauuaauauuauuauccuaaccuuuuccucuaacuucauuauguuuugaccauugagaaggcucuugucagucugauucuuaguucuuuauaggugaucuguuuacucccguggaaauuuucaggauuuuuauuuuugugcuucugaaauuucacaauaauacauaagauuuuaugcccaaguauuuuggauuucuaaaaagaugccaacucaguuauuuucuguaguuucuuaguauuucauauauuuugauacuguuguaaaugguaucuuuuuucaaauaucauuuucugauuauucauuuuagcauagagaaaugcaacucaucuuuguagaacgaucuuguauucuacaccuugaucaacucacuuauuacagcauuuuuguacacuucauuggauuuucuaguugacaaucaugucauauguaaauaaacaaaacuuuacuucuucuuuuacaaucuggucuuuuauuuauuuuacuuaacuuauuccacuggcuaggaauucuggugcaauauugaauagaaguggugagagcagacauccuugucuuauuucugucuuauucuagggagggaaauucagguuuaaguaauaaauauucagucuugaauauuacaccauuaagugugauauuagcuguaugguuuuuuguauaugcccuuuauaauauugaggauguucccuuuaauuccuacuuuauugagagccuuuccaggaagauauguuagauuuuuucugaugccuuuucugcaucuauuaagaugaucauaugguuuuucuuuauaguuuagcaauauaguggauuauauugaucauugauugauuuuugaguguuaaaccuauuuugcauuccugagauaaacucugcuuuaccaugauauucuuuuuggcguauugcuggauucaauuugcuaaaauuuuguuuagaauuuuucuagguucaugaggauauuggucugucuucuuugcuuguaaugucuuuguccaguuuuaguauuaaggcauugcugaccucauagaauaaauuggaaaauauuucuuccuuuccaauuucauggaagaguuguguagaguugguauuauuucuucuuuaauacuugauauaauucaccucugaagccauuuggcccagaguuuucuuugugaaagaguuuuuuuuaaauuacaaauucaauuucuuuuauagauaaagggcuacaagguuaucuaauucuucuugaguaagcuuugguaauuuaugucuuucaaggaauuuguucauuugaguuguugaauuugucggcauaaaguucuucacaacauccucguuuuuauauuuucagcaucuggggacugaacagucaugccacuucucucaauucuccugucagcaauuuccgucuucuuuuuuuuuccuaauaagucuggcuaaagguuuaucaguuuuauugaucuucucaaagaaccagcuuuuuguuucauuaacuuuuuucuauuguuuuucuuuuuucuaugucauuguuuucuguuccuuuguuauuuccuucuacuuaaaguuugauuugcucuuuuuuuuuuuuuaguuuuuuaagggaaaaacuaauacuuuuuuucuuuucuaauauaagcugguacuauaaaauuuucccuaaaaacuguuuuaauggcauccuccaaauucugauauauuguauuuuaauuuucauucaguuaaaaauacuuucuaaauucccuuuugaguucaucuuugacccaugaguuaucuaaaaguauguuguuuuguuuccaaauauuugaagauuucccagagaucuuucuguugccauuuuuuuauuuaauuccacuguggucagauaauguacuuugugugacuuuaauuauuuucaguuuaauaagacuuauggaccacuguaugaucuauuguuauagcuguccauguguuauugaaaagaauguguauucugcuguuuugggagugaaauguucuauaaauguucauuuuaaaaguuacuugauaauguuggucagaucuucuauuuucuuauggauuuucauucuguuuguucuauauauuauugagacagaaguauuaaaaugucugacuauauuuuuggauuugcauguuucuucuugcaguuauaccaguuucuauuucgugucuacugaagcuuuguuaguaggugcauagacaugauuugugauuauuuaugucuuuuugaugaaaugacuccuuaucauuaugaaaugacauuuuucaucccagguaauacucuuugaucugaaacaucuuuugcuugauauuacuguagcuuuccuugauuggugucacacaugauauuuuuuuuuauccuuuuacuuuuaaccuguuugugccaucacacuugaaauguguuucguguaggcaacgugugguugggucuucuuuuuuaaucuaauuugacaaucucuucuuuuuaauuggggcauuuagaccauuuauauuuaaugugauaugugaugugauaagguuuauaugcuaauuuugugggaggguuuugucccaucucuucuuuuuuuuuuucucuuuuccugccugauuuuagauuaaaugaauaauuuuuacaauuucuuuuuguguccuuuguuggcuuauaaguuauaauuuuuguuuuguuauuuuaauuguuacuuuaggacuuauaguacauacauuuaguuuaucacaguuuaccuucaagugauuuuaugcucacauauaguguaauaaucuuggaauaguauauuuugauuuuuccccucccaaucuuuuuugaaauuauuggaaaacauuuaaccucuacagauuuuauaaacucuacauuauguuauuauuuuuauuuaaauaguuaauuguguuuuaaagagauuuuuaaguuagaaguaaaacaugcacacacauauguguauauauauauguauauguguauacauacacauaaguacacacacacccauuuccaauacucuucauccuuuguagagauuccuguuaccaucugguguuauuuucauaacccuuaaaggacuuuuuuuaaauuuuguggugaaaucugccagugaugaauucuucuaaguuuugugugucugaaaaagucuuuguuuccucuucacuuuuaaaagcuauuuuacuaaauauaaaauucuaguuugacaguuuuuuuccuuuuaguacuuuaaaaauguugcaucacuaucuucucacaugcauuauuucugucuagaaauauauuauacaauaaucccugccuugauucucuccauauaacgugccuucuuaucugaagcugcuuuuaagauuuuuuguucgucacuucuuuugagaaaguugauuaugauguaccuugcuguaauuuucuucguauuucuuucgcuugggguuuauugaauuucauggaucucugguuuuauuuuuucuaucacauuuggacauuuuauauccauuauaucuucuaauuuuuuucuauccuguccucuuuuuauuucagggacuccaguuucuuaaguacaggcuacuugaaguuagcccacaacucacugaugcucuacucauuuuauaaauuaucuuuuccuuugucuuccauuuuaaauauuuuuguagcuaugucuucaaguucacuaaucuuuucuucugcagucucuaauuuuccauuauucccauccaauguaauucuuaucuuagacauuguuuuuuaucuguagaaauuugauuuuggccuuuaaaaaauaucuuccauguaucuacuuaacuuuuuaagcauuugaaaugcaguuauagcaaccgcuaauucuguguuaauuuggggucuauuuugauugauugauuugauauccucuuaugguccuauuuuccugcuuuuugugugcugguuaauuguugacuggguaccagauauuguauauuuuacuguauugguacuggacauuuuuuuauuccuaucaauauucuuaagcuuuaaucugagacacaguuucauugcuuagaagcaguuuuauccuuuguccucacuuuuaagguuuguuaggugauaccaaagcagugguugguuuagguguugcuauucccuacaauagaggcaaacugcucuaugucagagaaucuuaagguuucccagucugacuagcaggaauagacucuauuuccaggucuguguaaguagcgggcacuguucuucaaucuuuuuguguggauuuccaccuaaccuuagguaguuuccucacaugcauacacuucucagcagucagcugaauacucaagaaggacuauccuuauuuuuuuaaauuguuauuuauuuauuuauuuauuuauuuauuuugagauggagucucacucugucacccaggcuggagugcagugguaugaucucaacucacugcaaccuccuccucccagguucaagcaauucuucugccucagccucccaaguagcugggcuauaggugcaagccaccaugccuagcuaauuuuugguauuuuuuaaauagagguuucuccauguuggcccaggcugaucuugaacuccugaccucaagugauccaccugccucggccucccaaagugcugagauuacaguugugagccaccaugcccagccagaaggacuaucuuuagaucuuuggcauuuucucuaugugaagccuucucuccaguacucuucucuguaaacucuagcugccuagguguccucagacucagcuucaucuacucaaugugaggagcccaccaggcucugccuggauuugcccucucaugcuguagccuggaacuucucuccaggcaguaagcuuaaaaaucacugggcccgugucauuugcuucccuucucucaaggaucacugauuguuggcugaaguccagugucuugcauauuauuuaauauauuuuguacugggauggggggagugagguuaggugggaggauaaagcaaguuccuauuacuccauuuuggcuagaaguggaaauuugggauuuacucucauuuuagugggguuuuaguuaggacaagaaauaaugcaugugcuuauuccaccauauugagccaggagcacauugcacauuuuuaaaaagaucuugcugcuuguguuauuggagccucuauaacacuuagcucaugguuuuguuaauuaauuguccaaguucauauucucuaaauggacuuguugagaaguggaaacugugucucauucacuuugggauagucucagugcuaaauuggagcuccauaaaugcuuguugaaugaauuagugaauuaauacuguugucuuauugguaaaauugcaaguuuaaagagucaggacugaagguaagagugcuuuuuaauuaaaaccuuuguagggaaaugcaauuuaccuuucaggacauuauucuuuucaggcuacagcuuuuuaagagcuguuaacauuagcacccacuucugccuuuguggcaggaaacacuucuuaaaaauguugucacauauuuucugguagaauguauacgcaacacuugggggaauuuuauucuuggccauuuauccuggucauuuucuaaucugaucucaauguaaaaguuauuguggaauaacagaaaaauacaucuuuccaauccaucuagucucuuuuguguguguuuguaugaaauaccaauuuacucuuuuaaagaauucuuaagguuccauguauaauuuuaaagacaaauggauauauuuuaagaucaaauuuccucaaauuuuuuccuguucuaaagaguguagaauuguauuauauauucacuuaaucuuucaaagguucagaagcuaagaaauuagagcaagaucaucaaaauaugucacuuuuuaauuccucugcuuguaaaggcaacauagcuuagugauugcaaguacuguagagcccgguggccuguguacagcuccaccuuuuuuuuuuuuuaaaugcagagucucgcucugucacccaggcuggagugcagagguguaaucucgacucacugcaagcucccccucccggguucaagcgauucuccugccucagccuccuguguagcugggauucaggcaucugccaccacaccuggcuaauuuuuguauuuuuaguacagacgggguuucaccauauuggccagacuggucucaaacuccugaccuugugauccacccaccucggcaucccaaagugcugggauuacaggcgugagcuaccgcacacggccacagcuccaccuuuuacuagcuguguggccuugggcaagucacugaaucucuccaagccuguuuucucacguguaaaaggguuuaauaauaguacauucuaggguuguuaagaagauuaaaucgguuaauguuuacaaaguauuuuaaauggugccugauauacacaguaaguguaauauaagcauuaguuuaagcaaaauaaaauagugaaauuaaaguaaaaauaaaacuuuauuuuauaaauauuucugcauuuuauucuucugacuuucccaagaaguaaaaauuacccucuuuuaugaaguuaugucauacuuuaauagcuugcauuuuuggaaaucaguugaauauugaggggacaaagaacccuucuaauuuuccuucaacaucuucuauauaacagugaugccuaucucccuauuuaucucacaguguuguauuuagcaagguuuugcgcuugguaccucuguuuuucuuuuagucuaaaccuucgguuguccaugauucaacuuuaaauuauaucucugaacggcccccuccucaccacgaaguugauucuagagauuuucccaucauaauauuuaagaucuccuuuuuuuuuuuuuuuuuuuuuuuuuuuuuuuuugagacagagucuugcucugucacccaggcugggcugcagcggugcgaucucggcucacugcaaccuccaccucccagguucaaaugauucuccugccucaaccucccaaguagaugggauuacaggcacccaccaccaugcccagcuaauuuuuguauuuuuuuaguagagacgugauuuguccauguuggccaggcuggucacgaacuccugagcgcaggugauccaccugccucggccucccaaagugcugggauuacaggcacgagccaccaugcccagcccaagaucuccucuucucucuguuauguugcuauuacccgggacacuuuaauaccauaaauauguuuucuaaccuuacugaguuauuugcuaauuuaacauccuuauuuuauuuaguguuccaauuaugagcaucuguggcuugcagaauugugucaacuugcuagagacagacuuuugauuuagcauucguuuccauuuuuaugcuuaucugucuuuuuuauuuguguuugcagaauuuucaauuucucaucaaucucucugggucauuauuauugucuuagcaucucauuguccagauuuucaagaaguuaagaaagcuuagucagaugguugacuauauuuuguaaauauaugacucagcuaauggcucuuugaaauuuacauggacuuuuuuuacuuaguagucuuagucuguguaaugccaucuuugagggacuuccaugcacaaucucauaucaucuccguauauuuguuucuagcuggguauuugaggcuagauagacucacaagauguuuacagaaacaaagaugagucaaaaauccaaaucuccuaauuaguguaauuuucaauauagcccaguccuguccagcaucaggagacuugacagcccccaaaccaaaagggcaucugaaauacauauugcucaucccuccgccugccucccccaugccgagacaggagcuguggugagcguguggauggcacaggcucugcgggugucugacuagagagccucaguuacgcgcucuccaccucaucacacagcagccccguguaauagaaaucgcuuauuaugaggguuggcuaaauaaaggcacauugugaccagucacaauuucuaaaugaauccuccugacugaucugguccugacacuuucaaagcugccguuauuacugaaccugaacauguggaaaggacaagucaagacagaaugauaaaauucuugaaugcuuuugcuuaaaauuauucauucucuuguguguguguaaauggggacacacacacacacauacacacacuccauagacacucucgcauacuuaaacgguucccuaggugcacuuuuaucauuuuaucucaucucacuuugguaguuuccauuguaguccuucuguagacuaauucucuaaauauuuagaaaaauaagagggucuuuuaucuguguguagucguggauuuugcugccucuuaaagcauuaucuuuucuaaguccuuaaguguuagaagugggaaaaccaucuuucuuuuaaauuuagcaaauggcacuuaugugcauauguacugaugccauauacacacuuacacuguaauagaaacaucguggaaaagcaaaccauaggcuuuuaucauaggcaugagcuuuuucccucucaucuccgccuggaaagaugguuaggagaaugagaggccucucuggaucuguauuuauaagccuuacuggaaaaaaaaagucaauuauuuuuuagacucagcucacaccauaauaaaugugaaucuaaacaaucgcucaagugcuuucuaagcaaugguucuaucuaugaucacucagacuuccuucuuuuauuuaguaaaaagguaacaaauaagaauggagugccauuugcauguuucuuauuuuuacucaauauggaguccagugguugaguaggcucauccaguagcaaagagaagcaaacaaaauugauuuccuguagcccacagugauuuucccuagauuuagagagcaugugauuccaagaugggugugggguaaaacucucaaggcuuuccuggcgagagacccgggcaugcugguggagaaaccagacaucaugcuugggagguuggggccucucuccuccuugaaugagcucuguuuuaggauguuguucaugugaaaguauugcacuuaccucagcauaaaaugucaagccaucacauccuugggauagaaacaauuaaggaaggauuuauguuuguaaaaacaugugccuauuaagguaaguaauuagggcacaugaaagaaagauaauauggagauguaaaaauuggggguucugcagucagacccccuggauuuaaauccuagcuccacuugcugagugaccuugggcuagucauugaaccucucugagccucagcuucuuucccugugaaauggggaaacuaauggguuuauugugaguauuaaaugaguuaauacaugcaaaacaauucacacauaguaagcaugaaauaaauacuaauuauuaucauuguuacgcacuaagaaaggauuuuugcaacuaaagugucaaaagaaauggagaugcuaaagaauuauuuggcuuuaaaagaugaauuccaguacaaaaugaggcuguuuaacaaccagauuccauauuacaaucagaaaguuccagcagaguaccucaggcuucaucuggggaacauguuuaaagguaccaauaauuuuuggguuuuuuuuuccaauuuuaauaaaugaaauucucauuccuuucugucugucucucuguuagcgcuauugcuuuaucuuacucuguagucuguauuucucuuccuaguuucuuuuuuuuuuagaacuaguugugaauucuuuauucucucacauagacauaugacaguggggaaggagggcauguguguuuccuaaauguuagcaagaagucugucuugccaucuccauagaguggaaaauucagcaaguagagucuguuaaugucauuccccuucaaaucacauucaaaagugugcuuaaugcacuguguacauuaaucagacauuuugaucaugaguaauggugaugccuucagaaguuugggguggggguguggguuuuguauaucuuggaaggaauccuaaguccuugggugacuucgaagcagucuguaugggcgcuccucccacauccauugcaucuuugucagacacauggccccuaggcuccacuuuguccauaggcauggaaaggugaaagugccugggaauuaauaucucuggggacacucugaagcaaugacugcugguuauauggguauaaauacuccagcucccucaccccuuggcuaaaguaauuccaaggcacguacuuugcaguuuuccagaguuacccugugagauucaacugccaucacccacugugguagcugacuuaauaaugcauccuauauuguguggccgccuucccuucccugucuaacuucucccucacuacccagacucucuguaucucccaauacaccacucacuuguucggggucacuucuggaguuuccaaccccagaugaugugcacacuuucagagguagaagugaaucuacuaagccuagacuagguaucaucaaaaccacucugggcugcaaacuggcagggugcaggccgcaaauuuggcagagcucugcuuucccuggguuuggaauuccacugacucagagccugaauaaucguggaggcagaccugucaagguguuaucugaagagcuguuggggaaguggaccaagaccacagcugcccauucucucaccccaccuucuuucugcagaguggcccauuugugauucaggagaaagagugcaggagcaguggucagcaugcugugaucgaugauuucugagcgugggugggccuugacaaaugcuccuauccacuucauucccucuuaauagacccaucagacaggugcuuguuguuuuccagugccaaccuggguaaaccagucaucaugugccccagugugucaaagaaaaugccugcuucccagaagguuucccacuaauggggaaaagaagguugauucacacagccuuuuauugcaaaccaauucauucuuuggcaaucugaaaccaaaacugcacauuuagccaggcaggucuuuuaaaagcauguccuuuaccguacuguccauugcagacucccauccauaucuucuuucuuguuuuguguuaucauuuuugugaugcuuuaauacucaauacaugaacugaagcuauguggcuucuguaucgcaguguauuaggauuccagaaagacaugcaaucccugagcagacaauaaauuugauuuugcacaaguggcauccuuuauacuuugcucauaaggcgaucucucaaguguauuuuuuuuucugaaacacaacacaaauagucugaugaaguaaaaauggguugcaugauggguuuugugcucagcaaaaagaacuuggacaaagcagccaugcugauguucuuauuuacaaagguugccgucugggaaauuaaucucugcuguugcucaguaauuaggaaaauuuaggaccccuagugcuccagcaucuugcauuaaagguuguaugucauugguguuuucaugagaguuugcuggauuucugucauuaauaacaggcauaagcccagcaagcaguagaauaugcauugcauuuaaucaauuugcuauuuguauucauuaugcaugucauccguuuugagucaugaaaaauugaaaggccauuacgaauagaaagagcaucauggauuacaaaugauguaacaagagcauaagcgcuauuaauuggucaauugugcuugucgguacauuuaaagugauuaaggcagaaagauuagaaaggacacgaaugugcuugggaaacagaagcauagcaacacaagggcucucccaaguccuuugugcccaaauaaaugcagcaaaauccaauggcauuuauuccaacuaauucauuaaacagauauuaguugagcacuuaccaugugcugaguacaaggauuguacugaguacagcagaaaacaaaauaagugaagcccuugaccucagggauuuaccuuccagaggggagggggaaguaugaaaugaacaaauagauauacaauauaauauauuguaguagcagagaccaugaagaccaccagaagcagagaggaagcccucuuuggggaaaugacauuugaacagagguuuaaaugaagaaaauaaaaagacaggggguccgagcacaguggcucaugccuguaaucccagcacuuugggaggcugaggugggaaaaucacuugagcccaggaguuugagaccugggcaacauggugaaacuaucucuacaaaaauacaaaaauuagccaggcguggcagugcacaccuguagucccagcuacucaggagacugaggugggaggaucgcuugaguccaggaagucgaggcugcagugaguccagaucacgccacugcacuccagccuaggugauagagcgaaacccugucuaauaaaagaaaaauaaaauuaaaaggcuacauggauaucugggggaagaauagacucaauaucccccacucccauuccaacacucaagaagaaaagaaaauucuugcaauuauuuuuuuacucaagugauuuugugaggcuugacccaauaauggaauggcuuugccaaggcuagagaacucacucagccgguuuucccauuacagaccucuugggugauagcaauucuguuaaaguggaaacugauggcaucauuugccauuuuuacuguccccauacauaguccuuaccauggcaugcagaccccuacgcuauccagcuccugccucccauuucauaccacuccuccuucuccugccaaguucuagccccuggacuuucuguugcucacauuuccaguucguuccugccucugcacccaugcauuugcugucuccugcccucagaaauccagaccugagcucccaggccacauccucagagacacccuccaugaccaccaggguugcaccugcucccuggccccugugauuugaucccacuacacucauuacugccugaguucugugcuaucugcuuacucguuucuuaccuaccucccauguuugauauaaguuccaugagacuaggcccaggucacuugaguucacugcgguaucccaucaccuggaacagugcccgguacaaagaggcucaguacgcccaaaucaaaugaaugaaugaguggaucaaucaaucagccaaccagccaaaaauaaaaugaaaaauugacaguuggguuucugcuuuuguauucgguaacuauuuuaaaauuuuguauuuagguagcuauuuuuuuaaaccacaugaaagaaagggauguuuguucugcacagcauucucuggagugauuagguagcauugguauuugugcuucaugugucuacaaucuauugccaugcauuucuaauaacauaauauuccuuuucaauauacugacuuguuuuucuuuuucuuuucuuuuuuguuuuuacuggcuaaaugcuauagcauugucuuugaauauuagcaaauaauggaacaugggccaagggugaaccaugacgaauuuguguuccagcagcccugcuucuuuagaauugacagucuggcuucgugguuaauucacagcaucugaggaauacauccaaagagggugauacuguggcaugaugguaccaggauuccaaguucauuccagguacagucgaugcaucauucacagcagacucgugaguguccauccugugccagacuccaucgcaggugcuggggauaccaggcagaggaugcaguguugccagcuaucaggaagaccugacggucaacaaucgugcuuccaaagccaccugcauauuauacucccuugggggucagcuguaauauaccugugccuaggccccauccuaggccaauggaaucagaaucucugggccuagggcuggcacacccaucuuuuuuaagccucaagugcuguucaugggcagucagggcugagacccccugcuggaguagaaggauggugcauagguagcaaaaccacaaagcaaugggcaaaggccaagucgcagauggcaguugcguaagcuggaaguggugacauuucucuucagugcauaaccacagcucagaaugaauauuuguauggaucaggaggccaagugaccugguauugagcaguagauaaacguugcaucuauuuaucaccacccccaaaaaaccuuuuuaaaauggcaaauaccauucauuaaauguuuauuuuuccugcaugaggucaaacaaauaaucucaauuuucuggguguuggggauucaaacaacacccaaaaugggauguuguauacuaagucaaauaaagaauuuuaauagagacauaaugucuuuccuaaccagcagguaugagagaagggaaaauaagagaaucugccugguaaccaucagggggaaugaauuaacauguucucuaagacuauguuagaaggucagagcccagcacagugguacaugcuguaauccuagcacuuugggaggcugaggcaggaggaucacuugagcccaggagaucaaggcugcagugagacaugaucacgccacuguacuccagccugagcaacagagcgagacccuuucugaaaaauaaauaaaaaauaaauaaauaaaaggucagaauuucaugaagugggaugguaaaguuguugugaaauucucucccucagauacccucugccuuugauggugggcauuaaaaugcuuagacuggaaaaaaaaaaagcaaaucuuucuggguaauuaaguaaaguuuauguuauucauuugaagaucaagcuuugcuucuccccuugaacacaggugaaaauaacaggaaaaugauaauaacuuuauaagggccaaauuaccacucacagugguacuucugaguguguguuggaaaauuacaucuuuugucaagugauaaacucugauuuuuuuuaaaaaaaaagcaauguucgugaucuaguaagcacuuuacaaaagcuaacaugcuuuaugaagguguguacacagacugccuaaccucacacugcagccucacuuacucuaacacacucuauggcccuccauggaggagcagaagcuuccacccacgggaugacuucagaugaacgcuuuugaugcugggagcagcagccacccaugucuccagauaccuguuccucugacucugccuccuuggauuuuacaguuaccaacaguucaugaugaucuucagaaauguucacaguuucagaggagccacauauuugaauguuuaaagaaagcaauauuuugcaaaacgcaaggaugauccaagagagccacaggaggaucuagcagcccuuugucgggaaaugaaaguaaccaacaagaucaggccuggaaagaccuuccuggaucccccaggacaugcucccuucugugaagcagcgguucucagcccuugcugcucauugaagucaacuggggugcuagaauaauacugaugccugaugugcccaggcuggaguacagugguguggucauggcucacugcagccuugaucuccugggcucaagugauccuucugcuucagccuccaaagcgcuaggauuacaagcaugcaccacuguggugggcucugaccuuuuaacauaguuuuagauaauauguuaauuccuugccucugaugguuaccaggcagauucucuuauuuuccuuucucucauaccugccaggaucucauaccugugccagagauuccugaggaaggaggggcaguguauuuuggaaaagcucccaggugaaucugaagugcagccuggguugggaaccacugauguagucccagauuagugacugaaauggguaauaagggaagcaguguuggcagcacauucuaccaagcucaaagucuugacauguccuggagccagcagagggcaaagacuucauugcuaagagagaagcuuuagugggagaagauaaauaagucuguuuccaggcaaauguccccuuucugcugucagcuuccuggcuauuucugcccugccugagccugaggauuuagacaucacuuucacguaaaugccauaaaugccagcuuccaggucucuccacacauuaaugacauuguggugagaaaagccacuugcaaaugaaguaaauccuugaaagagucagacaauagugggcuuuguaagcucugccuuacaggagagccugcagggggauuuucggugaucuaugcagggaucaagcugccauggccaaggcucucaggacaaaggccucauggagucuuuuguuugccaccgcaugugacuuuacuccugcaucuccugcagagcucucccaggacaguugaguaagaguggagaagcaauuggggugaaccccaagacucagccugauccguugaggggcuuugcagcauaaauuacaccucagagccuggggcaaaggagcugugaggcauuuuucucuacauggguuagucauuggcuaccugggcucucgguaagagugauguggcuccagagcccaagaaaagcggccccugcgguccugggguggggagcucuuagcagcacagcacucagaagcugcgagaugggugcgcagagcugugcuagggauccuggagucugggcaaacagcacugcaugugcuccacaggugaagccuugccuccuccauccgucagcucagcacccuguauggaaaugcaaacugugacgugugcuucugcguuucccaccucugauaugauagauggcaccgcaaugcuuuucucuuccucagggcccauuuccaggcuggacugcaguggugugaucuccccucacugcagccuccaccuaaaguaauccucccaggcuaaagcgauccucccacuucccaccucagccucccaaguagcuaggacuacaggugcaugccaccacacuggcuaauuuuuauauuuuuuguagacaguuuugacauguugcgcaggcuggucuugaacuccuggacucaagcgauccgaucugcccgccuuggccucccaaagugcugguauuacaggcaugugccaccaugucuggcucccauuuccuugucuucauuguuguugguuuuuuucuuguuacuaucacaguagaaaaucuagcauguuggggaaagggugugacuaagggaaaagagaccgggaggucacuucgacuaugaccugugcaucaguuaagauguuaguggcagcaagagacaagaugcccaaccacaagggaaccccaacacuggagacuuuuucucauguguugggaagucuggcagcaggugguccagacuguguugcucaacaaugucagggcucuugguggcugcucugccauccucuugguggcaggguggcugccgcagcuccuggcaucauauccucacacaauaauauccaaaaucagggaaggagggacagcuucuugucacucauuguucucuaguuagaaaggaaaagacuucccagcuccagccacagacuuuacuuugcaggagaaaguucggccagguuugcaucuggaggcugggaaaaugauuaucuggcauuugagcuucugucugccaugcccugcaaaagaagaggugcugguuuuucuccagucaucccuuuggguccauucucugucccacucuauccucuuccuggcuccgugcccuuggaggccaauccuggauuucaucacuaggcucugcccuuggacuuaucauuuacuucagccuaaggaaggcaccaggaggagauaggaaagccagggagagaggcuggguguuuccucccuaccaaaugccaccuuuacccaaggccaugaagauacugcccuuugucaccuucugaggcauuguuuucccucccuauuuacaccugcuguccaccuggaaaugauuuccccucugauuuuuauuaugaaaguuuucaagucuaccgaaacauuaaaaauagcuuaaugaacacuaauauccuuccacuaaauucaccaauaguuaauguuuugccacauuuuuucaaaauauagauguaaauagguagacagaucguacauugagcuguacaauuuuguuuuauuccgaaccaugugaauguuuuaaacauuuugacauuucccuccuaaauauuucagugugcuucuccuaaggauaaagacauuauccuaacaaugcaaaauaacaucaauucaauaauaucacccaauuacacuuuuuugcuuaaaauauacuuucuuaauaaucuccaauauuugauauuucuuugcagcugacaaagcacuuucucuaucauuauuuccuuuuauuuccacaguagccucugaagcaacugugaucagcucccuuuucuagaugaggaaaagaaucagagaggcuaagugaccagccaaggucacacagcuaauguauagcagucugggauucaaaggcaggccuuccaaauccaaaugccacacacuuucuguggcauuauagccccuucucacaaguguguuaguuuuccuagaacuuagaccccuaagcaauucuuauauuugcuccccaccaaccuucccauccaccaaaauugaggauccccuuuccagcuucaaauaacaauacucuagugaugcuggugauucaccugggccucuguuugaugugggaaaaugcuaggcaaugcguuuggacauugcauuuuauuuaagcuagugugauugauuacauaguauuucuuaacugcauuaugccugauucuccucucauucucugggcucagagugaaagaaagcgucccucugcaaacccuuggguuuauccuccuugauggggaggaccugguuuauacuuuucaguaagcaggugagaacgaguguccuugaagccaacaagggcaggaucucugacucuccuucgcuuaccagaucugccucccagcaucucucgaaucagcccaugccucuccuucaccguugccgcugcaccaguucaagccaccuugacucuugcugggaaaacacagcagccccucaccuggucccacguggcugagcaucuccuccaauugacagcugaaucucaucaggcugccauuccacccagaucccuucuguggggcccacuacauguaguaaauuacagugccaggugugaugugugcaccuguguagucccagcaccucgggaggcagaggugagaggaucacuggaacccaggaguucaaggcugcagugagcuaggaucgugccacugcacuucagccugcguaacagagcaagaccuuaucuaaaacauaaaauaaaauaauaaaauaaauuaaauuaaauauaagaaaauaaaacacacaguagaaggugugcuguggccuccgcagccuccuuggucuggccucagcuggccucacugccuccucucauaccaugccccccuccuuaccccaagcuuaggccucauuuuccucaaagaagccuggguccugucucagagccucggggcaugcuuucuucccugccccucguuuccaccccagucaccuccugaucccugugcauccuucagaucucagcuugagcaccaacccugaagccugcagcuggaucccauaaguauuuccacaacacccuguacuuuuccuacaugcaccccagcaucuucauacaauaggugcuuaauaaauuguccaaugacugaauccucacaauaucucuagagaagauggcaagaugcagagaggaggagucacgccugaagccacacagcugacaucagagccaaagcaugagccucagucucucugacccagagcuaccacccuugcugccuugggaagaaggaagcccccuccuauucuauccuugagcugccuuggcaaggaggggccccuugcugccgccauccucacaggacaccauccacaugaggggauggugagcuccacuuccaccuuuucuacaugucugcucuuuaaacugcacacguugauucauucauucauucauucauucauucccuugauauuaccauucauuuauucaucaaguauuuauugagcauauuuaucugcauggcauugugcuaaucguaaucaucauauucaccacugcugagcagaacagucagggugcugcccucagggaguuaccauguaguaaaggagacagauggaaucacacagaggaaugcacgucugauuguagccugacuggagugccaugaaggagaccaagagggcagggugauggagaaagcacaggaugaaguucucgucuuccuuccaacagaaucucaguugcacucaguuguugccccccucgaaccucccuugagccucaggagaaaccacccugauucagagguccagagaagaccugacuagcccaagguaauuccguccccuugccagaguggcuugggcagggacacgggaccuauuucaaugaggccaaugagacaaagguauuucugcuggggaggcaggggcuucaagcaaagggucuugcuugaaagagccaccggaagagggcucucuccuuccuuagggugucaccgugucuggaugcgaugccuggaagugcuacagccacucgcgcccagccugaagaugaaaccaaccccaaacacagccaagcagagagauggaaagaacuaggacccuaauuacaccacugagcagcuauagcaaccaguuccagagcccucugacuucccgccaaagugagaugauaagauacuguuuaauuucucucuuuuauagccaaacacaccaaaauugacacagagaugugagccauaccuacuacuguuacugcuccaucccuagcuccaaccacagugcaugguacaugguagagagccaacaaacacuugaagaaugaauggugcauauugagugggauuuuccagaggcagaccuggagacaaggcuucaagugcguguguuguauuaaggaaaugcucccaggggacaauagcagaguggcagaaaugggacaagggggccagggagccaagaacagagaaucaaucgucuaaacagagcccccuguuuuuuguuucaccugggaguagcuucuaccugauccccaggggaacucugggaugucagugacggcucagcauugccccugaggcaagggagcugggcuuuccuaaucccccacuccucagucucuggcuaagcgcuguccccaggggacuuaaucacccaaacacuuccccaagaguggcaucugcugaccacuggaggcacugguacagugaagcgacagaagggaucagagaggguccagguggagcacagcaauguggcugaauaauaacuauauuaauucauauaguuaauucucaagcaauggcaaaguguaggcagcuucuugucugcaaacguuuccaugauaucucuccugcagccagacgggucuuuuccugccgccuacacagaauggccauggagcauccccaacucuuauuaaaauggaaaaaaaaaaagccuuugcauuucaaucuauuauugcacuuuaugacucaucuucagguucucucugcaaaacauugaaagccagaucauaauuugaugaugaaauauugauuaugcauuuguaugcagaggucuauacuauauagauagaauucccacccuguaguaucuucuauuuuaagucaguaugaagauggauguuccccccaggcaaauuuugauaagauacuugugucaauacaaaaagagauuaaugccaaugugaau

SEQ ID NO: 15709 - RNA, 16575 nt, Homo sapiens
gccuugaaucugcugugguaugugcugguaggaauuuuguaugaagcuguuauugaaguagaugacauuaaggucaaaggaaaaaaaaaacagaaaauaauguaauccuacagagcugcucuuaagaucuugagagaaaaaccacguagguaacaucaaacacuaguuggaaucuuuccaagaaguaauuaucugugugcuguuuguggugguugauuaugggaacaaaccaagguuuagccaauucagcaaacauuuauggagugccugcaaugugcaugucacuguuuuaaggccugugccuacuguaaaggugacccacacaugaugccugccuugcaggacuuggaguucagcgauaauaagagaugcauaccugaaaagccuauuuaagacucuuccgguucuacaaagaaggcuucuugaaagugguagcuuugauuacucuuuggauuuauuuacauuuauccuauaaucagaagguauacaaaacagacucacacauauauaaaauuaauagauuagauagcauuuaaacaaauauuucagguagguacuucaaaugcauuugacauuuaucaaagaaaugguaagugcugucauccguggguggcuggauuaacaugugggacuacuuaucaccaauuuuguuagggaucuuagggaaauuccuggaucuuauauucacaagcaauuguauaaauacuucccacagcucagagaccuaauaggauggggucuuagagaaacaucuuuugagccacagacuucuuuguuaccagaaggaaaaugaaagaagaaauuuaaauaccacuugaagagagguaaauaaaugagaaauggggcugagagggcggguauuuuuuuaaaaauucauuaaauggaaaaauccacaaauguuaauucugguagauuucuuagaaauuacaucagaggagcaugcuuggucuucccacccucauuaggccucagugacagguacuugaacaacugagccccuaaugugcaugcucccccaccccugaagccagucucugcccuccucuucccuccucuugccccuggaagcugaucgccaccaacuggccucuggguggauuuggccaauggaagcaccuguagagggaagagagugagguuaggauauuucuuccugcugucuccgugcuucccugcagagagugugaagaaaugacccugaaaagccucuggcagaggauucuucuuucaggauggugucgccuccucagcagcccauccuccuccccuggacucaagcucucauuccaguaacacuccuuccuccuucuccaucuucagggggagguuugccagucgguggguucuaagcauaucucgcugauuccccccaacccugccgacaccucuguaggucgucccuucauuaaaaucucuccauuugaacuaucugaguuuaauuccauuuccuccugguaucucagugauacacgguaucaguacaaaaaucucgcuucaccuucagaaccaacagauuugagacauuuuauccucuguggaaccauuaguuauuuugucauugguuguaucagaaaaaaaaaucaggaaugcaaauccuucuuuauuacagauucagauuugcauauuaccaauguuauauauuuuaaacaaaacuauucaucauaaguuuuaaaaauuaacuacuggaguaguuaaugaaucugaauguaauuauguagcuuucauaauauuaaaguaaaaauacuaaaagaaguauuucuuaaagaagcaaaugcucaaucuccaaguaaauuuuauucuaugcucuuccgguauaagaauauguuaauaucuugaaaaauaucauauuauuuugugaacucauaaagcuauuuugaguuuuuguaaaaugaaaaccuuaccaaaauguauuuuauuguuggaaagcuugaccguuacugcuguuuaauuuuuugagcuuguaaacuuuauuugugcauguuuucaacaaagaaggauuuuauuguuauuacauaaaacaggugauuucuagauuuuaaaaucacaaauugaaagcaaggcacaauaauauauauuucaagauauagguacuuaggaggcauccuuuuagucaucuguucaauguagccaucuauuuuacaccuacugucuacuauuguuugagguccuugccaaaguauugcaggcuaguuaggaaacauaaaacaauuagaaaguaaucuaugacaaguaagcuaucuauaaauggcaaugaaggguagaacaaauucaaugaaaauaucuauuuaauccuaguguuuacuggucuagaagaauaggcugaguaaauuaguauuucucuggcuguugugguaacacauugcaugcuauaacaguuuuaaguaauuacaggugcauugaaauuuaucuauggcuuugucaucauauucuaaaaugucaugaguacuuuuuucugaccucaauuacuaugaaauugguuuccaauauuuaauuaaccaagaauaucaagucuauaggguauuauuaaggugagacuucuguagccuuuucaauaaagaccagaauuuuggagugccuugaaccuuaaucauugaucuuuaauucuuauuaagucaacugcccaccuuuuaaagacugaggcccaggaagaguaaguuucucugagacaaugcauacaguacagugcuucuuggguauuggcucuaagaccagaugcaaagaaaggcuaaaaucccauuucauuguucauuaggugagaacccuuuguuaagcuguguaaccucugugcauaguuuccucaucagcaaagucagaaaaaguauguaccugaaggacugauuguaaggcugggaugagagaauccaugugaucagcccucaccaacaggugcugcccaguucaugagugcugcugcuguccugcccaaguacccagcuugcagagugccagaguuagagucccagggguguucuccacagcugcaugcuugauccaggccuaucaggugaguuggcucuuggcuagugguuuuucuucucuugcuguacaaaaguccagacaguaaugucuuuuuuucauuuuuauagauauauuccauugaaaguccucauucucaaauuuaaaacaaagacuuuuuguguaccucaauagcaaugcacacacaguuggcuucacaaacauauuguacauuucuuuuuuucauauuuauucaacaaauguauauugacuacccaccgugugacagguguuauuuguugacggaaccaggcaucaucagcaaacaaaacugacaaagcuuccugcccucuguggaaggcaucugaggaagagacuggauuuuguagcaacauguuauucucauuauaaacuuuaucauuggaauacuaaagccaaaucaucccccaucuccuugaucaggauacccacuuaaucuaggcagcuacacaauugugagagccuuuguuuuuuucugcugaaacauccuuaaaaagauaccucacaacccaagauuuggcuuuucuuaaauacgauuuuuaauuuuuuucauuucuaucuagagauuuaauuggaaauggaaaaucaucaauuuuccaauuaaaugucuguuccaaucaacauuauaccuuuuagguugucauugucauuuuuaaguuuaagcaacuuuaaggauuuugaaucuggcugccuguaaauuaaaggugaaaguaaucauuguguuggauuggaacauuuugucaauugagagugguuuccuuguucuuaguguaugaaaaguuuauuuuucuaauguagauuaauaaaggagauaaagaaaaacaaaaugagugauuuaugugugugagaaaagaaccauuuccucaaggauuaaauaaaauucauaccuuuuguuucuuuugaaaaguuuuuaaaauaaauuuuaaugaauguguccuuuaaauauuccuuuaaaaauguauccuauuuuaaaauggacucucugagagaaggaauugauaccuguguuuaaaaucaaaaauagcaugcauagagacuguuuuucuaguugguugaagcuuuuuucccucuccuuuacaucagugaaccagcaucuugcccuucagacccuacagcacacucuugggcucaugaaguguaugacacauccuccuugggggaucggccauguccucgcucucaugaccacaugaauucuucuguaugucuuuucucacagcugaguacucucuuccugacccccuuguggaauggggaaaggaggcugugacauugugcuugugcaaacaauaauugagagcuuuccgagucuccugcaucuucauaaaugauuuuuuguuuuaugcugggacaguaguucuuuaaauagaauauucucccauggaaaucgcccacaaugcugagaguacaccuugcaaaagguaagucuagaauauagggugccuccucagcauugcccagaagcugaaguuaggacucucuagaauaccaaaaacaaauuuauagcaguucauuaauguaaggaauuaugaaaacugugugccaccauuauccauagaugaaacaagagccaccacgcaagcacagacacaaagcccugaagaugaagccauugacagggcucucauuuauucuguagaaacccacuugccuguuuuugaaccaguuuucuuuggagcauaugucucacugugcaaccaaagugguguuuauauccuagucacuuggcaaaaauucugucauugcuucagggagauccauuuuaggccugaagcauggagcugguaauagaugggauuugguacuucugaagaaaagacccuacugcaaauuuagagaguuaauuuuuucuuuuguuccccauaauauuguugcuagauagaacuaccuuuuuugacuagaaguuaaauauagaggccuaaaucaauuagguaacucccacucauucuaaaugagaacauguuuguuuuucuccaacgagaugagaaauauuugaggcgcuuccugauaucucuaucacccacugcauuuuuucacuugauguauauuuccccauguauuugggauaauuuucaaauaauugcccuuuagaaaucuacuugauauuaaauguaaaaaaaaagcaagaugcaaaauuauuauaggaugcauuuacagaaauuacaaaauuucuauaaacuauuuauggaggaagacuuauagaguauaugucaacacauugcuuuauuauuguccuugguuaugaguaugguuuuuuugaaaccugcuuuguacuuuggguguuuucucaccauugguacaauugaggcauuuuucccucuucuucaaccuugcaaaucacacgugaggaugcucauagaagugccucucagacaggcuguuguuuugcuuucaccaauaaaucauuuauaauuagaaguagaaaacuauucuuuccagugcaaauacaucccuuucaaaagcaguucucuuuuugugaaugaugucuagugucuaagaaacgaggguaaccuuuauuauaugcauugcucuaaucgaagcauuguuuuuugcggugaacucaagguuacauguuuaagaaaagcaucggguuaauuccauuaggaaaagugucuuauucauaaaccuuuagccacuggaaaaacaccauuaggaggccacacaaguguguauagcuggauagaauuugacaacuggcaaaacaaaacaauagccuacaauugcagagugcugucuguuuaaaaaccaacauaucuuucaccaacaaauacauauucaccucaacacgagacuuucaugugguuauuaauaucaaauuuuugaauguccaaauuuuggaguguagucuagcagagguaaacugauuugccuaagguccuucaacugucagagguagaauuauuuucucucuccuggcucuaaaaccuguccagauucuccugcaacacuguccuucaaaaacacacuuccgcugacuccagugcuggugaugucaugcuuuagcuaguaguuagaggugacuuaacuuuaaauauggaaucuuuuuuuccuauuaagcaaugagguuuaguuugaaaauucuuagagaugauaaaccccucuccuuuuuuucuuccuucuccucuuuuguccugaacaauguuccauauauauuacugccagaaacagauucuugacauuccuguuaugcuuuuccacaucuuguaaucauuucuacagcuguuagcauugccaacaauuauauuuccacuuuuaaaaaauuguuacaaagaugcagagagaaaagaggaaagccaaggaauaaacuacaggcaauuaugggauauuuuugugaugugacauuuugggaacugaggcagcaucacugauacugcacuacuuuuuaauaucuagauuuuaaucuuuuguaugaagauaaaauucacaugccuuaaaccugaccacaacauaauagggcauuuauuuuucuaauuuugauaccauccacauuucuuaacuauaagaagaaugcuuauguuguaccagguuauaugauguugccaagaaguagauguguaccauuuacuaauacauccuuuuggaaaaugcguauuaauaacauauuaaggaguaaauugacguugugcaaagugagccugugaguuuaaauguauggauuguacaccuugcucuuccuaauugcagauuuaacaggauuugaugaccuaaugaguuuauuucugaaugauuuauauuucuuugucaguucaaugauuuaguauuuuaaauuuuuuuaaaucacauuuuauugagauaaugcuauuaguguuucuuucccaucacuuaacaaaguuaagucacuccucucccaccccacuuuuguaccuaccaauguuuuuuucacaguuacaggcugauuggcuugacgugucuuaggauaccacccaaagagagcuucauuuuauaaauaccaagcucauuuuccuaaauauuuucaaaaagauagauuuauccucauauaguaaauucagauuaauaauuuuggaaagggucaugugaccaugguauuacauggcuguggaagacccuccaagaucuuguuuugggauagaaggacucagacauccaaacuuuuaaauuaaugaacuuauuaaauucuaaaacuuuguaacaguguuaauuugagaaguauaauauuuugcuuaaggucuguuuugcuuugcaaaaugcaucuccuucauuuucauauuauguuggaagcuuagcaugaaagaacgugccucagaggaaaccauagguaagcauacuuuaacaaaaguuagugucaucauguuugugucuuugccugugguuuuuuaaauguauaauguuuaacguugauuuggcuaucaaauuacauuuucuuuuguuaaaaaauucuguaaauuagaaauguacugaaucauuuauuuagcagacugaagguggguaauguuggcugaacagguuuaagccacaguaauuugaaaauguaaauacauaaaauaaugucauuucucuuccacucaauguuucuucaccaaauaaaguccagccugcucugaauuuguugccaguaggaacaauguuacagugaaucaugguuuaauauaccuugaaaauggcacaucuguucugugauagcuuaccaauuuuagccucuuuauaaaauacgaagaguuugucaaccagaauaaucuagaaccuggcaauucaaauaccauucaaagcaaauguuuuaucuaauaacuggaacuaaauguuaggccucaugacaguucaauauuuacuaaauaaguuuaauaacaggguaagcccucaguauccagagcagagacaagcacaccauauuuacacauacaaauucugccuuuagccaucugaaagggccccgaacuauugcagcaagcaaagagucuuugcauuguccuaaaauccauacaauacuuuauauuuuacacauuuuaauagcuaguuuaacaaauaacaaguaccaugcuuaauucucugcaugcauuauuucaacuaauuauuggaauaaucuuauaaaguggguacuuucgucucagcuuacaggugagaaaacaaaaguuaaauagaucgcccagggcucugcuggaacguguuaagcagggauuucagccuguccagucagaccccagaaguuguguucuuaaccauuagcaacacaucaucccaggcaggcccuacaugagccucauaaccaauuuuaugcuggauaguauuaucccuauuucacagauggcaaaacugagguccagagacuuuaagugaccuacccaaaauuacagucaugagcagaggcacuggaauguagggccuugacacucuaccucacgugguccucuuuccuguuuuggguaguucuccacuaccacuacucauuucugaugcuggaaaggcuguguuuuauacauuucuguuucuggcuuggaacgaaacacucugggucucugcuugaucaguguccccucuaaacugcaccucacuacaguagggauggcauaagauacuucuuuacacagcaucuuuuuguucccaccucacccccagagcuguaauagguagagccagccaaaugucaaagggaugauuugucuugucaccacuaguuucccuuuucucugccuuguauguaacaggaauauucuuuaguuccuccuuauguucuaaagcaccuccccaaccuaaaaauagaagaggaguugugggucauuuacacuuuagugugaauuugcccuugugacuuugccaaggcuguugugccuaacccuuucaaucuaacagcagaaugagagucucuggacuauccuggcuccuucccugagaagaaugaacugggaauuguuggucuagacaucaagacuaccagagaccuauugcucagagauguuugggcuguacaauuucuguagauauggcaucuggagcagccuuuucuaagcaauggcauuaucauuccaggcucucucgcucuuuccaucucuccaccagguggacucuugcccuccaccccuuccaauuugucagugauucagagaacauucuccauccuuccaaugauuacauuccuucaucuugcuggggcgccaauucagugauggagcggcucuugggagcagccuuggcuuauagugcagcucucugcuaccuucaacaggcugguauucggggugcuuagaugugacugguuguacgcacguguguguaugugcauguguguacagcaguaagagcuuucgagguagauacuugaggaagccucagacaucuagccccauuacuggggcaaugucuuacuuggguuuuuccagaaacagaccuggagaccaggauucaagugccagugguauauuugggaugugaacccugcaaugcugguaggagaguggagaagugaggcaaggaaaggaaggccgucaaggggcguguuaggaggucauucaccaccgcagguagcccgcuggggaccucugggagcaaguguggcgcacaagccucagcauuacugcccugugccuugaggaguaagggauaaggauuuuccccaccaguucccuguaguccuuggugagagcuucugggguggagguuaaggucuuuaggucagagaaauuuucuuuaguuucggaaaaaucuuucaggccgagguccagacacucacuggaacacacugaagugguuagguccaagggcuguaggcagagcucccauauccaucugcagagguguuucagguggaaggaguggagacagccuucucugcuccacacugucuucagcaaggguuucuguaucugugcauugaggauuaaauuauucacauggucagagaagcccaucaccacugauaguuauuguagguauggaaaacuaacgacuaagaagggagaaaaauauaccaagcaguuggcuuggcugaacacaaguaaagacucuuacagucacuggugugaacugcuuauuaucaaugucugauuacagugcugcauacuaaugauuaugcaugucauuaaaugugucagauuaacuuuguuauaaaauuuaugacaacauuaaauuuuauucacaugcucagccuucauaauuuauugcuuauguagcaugguuuuaacuucagaaaaaccuccaagacaguguugucuugaugacuacacugcuuauccgugagucuaguuuuccuguucauuugaaauguucacauuacauucagcucugucucaagcacugagacagagcuggaaucagugcccagcgauuccacuugccgagugauugaggcugggggauuacuccccucucuuugugaauucucuugcuguguguuauugauuaauucaaccaacucuuaguugacccuaaccaugcaacauguauugugccaggugguguggauuuagaauauggauuagacccucauucuguccucaaggaguuccuggucuaguagagaaucacaucacuuuauaguugauuguucaagaaggaagcuuguucaaacaugaauaaaagacugugcaucuucugacuuuguagguguggaauaacaaagaucuguuccuuuauuggguuuccagaaaacaucuccaaagcuauaccagucaucauuuugugcuuucagaaaugaguaacauuguaggauaguacuuauugcuuguacuuagcuuugugugcuagcugagcauuuguaaauagaaggcauucacggguaaaauguguuuccuuuagccaaaugcacaaugguagugccuuucuagaauccaagcuaaagaugucgucacaugccacauccacacacuucuuagcaaaaauccaacuagaagaacuuugcuauuuacaacaaaggcaaaugcugucaagaaguaggcuuaguaccacaggaagcggagccaaauguguucuugaaauuuauaaguugaccugaaaauaauguuuugggaagccauggcuugccguugucagcugucaaaauugagcuuggcaggagaaaucagggucaggaacagaauagagauagucaaaaagagacagaacagagagagggcuacuguuguuucuggaguccagugaccacccggguucuagugugguacuggcaguggacuaaauaaguggauccacccuaagguggagagaagguucauauggagauaauuuaaagagcugacuuuuagcccuuccaaagaauuacauguuccuaacugccaaccuaggaacauccuggauuaacuugcaauuuaaggcugugguauaccuguuucaaauaaaauagcccugugaauagcauggaagucaaaugauaucaacuagguuugaaacaaccuccuucucucuuuugaauggagcagugauuaaacgcaagacaucagcuuagaaaaugcauguauuagcaaacgccuaagaugaggaaagaucugggcaugcccugaagccaaugcaauuuuucuuucuccaccccaaaccugugcuacgugaugaauuuacaguauuaaaaacauugcugccgccuacuucuuccagcugggacuucaggaccaucuuugaauccuccucggcucuccacacccagcagugcagcaacuccucaucucucucucucuuucucucuuuuuuuuuuuuuuauuuuuuuugagacagagucuugcucuguugccuaggcuagggugcaguggcacaaucucggcucacugcaaccuccgccucccagguucaagcgauucuccugccucagccuccugaguagcugggacuacaggcacgugccaccacaccugacuaauuuuuuguauuguuaguagagaugggguuuuaccauguuaggauggucuugaucuccugaccucguggaucugcccaccucggccucccaaagugcugggacuacaggcaugagccacugugccuguccuaccccucacaucucuuuaaauauuuuucaaauaucugccuuccuuuucaaucucauggacuugguugugguuauggccucuugugagaggguuucuugcuuccauuuuucuccggcuucaguccaucuuccaaacccaugucagcggcuucuccugcuugcacagaaaaugaaguucagacaguuugcauuugagccuuggcucacuuucccagccucaccuccagugacccccuucucugcccuaccccaguccuucuuagcccaucuuucuucucaggacacaccaggcaacuucaugccaccauuccuugcguaugcucuucucuuggcccagcucacuaccucucugaaauguuccaaaacgcuuccaggcagaauuaaucauuuugugucuguauuccaaaaaccaggguuccauucucuguuuaucauggugaugauaguuauuuacuugucacucuuaguuagcuuuguaacaccuagcacaguaacugaaacaguagaugcucaaacauggauuuauuuuuaacuuaaaaugagauggguauuuuaggaugccagaaucuuugggucaaaaagauguggcuuaguuuucaugucaggaacggcucuuaguucaagcagugaaacaacccuggcucauucaaacaggaagggaaaaaauucaaggcuguugaguugcucacaggcucugagggguucauggaggcagaugcugguggccucagcggaaggagcaauacacagacucuccacagagaacccauucugccacugcugcugggugcagagucugguugcaccuaccacgccccaagccugaugccagauucugcugcucccucuggaaacugaugucgcucccagugcagcugccaccccagcccaaauggauucccugcagccccuccuuagcccaugucaugccaagagucagugccaucugauuggcugagccuggaucacaugcccaagcccuagcugcaagagaggcugggaaagcaagcaucuggcuucuguggaguuguuggucucugccccccaucaagacucaugagguggcugggcacgggcaugguggcucacaccuguaaucccagcacuuugcggggcugaaacaaggggaucacuugaggccaggaguuuaagaccagccugggcaacaaagugagacccccaucucuauagaaagaauaaaaagaaaaaaaacuuaggcaugguggugugcaccuguggucccagcuacuggggaggcugaagcaggaggaucacuugagcccaggauguugaggcugcagugagcugugauggugccacugcacuccagccugggcaacagagugagauccuguucccaccccaccaauaaauucaugcauacauacauauacucuugaggcgggaaauccccagauucagcucagaugcuggggugacagaaggugcaaaaagagugacagauguccacuagaacuuucuuucagaacaccagaacccugguuaagagcuuccuuugaugguauguccgagacuuagcaggaaaagcauggcaugcucaaauugaguaacuugagaauugaauaaagggaacauuuacaaaggaugggcaggaugcagggaagccaccaggaacagcugcacuccaaggccaguaacacuggggagcuuuuaccaccccaggccugaaggggcaaggaguggggcaguuaccagaccuggagacagacacaggguuguguguguggagaggucccuggcaggagccaagacugcauuagaaagacacagccagcccugggcaauuccucgguagggaguaagugcuccaauucccccuuccuucccuaugguccccugcugaggcuucccacaagccccaugcggaagccagagggccagggagccccacuucucaaaaugagcagaguauguugaagaagggcagagaguggauccggaggaacaaguagaagacaggcugcccaugaggcuucaucauaugucaccaacauuuuucuauucauuuuauucaauaucuacuuuggggaugucacuucacauuuuaaguaccugagcccacaagaucgaugugaucuuaaaguguccuucuccuauugaauuuaacaagcugcuauuuuccccucguuugcuauucagaaugcucuaucauaugguucaacaauuuguacuauuaaagguuagcaaaugccagccaaaaauucauuuuuuuccuuccugggcuugggaaaagaggaugugacaugugaccugcacaaacacaaugucaagaaucucccuuuacaagucuccauguagaaauccucucuaggauuugugucagcacacgagaucuccugcugcucaucucugccuccucuucauuaauaucuagccuccuaaauaacgcagauagaagaauggucauaaaauugagcccuacacaauuaccaguagcuauaggccuccccaaggauucaggcacuguaacccugauucuuucaaagcaucugguaacuugugcuagaauaaccauuuacuuuggaaaagcauaccaaggagaaagcuucauccuuugucuuugcauagaugguggguuccuuuacagaauauggaaacugauuguuuucccauaaaccucaacuaggagaaugagguaaucauguguuauuuagauaaaagaauguucaccuuucuuuuuuacaaaaauuaugguaauagaauuauuuuuuaaaugcaaaugauggagaaguacacagcaaagggcaaaagucacccuuucugugugcccacuucccuugguccccccucaauauuaacaauaugccagaaaaagcaagauuguucuaaccacaugauuacaagcuguguccucagggacugcugaggauguggucuuggaacaguauguacucuacuucuccuucaagguccaggcagcccuugggucuucaagcccaagacagaaaguucacuuuguaucucacucugggagaacaacacccauuugcaaagcuguaaacuugggugguguaucaugacagccacucgcaggggacucuagaggcacuucuaucuauuuacuuaaguguuaauuguacauuucugauuuaccacuguccuaccaaaacaggaauuugcuuucuuauuuuuuuuaaaaaaaaggauggaggaaucaacuaacaauaaauaucugaaauuccuagguaugauuuuuggcauuuguagccaucaauuguuugccaggagcagaauguguaugcuuuuguuagagugucaugaaaugaauauaacugauauuuaaugugaacauaagaaauacuuguuucccuggcuaacacggugaaaccccgucucuacuaaaaauacaaaaaaauuagccaggcgugguggugugugccuguagucucagcuacuugggaggcugaggcaggagaauggcaugaacucaggaggcggagcuugcggugaaccgagaucgcgccacuggacuccagccugggcgacagagugagacuccauuucaaaaaaaaaaaaaaagaaaugcuuguuuccaguauuacaccaaacacauagaguuuucuauauggauuuuagggauguguugcaaggauuuugaaagcugccucucugugcuuuguccuucaggaagaaaucccugaccuggcucacccuggcucuucuccucucuugacuccuagaucacauggugucaguaucccucauaauagccuguacucaucugaucccaaguacuguaaaugagcuggcuuuugcguaccaggcucaucuuagcagauuccaaguuccuggagggcaaggaauuuguuccaggaugacacauagccauuugacugaguucuuccauccuucuuuuccauagcuuuccuacaagacccuaaaccuuugucuccauuacaacuauggcaaauauccaugcuggaugaauacaaaugccuacccuuggcagcugucuccuucacccauagccuauucaccacagauguuaccuccuuaaaaaacacaugcacacacauacacuauggaaugaauccaucuacuucuuuauaucuucauugccacaacuuuauccaaccacugucaucucuccuaggucacuguaguagccuuccaguugguuucccaucauccauucugaagggcuuccaucaguucuuuacacagcagaguuacauuuuuaaaaugcaaaccugaucguaucacuccuuacuuaaaauuguucaauagcuuccuauuuaccauucaggaaagacaacacuuuuccuacagcauagaaggucuugcaugggcugaccccacuugccucuccagcucgucuuauuuauaagcuccccuuugucucugacccccaguccaaucggccuucuuccaauucuucgcuacuuuccccugucccugagcucuugcacaugcuaagucucugccuggaaggcucuuccaauccccuucacuuaguagaaucuccuauucaucauucucuguuaaaucaacacuuuaugagugaaaccuuccuuaaggucccuuguguguggauaacuuugccaugcaccuguccuuaagauuuccacaguugguaauuaagcaauuauuuuuugagcauuuguuuaaugucuauccuagaagacugaggucug

SEQ ID NO: 15710 - RNA, 1231 nt, Homo sapiens
ucacagaagucccaugacacuugcacuguuauuuuacagguaccccauuuugcagauuaagaaacugagaagcaaaaaauuaaagugguuugccuaagguuuccagauaauaggugggagagcugggauuuaaagcugguagacugccuccagucugcuaugacuucugccugaagacagaugauaucuaaaauaauuuuuaaacauaugaaauucauuuucaguauaauuauagauagcagaucaaaauaacuagaaaaauccaggaaaaagagccaugaauauacacuuucaaagagugugcaaugaagagcaaaaucaauucuugcuuuauaagcuaucacaaggauuuuaccacugucaacauuuuauuauuagauaucaaaaaaucauuaccaccaaaacaaaacauucacaaugauauaaaaauggacuuugcuccuuaaggaaaugcuauaaauaugcacaagaaaauauuuuucucugagaaauggcaaucagccaauaaaucagcaagucacacacgaaucuccucucuuuuccuagaauuuaacacaugaagauuuaacaaggcuuguaaccaguucaacaagaaugagagaagccuguuagaagccaucauuaaaucuaaaacuuaaaacuucugcaugacaaaauacaucauaaaaagguuaaaagacaagcuauacauagggaguaaauauuugcaacaugccuaguaagagaagacuguuaaccagaaaugaugaacaacuccuacaagucaguaagauaagcaacucaaaacaaagaagcauaaauaauagguucaaggauuucacagaaaaggaaauucaaauggccaaucaacauggaaggauguugaacgucacuagcaauuacagaaacucaaaauagaaccacaauaagcuacuuacuucaaaugugcaaaauguuuaaguuggucgguaucagauguugguguaaguauggggaaaugagugcuuucauaugcugcuggugggagucuacaucauagccaaguuggagguacuuuggaaggaccuaguaauauugaagaugagugaauucuauaaucuuaaaauuaucugcacagagaaauauuugcacagaugcacugggggauauguacaaggacguucacugcaacauaauuugaaauaaugaaaaacugacaaaaccuaaauauccaccagcaagaaaugaauaaucugugguguguuccuaggau

SEQ ID NO: 15711 - RNA, 1863 nt, Homo sapiens
aaaaaugccuuaauguuuaaugucaacauuaaaaggaaaggagagaguuauuaaaaguagcaaguggcuuauuuaaaugguguaucaauuuucaaaagaguuauugcucaauuuagauuguaaaccacuuugguacuuaaaucacucaacagguggccucgggaauguggcuuuccacagcacccuucaaaauagucacaagguggguuacgccacacaucuuuguuuuuaagaguccaauuuaagaaaauugugcuuucacgugccagacaucagugccuaagaugucucugcagggagaugugagguuagcagguggcacagggaagccuguugagacaggugcuuaagcaacacggcagggcacagggagggcugcagaggugcuggggaggugggcugggcccugccaagacaggugaaagcagguggauaggacuagggcaccaguuuugucacaguuuaaacacaaauaguguuuuauuuuauuuuuuuuaaauagauaagucuggcugucuugcccaggcugcaguucaguggcuauucauaggugcuaucauagcacacuauagucuggagauccugggcccaagccauccucccaccucagucucccaagcagcugggacuacaagcacuuugucccccaucccuccuucuacuuucccccuuuucuaaggcagcuauuuccaacuuuuuguguuuuucugaggugcuguguuuaccuccaugucucuaaauaauagaccucuauugccacgucuugauucuugauuuuuaguucuugaaauuguguugacuuccugccaccccugaacugcuucugugcccuagccucccaauagaguuaaaaugaauuucguuuagcucaauagucaguguucacauuauagugacuguguaagggcuguucuuaucaacugagcuguguaauauuucuuuauuuaucauuuuaaauuuuuuuugaggcagggucuugcucuguugcccaggcuagacugcaguggugcaaucaaggcucacugcaaccucaaccuccugggcccuagugauccucccugccucacugucugauuuuuuuuguuuuuuguuuuuugguuuuuuuuuuuugagacagaaucuugcucugucgcccaggugggagugcagcagggugaucucagcucacugcaaccuccgccuccuggauucaagcaauucucccuccucagccuccugaguagcugggauuacaggcauguaccaccaugcccagcuaauuuuuguauuuuuaguagagaugggguuucacuauauuggccaggcuggccucaaacuccuggccucaagugauccacccgccuuggccucccaaagugcugggauuacaggugugagccacugugcccagccugaacuguguaauauuucuuuuuccgugcaaguucuuuuuguuuuuccugaguuuuucuuuuccauguuguuuacuaauucccccuaaacuaugccaauguucuaagccccuccaaaugcuuagcacauaagguauuuuaucacugucaucuucucagaggcacuuguccuggaguuucuggccagcugugcccagcacacaaacuucauccuaaaugacgcuuuucuuccaugcaucccauggggcagcuccucuccuaugugucuuauguuucccucuuucuugauaaacuguuuccuuucauuggugcucaucccccaguagcuuucuggaagcgugcaggcaguagacauccgaaaauauuuuuguucuucauuuacacucaauuguuagcuuggcuggauauagaauccugaguugaaaacaucuuuccuccagaauuugaaaacauugcuucaucacucccagcg

SEQ ID NO: 15712 - RNA, 838 nt, Homo sapiens
uaauaacccccagaaaucucauuuuaauaacagauacaaaccuuuacaacucaaaggaauaccucucuucaacggugacacuuuagacaaugugacaggagaguuggguaagggcuuuucaaaaguuccugcaaugcuagguggguguccucucugccccagguaguuccuggaguaguucucccuaccccagcaauaucuaggauggguuccuguccucccaccaaacugcuggggcacaaauugguucccaugagagacuggaccccuggaacucuggggcuccuguuuggaguuucuuuuuuuugagacagggucccccucugucacccaggcuggagugcaguguugcaaucacaacucauugcagcuucgaccuccugggcucaagcgauccucuugucucagccucaggaguagcuaggacuacagggaagugcugccacgccuggcuagauuuuuaauuuuuauuuuguagacauggagucuccccauguuguccaggcugguggaguuucugcaccugcagaucugccauaaaauucucaagauggcucuggucuggcugcugccuaacauggaaggggguaccuuccugagaguucagcaaaauaaauccaagcugcaaagauucuuccaggaccugcuuugagauuggcuagagcagaagcaguuagcuacaaggagaggguggcauucucaucuuuucugcccugcuggccuggaaacccguggcuggucagugagcccucccuccugccccaggcucccacccauguccucauccugcuccacaccuccucuugugcagucugucagagcucugaccaccaaauua

SEQ ID NO: 15713 - RNA, 8585 nt, Homo sapiens
ucacacagccuguuuccuguuuucaaacggggaacuuagaaaguggcagccccucggcuugucgccggagcugagaaccaagagcucgaaggggccauaugacacuccucccggaccccuggacacacacagcccuggagacuggaggucaguauuugaucccaagcucagcuguccucugccugcuguggccugaguccccuucuccuggggcccugccuggcaccugcugggggcagggugggagggggaagaguuagugacagccacugugucuggagcucuccuuagcacacugaggcagaggaagggacagcuccuggaccuuccaucaccuccauuccuuuugaaaugcuaggcgcuuguacaacccaucuugggccuggagaauaagucaccacaccuguguuucucaaaagaacagugucagggaaccccugccucagcacagccuuagaggacucauggaaaaugcagaauccaggccuguucaauggcaccuuccuauguuagcagccaggaaaccugcucuuggacaagccccugggaucccacccccaccccaccaggggauucuuacacacacuggguugggagccccuggcuuuggcaaggcuucucaggugagcguccaguuguuggaggguacccacccuuuccccaagagaggcagccacacauccaacauccugggaucucugucucccagcgugggccaugugcuuuauuucacccccuagaggcucaucccccaugaaaaguccuccgcaggcccucagaaagauaguguggccucugugugcccagcagaagaaggacuggacuuggcagucagcucuuggagagggggugguuaggacaccuggggacaggaggaggagaaugacugucugugcacacacggcuggaaggcagaggaggcugggaagcugcucuguccccugggccaacuacaggcccccaggccaacagcaacaacacuuuuaguauuuuguuauaaagucaagaaaucuuugcuacagagggugaggagagggaaggaaagggccauggaaccgucuauguggcuauccccagagagcuuuuagagugacaggauugcuuucccauuucacagaugaggaaacugaggccuggagagggaugggaagcuacccaaggccccauggauacaccagugcacaacucuuuccuucccccuccucuuuaaaugggugacucccaaugaaaccuguaagagacaaccauaagggagcugacuguggcugcugaauuugauuuuauucuaaggccugguuuuauaaucagcuuucucagucuuuacuggagugucaagccgaggcaucauuucuagggucuuacagggucucugggccaauagugcccugcuucugaccuggagccagcugccuggucaugaaagcagaucugcaaaggcuggggccccugaggccaaggccacucgccaucacccauuuuacagaagugcugagcauaggagugcccugggcccccaagaaucccagccaccaagaaucacguaaaccauccacugucucacuuaggcaccagucagaauguagggaacccaccccuagucauccaucaucuuaucaacaggacggggcuuguagccacauuuaucagguagggaaacugaagccuagagauauuaaagcacuugcuuaaggacacacgguuggucaggauggaaggcgaugucuccugacucccugacaggcacaagagacaagcgagaggugcccgugacggcaugcucaagaacgugcagcccugggccagccaggccccugcuccgugccucuguuugcccaucuguaaaaggugagguuggaucgagggucccugagggccgcccacuggauggcugugcagagccaaacggagaaggccccaggguuccuuucacccgacacagcaagcacuucccccugaagugcaggcuccaggccccagcugaccuccccucucccaggccagcggcucucaccccuggagcaagggacaggcgcuggcugugcucagggacaugcaugacucccgcccccaucugugcucagggggugccagggaggcacuggcucuaucuuucucuaggccguagucagcccagggguucagaccaagagcccagaauccaacagaucagaguucaagucccagcucuaccucuauguuccacuggcagcuuccucaggucauuugcaccuuccuugucuugaauuuccaugccuaaccagucaguauaccagcuacucccuccagccgaucuaauguuuuaauugucccuuucucuaaguugucucaaacauuuguaauucuauuccaauccaccuuaauuuagucauuuauuucacaaauauuucuggaaacaucuagcacuuaacagacacuaaaagcggggguacuacacagucccugggauggacagggcccugagcugaggcuucagagucugccugacugaauccucaccccagccuugugaacguggguucuguuauuauccccaauuuauaggaaacagaagcacagagaaguugagucacuugccagcuaccaggucaucccuuccacuuauccgggucacagacagaguuauuauguaaaccagaucccagcugccuguucucccucccugaguaagguggagagaauucugaagucagcccagccugggucuguauccugcccaccacucaccagcuccucaucuuuggcaacucuaagucucaguucccuuaucauaaaagggagauguaaacaguccugagugcagacaguguucagguuagugcaagagugugugcugggugugaagugcacagccagcacgucacaagcacuggagacaaauucagcuuugcuuguugcgcacacucaccagcugcgugacuuuagaccucaguuuucucaucuguuauguggugguaaugauagacuuuugugagcauuaaacuagauuaggggcuauggagaaccuagauggguaugaaguggguauaauaagcuaucaguuaauuuugcugauagauagauuauugauugauugaucgauagaagauucauaccaguaucuaccugcucugaacacugaccuuucuuuuuuucuuuuugagauggucuuguucugucacccagacuggagugcaguggcaucaucauagcucacugcagccucagucucuugggcuuaagggauccuccugucucagccucccaaguagcugggaccacaggcgugcauccuggauaauuuuuuuuuauuuuuucuagagacggggucucacuacauuggccaggcuggucucaaauuccugggcucaagugauccuucuaacccagccucccaaagcgcugggauuacaggcaugaguggccauguucaacuugaacacugagacuucauucgcauguguaacauaaaacugaguaucuagacaagccagcaucuuucuuucaaguaaucacuaaagccaauacuuuuacuugaaaucaucucauuuaaaacucugagcaauacguaaggaucaccucaauaacauauggaucaucgcaauaggugaagggucuucucugccuuggaguaaccugcccagcaaaggggcagacccagauuugggaucuggcagcugggagaguggggaagguugagccguggggcccuugucauucccucugccugccaggagggggcaugacacagcuccuaggcaccccaggagccaccgggaaccccaacuggaguggguccucacuguucucuuuuuccucuggcagccuuggagcauggcaaguccagagcacccugggagcccuggcugcaugggacccauaacccagugcacggcaaggacccagcaggaagcaccagccacuggccccgaccucccgcacccaggaccugacgggcacuuaggugggcuugaggcuugagacucggucugggggagaggucugaagacauucaaaguacaaaugugggucacuuugggggaugcagcaagaggcccgggcagcucuuguaacuuggguuaucccaaaacagacacugagacacagaucuagugcaagcuguuuauccgggagacgguccuaggagucauggcaggggagugggaauggaaggaaagggcaagaggccagggcaggacaucagugaacagauaggcacgguagguggcugaagcucaaccccagcgggggucuucugggagacccuggaacauaucucuggguuguccuauccuaggggugaggaagccgggcuguuaucuaccaguccugcccugcauaggagaagggacgcuccugggccugcugcuauggcccuagaaagcccucagggaagccaguggcauguucuggaaaagugggugccaagagggcacgguccagccuggggcauggacagcaucugcuguagugccaucuccuggaacagaucuuuucuuacaguccuucgagaugcccuauucaauaccugcucuguuccuggcccuaugcagggcacuggagaaacagaaacaggaagaaaucaaacacugcacuaguccugagguuugguagagaaacagaucagugagaaacaguuacacgugccacgagaaauaaauaaauaaaaugaaaaaccuguaggaacaaggugggaagcucuuacucuaaugccaaggggcauuugcagugaugugggggcugggucuugaaggguagacuggaaaagggcugggacccaugcccuuugcaauaaaaugcacaauuauuugugcuucuuaagaaccucagaguggcgcagggcucaagugggguuuaagaaacacuguguucguuuuccaggcguggaaauagaggguuggaugcaaggcagagcagugcacguccgagaagagcccggcaugugggcaguuagaugagaagguuaggaagggccagcccgcugaggcuggaacauaacauccuccucacugccuccccugcccacugaugugugcucaaggagucguggcaacagucacgaagucagggcugcagggagcacagaaacacacaagccaccgucucugcuuguccagagcagggauuucaccauggccaaucuacagaccagaaguggacgaugcaaagugcccgcaccgcauuccaaagcugugaaaccacuugggggugaugggcuauuugggauugucggugguaggguggauucugccaggcugggcacagaggucugucugaugccccaauugggccuauaaauggcggggugggagagagggauauucaauacucuucaggaguucugauaugccaucucagauagacccagccaucuccccaagcccaugccucggaagugcacugacagggugcagauccuuaaggguguuguccuuccagacacacacaguggccugagcuccaacuccagcaugaccacgcgggagcuucagcaguacuggcagaaccagaaaugccgcuggaagcacgucaaacugcucuuugagaucgcuucagcucgcaucgaggagagaaaagucucuaaguuugugguaagcagagauugggaaaugguggagccucuuucacucugcuuccuuccuggcccugaauaagucuuguagagccucagguuucccaacuaugaaaugggucaacacacuaacucacagcuuucuucuggagaaaauggccaaagagcaagauuucaggcucagcaccugcuagggucugugaggauucgaaccauauaagucauauuucuuggucccaagaaggaaauagcccaguuuaaucccaucuuaucaggugucagucaccuguguccuuucuucaccaauuuugccauaucacuguaucuguucuaauuauuauuacuuauuuuuuucuuuaaauuggaucacuuuuuaaaaacaugaagcacauuuauuucaaagagaaauaccuuaaauggaaaaccaauaucacauggcacaaagcaaaaguaacauacuagaaaagucgauacaaggaaagucaauacaaggaaagcuaugugcuguuauuaaauucuagcugguuacuguggcuucgggaaagcccugugccugggagcugcuccucucccuguuagaauggaauuuuagcuuguguuaagggauguuaaagacugccuaagagccacacuucauccuucuccuucacuuaccugggaccgggauaaauaacauagcuaccacugaaugccaauggcaugccgggcacagcuccaugugguuucagugcauuaacucauuuaauccucacugggugagguaggcacuaugccuauccuuguuuuaugaaugagaaaagugagacucggagagguuaaauuacucaucuaaaaccacacagcuagaccaugguagggcuauaauuacaacccaugcaaucuggcucuggagucagaugcauggguuauaauugcccuuaauauauaauugcccguaaucaggauucucuugaaagaugauugaaaaggauugauuuucuuaccauauaacggcaucaccaguguaccuaaaugauguuauauuguacguaaaacuaauucccaagugugaaacauuuggaaaacacagcaucucaguucagaaaacagaggcccaguuuuagcaaguaaagccaagagggaccccagcagccugcagggcaggacccucugcccuuucuccucccagauguccccaccuugcuguguuguuguuccaggguugacucagcugaugccaauagcaauuuaaaacagaauugggccaggugcaguggcucaugccuguaaucccagcacuuugggaggcccagguaggaggaucgcuugagcccaggaguuggagaccagccugggcaacacagccagaccccaucuuuuaaaaaaaaucaaaaaaucugccagguagugggugugccuguagucccagcuacucaggaggcucaggugggcaggucaauugagcccauaaguucaagguugcagugagguaugaucgcaucacuguacuccagccuggguaacagugcgagacccugucucuaaaaauaaauaaauaaauaaauaaauaaauaaauaaacaaacaaacaaacaaacaaacaaacaauugcauauaaggaucgcccguuuucagggcaugcuuuacaccggccugguuaacuuuacucugggugugcuccguccgccgcagcccccgccgggagguggccacagcucucucugguugcgcccuagguguaccaaaucaucgucauccagacugggagcuuugacaacaacaaggccguccuggaacggcgcuauuccgacuucgcgaagcuccagaaagcgcugcugaagacguucagggaggagaucgaagacguggaguuucccaggaagcaccugacugggaacuucgcugaggagaugaucugugagcgucggcgcgcccugcaggaguaccugggccugcucuacgccauccgcugcgugcgccgcucccgggaguuccuggacuuccucacgcggccggagcugcgcgaggcuuucggcugccugcgggccggccaguacccgcgcgcccuggagcugcugcugcgcgugcugccgcugcaggagaagcucaccgcccacugcccugcggccgccgucccggcccugugcgccgugcugcugugccaccgcgaccucgaccgccccgccgaggccuucgcggccggagagagggcccugcagcgccugcaggcccgggagggccaucgcuacuaugcgccucugcuggacgccaugguccgccuggccuacgcgcugggcaaggacuucgugacucugcaggagaggcuggaggagagccagcuccggaggcccacgccccgaggcaucacccugaaggagcucacugugcgagaauaccugcacugagccggccugggaccccgcagggacgcuggagauuuggggucaccauggcucacagugggcuguuugggguucuuuuuuuuuauuuuuccuuuucuuuuuuguuauuugagacagucuugcucugucacccagacugaagugcaguggcucaauuaugucucacugcagccucaaacuccugggcacaagcaauccucccaccucagccucccaaguagcugggauuacaggugcacaccaccacaccaggcuaauuuuuaauuuuuuaguagagacagggucucucuguugcccaggcuggucucuaacuucugaccuuaaaugaucuuccugccucagcuucccaaaacacugggguuacaagugugagccaccaccccuggccugggguucauuuuuaaugggaaaagccacugggggcucuaacucgcugggugacuuuggacaagccccuccucugguccucaauuucuccaucuguauuggacagaggugcuccugggaccccuuggaagccucugcuugugucccacguccucuugaugccagggccacuucaucuccaaaacacaaaaccaacugccaaaaccguccagagcaguguccaccccaccagugucuuugugggaagcuggagaagaaguuuaccucaca

SEQ ID NO: 15714 - RNA, 59885 nt, Homo sapiens
cgguucggaggcggggcaggugggggcgggcccagguagcagguuuggcugcgcgggggccgcgcgucggagguaaauacuagggcgguggguguggggagccggggccggcccgggacgcgggcuggggagccggggcgaggggcgacgccccgccgcccgagguuagugaaugagcgggcggcuggcggccggcgggcggccggauccccucggcgcagccgccuggccucagggcguccggagccgccgcggcgaccaucgggcccucggcgccggcccguuaguugcccgggcccgagccggccgggcccgcggguugccgagcccgcugacgucagcccggguuucccccccccaccggggcuuccccaucccccgaggcuucccgggagggcugcgaguccggggagcgugcggggucgccaccaucgggacccccagaggagagaggacuuggggcgggagccgcgcgggacgcugucccccucccgccccccaccccauuuacagauugggagacugaggcacaggccgcuggcgggccccgacggccacgguuggccucaggagcccggggcugugauuccuaccgaccgcgccgcggggcguacguaccgaucgauuuugcggguguugguggcucccguccaggaauggcagucgggguucuggccuuguuaauggcguguucugcuuuuucuuucaguuucccccuuucuagggugaggaugguucuacacagccacccggaguuccuuaguugaaaggugcgcccugcugugacagguauucuuucuuuauguuuuucuuucauguuaacaaucgagggggguggggggcgaauggggggcgggggcgaagucaugaaaucuucaggagaugguguugaguuugguacucagcugggucagcugccgguuauucauguacuuggcaucguuucucuuccaccccuuggcauuugaauguuuuaggauaguugucaucuuccagccaccaagccuguggccuugcagucucccagcccccaucaucccugccaccuucuucuccucaauuuuuccuggaaaguuuuauccuuagcucagcuaaggagcaugccuaccuugcuuuugaauucgggcuaauuagggaucuuaauaagauuguucauuuugcaaucauuggcucucagagaagcacccaggccuugagaggguguucguuugauuguuggcuuucuacacacccccucacgccccaaguagacugaauggccuuaagaauuuagccucccauuccccacugagcaguagguggauuugaacuagaacaguauuaggagaaaaugauuugcuggaaauucuuauugaaguaacacccagaacauucucuaauauucugcugcaaaauuguauaguauucuugcaaauaaaccuuccucugggugguaacuuuugugagaagcagauaaggcuuguuauauaaagcacaacuaacauuaagcagcaaugauuuuuauagucuggcacaccuaaacugugguuuuguuugauuuaaggaagucuccaacacagggagagagaaaggaauaguuauguuguuuaucaaacuauuaguauuuuguuccugauuuucacacuaugauuuaaauuaguuuuuuuuucauugguuguacagaauuuauaagcaucauacaugcuaguugaggcuguaggaagcuaguaucaaauaaaccucaaaacaacuugguuucguaauugugaaauuuuccguauuuguuucuucuuauauguauaacaaugaagugguuuagcaugauuucauuuuaucuagagaauuacugaaguuuuaggcaaaauucauuaaauacucccaauuccugagucuuuuucucuucucuuucucuugguuuaaucccuuaaacaggaggaggaaaugcaauuuuguuuucacuguuaccacuugagucuuucauucauuucucuguauucagugccuagcauaugccaggcucucgugugggcacuggauaauauaaaaaugaaggacuuggggaauucacaguuuggcaguggaguggcuagguuuaacacuagagaggcagcaguauuccuuguuccagugggaauaugcagaugugagaggcucuucuuuucuuuuuuuuuuuuaaccuuauaaaucccacuuguauuagggacuguguacuugugacacaaauuagucauugaggaaaauuaaaacggacucagucuuuuuucuggccacggaaucucuguaucucuauucuuuagcuguuuagaaauauaacaacuuugucuuuuagugagagauguucucuuuuaaaaggaugaucauucuagcuauccagaagcuuuuggaaaaaggcccacaugucuucuuucuuugguguucaagcugaccuuccuaccucuuugccauuuauaauuaggggcagaauuaaguauuguaaguuuuauucuaauuuaaauagcuuccugugguuuuuagaacaagcaggauaucuuuggagaugcaaaaagcucuugaauuggaucugucuuugugagauccuuaugaacaauauaaccugauaacuugagaaucagaaaaacacugcaucuucuggauaaguuaaccauuguuaguuuucuguagcuacugauguucauuuguacuauauguugccuuucagaaugugguaauuguaaucuuuaacauuuucauguaaaacauauuuccugaucaucuuuccauugucuucauggaaaauugauaaauauuugugccuuccaacucucgucuugguugaaugacuucaucuuaauacaaguaaguuccccuuuacucagaauccagaccaucaacaagcucagauaaccagaaauguuuucaaaucuaugugaaccugaacuguucuccuucaucagcguccuuaaaggaaaggccuucuguucaacauggcuuuaggguuaaacauauuauuguguuucaacucguugguaauuuucauucaguauuuauuaccaagauauucauaaucacacaguuauccagccugaaguaagauaguauuuagaugagucauuugugauauacucacucaaagugauucaaccugcaaaauaauaagagaauacaagugaaaauuucucccuucacacugaccccucacccccaccugcccuacggugacuuugaauuuagcugugcuucuuuuuccuucaguugucuuacuguucccuaggccuuuacuuaaaggcagaagcugagugaauguggauugauguuggguuuuuuuuuguguguguucucucuuuccucuuuguuuuuuuuuuuuuuuuuuuuuuugagaccaggucuugcucugucacccaggcuggaguacaguggugugaucauagcucucuucagccuggaccuccugggcucuagcgaucuucccauccuccagaguagcugggacccugaguagcugggcccacaggcagacaccaccacacccggcuaauuuucuuuucuuuuuuuuucuuccuuuugggacaggcucucauucugucacccaggcaggagugcgguagugcuaucacagcucacuaaagccuugaacuccagggcuuaggggauccucccacuucagccuccaaagugcugggauuacaggagugagccacugugccuagccuagaugauguaguuuucaguaucuaacucuguacugaaagcguaaaaaauaccaaacuaacaaaccaaccuucuugaugauaaauaacucauuuacaaugugauuuagaucuuucccuucauauuguguugagucaguuuuuacugcuugggguaccuaagacuuuaacuauuuaacuacuaugcacaucccagugaaaguagacuguugguguuauauucacuucuacaguggggagaaauguauguuagcauauuuuuauugcaauacugguauuuugaguacauaaaauaaauauauauauauaauggaguguguauauaugugagagagugugugacagggucuugcuuuuucacccaggcugaagugcgguggcgugaucauggcuugcugcagucccucccuccagggcucaagccauccucccaccucagccucacaaguagcugggacuacaggcacaugccaucacaccuggcuaacuuuuguacuuuuuguagaaaugagguuucacuguguugcacaggcuggucucaaacuccugggcucaagcuguccacucaccuuggcuucccaaaguguugggauuacaggcgugagucacugugccuggccgagaauauuagugaucauucaguugauugccuuguauaucucuagacucgagccguaaaguuucccauucaacuuucucuaucaguugcagugaagagaaucaauuuuuaauaagagaguuucaaacuuguucuuaauauauucuuucugaaagaggaaaggcuguauccuuuauuuuuggauaaugcuuuugaaauauuugauaacuugugcuugacuauuuuaguugucuaacaugacccauccuauugcuaagucuaagcucauuuccacuugugcuaaugaaaguuaggaaaaaaguuaccacuccuuguagaguucacuuuaaaauaugguacuugaaagcuauaguuuauuacccuaaaacauuuuuauaaaccuagcaguuauaucaauuuuuacuguggauucucuuccuuaaauuauuucagaaagcaagcuuauaaucaaauuuauuuaacauaauguccuaaugcacauauaguaauuuaguuuugucuuaauaauagauuauuagcauuaaugauuuuuauuuuaaauugugacaugaauaguuaagcuacaggaccaauagaguaggagcuguugguauaaagcaauuauuaagauucagggaaguuucugauuguaauauuugaagacauuguucuuaggaauuuuaaaaaagaauuucuuuucaaaauagaauuacuuuaccuuuuucaaaaaaauuuuggcccuaaaaaucuaaauacauuuuaaagagaaccaaaacaacagcucguuuuuuugaaaguugcuuuuugacugucuuaaccuucugcuagugaccagacucucuauucaauaaagccuaugugcccuuugcuccuaaagacccuuucagaauguaugcauuccucuuuucacgauuguugcuuuguguuuucaaacacacaaacauauuucacuaccuggcuucucagaacugauucgaagcgauaaguuggaaagcaacaaggccguaaaaggagucaaaugcauacagcaggaaaccacagaaaauggcugauugcaagggaaaacucuagacaguagaucuguagaaagcauucgcgaccucaggaagcauaagauacagccuuuuaacaaaauaacagccuugcagaucaagaguuaugcaaaauaauuuacagucauaaugauacaucaaugaucaagaaaaaaauaaggacauuuucuuguggaaaguguugacauguuaaaagcauuuuggucaaaaagaaccaacacuucaguuugguccuuuaaaggaauccaaccaaauugagggguuggauagcuguuugggcagcccuuauaaggaguuuuguuuauauugugucaagauagagguuuccacaggugucuuauauaaguggcaaauauaaauugaucccauucuugcugaaguagacagugcccucaaguggaauuaaaacaaacacaccacaaaaaagaagaaaagagaaccacuucaugcuaccucugcuuuuacccucacugaguguuacacagauauuucagucauguugguuugaaggaggugccuaaccuguauccugucuuggcuaaaccacaugucucaugcuggcuuguagagggagagacuuuuaggaacguuaccauuauggaauacuucauuaucuagcagugcuuucuaaaagaaguguuccacuguguauagauuugccagguuguuugaucauuaagugauuaaaucuaaaauuugguucuuuaggaguauuuauuuuuuaauugcuagaauaaaauaaauaugauagugcuaucaauugcagccauuacccagaauaauggaaauggauaccucuaucucaaggaaggaugaaaugaaaguacugucuuuggaaaccagauagccacauucuuaugacagggauaccuaggaaguauuguuuucagcagaaaauuaauuaaaauaaugaaguaaagucucaguuuaaauuaaugaaauuguguaguuuuuuaaccaucaguuaaaauagguuugagaaugagccuacuucauuggaaagauuauuauucuuguaaaaauuuuaaaugaggaccaggugcaguugcucaugccuguaauccuagaaccuuggaaggccaaggugggaggaucauuugaguccaggaguuugaaacugcagugagcuaugaucgcaccaauguacccaagccugggugacagagcgagacccugucuuaaaaauaaauaaauaaaauaaaaauaaaugaaaauuugaaaaagaaauaauagaaagaaauuauaaugcaguuauaucaugauauucccuugcuauguaguacaaguuuugaugcuacaaaauugauuuuuaaaauauuuuuaauauagucauauuauaauaucugauauuugcgauuugagaaaucagauaacuaugauuaaugugaugaacauugcccaucuucagaaaaaauauaugaaaugaaguugagucagagguaaaauguuccauuaucacaauauggccauaucauagcuaucauuuauaggcaugagccacacagcucagcccgaaacgcuacuuuuaaaaguuuauuagugucagaauaugggacaggccugguggcuuacgacuguaaucccagugcguugggaggccaagacaggaggauuguuugagcccaggaguucaagaccagcuuaggcaacauagugagacccugucucuacaaaaaauagaaagcuuagcuguguguggugauaugcgucuauaauaccaguuacucgggaggcugagguaggaggaucacuugagccuggaaggucuuggccacagugaacugugauugugccacugcaguccagcaugggcaacaagagugagacccugucucaaaacaaauaaauaaaaauaaauuaaaaaaaguuagaauauguauauaaggguaaucuuuaaaaguuuuuacuagaaucugauuuuauaaauuucagugucuuggaagcaaacauuguguugucuuugaaaguacuuuacaauuggauuucauuaauuaaauaugcacaguuacaguagauaaaaguaauacaguauguaugucuuuuagcccuuuuagauauuuuuugaaaauauuucauuuguguguauguguuuacuggucaaaugaaaauuuuaaaagucuucagucuuaauuuucagucauguagaaugaagucuaaaguuuauuuuugcuuuuucacuaggcauuuugauuuccuuucuuuuuacagcauggacaccacguugcugaaaacaugcuuugggacugccacugaauuuaucuuuugcgguuuuaugacaaaguuauuaguaguuucccuuuuuugaauuaguauuuugaaguuaauaucacaaugaguucaggcuuauggagccaagaaaaagucacuucacccuacugggaagagcggauuuuuuacuugcuucuucaagaaugcagcguuacagacaaacaaacacaaaagcuccuuaaaguaccgaagggaaguauaggacaguauauucaagaucguucuguggggcauucaaggauuccuucugcaaaaggcaagaaaaaucagauuggauuaaaaauucuagagcaaccucaugcaguucucuuuguugaugaaaaggauguuguagagauaaaugaaaaguucacagaguuacuuuuggcaauuaccaauugugaggagagguucagccuguuuaaaaacagaaacagacuaaguaaaggccuccaaauagacgugggcuguccugugaaaguacagcugagaucuggggaagaaaaauuuccuggaguuguacgcuucagaggaccccuguuagcagagaggacagucuccggaauauucuuuggaguugaauugcugguaaguuugauaaaccauuuuaguaguguguuuguuuguguucaugugugucuguguauuuguaugcacauacauauuuuucuccuuaaauacgaaauaaauuuucccaagagucuucuguaauuuuuaauauucaucauccuugcugaugaauccauguugugguugaauccauaauccaaaacuugcuuauaguugucacugauaauaugugugaaaaucaccuuggcguuuauuucuguuggaaagagacccaagaacucugugauauguuuccaagcuuaauauucauucuugagaacuuaaaugucaauuauauuuugacauucuugcaaauagaauuguaugccuucuuugcuucuugauuuaauuucuuuuguuuacuuuuuaaugaugaauugcgaagauguaaagaugaugucgaaacuuaaaaaacuauguacuaugguaggaacauacaaagagauucaccuggcuauugcagacauauauauuuuagaaauuuuaacauugccuguauuaaacaugaacgcuaccaguuguaaauaguuacauaaaaaauuguuaauuaccuugcguuaucaucuauagguuucuuaguucuucuuaauguauguuauuaaauaacaauuuagauauaagauuuuugaaaaaaaaguugcagaaauuuaaacuugcuuauaauuguccccgauaauauaugugaaaauccuuagaauuuauuucuaccggaaggagacccaagaaugcugugauauguuuccaaacuuaauauucauucacaagaacugaaaugccaauuacauuuugacacucuugccaauagaauugcaugucuucuuugcuucuugauuuaauuuuuuuuaaaagcagugauuguaaacaauuaggaauuugaaucccaguuaagccauuuacuagcuggguugccagguuacuuaacaaagcuacuuaacuucucucauucugcauccuuaccuguacaaugguguuaauaguacaugacuuguaguguuuuugugguacauugaugcaggauuuaagcacagugacugacaauaagugcuuaaugaauggagcuaacauuacugcuauuuuaaaguaacauuuucuuuuuauaaccaaauuaauguuagaaucacaacguggaauucagccuagcuuucucaugauagaguuaugaauugaaauuaucagauaauauuauuucagcaucagauacaacuucuuauuuuuuaaaacacucuaaauccaacagaaacugcuaauaauuguauuucuuauuauauguaucauuuagaaauuuuccagagugauuuuccugaaaucccuagagugaaccccuuuuccuauggaucgucuuucuauaucuauuucuuucccuucucucuuaaaaacuaggaagaaggucguggucaagguuucacugacgggguguaccaagggaaacagcuuuuucagugugaugaagauuguggcguguuuguugcauuggacaagcuagaacucauagaagaugaugacacugcauuggaaagugauuacgcagguccuggggacacaaugcaggucgaacuuccuccuuuggaaauaaacuccagaguuucuuugaagguuggagaaacaauagaaucuggaacaguuauauucugugauguuuugccaggaaaagaaagcuuaggauauuuuguugguguggacaugguaagaaaauuuuggauuaaauaucuuugugauauauauauuaguuuauauauauauguauauauauauauaaacauauauauacacacauauauauacacacauauauauguauaguuuauauauauauguauuaguuuuaggaccaauuuacuugcaaauugaacacuuugaauauuuaacaugaucuaauuuggaguacuuuaaagaacauguucuaauuuaucuuugguaaaggagcauugaaauagaacaggggucuagauacagauuacauuuacuuuuuuuucccauuugaauaaacuagaauaauguucucuaucuuuaaauuugccuuauuguagcugaccaguagacaaaacaaaacaagacaaaacacaauuauauuacuugaaguccuauuuuucuuuauuuugaaacaguuuuuugggguacuccauuuuuuugugauauucuacacaauuuaauggcugaucugauuuuaauaauuaguauaauaaucauuuauagaaaauaccugaguagaggaaaaccacauugauuuugaggaauagacaaucagaauaucucauaggauuucauucauuuuaaaaaccuuuuuuaauugugguaaaauauacauaacaaaauuuaucacuuaagcauuuuuaagugugcauacaguggcauuaaguguauucacauuguuguacugucaccuguucaucuccagaacuuuuucaucaucccaaaccgaaacucugugccuguuuuaacaguaacugcccacuuuccccaaccucugcuaaccacaauuucuucugauuucucugucugaauuugccgguucuaggcuccucauaagaguggaaucauacaacauuugaccuuuuguuugugucacuuauuuuuaauguuuccuuacaaucauacuuuuuaauaauggauccauuccagugugguucauuggauuauaccuguggcacugaaagaauaagaagagaaaggcugagaccauuuuuaucauauauugaacauaugggcaagacuuuguuauguauaaagaaggaaauucauauggaauuacugaacacuagaaugaguuaggaggcgaugugaguaguaaucucuuauacucacaauggggaugcuuuuagucaucauuuuuaucugcucagguauacuuuuugguugguaagguaauguucuaguguaaugguuuccugugcuugaaaauuccaggaaauucuaucugauacucauugguuaguuacuaaacaaacguuuacucuuaacaugugaaaaguuagaaccagaguaaaacauguaugccccucaggauagcugacaguaaagcacuccuuuuaaccaauauucuuuaaauaguaauucagucuuuauuucaaggagaauuguggccuucauggagggaagauuggagaaagagggccacuggucauugggguuggucuccccuugcaucaggcucuuuaccuugggccucaaacuuggcagaagcuguuuaggguuuaggccuugccuuuuucagauggcggucuggggucagcuuguuuaccugaggcaagcugccuagagauuugcccugccagcuucucuccuugccuccaucugucccauagcugacuugugcagauauucauuccaaacacuucuauuauaguccuuaagaggaaaguucuggcaaaugcuagaacuucuuucuuuaucuccuuuuccuucuauucauccuuuauuuccagggacauuuuagcaugccaugcacauuggugcccagggcaguugucugacuggcccgucuacugauguaguucccuguacagcacagugcuaguuggcacuauauuagaauaucagauaauuaaauauaaacaucuccaucuuggagaagauuccuauaugcucauaaaugacaaaagaacaauuagaaaauagacuuuuuauguacagaaaggcauacagaaguucagauggacuauuuaaaugcucagggaauaugaagaacuuagggcuaauuagaggcagguuucugggugaaauaauauauuauuaaugaaacuuccugugcaaaauacugucuuuuuaaaccucaaauggguguuauccuacagauuaguauuuauuguucaguaaaguaugaaaaaaacacuuucaauucuuugcuuaucuggggguuuacuaucacuugguuauucuugaaucucauuucccuaaagaaaaaaaugaacaaaccaaugaaaaaagcaaaaccuuauuacuauggcaacuauuccuaauguauucuuucuuucuuuuagguaaaauuguuaacauuuaccaauguaaaauauuuuggaggauucuuuauggaaaauacagacuuccacauuuacauuucauugaggaggauuuuaauguuuauuauuuaauuucuaggauaacccuauuggcaacugggauggaagauuugauggagugcagcuuuguaguuuugcguguguugaaaguacaauucuauugcacaucaaugauaucaucccagguauguuuucuuuguuuuauacauuuauaaggcaaacuuuauuuuuuaauuuuuuauuuuuuuauaucaauauguuuugggggaacaggugguguuugguuacauggauaaguucuuucguggugauuucugagauuuuggugcacccgucacccgagaaguauacuccguaccccauguguagucuuuuaccccuugccaccccccauucuuucccccugaguccccaaaguccaauguauuauucuuacaccuuugaauccucauagcuuagcuccuacauauaagugagaacauacaguguuuggcuuuccauuccugaguuauuauacuucucuuagaauaauagccuccaauuccauccagguugcugugaaugccauuauuucauuccuuuuuacggcugaguaguauuccaugguguauguauauauauacacacacacauauguauauauauauacgcauauauacauauacacacauauauguauacauauauacacacauauguauauauacacacauauauacauauacacacauauauguauacauauauacauauauauguauauauacauauauauguauauauacauauauauguauauauacauauauauguauauauacauauagauauguauacauauacacacauauauacauacauauauacacacauauacacauguguauauauacacacguguacauauguguguauauacacacguguacauauguguguguauauacacacguguacauauguguguguauauacacacguguacauauguguguauauacacacauauguguacuacauuuucuuuaucgacuuguucauugaugggcauuugggcugguuccauauuuuugcaauugcagauugugcugcuguaaacgugcaugugcaaguaucuuuuuccuauaaucacuuuuuuuccuuggguagacuccuaguagugggauugcuggaucaaacgcuagagcuacuuuuaucuuuaaggaauccccacacuguuuuccacagugguuguacuaguuuauauuuccaccaacaguguaaaaauguucccuuuucaccacauccaugccaacaucuauucuuuuuugauuuuuugauuauggccauucuugcaagagugaggugguaucacauugugguuucgauuugcauuucccugauaauugaugaugcugagcauuuucccauaugcuuguuggcuauuuguauaucuucuuuugauaauugucuaaaagugggcuaauguccuuagcccauuuuuugaugggauuguuuuuuucuugcugauuuguuugaguucuuuguagauucuauauauuaguucuuuguaggauguauagauugugaagauuuucucccacucuacugauuauuucuuuugcuguguagaagccuuuuaguuuaauuaagucucaucuauuuaucauuuuuguugcauuugcuuucggguucuuggucaugaagucuuugcuuaagccaaugucuagaaggauuuuuccaauguuauccucuagaaucuuuaugguuucaggucuuagauuuaagucuuugaucccucuauaaggcaagcuuucuaauauauauuuugaguacauaaauguaagcuucaagauauauuuuuagaacuugacuuuuauauuauggaauuguuauuaaauaggauauccuuuacccucaaaugaaaauaauuaagauuuuuguuuccagacguauaugaguauaaggguggcauuaauauguuuucauucacuuuuucaucaccuguccauucuuagugggggaaaaacccuuccuguuaauuagaaggaucggaaaauguaauaaacugcuaccugagugagagcuugguuuaaacuagaaggcuuuacacagacauuggucaucuaaucuaaucuaauguacuguggagaagauucuugcuggauaaccugugagaucccuuuuaguuuugagaaggugugauugaucagggaucaggacucuagucagaaauagauugcucaacuuuacauuuagaagaaaaaucaagcaaucuuuuauuuugccucuaacaaguagcaccuagugucugcugucagguaauugacaauuucuguugauaacagcaucaacaguuucaucccccugcuguuaguggaacucucugugauacaggcuagugcaauaaagccaacaguggcagucagagauggugauucucauugagcauuaugcaagucugauuaaaaugucagaaggccugcaggcagacuguagccaggaauguaccaggcccugaguuagacgacuuaauacuuuuuuacauucuuaacaaacuuauaauguaagucuuaaugauccccauuucgcugauaaaaagcuggggcucggauggacaacaauuaccaaaaucaaaguaaauaguagagccagaauuuaaauccacaccugucugauuagaaagcugugcucuuuucaguaccuccccaccccaaauccuaucuguauauuuaggaugugaagaccugcauagaaaaccauacuucucagucucacauguauacuugggaauauuguuuccauggagauauauuuugucucuaauucuauaaaagcugaauuuugcuauagcaaggaucacaauugaauaagcaaacugaauuguuuuuuuuucaggucauuucagguccucaguuucuuuuguuguaaaaaugaaagggcuaauacuagaugauucuuaagguuccuuuuagcgugcacuguuugcgcuuccuguuuuccuguugcugaagcaaguaaucaaugcuuguuuuucaaguuagggcaugcuuucugcuuuaguuuuuagcuuuacagcaacagcacauuaauuuaguuggagguauaggauucaaaugauagcuuuauuucaauuuuacuucuucaaagugugacauacuuugcuuuacuugauguuuguaaaaucaauuuuuaauuuauugcaaauugaauuccuagcuauuuuuuauuuugcuucccuuugggaacaaaugauuuacauucaggaaaaagcauauaugugcuugauauuuuacuuggcaaaauuuaauuuaguuuuucaugauuuuuuuuuuugagacggggucucgcuuugucgcccaggguggagugcaguggcguggucucugcucacugcaagcuccgacuccuggguccacgccauucuccugccucagccucccgaguagcugggaccacaggcgcccgccaccacgcccggcuaauguuuuguaucuuuaguagagaugggguuucaucguguuagccaggauggucucaaucuccugaccucaugauccacccgccucggccucccaaagugcugggacuacaggcgugagccacugcgcccggccuaguuuuucaugauuguuaauggagauaauacaauuuauuuuaugaauuaaaguacuuuuaaauauuauaauaaaugcuuaugguuuacaaaacaguuuaauaaaaggccauuccuucauucaaauauuauuaagcccuuaccuagauguuggggauauaguaggaagcaaaacugguaaaaauucuucucguguggaguuuucauucuagugaguggagacagacaguaaauauguaauguguaugaucaauuacaugauaauaagaugaaaaaugauaaacacagugaggaggaagggagcacuagguuguagggcgggauuuuucgauuucauguaggguaguucugauaaaccuucuaauaaggugacauuugagcuguugacaugaaggaaguuugggagagaacauguggauuccgagggagagcccaaggccgcagccagcguggccaguuugagcaaugugaagaguugacuguggcugcggcagauggagugagggagaaaguuguaggagccgcagugggagcuggaacagguagugcucagugggcuguuguguggauucuuggcuuucauagugacagagguggggagcuauagguggguuuugaacaaaggacaacucacccuaauuugcauuuuuaaaugaucucucuggcugccuguuaagaauaaacuagacagaggacagaaacagggagaccaggaaggagacuguuguaguuauccacgugagagacggugguggcugggacuggggugguaugaagaggaugguaagugaaggauuuggauauaauguaaagaucccaucaagauuugcagauggguugggugugagguuugagagagagaacagaaucaaggaugauuccaagguuuggacugagcaacugguaggcuggagaggcaauuuacccaggugggaaagacaacaggaagagcaugcgucggggagugggaguuggaagucaggaucuugguuuugaucauguuaaaauugaguuagcuauuaaacaauuucauuugaauguuuauguuaauauuauacgaauucauguuuaauccuuaaaaaugggcaaugugcucaucauuuucauauuuaagaaacuuuuggcugggugcaguggcuuauuccuguaaucucagcacuuuaggaagccgaagugggcagaucacgugaggucaggaguucgagaccagcuuggccaacauggcgaacccccccgucucuacuaaaaauacaaaaauuagccaggcgugguggcggucaccuguagucccagcuacucaggaggcugaggccaggagaaucgcuugaaccugggagguggagguugcagugagcugagauugugccauugcacuccaaccugggugacagagcgagacuccaucucaaaaaagaaacuuuuuacuguagaauguauuugcaaaaguauauauaacaacauauauuaagaauaauaaugaacacucaugaaacugaccaucuagguuaagaaacagaacauuagaaguaccuugaaaaccaccugcaauaccuuguuuucauuauaauugcaaucucucccuagaggugaccauuauucugauuuuuucauuaauuauuuccuugcuuuuuauaauuuaauuauaucucuguagcuaaacaauauacuguuuagccugcuuuugaacuuaauguaguuaaaaucuuacugauuuuuaaauuacuugcaucauuuacuuaaaauguauuuugagauucuuuucuguggaugagggcauuaguaguuuguucacucucacugcuucauaguauauuucgucaugugacuaucccacaguuuggugcccauuguaauauuaauggacgcuuggguuuuagguuguuuccaccuccuuuuccacacuugguacugauuaaaauuuuugccagccugacagcugagaaaugguaucucaaggugguuuaaaaguuuguaguucccugauuacaaguaggauugaacagccuuuuauauguuuauacaacauuugugucuucuauuaaacacguauuuuuugccuguuuuucuguugaguugcucauuuauugauucaugaguucucuaguuuuagaauuuuaauaaaacaucuuuuaauguuuuguuaugacauuuuaaacagaaaaacugaaaauuuuauauugagcauccuuaugcauaucaucuagauccuacaaucaacaucuuacuugcuuuauauguaucuguccaccucucuauucacguacuuauccgucacguuuucuugugcauuucacauuaaguugcagauaccaguucacuuccuccuaaauacuucagugugcaucuaauuaacuagagauaaguauuuaggguuuucuuuuucauuucagauagaagucacacauauaaugacauacauauggauuuauuuggguucuaacuaauauauauauacccuugaauuagaaaccucuaucaaguuauuaaaacaauuuuaagaagaaaucauucauguaucucaaaucaaaauuaaaaaguacaauaaaauaucucauuuccauuuuuauccccucugccucaguugccugcuuacuccauccuucguuucucacuagucacaguuuuuaugaauuucuuauauaucuuuccaguguuucuuuauacaauauaaauauucuuauucccccuucccuuuuaauucaagaaguguaguagauacacuauucugcuguuugcuuuauucucuuaauuuuauauguuagaacucuuuguauauuugcaaacagagguucuuguuuuuuauaguguauaauuuuccauuguacggaaaaaaauuucauaauuuauuuaaccaguuuccuaucaauggacauuuggguuguuucugacuuuuugauauugcacacaauguuaccguaaccuguacaugucuguuucccacaugugcuagcauaucuggaggauauauauauucccagaaguggaguugcuugaugaaagggcguaugcguugguauuguucuggauauuguuaauugccuucagucguagauauaacaauuuauauuccugccaguagaauacaagggggaacuuauagcuuucccaugagaguguguuacuaacuuuuuucccaaucugauagauaaaaaauauauuucaguguauauaauacauuugcaaauagaaauuugcauuucucugagugauguugaacauuuuugcauaugauuaagggcaauuuuucuuucugugaacuguuugcaucuguugccuauuuuuaaauuggguuagguuauuggccuuuuuucucacugauuucuucauguguuaggguggcaaacucuucugugaugcgagaugcaaauguugcccacucuuccacccucauuugucauuugucuuuuuuuaaaauugcuuauuuuucuggucacccucauuuguuuuuauugugguaaaauauaccuaacaggauguaccauuuuaacaauuuuuaaguguauaauucaguguaaguauguuuacaguugugcaaccaucaccacuaucuauuuccagaaaucuuguucauuaucccaaauagaaacucuauacucaugaagagauagcugccgguuccucuuucccuccagccucugcucaucucuguucucugcucucuguccuuaugacuuugcuuacucuggguaucucauauuaguggaaucauacauauguccuuuggagcuggugcauuucacuuggugugauguuuuugacuuuggugcuuuuugccuugcaggauuuauaaaauuuuuaugcuguuguauucuuuuaguuuuaauagauucuggauuuugaguuacuguaagguuauaaaggaauuucccuguguuuucuucuaguacucugugguuuuaguacauaucucuauaucuaucuaucuaucuaucuaucuaucuauaucuuugacccauuucuguuuuaugugguauaugaugugaaauauaaauccaaucuaguuuuuauuuuugcccacagguagaagauacccuguugucuuaguaucauuuauuaaaaagucccucuuuacugguuugagaggccacuuucaucauacuaaauuuccacguguagcgugguauauuucuggacuuucuauucugucuucccacguuucaauaccacauuguucuuaaugauuuuuaaaaaauuguauauauucaugggguacaaguguaauugugcuacacuacuguauugcauuguggugaggucagggccuucagcacauccaucacuggagcaaugcacauuauacccaccaagcaaccucccaucauccaccccccgccaccccaagcccccuuuauucaucuuuccacacucugcuuccacgugugauucuuuauguguuuuaauauuauuaacacuagucuccucucacuguucuuuugaauuuuccuguucuauacuguuuucaaaauaguagucuucuugauaguuuugcguuuuuacauuuaaguguguuauucacuuagauuugguuuugaacaggauaugaaauauggguacagauauccaauuugaccuuccaugcuugcugcguauaaaucaaguuuccagauguacacguguggaucuuucugagcccugucauuucccuacacuaaagccuauccauagcuuuagaagucuugguagcugugagaguacauuuccauuguuuguuuucuuaaugaaugucuuggcuauuguuagccuuugggcuucauuguaaguuuaacuaucagcuucucaaauacuauaagagaguucuguuaggauuuuggaauugcaauuaaucuguagaacaauuggaggagaauugacauuucuaugauauuaaaacuucuaauauauaaaccuuguguauccuuucauuuauuuaauuuccuuuugguaaaauuuuauaauuuucuccaugaagagcuuacuugcauuuugaugcauuauaaagcauauuuucuaacagugucaugcugauguagaaauacaauugacuuuuuuuuuagaaaacagcuuuacugagaucuaguuuauaauucacucagaguguacaaaucagugcauuuuagugcauuuacagacaugugcaauugucaagauaauuuuagaacauuuucaucaccucuaaaagaaacgcugcaccccuuagugaucaucucccaaacccuucauccuuguuuaguccuaagcaacuaccagucuacuucugucucugcauauuugccuuuucuggacauuucauuuaaauggaaucacauuauauguggucuuuugugauuuacuuuuuucacuuagcauaauguuuucaagguuccuccauguuguagcaugugccagaauuuccguccuucuuaaggcagaauaauauuccauuguauggacacaucacauguuguuuauuaaucaguagauagauauuuagguuuuuuuuucaccuuuuggcuaaaaugaauaaugcugcuacaaacaugcauguacaaguuguuguguggacauaugcuuuuguuucucuuggguuuauaucuaggaguggaauugcugagucauaugauaacucuauguuuaaccauuuguggaacugccagacuguuucccaaagcagccacaccauuuuacauuccuacuagcaguguguaagcguuuugguuucuucauguccuugucaauacuuguuauuaucugacuuuuuuauucuagccauccuagugggaaugaagucauuuucaauugacuuucgugugcugauuuuucuuacaaacagacuuacuaaaauaucuuauucacaauccauggauuacuuauaaaauauucagucauuauaguuugcacauaauaacaguuuugccucuucugaauucuuuuauuuuuaaaaaugguuucuuacuguccuagcuaggaccucuaaauacaauauugaauagaaguagugauggaaggcaucuuggccuuuuuuucugaucuuaaagaaaaugcuuucaacauuucauuauuaaaugugauguuugcuauagaguuuuauuguuguaucugucauuuaucagguuagagaaguuaccuacuguuccuaguuuucuaacaguuuuaucaugaauugauguugaauuuuaucaaccccuuuuucucuauugagauaauccuauuuucuuuuaaucugcuaauuuucuuauauugaaucaaccuuacauccaugauguaaacccaaccuccucaugauucauacuuugcuugguccaguuugcuaguauuugcauccuguuuuuaaaaucucuguuuauaagagauauuggccuauacuuuuucccuuuuagcuguccuugucugguuuuggaaucaaagucgugcuugucucauaaaguaccugggaaagguuucuuuuauuuuguuauuugaaagaguuuaugugagauuagaauuaccuauuccuugacuauuugacaaagcuucuuuuuguggaaauguuuagcuacugaugaaauauccuuuaacauuuguuuguuuuugauugucuuuugcaaguuuuauuuuuuaugaauguauccauuuaauucauuuucaaagcuuugggcauaauguuguuuauaaaagccucuuaauuuucuguucaaccucagcagcaucugcccuuguguuccuauuuucauccaaaauguuaaucauuugugcuuucuuauauucuucaccaaucuuaccagugguuucugacuuucauuuuuucaaaggaccaacuuuuggcuuucuuaauucuuucuagauauacuuguuauuguuuaaaauaugcuacuauuuuuacuguguaacuagugcauuuuuuaggucuaagcccguaguucucagccugggaugcuuuugucuccuggggacauuuggcagugucuggagauuuuugauugccacaucugaggugagaguacuacuggccucuaaugcauggagaccagugaugcuucuaaacuuccuacagugcacagggcagcccuacacaacacagaauuaucugguucagaaccuuaguagaacugagcuugagacacuguguccuaagcaaauucuaggaguuaugcucauuuuauaauguuaacuugcuggauagcuaugggggaaucacuugaaaaacaaauuuucuuucauuauuuauguauucuugcagggauaaccaauucuaugcuaauauuguuuuucccagaguaacauggcuaaauguaauuucacuugucuuacgaaaucaaauacaggcauaccuaauuuuauagcgcuuuucuuuauugugcuucacagauauguguuuuuuauuaauugaagguuuguggcaauucugcuuugggcaagucugucaaugccauuuuuccaauagcaugugcacacuucgugucucugugucacauuuugguaauuccugcaauauuucaaacuuuuucauuauuauuauaucuguuauggugaucuguaaucaaugaucuuugaggugacuauugaaauuguuuuaaggcaccacaaaccacacccauauaagaugacaaacuccacugauaaauguuguguguauucugacugcuccacugacuaguggggccucugucucucucacuccuugggccucccuauuuccugauacccaaaaauauuaaaauuaggccaagucauaauccuacaauggccucuaaguguuccagugaaagagagaguugcauaucucucacuuuaaaucaaaagcuagaaaugauuaagcuuagugaggaagguauguugaaaaccgagagagacugaaaacuaggccucuugugccaaaguuagcuaaguugugaaugcaaaggaauauuuccugaaggaaauuaaaagugcuacuuuagugaacacaugaaugauaaaaaagcaaaacagccuuauugcugauauggagaaagguuuaguuaucuggauagaagaucaaaccagcacauucccuuaagccaaagccuaauccagagcaaggcccuaacucucuucaauucugaaaggcugagagagguaagaaagcugcagaagaaaaguuggaagcucgcacagguugguucauaaacuuuaaggaaagaugucaucaccauaacagaaaagugcaagaugaagcagcaagugcugauauagaaacugcugcaaguuaucagaagaucuagcuaaguuaauugaugaaaguggcuacauuaaauaaaagauuuucaguguaggcaaaacagccuucuauuggaagaagauaccaucuaagacuuucauagcugagaugaguagucaaugccuggcuucaaagcuucaaaggauaggcugacucuuuuguuagggguuaaugcaguuggugacuuuaaguugaagccaggauucugaaaaucccaaaauccuuaagaauuaugcuaaaucuacucugccugugcucuauaaauggaacaacaaagacuggaugacaacacauguguuuauagcaugcuuaacugaauauuuuaagucuacuguugagaccuacugcucagaaaaaggauuccuuucaaaacauuacuguucauugaugaugcaacuggucacucaaaagcuuugauggagaugcacaaggagauuaauguuguuuucaugcuugcuagcacaauaacuguucugcagcauauggaucaaggaguaauuucuauuugcaaguuuuauuuaagaaauacauucuguaaggcugccauagaucaggauuccucugacagacugggcaaagucaauugaaaacugucugaaaaggauucaccauucuagaugccaucaagaacauucaugauuuaugggaggaggucaaaauaucaacauuaacaggaguuugggagaaguugauuccaacccucauggaugacuuugagggacugaagauuucaguggaaaaaauaacuguagaugugguggaaguagcaaaagagcuagaacuagagguggagccugaaaauguacuugacugaauugcuauaaucucaugaucaaacuugagcggaugaagaaaggaaaagugguucauugagaugacaucaacuccuggugaggauauugugaacaucguugagaugacaacaaaggauuuagaauauuccauaaacuuaguaaagaagcagcagggcuugggagaggauuaacuccaguuuugaaagaacuucuauugugaguaaaaugcuaucaagcaguaucacaugcuacagagaaaucuuuuaugaaagaaagagccaacuucauuguugucuuauuuuaggaaauugccacggucacuccaacuuucagcaaccaucaccgugaucagucagcacccauccacacugaggcaagagccuccaccagcaaaaagacuaugacuccuugaaggcucagauaaucauuaacauuuuuuagcaaugaaauauuuuuaaaauuaagguauauacauuauuuucaauaacauaaugguauugcacacguaauggacuacaguauaguguaaacauagcuuucauaugcacugggaaacaaaaacacuugugugacuugcuuuauugugauauuugcuuuauugugguggucuggaacagaaccuacaauaucuccagggugugccuguguggguuuguggguuucaauuuuuuuuuuuuuuaauuuccauagaguacuuuugaaagcucaaaaaauaauuaaaaaaaaaagcauuuuagauugaaaguaaccguucucuuuaccuaccuuaauugcauuucuuugaauuuuacauuuuacaacugaaugcaauucauuauacugaauaaguuaggagacuagggaaaucauuaguuuaguauuauaauuuaagauugagauaccugaacuaugaaguuggcuuauguauaauugauuguuuuucucaguuggcuguagaauaaauacuugaagugcuuucucccacacacacacucuagagcuguauuuccuucugucuauuuuuuccacaucucaauuugguuugaaauguaaauuaucuuggguucuacaguagcacuuaaaaagcaaagcaaagaaaaaaaccacccuuucuauuuuuccuggaauauaaccugacaaggaauucuucauuaguaguauuuaucuuaaaaacauuuacgguuuuguuuuauuaaaauauugguggaggauugagauaauuaaaauuaguuacaugaauaucuugggcgucacuugucaggcacacuuugaucuucuaaaucaguaguuaucauugucauuauugcuggcucagagcagugaagagaaagaaaaagaaugauauuuuuuuuucuuuuaaagcuugauuuucauaaacccucaauaggagauaauuaagaaugauaccagcauuuauaacauaauacauaaauuacacuuauuugucaacaaaauaaagcuugcaaauagacuuuaaaaacuaaaguuguuuaaaugaaaauuaauuuaguuuacuuaaaugagucuucaucugccuuucaugucaucauuaggacucuuuucuugaggggaaaaaaaagucaaagugucuccuuuaguuccuuaguuucuuuuucuugcccaauuaccuucauccgugaaacaaaauuaauauuuacagcauuuaaaaaagaaaaaagauucuuuucagagcaguugaauggcugggaagcuuaggaaagaauucuuucuagucaauugcuuguaauaguuggcuucugaaggauaccuuugauugaaagaugcaggaaucuuaaaccuguuauaaaauuguuucucucuuauauuucuguucuaaaugguuaaaaacacugcuaacauaucuaauuugacauuauguucauguucuugaaguuguuaugaugaagcauaucaauuagcaccaccccaaaauuauacauuucgguuuuucuaguucaaccugugucuucuguucuaguuguggggguugggaguauaaugcuguuuuuuugacgaucucuacgaucaagauagugaacauauccaucaccccaaaauaugucccuugggaucccucccucugccucuuccuguccucucaacccccuacauucagacaaccacuggucuucuuuacaucaguauacacuuguucacauuuuuaaggauuuuacaaaaguggaauaacucagaaugcauucuuuuuugucuggcuuauuucacucgacauaauuauuuuuuauucauccauguuguccuuuuuauuguugauaugguuauauuaguuucuauauccauucacuuguugauggacacuugaguuuuuuucaguuuuuggcuauuaugaauaaugcugcuaugaaaauuuguguacgaaucuuuguauggacauaugccuucauuucacuuggguacuuaccuagauguggaauggcugguaauaucauaggugacuguuaacuuaaauaaaacccccaaaccuuccaagcuguguuuccaaagugguugcauuauuuuacauucccagaagcaguauaugagagauacaguucuuccauaucuuugccaacacuugguaugaucaguuuuuuaaauuuuaguaacaucuaauugugguuuuacucugcgcuucauuggugaccagugauaucaaacaucuuuccaugugcauauuugucaucuguauaucuucuuugguuuaguaucugugaaagucuuuggccgauuauuaauuguuucuuuaugauuggguuuugagaguuauuuauaaauuuugaauacaaacccuuuugcagauauaugcuuuacagcauuucagauuauuauagauucacaugcagagagagggacccugugugcccuuuagccaauuuuucccagcgguaacauuaacauguuguaaaacaagacgugugcaacaucacaaccagaauguugacccugauacaaucaagaagcagaacauucccaucccacaaagaucucuuaucuugcccuuuuacugccgcacaaauucccucuuccuccugccccauccuuaaccucugacaaccacucaucugcugucgauuucuguaauucagucauuucaagaauguuacauaaauggaguuguacaguauguaaccuuuugagacuggcucuuuuuucacugagcauaauucucuggagauuuaucuacauuauuuuauauauauccauggauuguuccuguuuauuccugaguaauauuccauauuauggauguaucaguuuguuuaacuguuuagcuguugaaggacaucugguuuguuuccaguuuuuggcuauuaugaauaaugcuuuuauaaauauuuguguguaguuuccugagugcacauaaaucuuuauuucuugacauaauuguccaagugcguauucggugauauuugcaaauuuaguuucuuaagaaaccgcuaaacuguuuuccagagugacuguacucuuacuuuaccacuggcaauauauggguaaucugguuucucuguauccuuuccagcauuugauguugucccuauuuuuaauuuuagccauucagagagauuuguaguuguauuucacugugauuuugauuugaauuuaccugauggcugcugauguugaacaucguuccguguacucacugucaucuguauauauucuuuuucuuucuuucuuuuuuuuuuuuuugagauggagucuugcucuguucacccaggcuggaguauaguggcgugaucucggcucacuguaaccuccaccuccuggguucaagugauucuccugccucagccucccaaguagcugggauuacaggugugcgcccccgagcccagcuaauuuuuguguucuuaguagagagaggguuucaccauguuggccaggcuggucucgaacuccugaccucaagugauccaccugccucggcuucccaaagugcugggauuacaggcaugagccccugcacccagccuucguauauauucuugagugaaagguguccucaucucuuuugcccagguucucauuggauccugugcuuuuuuacuguugaguuuugagaagucuuuauguauucuagauacuaauucuuuguucaauauaugguuugcacauuuuauuucccaauguguagcuugucuuuucauccucuuaauagggucuuucacagaguacaagauuuuuauuuuuaugaaguccaauuuauaguuuuucuugugugggucaagcuuuugugucaaguucgacaacuuuuguuuagcucuacauauggaagauuuucuccuaaguuuuuaaaaauugaaauguaauauguugugcaacccucaccacuauccaguuccagaacauuuucaugggaacccaguacccauuaagcaguuacuucccauugucucuuacccugagacccugacaaccacugaucugcuuucuaucucuacagauuugccuauucuggacauuucacauaaauagaauaaaagauauguggcuuuugugucuggcuucuucaguuaagcauaaucuuuucaagguucauccguaugauagcaaaaucaguacucuaaccuucuuuaugguugaauaauauuccaauaaauggaucugccguauuuuguuuagccauuuuucagucgauggacgucaguuucuaguuuuugacuauuauuaaaaaugcugcugugaacauucauauacaaguuauucuguggacaucuguuuucaguucuguuggguacucccuaggaguagaauugcugggucauguggugacuguguguuuagucauuuguggaacugccaaaugguuuucugaaggagcugcaccauuuacuuuuccagccacaauguaugaggguucuaauuucuuugcauccuuguucucuguuuuccaaaaaguuucauagauuuacuuuuuacauuuaagucuauaaucuauuuugaguuaauuugguauaaguugugagacuuaaguagaauuuuuuuuuaaaaaaucuauggauaucuaauuguuccaucacuauuuguugaaaagacucuuucuuccauugaauuauuuuucuaccuuugucaaaauucaguuggguauauuuaugugggucuauuucuugguucuccauucuguuccauugaucugugugucuguccuacugcccauaccacagucucgaucacugcggcuaacuaguaagucuugcaaucuauuaaacuaauuccuccuacuuuauucuuuuccaaaauuauuuuaguuauucuagaucuuuugccuuuccauaugcauuuuagaguaaucuuguguacaucuauacaaaaucuucuugagauuuugauaggaauuacauuaaaccuguauauaacuuuggggagaauugauauccuuuggcuagagagagcaaaacuuugguuggggccuucuuuugucuaugccuauugauguuuccagggugcugauuuuuuuaucucuaaguaugggauaagaauguagucaagaagaaaacccagagggaaaucucugugauguuauuucuuaggucuugagguuccuagcuggucuaccuucucaucucuaccuuucaaagucuucuuauauuuguuuuauauauuaugucuagagauuuuaguuguacuuagcaaaagaaauaggaaguacaucuacuuuaucuucccagaaguagaaguugcaccuuccuuuuuaacuuaacaauagauauuagagauuauuucauauuaguacauaaguuguauacuuggucuuuuguuuaaaucauugaauuauauuucauuuuaugcauguaccauaauuuuugaaccagccuccuacugaugagcauuuagguuguuuucaaucuuuugcuguuauaaacagugcuucagugaauaacuuuguaucuguguaucaguuagcaugugugccaguauaaaaagauaacuuccuaggaguagaauugcuaugcauuuuacauuuugauagacaguaauacauggcuuucauagagauugcuugucaaucggagucaccaugaauguugccuguauaggcaguacuccugguccuaugagacaguuagagcuggagcccugaagaaggauaauuugaagcaccagauaucagcaugcaacuuuugguguuaucuauauggcaccuucaagcauuucuugaagaauuuuucauauacuauuauggaaaauauuuauucugagcaggaacccaaccuuuuagagauuuuugaauaguugcuauguaggauauuucuggcaucggguuuaauaauaccucauucuacucaaguaaacuguauuuucuucacaagauuucuguggauguuaaauucucauuugagucugaauuaugcucuuguggcugcugauguuaagcgguacauuaauuaaacaauuucucuuaauuuacugggucauucaaauucauagacauuucauuugauuugaacaauaacuuguucacuaguuuauuguuaugauuuccugcucaagauucuccaagggauuuuucuuuuucugguuaaaucaacaagugauggauaagcugugaauuuuaucauuuaaaugcaaucuugcuguguauacauaauggauacuuuugguuugguuucuuuugcugaacacaauguccauguugcccuguuuaucaguaguuuguuccuuuuuuauugcuauguaguauuccauuguaugaauagaccauaauuuguuucucuauucuucuguagaauagcuuguuuccagcuuuugauuagaaugaauagggcugcucuguacauuuuuacucaugcuguuugguggaauuaucuucuauaucuuuuaauaucuuuaaucagguuuguuuuaaucacacaaaauugccagcugaauuuaucuuaccuugcuuuccaucccauauuuaucuuuuucugaguugguaaucacuuauaauucauuuaacuuugaaagcuuugcuucaugacccaaguaguuuugggccaugaacacaguugugacaaaguaauaagaaauauuugguguguaauugcuggagggcaauuagaggugguuugugccccuuugucuguauagaauucugauggaaugucuucuucuucagagcugauauuugacccccucucagacagccuuugacagaagguagccacaguuuccaacuccagugccccccugcucacauuccuaaucuuuggagcuccucccuagugucaccugcagaacugucaccaccggccauccaguuggcucuccaguccugccaggcuaccuucaaagccuaacaaagggaagagcacuugcuucauuuguuauaaugguuacuaacuauauaauggaucuauaucgugguauacaugugaacauacuuuaaaaauguuauaugcaguuaauuacaguuaauagugggaguuguuuuucuuuaggaaauuuauaugcuauaauuuaggaacucuucucagugacuaagauuuuccuucugaaguaucugucaugggugcuauuuaaagauaucugaaugacaacaucauaaaagaacaguggucuccucuuucaucaagggauacuuccaagacccccaguggauaccugaaacuauggauaguacugaacccuacguauacuguguuuuuccucuacauucaugccucugauaaaguuuaauuuauauauuaggcacaauaagauauugaaaacaauaaucagagaagagacaauaauaacaauauggcaacaucacuacucguguacuucaggacuauuauuaaguaaaauaagggugacuugaauguaagcacugugauacugcaauaguugaucugaugacugagguggcuacuaagugacuaacaaggcagggaguagacacaguguggagaugcuggacggggauggguuacgucagggguuauggauuaggauggugcaagauuucguuauaauacucaaaacagcaugcaacuuaaaacuuacgaauugucuguuucugcaauuuuuuauuuaauauuuuuggacagugguugacuguggguaacugauaccguggaagguaaaaguguggauaaguggggaccacaguauuaguacauagcuuuucucuuauuauaucacuugaucgaaaucgugguuaauugguauaauuuuugaauuaaaauauuuucauauucuauuggaucauauuaugagauguuuaagauauaguuuaauaacacaucccccuccucuuucaaccauggaaaaaaguuaccaaguauuuacauauaauucauuuaguaaauuuccucuuuuuuuaagaaaagucuuuuccuuguguuuaaaauguaaaaauuuuccuauuucuuucuuucuguccucaaauccacugugggugauaucguuuuugcugacacacagcuuuaucagguaugacuccuaagugucguguuggacuccacggauguauuguugaauuuuucaaaggaagaacuuuucacacugccucuucuacauucccuugaucaguauuuaggaguauucuaugaucauugcugggcuuuaaggucuagaguggucuuuguauucaaaacaaguuugccacacuuauuacaccuauauuucagaaauaauugugaguguuuucuucaaauauauuauuguugugugucucuggcuuucuguauuuuuaaucuaugcauaauucucuauguuuuccucuuuuauauguauaaguguuuguauacacaucuguguuauucuuaacauauauguuuuuaaaaacagauauauguucuuaaccagaacuuucuuuccuaaccaugauacauauuccuaaccaggcuuuuuucaaacuguguucaugaaauaauauuaaucugagaugcuaagcaaaguggcacaaaaauuuuuaucaauaaguuuauuuuguuucucccugagcaguucacaaugcacauuagcauauuaaaggcucugguuccgugcaguaaagaaauuguuuaucuuuguuuaucucagcaucuucaagaaauauuugaguucgaaacacuucauaauacacagggguguucuaagccugcugauuugggaaaugcuguaaaaaaccgaguaagauuuucuuuguaguguuuuaagagaucaaauaaaauugacuacaagugauuaaauuuucaagagguuaaagcauuuagcugaauuguauuuugagaggguauuuucuuauagaaauuacauuuugaaauacagcauugguuuuuucccccauaguauuaucuuuuucaauacuuuugauggccuuuaaaaggcauuuguaaaacuaaaaauucugccuuuuuguggaaagaggguuuuuuuauuuuguuacugucauuccuuguuucucuucuauaagaauuugccuuuaucuuuaaaaaacaugcuuacuguuucagagagugugacgcaggaaaggaggccucccaaacuugccuuuaugucaagagguguuggggacaaagguucauccagucauaauaaaccaaaggcuacagguauggauuaauagcauauaaccuuuaguaauuugcauaaugccuaacuugccauagcauuaaaaaagauuauaagcuauuacuucugaacauguauguagacuuuuuuucuuucaaacauuuuuaguagugaaacuaaaguuuguauauaaauacuguugcuuaagccaaguguucccagccuuuuuuaccucaggaagaguuccccauagggucuuguguguuuugcuggucuauaaucaaaugguuuuuggaacuccuuacuuggaauauuuguauguauaguuuaggauugcaacuguguaaaauaauccuauauggauaauguuauauaggauaaaguauacuagagguuaauuaaauggauuuugcuaacuagauuugguacaaauuaaaucccaaacugcuaagcaaaaauuucuucucuuucccagaagcuuccucacaauauguguggagcuuacagcucuuuuuuuuguuagcuuccacauacuucauagauuuauagaauaguaguuauacaagccaaagagcucauuaaaaaggcucugagaauuuuuguuaacucagaugcgaguuaggaaaagaauauuuuuuccucaauuauuacaauuuuggcucauuuaaaaggaaauuguacuuuaagaauuauuuuaugugacauuggggccugggagacuuaggauuaauugcaggauauauagguaacagucuuuuuuauguuaaccuauagaucuauauaggauagcucaaacuugcuacucucacuuaaauagaaacagacuaaagauuuucuuaagcuauggcauguuaauuguauuguaguagaucuuaaaguuauaaaauguacagcuaccugcuuuaauuugaaaagggaaaucagcuuuuuuguggguucuggagagcccacugcccuccacugugugugguauguccuugaauuaauacugaggcaggguaaugucaugaaauggcuguggcauagcuacacucgcccucucacguauaauaaauccaaucuguaagaaauaauagugcuugauuuuuucaaagacacaaggaauuugaugaccaaaaauuccaaaauguuuaaaacuuaacuauuuuuaaauguaauuuguguauugauuuauauauagaauuugaggauuaccuucuuuuaaaauaauagguuaaauuugugaaccaaugggucuaugaaaugaagcuggagaauggugauuuugacauuuagaaauaagcugugguacauggaacaauuucuuaaagcaguucauuuuuuuuaaaaaugagugggcuuuucuuuuaacuuacuccuguuucccuccuaucuugacuuuugggcugaaaaauauuuuuaauauugucaaaaugguuaccaaauuuuuaaaagcugaagacaguuaaaaaacauauuguguuuauauacauuuauugguuauguaaacaguuauuaacaucauauucauaauaauuucucuuacuaaaaaaaaacuuugaugcuauauugacuuuauuuuuaaaugaaacuuuucuuguuccuauaggaucuaccucagacccuggaaauagaaacagaucugaauuauuuuauaccuuaaaugggucuucuguugacucacaaccacaauccaaaucaaaaaauacaugguacauugaugaagguaaucaguaauuuuaguguucuuuauaaugauccuuucuuucuaacucaucagagaaaaaugguuuuuuauaucaauauuuguaguuuuuggaaacagaauaaguagaccgcucuuuguaauauugcugaacuaaaauauuguacacaguuugaaccguacugcuguuaagauuauuaaaauguuuaagaaauguauuaguaauuuguucuuuuccuuuaacugcugaucuauuuaggguggaagauuucugucugguuccuuccugaccucuuuaaagcacucccuuuuaaaaaauuuuaucuucccuugguccugggacaucauuuucaccuaguuuauucucuucuuuguucauuuguucaacaaauauuuauugagugcuuaugauugccaggcauucuuuuaggcaucaagaugaaaauggugagaaaaaauagacaugguucaugcccuuugugaguuugcaguuguuaaguuguugagauagaaauuagucaaacaaccacagacacaguagaguugccuugguggugugugcagugaaggugcaugaugcugugagaauacaccaaagaugauuuuucucagggucuuagggguguuucuuuggggcagugacacaugcuuagguuuaccagaggagugacagaugacaaagugaaaggggcuagaacuuccucgggagaagaaauagcauagggaaaguccuccuggaagaauggaagcuaguguuugccagggacuagaacacagacagaggcaugacauucaugagaugagaauggaaaggcaaacaggccugacucuguggucucccagccuuuagaguuuugccugccacauuuguuuuuaaggcaccuggagcugauuuucauguaaaguaugaguaggauuccuguuuaauuuuuuuuuaaaaauauggauaaccaauuaucucaacagcauuuaguaagaaguucauucuuuugucauugaucugcaauaccugccugucagcuguauuagucauuuuaagaaaauagcuuuuggcuguggcucucuuuaucauguguuugguuucucuuaaauuacauucuguguuuguguuuauucuggcuuugaacuucuuauuguauguuuguuuucucucuucuguuguuucuguucuuuaguuuauucuucucuacuuuuuugaggguuauucuguucuuuuaacuucccaaguuguaugcugaguucauauuuagcuuuuguuuuuuucugaaauaagcaaugaagucuauaaaauucccuuauaaguauuaauuuagccauguuucacaaggauucuuucuuucuuuguuacuuuuucucucuuuuuucuuuauuguuaaaacguauuauuucuuuuuugauccauuagauauauagaagcguuucuuaagguuuucgguaucuuuuuguacugccuucucaauuaauuguauuuuggacaaagacuaucacguauacgauacccgcugauaauagauuuuuuugguuugaacaguugggugccauugacugaggugcauaaauauggagguggagagaggagcgagaacacuguuggagauaauaacuuugugaugccuaugagaguacuauuaauagcagggaggucaggugggcaguuggacuagaucuguauauaaauuuuuagaaauguaagacagagucaauauccuugaauacauuucuguaauuaggaauaauuuuuuaguugcagaagacccugcaaaaucucuuacagagauaucuacagacuuugaccguucuucaccaccacuccagccuccuccugugaacucacugaccaccgagaacagauuccacucuuuaccauucagucucaccaagaugcccaauaccaauggaaguauuggccacaguccacuuucucugucagcccagucuguaauggaagagcuaaacacugcacccguccaagagaguccacccuuggccaugccuccugggaacucacauggucuagaagugggcucauuggcugaaguuaaggagaacccuccuuucuaugggguaauccguuggaucggucagccaccaggacugaaugaagugcucgcuggacuggaacugguaauuuaacuugacccaaaaauuucaauuuuuuucucugugagguuuugugcagauuucgcccuauuauaugcuuuuugacaaacuguuauauuugucagaaaagcuaucacugcagaauaauuuucucaccauguuuucugacuucccuuugccgccccugaagcuugcgacccacuuguccuaauguuaguugauuuauguucaaggaaugaaaguugauuuuuaggccaaucgauuuaggcuccuuauauuaaacagaauuuaguaaaucaagcaaauuugccaucagcuuuucucuuucuucuucagccccuuccccuggucaguucuaauaauuauaucacuggcuuuaaaguuaaucaccauuuuuagagaucuuuugagaccuuugcuagagggaaagguuuucccuuuagagaucaggagaacauaucauuugauauuuuguaaucaggaaaggagaaguugaguauguuuaggauuuauuuagagauggggucucacucugucacccagacuggagugcaguagcacggucagggcucacugcagccucgaccuccugggcucaagcuauucuccugccucagucaccugaguagcuggaauuacagacauguaccaucaugcuugguaauuuuuuguauuuuuaguagagacaggguuuugccauguugcccaggcuggucucaaacuccuggacucaagugaucugcccgccuuggccuccuaaagugcuaggauuaugggcaugagccaccacaccuggccaauuuaaauauauuucuuuuuuuuuuuuucuuguuuguuuccaugcuagugaauacuaucuuauggggcaugguggggaggcaagaaugaggguuaaaauaaauagccuucuccuucccugccuguuuuaaugcuuguagaaauggugcgggaaagcccguuuaaccaggggagguugaagcauauauucugaaaggaaauacaagaaggacuucaugcuggauuaaggaagucacuucuuaaaucaguagcugugggcugaagcacugauuacucaacuccuuuuucuugaugagguucucaguacaggugcgaagagggaguggugagaaaggguauacuagaaacaggucuuagaaaccuuaguucuuuguauacuaucucuguaaggcacgguauaaugcauauugaagcauuucuuuuucaggaagaugagugugcaggcuguacggauggaaccuucagaggcacucgguauuucaccugugcccugaagaaggcgcuguuugugaaacugaagagcugcaggccugacucuagguuugcaucauugcagccgguuuccaaucagauugagcgcuguaacucuuuagguauuuggaugcuuuuuguuuacuuaacaaccuggaaugacucuaauucuaaucucauaucauguuauauuaggugauggugacaguguuuuaauauauuucuugccaacgcucauuaagcuuuaaaucaguaaaaauguugcaugguguauaagaaaguuguuuuaagaggggacaucuuaaaaaaguauuaggacgugcguuugggacuuauaaagugaauaauagugugguuuguuuuucucuuccuguugaugacagacauuuaguuuucagcaauacuagugguagaaauugaaauguaaccuucuuuuuuuuuuuuacugacuucccucacagugucuuguuuacagcagugaguguaucuuacaaagaaaucagcauuuuaguguaagaaguagauuucaacugauugcuggaggacagcucuccucaucauguguaauugguggcaguuuccuggugcuguuccuuuccacuucuacauaauaguggaaaagcaucuuggggcuucagcaggugcaaacaggaaagccaucuuuaugaaaaacacucuuauuauguugaaauaguacuuuggaauuuucauuuucuuuucaaacuugaaagugaagcaacuucagauaaauagugaaauauuugggaaacauauuuuacuugacagaugcuuuuuacacauaauacucuaaaguguguuuuuaaaucuuggaggaaaugaaguugaaaaugaacaauagcaauuuuuauaagccaagucaaauagcaguuaaccaaagccuacuuuccacuuaaagaaaaaauuuugcaucaaaauacaaaaacauuuuaaaaugaaaaaauauuuaugggaauacauauuguaauaguuuaaaagaauucuuuucauuuacuuuuuuuaaaaaaaucuuuucagcauuuggaggcuacuuaagugaaguaguagaagaaaauacuccaccaaaaauggaaaaagaaggcuuggagauaaugauugggaagaagaaaggcauccagggucauuacaauucuuguuacuuagacucaaccuuauucugguaaguuuaaaaagaaugcaauagguauagauagugccaugaggcagggacacauaccggugugugugugugugugcgugugagugugugugaaagaaacugccaucugccucugaguagagaaacuggaugacugugggucaggauugaaagggagauuugcuuuuuaugacauacuccuuuuaagcuuuugaauguugucucauguuucuguguccagaaaggugaaugauauugguacaauggaauagauauacagaggguaucugggaaaucuuugugcaugucucaaacaacauaacuugcaguaaagccauuggcuguuaugugcuguauuucuuuuaguagguaaaggcagucauaaaacuacugucuuuaaaaaaacgauuuucaguagcagcacugcugcccucauauaugcaauuuuuuccaaaguggaacaacuuaagauuuuuuuuuuuuuuuuuuuuuuuuuugagacagagucucacucugucccccaggcuggaaugcagcggcacaaucugggcucauugcaaccucugccucccagguucaagcgauucucuugacucagccuccugaguagcugggauuacaggugugaaccaccacuucuggcuaacuuucuuuuuuguauuuucaguagagacggggguuucaccacguuggccaggcuggucucgaacgucucaccucaaaugaucuacccgccuuggccucccaaagugcuugggauuacgggcaugagccaccacgcccagccuuaacauugcaaggaucuuuaagcucuggaaauugaaccaagaaucuuuaggcucugaggauuguagacugggcuaaauugagaguagccugccaguucuguagccauaugauaagaauuaggaaguuaauaugggauguuaacauuuuuaaaguaggaagaagaauaaaguggcggccauuuuauuugcagaauacuuugacaaaaacaaaccuuguagcauugauauaauauucuuuagauuuccugauaaaaaucuauauuagcuaaauuuucuuuuucuuugauaacagcaaguuacugcugucacucguuuauuuuuuugagaaggagucucgcugugucgcccaggcuggaaugcagugacgugaucucggcucacuggaaccuccaccucccggguucaagcgauucuccuaucucagccucccaaguagcugggacuucaggugcacuccaucaugccuggcuaauuuuuguauuuuuaguagagacgggguuucaccauauuggucaggcuggucucaaacuccugaccucaggugauucacccgucucggccucccaaaguucugggauugcaggcaugagccaccgcaccuggccuguuagucacucauaagugauuuuagcauuuaaagaaauuuauuaauguaauagaucuuugcaaaggggcauggggagagggaaguggggcacugaauagugcuugccucgggaagucguuuccaaaugcuguccucuguugucuguuuguaauuugacugauauuuguagucucucuaucaacuuuugcaaagaaguuuucuuucuuaauauucuguuggcacguuguuauccuuuaacacugccaaucugccguuugcuuucucaguauuauugguguuguccuuaacauggaaggaucuguagguccugaugauugaaccauggguaucuucacagggguccugguaccuguguuaaugaaaaacacaaauuguuauguuauuuguucuccagacuuuacuuauuuuccucuucuaauucuguuaaaaaucuguuucuugaaaaauauguuuacagcaugaagaaaauuauccuuuuucuuuugcagcuuauuugcuuuuaguucuguucuggacacuguguuacuuagacccaaagaaaagaacgauguagaauauuauagugaaacccaagagcuacugaggacagaaauuguuaauccucugagaauguaaguagaaaacaaauugcuauuuugccuuuacaugguguucuauuugcuguuuucugguauaguaauuaauuuauaccuugucuucauguaauaagagaugggugaaaauuaguucuuaugguaaaauauuacguuuuuaaaccuuugguccuuguacuuuuuugcuuauuuaauuucuuaaauguggccaagguguagaacauagcauauuccaugaaaugauuuaaccuauuuugcuagaguaaacuauaauuuagcaauugcaguauguuuaggaaagcuaauacauaauacuuaggauucuuaucuuuugaaauaguuuauuccaacacuucugcuacaaguaaucaugcuuauuaguuaaauugguguagucuagcuucuuaaaucugaaagaaaaggagaaagggaaauucuuuauagaauagcuaguguuuaauacuuuggacuagcaacagaugagauguauuuuaguaccauauuuuuugguuaaaggaauauauuuggccucuuuccaccugccuuaaaaaggugauucuuuuuccauuuccuacuuuaggaauuauaaauaugucuuuuuauggccacaggaagcaauuuguaaugguacaagcacaagugacaggagauaucuaguaaagacuuugaauaagugguaguagugauaugugauaaugucacauuauaaaauuuaaacuaugaagaauuaggaccauagaucauaaaacaaauuuguucauucaggaauauagagagaaagugauuuauuuaaaguccauauuaagauaaauuugaauccuuuuauauacuguucuuauuuaucaauuaaaguaaaaaauaguuugauaucaaauuugaaccaaaaaagcagaauacucaaauacaaugaggauuccaaauuaucugcuauaucacaugacuaggaaaguaaauuauaagagaauaaauuuccucacuuauaucuuuugcuuucuuuaaauucuguaaugauuucucuaaugaucuuacucuuuaagauaauugugaaucuugauuuucacaucaacuauuuugucuuaugcaaauuuuuaaacauacgauuuuuuucccccaaguaauugauacuggaacaagacaggucaaacccgaaacucuaaggcauguuaacaccuccuuccuagaagagaggaagaauaaacauucuuuggauccuauuguucagccaguuaagaaucauaguuaaucacacuuucuuacccuguccacgguaagaaacuggucagaugcccuguugugaucaggauucccugugucuguagcauucauaucuguauauagcugacugguuuuauuuggugcugaaaucucugcuuuucuucagagacccugucuuuuuaaccuuacucauuuuguauucccaguggcugacagguuacguuacuauguaagugguagauucucagucuguauugguugcaggaaacuaaugagugaaugaauaguauaaaaaguggauauaaaauuagcuaguucugacuuguccuuaguaaacuuaugguagccgccaaguucuccucugaagccauuuuuagaauuacaaauuuaaagugauauuaaacugauugaaugugucuugcauucagacaaagaagagagaaaaugucaucauuaugccaauugguuugauugcagauuuuagauuuucaguuucuuauaaauucccuuucccauuucccuugguggcuguuucacacuucaguauuaaaaggauauucucucucaaaauuguauauucugcuuuauaaaguaaaugcuuuaauuucccaagcaaauauuauuuaaaaaaucagucacagcaaaccuaaaaauuuuuuaucuuaguguaugacaguuacuuguagagcauauaauagugucuaggauaauucugguucuagaucuuuaauuuugcaaacuucaagaagaagcuuaucauuguuuucuucaaaaauaauugucuaaccuauugauuuaugacauacuggaguuguauaagaaauguguuggccaggugugguggcgcacaccuguaaucccagcacuuugggaggccgaggugggcggaucacuugaggccaggaguucaagagcagccuggccaacauggugaaacccuguuucuacuaaaaauacaaaaauuagcuggaugugguggugcacgccuguaauuccagcuacuuugguggcugaggcaugagaaucucuugagccuggaaggcggagguugcagugagcugagaucgggccacugcacacuccagccugagugauagagugagacucuaucucaaaaaaaaaaaagaaaaaaagaaauaugugauuaagauguguuauauaauuuaauacaugccaauaucaauuaauaguuuuuuacuaacuuagauauggauaugugugugccacaaaaauuaugaaacugaggaaaauacuugaaaagguggaggcugcaucaggauuuaccucugaagaaaaaggugaccaucuuaacuuauaugcguuaaaaauaacugaagagcauauucacaugucaaaguauuagcugaaaugugugucuguguaguugggggguuuucuuuuaaauuagaaauuucuuuuuaugugauauaugguuagcuccucuuuuuguaaauucuuccucucuucuaaaagugauugaugauguggaauaaugaacuccuuuaagaagcuggcugguucuaguauauuaaaugcuuaaauaaaaaguccuuuccuuuccaccuagcaaugauauucucaguuguuucucucuuguggugcagaguugcauuggguuuucuacauuuucccacugagucuucccuguuguaaaagggaguuagaaagcugcuaacuaggauuaaguuuauagucagggaacaguguuauaaucucuuccuagcuaaugggcuuacucaaagauucaccaccugacuuugaauuugucagcagcauacuguaaacagcuguaauguucagaggcuugcaggaaaaaacagagcauacuucagauuguacuccauuuaccuuaaccccuccaaaggaaauaacagcuauuucauuaugugcaauguguuacacccuuucaaauguaauaaacucacaacaaaauugaaacauaauacuugauuauaacuuauuaaaugucuuuuauguuuuuccuuugucaggaaaacuugaaaacugugcuuuuaauugaaauaauauuggaugaaugaaacugaauucaguauuaaaauuugacuguuagaaaugaaaaauaaaaugauuuaaaaauuuugccugugacuuauuugauuuuuaaauuuucuccuagauccugaggaauucuugaauauucuguuucaucauauuuuaaggguagaaccuuugcuaaaaauaagguaaccuuuaaauuguucuagaagcauuggaaaaauagacaauucucauuucuacugccauuauucaacagacaugauuuccagaaugauuucuuaauauuguauuuguuuagggcucuuaauaggcuaggggaauaucaugcaaguuaauuuuauuuguuguccuugccacaguaccauaguuuacuugaagaucaaauccaauguaaauuuauacuacaauuuuuaacccuagcgauaaguauuauugcaaaucauuuucuuuugaaacuguauauauauuuucauaauuucaauuaaugaaccuuuuaagaaaaaauaucucauucuaacuuaaucagacacuucaagaagacuguuuucugucuacucaucacucaaaaaauuuagucuuaaauuagcuuuccuguuuuuaguuguauaacuuugucuccccuccccacccaccauguugaaugaaagccuuguuuaauguaguaaaguucuuaaugaaauguucuaaaugacugaacguuccagguaguuugaauguucucagucuaaacaauggaccuuuuuacauuuuagcuuggguuucucuguugagaaucuuaguaauauccuauacacuucccuaaaagcuaagcauagacgagcacucuuccucaucucugugucuuaaagugauauuguuugaugccacuguugaacugaugggugaggagaauagagggaggcuggguggugccauggcugugguuugauauuguuugggaaguucuuaugaaugaaaugagacugauacauaaccaucaagaguucauauuaucuguucaaagaugauaauagccauauguacaccuaaaaauccuagagaauggccuaaaaauuacuacaauuagcaaaauaauucauaauuugucuauguaaaauauccauggaaaaaucaauagcauuucuguauaccuucaagcaaauaugaaaaaguaauuuaauacuucaugaaaguauaaaauaccaagaaaucaauuuuauugagauagauuuuuuuuaaaagacuuauacagagcuaaaaggguuuugauuaauuagugagaaagauuacguucuggguaggacaauuaaauaauuuaaagaugauuacauaauaauuugcacacaagcaagaucuuaacauacuucaggaaaguggauuuagaguucucuacaaaaugaagugggaaaaaaucuugaagaaugcuuuuaaaauagauuucuauuauaagcuacgaaggcaaagcaauagacuuuaaaauagugugugauacuagcauaugauuagaaauauggaucaauggggccaaauagaaagcucagaaauagaauuaacuguauguagaauuucaguaucuuauaagucaacuuucaaacagaaaugggaaaggaaagauauguuuaauacaugauguaggaaaccuagaaggcacuuugggagaaaaaagucaauuugguuuuucauuuuaaagagauaaauuucagaugcuuaaaacaguuguuuucaucguuuuuacccuuuuucuagccuacacacuuauggaauguaauacacgcccaguaauaacauagguugaauacugagugauccucagaguggguagggagggaucagggcaucucugaauauaucucagagucugaaugccuugugggacuugaaagggcccugggaaguucuuacacccccugaaggguacacuguccccuucaccccugcaaacaaccucuucauauugagaaucacuuuuuaaagauuauaaauauucuaaguuggcucuuuuucaagaguaauucuuccccuccacuagcauuucauuuugacagacagagucagcagaugcaacaaauaggaggauaaguaccuuaaaaaaaaucuaaaauaauuaaauagucuaaaagagacuauaagauguucuuaaaugauugaagagacaaaagaacuagaugacaaugaaagguaaaacagauuugauaaacagaaucaaauaaccaaagacagaaucuccagaaauagaaaccauaucaugauguuaccucauugaugcagugugcacagcugaagagagaauugcucauuuggaagacagagcugaggaaaguacccagaauguugcacaaagggauaaagaguuagaaaacaagaaagagaggauaauagacauggaauauggauucuaacuggaguuccagaaggagauacuagagagaauagggaaaaggcaauguuucaacagauaauagcugaauaaauuuuagaauuuuugauagacugaaauucuaagaauaaaaauauucagaauuucugagcaggaagaaccaggacuaaauuaccauucagagacuuacuauaggauguacuucaguaaaacaaaacugaguuuagaauaaaggagugggaugcaagaaacaagggaaagucaagaaauuaguaaauugucuucuccauccucauuucugccuucuuucccucaguguuugcaaugcagugguccguucaaccaccagcccuccuccccugcugccauuauuaugauuacaacuacuuaccucuacuacuuccugguuucuuauuuuccucucuuauuuuuuuuuuccuguaaacuguuaauuuucuaugcuuuuuggcuuucacagaaaaauucuggucuuuugucauagucaucaacaacugauuaaaacauugguauaucauagccuucagguuuuuugauuaucaucuguuuguauuuguugugggucuccagaaucuccuguuuuguuaucaauuaaauuuuguuuauuuggggauauaaguugcuuugggaagcugagaauuuuugcaggcugaucucugaauagcugaguuuuuuuuuuuuaagugaaaacuauguuaauauuuucuccuaaaaaucuuaaaaucuagauauaaguuuagauguaaauagucuaacuuuauauccagaaauucugcugaaaagguaaauaguaaacuuaaggauuauuaguccuucugguagaguuaaagacuaauggcaugcuauaguaaaauauuuaggaggaaagaugcucaaaauauaagaguaacacugugauuggcauaugguaggugcuuacuugguauuuguugaauaaaugagugacuaucagacagcaugcuuuagcagaaagaaugguaagcagugguuagggccccuagauucuuuacccagcucugcuuuugacuugcugagaagucauucuccuucccuagaucucagcgccuucauuuuagaaaugaaaaguucgaucuagaaggucugcuaagggucugucacauccagcauauaauaauuuauuuucaggcauuaaauacaguuugcugcuuucuagauuugggcagugaaguugcacuaagugauuuaccuuuugguuaguucuguucacacagugcuucuugauugagauuauuauuccauuauuuuuuuccuaaucacuaggagaacuuuccagucuaaaaacuaagcaaaauaaaucauuuauaaggucuugugccugagcacauuuaauuauuuuauccaaaucauuuauuucucucuguuguucugacuauccaaagcuacaccaucaauuuuaugguuuuucuguucucaaauacugcugggacaacuuaacauuuugauuuaagcauuugauaaauagguuguauguauuuuuuucucugcguguuuuuagaucagcaggucaaaagguacaagauuguuacuucuaucaaauuuuuauggaaaaaaaugagaaaguuggcguucccacaauucagcaguuguuagaauggucuuuuaucaacaguaaccugaaauuugcagagguuagugauacucaccugugguauuuuaugugaaagucugugggagucuuaagacuauugguaguuucaguaucuauugauuuuaacuagcugagaaaaguuugaaacacaaacuguuaagaaacacaaauuuuaaaaaguaugcaguguuucaacuuugccuuuacagaaaaugucuuagaauuaagauugaauuuuuuggauuucugcugccaaagaaaacaccaagcuaaucugcguaacuugaaaacuuuuagguaguuuaaagcaaaaggagacuuacguuuuuuaaaaugccauuuuaugcaagcauauuauccaaauacaucaaaauauaauguuuacuuccccccuucauuaagagacaaaaugucaauaaauucauuuauauuugcuaaugaaccagugauagaaauuauuuuucuuuuauuguccaagaaucucaguaauuuuaauaguauaugcuugugguuuauuuugauuguauucauuucugaagucauuuuugguaaaaccuuaacagccacaguuauuuauuuguugaaauauaaugaguaguauccuucugugaugacauuuucuguauuauauuugcaaaaacaaucuguccaaaaccuuuaauaaauauaaacccaaauaaaaugccaugauuuuauuugagacucaagauuauugaacucugugaccucuaggugcuggugugccccugcgaucaugagccacuugaagacuuguggcuuauugguguccucuguccacagcccauggucacguguggauccuguuucauaggacaccaauauuaaggcagaacuguuuuguuugacagccaugacuauuuugguuucauagggaaaaguguuuuuuuuaacacuuugauucuaaaaauaucugucuuuuuuauaggcaccaucaugucugauuauucagaugccucgauuuggaaaagacuuuaaacuauuuaaaaaaauuuuuccuucucuggaauuaaauauaacagauuuacuugaagacaguaaguaugagauuuuuuuaguuuguuuuguugguuuuguggaaauugucagauaauucucaucaguuguggguuagacucuaacuggacacaguauuucccaaggcaauucaguaucugaagagccuggaaauaugaaaccagucauuuuauuucuaggaauuuauucugagaaaacacaaaugaaaauaaauauuugauaugcaaauauacuuauuauuauaugauuaagaaauuagaaacaacuugaauguuaaccagaggagaaugguuaaaugaguguguaucuaacaauuaaacuacugccauuaaaauucaugguuuugaagaccaauguguaugaaauggucaugauguaauauuaaguggaaagguaaguacguugauauauucuacaaaaggagccauauacacacacacacacacacacacacacacacacaugcauauauaccuauguaaauauucaguaugaaauuauuagagaaaauucauaaucauauugacagugguuaucuucugccaacuaaaauuguagaugcuuuuaguuuucuccauuauacuuucuuguaucuuugaauuuucaucaauggguauuuuauaaugaagggaaaaauacucuaggagacacuauuuagaaaaacuauuugguccaaaaaaauguuuuuaaagauauuucaaauacuaacugagagcuuaagcagauggaagagaaagagacuuuuuugaagccaugaacauuguccuuuuuaaagccuaacuuuucuuuacaucuucuucaugaaagaaugcauuuuuuuuaaaguccucuuaacuucccuuccccuucucacauuucagcucccagacagugccggauauguggagggcuugcaauguaugaguguagagaaugcuacgacgauccggacaucucagcuggaaaaaucaagcaguuuuguaaaaccugcaacacucaagugagcuucccuucacuuaauggauaaacuuuuguugaacaguaacuuauuuauaguugaaaacacaaugcucguuuuggaaaguuuuuuaaaaucauaauuaacgguuaaaaauucacaauaaaaugguauugcuuuugccuuuucuguuuacuugagagcuguuggugaaguacuugauugcuauaagggauguauuuaguaagaguaaggaagcccauucacuugacacauugaguuucucucauuaaugacauuuuuuuuuuuuuuuuuuugagacugagagacugagagagacuaaugcccaggcuggagugcaguggcacgaucucggcccacugcaaccuccgccuccgggauuuaaaugauucuccugccucagccucccgaguagcugggacugcaggcgccugccaccacgcccagcuaauuuuuguauuuuuaacagagacaggguuucaccaucuugaucaggcuggucuugaacuccugaccucgugauccaccagccucggccuaaugacauucuuuucaugguccauuuuagguccaccuucauccgaagaggcugaaucauaaauauaacccagugucacuucccaaagacuuacccgacugggacuggagacacggcugcaucccuugccagaauauggaguuauuugcuguucucugcauagaaacaagccacuauguugcuuuugugaaguaugggaaggacgauucugccuggcucuucuuugacagcauggccgaucgggaugguacugaaaacgccuuucuucugcauguggcacaggguucugguuuguagugggacaguuuguagugggaucgccuguucugagugauauuuucugagaaaauccuuucaggauuauucuggugacaacagucuuauaucuuggauugcauuaacaaccuugcuagcugaacuaaggaauaauaugcuguguuuuuuuuuuuccuuuuuugagauggagucucacucugucacccaggcuggagugcagcagcgugaucuuggcucauugcaaccuccaccucucagguucaagcaauccucccaccucagccuccugaguagcugggacuacacgcauaugccaccaugccuggcuaauuuuuguauuuuuaguagagaugggcuucugccauguugcccaagcuggucucaaauuccuggccucaagugauuaacccuccuuuuccucucgaugugcugggauuacaagaggagccagugcacccagccucauauugugauauuuugacaugcauaugcucuuuuuuuaaaaaaaagaauccuaaaauucuuauuucagcccugagggaucuuauuuccagcuucgcugucuucuuucaggccccucucauuuuuguaggagccacgguagcuguuuauugagcaccauuaagucauucuaccuaaauccuggcaagauggggauuauuccuguuuuucuguuauuaaagcugagguuuaaggggcuugagguauuguaguuuguguuuaacucagucuuucugaucucagugcauauguuuuuuuguacuaaaccauguuaucuuccaauugccaaaagcugagagcagaaguaaacauccuuuucagaaaaguaaagccucuucugcauguaguaucuuucucccugaaguggggaauaggcugcaguugccaggccacuuucuaggaugcuuaaucauuauuuaacuaaugcuuaaugaaugccaggcaggauaguggguuguagguaagaaauguuuguuaaagcagcccugccucuaccuauaaggaguuugcagguuaagaccaggccugggcaagguugugaggugugacucucauguuccuccauucuuauacccuauuuuuccuuuagcugcucucucagauccagcccccacggccuucugguguggcccuccaguagccuaagacauucccuguggcagccucuugaacagaggcccaggcccuagaucaagaguucuccaccuuuucucaguucucugaugcuugagggauacaucccagccccaucuguagaugugcccccaacccaguuaacauuugcacuaaacagcguaacacaacagcauagguuuggaaaagccacugagguaacccagaggagccuuuccuggaaucucugaaaucacaccccagagcaccuucaucagggccuggugaugugucaaacaaacuguauuagaguugcguaaggauguguuuaaaguguagggagcuauaauagcguucauuugacuagaucuauuccaaauuggacagucuuauggugaagugugcuggguggcuugugucugggaggaaaugaaaugugaggaacagagugucgucuacauauguauugauaauaugauucagagagaagucuggaaaguagguugggggcuuaccucagaauucguguccuuuuaccagguuuauucacuguuggccccagaauccuuucagaaaccaagaaaugagaauaugucaaggguuaaaggaggcuuucacuuccagaaaucagaaguaaaauaaaggcuuuuagagccugaaauuagcuuuuuggaaaugauaggauuauaaaaucacuggcaaaaggguuuagaacuugacugcccuauaaagaguucuuccucugugccauagguggucagaauggcuucaacauuccucaagucaccccaugcccagaaguaggagaguacuugaagaugucucuggaagaccugcauuccuuggacuccaggagaauccaaggcugugcacgaagacugcuuugugaugcauauaugugcauguaccagaguccaacaaugaguuuguacaaauaacuggggucaucgggaaaggcaaagaaacugaaggcagaguccuaacguugcaucuuauucgagcuggcaguucuguucacguccauugccggcaauggaugucuuuguggugaugauccuucagaaaaggaugccucuguuuaaaaacaaauugcuuuugugucccugaaguauuuaauaagaagcauuuugcacucuagaaaguauguuuguguugguuuuuuaagaagucuaaaugaaguuauuaauaccugaagcuuuaaguuaagugcauugaucauaugauauuuuuggaagcauacaauuuuaauuguggaaguuuaaagccucuuuuaguccauugagaauguaaauaaaugugucuucuuuauggaccaaggauaugaaaucauuuuucuuuuguagcuaacgguugccuugaggaagaaauaauuugguuuuauuaagagucuacucucaauccaguuauuagagauguacugaguuugauuuguuaauccuuucuauauacugcugaucuugcaugucuacaaucugcucaguuuuucuguguuucugcaauaguggucagaaaaauacuuaaauucccuuaaugguguuguuuucuauuuguucugguuuugagauaaaugagugauucuguccccaaauguccauuuuugaagugauuuuccuggaggauuaggguauuuagcaguugaagcucuucauucauaguaguuacugucagcuaacagguuuuuuaaggcuuuuaacuauuaauauuuuauggaauggggcaaaguaaauugaugaaagaauuggagugauaauaguccuuuacaaacauacaguccauaagaaaaugaauuuggcauauagaauuauuacaauuuccugggagagauggauauuuaaaccucuauuauuuuagacaagacugucuagaacuuaaguuugaucugucagccaguacucccauuaaauucaguguaguuucacuugauagaaucagauauguuaucgaaauguuagcagcagcuucauccuccuucugauuaaaguaaguagaaaugggauguuuuguuuaauaacagccauaguguguguuuagaccacagcggauguuguagaccaggaccauagaugauacaugucagugcuguggaaugugcauucucugaguguuguuuugugguaucauugucuuuccugaaugacuuucuaacugugcagaaaggcagaaaagucaucauauguauaugucauaugacuuuauaaaauauuuaaugugacaaaaaguggaaagaaucuuuacaaacccugcaauuacuuuuuuaaaggcacuuuuacucuuugguuuuaucauuccauuuugcuaauauuuacuagcuuuauaaauuacaguaagguacaaaaacucaucuuguaauauuuucauuuuugaagugaaaaaguacauauauuuugcacaagguuuuauacugcuaagugcuugguugggguggugagaugaugauuagaucaggggugaggcugagagacucuggguuuagggcuagcccugccuccaucucccuuggguaaaaugaagggugugggguaaaagaugcauaaggccuuuucuagcucugacagccuagaaguccaaucacccuguaauaaauauguguugaaugaagaaaugggugaaugagcuugucaaugugauuuuaaaaaauugacuaccuggaggaaugauuaggaaucuaaaugaagccagcccucgguaucugcagguuucucauccauggauucaaccaacugcaaauggaaaauacgauuuuuuuuaaaaaaaggaugguuacauccguauugaacauguacagacuuuuuucuugucauuauucucugaacaauacaagaacucuuuauguagcauuuacauuuauuagguauuauaaguaaucuagagauuauuuaauuaaaauauacaggaggaugugugucaguuauaugcaaauucuguaccauuuuguaucagggaauugagcaucuucagauguugguaucugcagggauccuggaaccaaaccccugcagauacuaagggcugacgaucuagguaagacuggauuuaacaguuggaaaaaaaaaaaaaaaaggagagagaagacaguuccuuuccuguagaaauuaaaacaaaauacaaauugaggaagcucugcuacccaggcugucaugguagagaacuugaagaagaccuguuuggauggacaccugguuucaaaagucagguguggagacuguuaaaugggagggccucauccauaaaugauuucuggcaacgucuucuucagguggagcuugacgucuuuuuaauguuacuuggggagggagugcucauuaagggaugccagggccagcucuggugguuccuggggaggcugcguccuucccugcuucugcaugucaugaggcagcaggaagguuuccccugcaccugucuguccuggcucccucuggguagcccccuacuguucugugcuucagcacagccugguuugucaagaggcacauaguuggggcugggcugcauggcacaggggcuuaugugccugcugguuauuuaauuuucagccuuaaguuuucuuuaauauuuuccuguuggcuauuuaaagguuuugguuaucuuuuauuccuuaucuacaaucaagaugacaauguaauugaauuaucuuauuuauaacacgguucgugauucaugauucaugauuacaaguagaaaauaugucauguuccucaccuccaaauaaauaugugugugucuguguguguguauauauguauguggcggagagggagagaguggggaaggagagcaguguuaucauacauagagaggcuaaaugugucccaucccucacugucagcuuuauaaaggaguuugacuccauccacagaagaauguuuuauaagacuaggaaaacacguugaaaacuaggauaaacagcaacaaaaaucaacuaaauauguuguuacuguugcuaaggauuuucuccuuagaauaauuuaggauuuuuaaaaauuucuguuugccaaaugcuguagauaaauggccagauucuuccuaucccuaggauuccuuuauuauuuuuuuucacagauuuugagaacaagggggagagauaguauggaagauuaagauuccauuaaucuuauagaacuguguugucacccaaauuccugcuuguuugaacauggcaucuucauagauucaggauucacuacccucuauagcuggaucuugaaaauuaucuggccagauaauuuugcaucugcuuggaugauuguagacugagaugugaguggaggauaaaguauuagacuuuugcugaguaacugccaaccaagaaguauuuaucggacacuuacuaggugccuaggauuguaucagagggaauaugaaaugugucccugcccuaccuaguuuuaacgacagaauaucuauuaaaggcuacuuagcugaaggguaagggugacaggucuaggggaagcuuugggagguggugugcugugacagaaaaaguggcagaguagggacgagagaccugcauucuagcccuguuucugucacuugcucuguacacuuagacaacagcuugaccucuugagcuuuaguuuccuccucugcauaaugagaggguuagacuacugaauuguaugggaaaaaaauacaaauuccuggguccuaggccaugccugcugaauccgacuguucaggaagaggccuaggaaaucugugagggaauccccaggggaaucucgugaccagccaggugugaaaucugcuaacuggaagaucucaaagcuuccuucacuuuuugugauuuuguggucauguaacguuacuguauuauucuacguaaauguggguacuuggauguuuaucauacuguuucucuguguuuacauacuaauuuguguaagaaaugcauuuuagucuguguaccucaaccugcuguuuguuuccuagagguguuaguagucuuuaaauacaaguaagacuuaagaggauauuugauguuauuuaccuggauauuuucuuccccuuuuauuuauuuagaggaaauugagauucuaggagccaaaaaaaugaaaacaaaauucuaaggcaaaguuaaagaaaaaaauuacauuauuucuuaccauuugcuacuuuauaaugaaaauuuaaaaauuauaugggaagauuuuucucugggauaacaaauccuugucauaaaguaagaggucuuuuuaaaguagguaggcuauaaggccuguaauuuaaaauaauacuccuuucucuaggguuuggugcaauucuccauuaaugaagauaacauuugaauuccccaaagcaggugaggagucggggaggagaaagcgauguuaaaaugaaaacucacugcaaaagaggaggcagaggaagaaggaauguaaaccccuuaaagcagauguguguggggccuuaugaagaccaggauucugcgggugucaggggauugccccucuugacagagacuaggguuuuagacugaggcuuccugcaggguguucgcauugcccuucuccguuccccuucagaccuuucuggggagaagaggugggaggaggggagaaagacuguucaucuuauucugaauccuggagcagcugaagguuuucucuugagucaggaugcagugguaaugcauuaaccagcaaguguggccaaggauaaugaaaaagugggaaaggaagguccuccuccucccugauuguagcauccagcagucucuguagccagguuacucaagaaccacauuugauuuccuggcccuuugccuuggcagugauggcauuuuuauuucacuguguuuuaaagucuucauuuauuuuuauaacauggguuagggagaagggccacaaauggagggauuguccuuucaagcaccacagcuucagauaaaauuaguacuuucaaauauuguccacuuuaacuuaaaaaauucuagagggauuauauuggagacucaacugcccuugguuuuaguuuauaaaauggccuaguacuguggaauuuuaauuuuagaaagucuuagcaucagaucauaaacauucauuaaaagaacucacaucccaucugaaacuucccaggggaguugggauucuuaguagauugguagaaaggggcucauuuucuacugcauuucccauuuuugguaucuuguucagcauguuuuauuuuuauuucuugucugcagaacauccuauauuuaugagaacauucuuuaagaagaccaccacauagaauaccccuuccuaucagcucgcucugauuuagccuuaauuuuguuaaauuuuuuagagaugaaugaagugcugcuguggaaagaaauguacauauacuauuucuguaucauuaaaauuacauuuuuaugguuccu

SEQ ID NO: 15715 - RNA, 17017 nt, Homo sapiens
guuuuaucuguugcaaaaaaaauguauuugauuacuugaguaaaauuacaguaucucuguuguuaguaaguauuaaauguuaaagaaauuggacccccccuuuccuuucaacuuuccaagaaagugcauguaacaguccaauuuuuuucuuccauaccuaagacaaaauaaacaaacacuauaccugcucucuugaucaagaagaagcauuugcucuuguaaggaacauauguacauuugaaugaaagugauauuucuuauuguauauacaagagcaucuacauuuucuccacugaagguuguucaagaugcuauacuuagcagcauugugaaauuccagcacacauuuucuaucgugaauauaccuacaaggcaaaauguuacgucucaguuucaacuaccaaaacaacgcuuguuuucuuuuucucuaaagaauucugcgugcuuauuacuguacagaaacuuauuaacauugaagacgacucaaguaaaaagcacaauacaaauagcaguucaaaauggaaaugguuaaaucgacaaaaaaaaagguugaauuuuagaauaaaaauuaaaaaaccaaaccuuucaaagaaccacacuguucagucuguacuuucaguccuuuccuuaaaucuguuuugaaagauuagacaauguguuugcugauaaaauuuuccagcaggaucaaaguguacauguauauacagacuuuauuagagaucuaaugcaucacugaggcauugcaucaacaccagauucauauuaaacuggauauagaaaauaaguuaaugccagauuacaacugccuagcagggcaacuugcaauugccauaaauguuacagcaaguuuacagcacucuagucaauuaguauuuaguccaaaauacagaagaccaaaguuaacgcuugcauucuguuugcaaagcaagguuauaucgcuaauaaauaagcuuucuuagaacucuaaaguugaacaagguacaaaagaaugucuucauaauguuguaguucauagaucuggggaacagaaggaaggggcggggcgggguggggggcaaggaguaggaggccaccauaggucgcauucugaacaggaaugaaugcuaugucuccagcccgagcugcuuuaacucgugacgaucuccuugcuguccuccacgaagcgggugaagcggaaguugguuccguucucacugcuugccauuuucuccaggccggccaggggagcauugggcucugaguucuggagccucuccagguuucccgucagcccacuaacaggugagcuguucccacugccgaggcuuccaggaauuggagggaugccaccguucugaaugacggagaucucguuggccuucaucgccagcccguuggagagcgcugcugcauacugauuccagaagcuggaaggauccccacuuccugaucuugccgccaaauccuucuggaacauuucugggaacuugacgggauugccuccuagaaaugucauggggccauccacagagagccgccgaccccgucgugcaggggugcuauuccacaugugagugcccauguguaccugagauauggggagggcaggcagagagacagagagagagagagaaaaaaaagaggagggggagagaagcuuaauagcugaaucugucucaacucauaucccaaauguccacaaagcaaguggccuaaaugucuauucucaucaugugacagacagugaaggcaacaggaaccauccauuccuccugucuaguaauaacguguucacucucugcagcccugggcugucuccccucuuccaaggcaaggaugccuuacuuacucuuuuuuuauuaaccauauuuagcuuauaauggccucaagcaagccaggcaguggcggauagcuccuuucaggguuagaauuguuagguccacucucauugcaaugguaaguauuguaucugacacccuuuacccuauaaauguccuuuucagauggggagaagguaucccucccugauugcccauuggagggccugcguauggagagaaaagccagaaaguaauuauucaucucacauuacugggagcaaucuccagagaaauacucugucaacagaaaaauguacacacuaagagcacucaacuguugcucuagaacuuaagcauauuugcuuuauuuccaacacauaucaguaggaaaugcuguauaaucaauuaucauaauacccauuagcagagcagugacguuauuguuuuuagacaaacaaaccaugcuggacugcauaguuaugaaaaauagauacauacgccgagaacccuaauuauuaagugauacgggcagcacacaggccacguggaggucuuuaaucaauaccccauggcaacgcuaggcuuucuugguagguaaagcaauucauuuggugcacuuagcgagacaacagagagaggccgcugcuucgcuuagguaccaaauuauucaaugugcacugacauucagugagcugcagcuugcccuugucccugccaugauccugacccucccaggcacccucucccccauuucucccccgucaaccaugugcagcagguucccuugcaagagcucucucccugaauaucugggcugaugacucugggggcaugcauuauagauaaucaauggcagugggacaggguugauggagcagguauggugcagagagagcaagguaccuuaagauugccuuuagucgugaaagcucuuccacaaauagugcaagcaaaggguuucucuccagugugaguucucucgugaaucugcagggcacucgaugaggagaagguuuugccacauguguugcaguagugcugcuugggaguucuccugggcagagcagggagcagaacuggggauguggcagaggaagacagaggcccagacgggacgugacugguggggguguccuuacuguccugaggagaaacaugcacgaagccguugaccucugucuugaugagagaugacaacgaguuggcgggaaucaccgcugaguucugauuggggccaagguuggaacugggcucaaagagcugggauggcagaucucgcaucugaugugucaacaugugcugcuucaaauuacccuuuguggaaaagccacgauugcaaacugugcaaauaaauggucucucuuugguaugacuucuauagugaauguccaaggcacucugacaagcaaauguuuugccacaaaugucacaagcaguguuuuuaaauuuaccccggucucuaaaagggaagaggauccccaaagaaucuucuuugaugauuuucucugcgugacuagaugucaaauccaaagccccaccauucacuggggugggagacaaaccauuggcaaacucgcuugggaccgcucucugugguuucuccucaaugcugggugacuuguggaacuccugcgugcuguuggacggggacagagccugcauggaagagguagacucugagauggcugggcugccagcacuuuggcuuuccaugucaccacccacugaggaugaaucauuggucaggacaucccccucgauggacccauucuccacugacuucaggcuggccuguagcugcucugccaggccagcauugaucaucuucaucugauuuuccaaagcagcgaugcucgacaucucgaggggcaaaggcgaagaggauaagcugucuugggaggcgucugcagacuuagguguaucagggaugcugcccucaggacagucuuccauguuuucaucagagaaguugucuaggucaucaaaauuuuucucaucaaaggaaccugugucagacuccauggacucagaguagcugucggggacugggguguuggggaucuggccucccauaugcauucggaugugcugcugcaggaccacagcguucgugaacuucuucuggcagauggggcaggaaugcuggacucugagcgggggcauagcacgauggacacuguaguggguuuuaagauucccuuucguggugaaagcccggccacagaucuuacacuuaaagggccucuccccaguguguguccuguagugcauuuucaaggcgcucuggcagcugagaacccgguggcagaugaugcacucauuggggucaguggccuucuugucaauguuuucuaccaguugcugaagcuuggacgucucugaugccugagcugaguccaggagucccccaaaaggaaacuuggccuugaacugcucggacaugagcggcaacaaaggguuggugaaggugguggcacugcccgcggggccgcagucugccgcuggggagcucaggacgcuacugcucgccgucgggacugaguuggugaccaugccacucucuucgcuuuugccaccagaggguggcagaguggacccuucggcuuccucugggagcccaccuagguuucuuguggcugacucagggcccccggagucacuuuugacugagccuggggggcugguggcagaauggcugauggggaugggggcuggcucuuccgucuugaugaaggguaugaggcuugggaggguugggggcaacggcaggccgacugaaguggucagaguaggcaggacugguuuggugucuagccagcuggugacuggcuucucuggagggauggacaugccauaugggaugccaguacucguggggauauuguccaaaugcucaggcacaggauagggguucaucuggauaugaggguauuucucuuuguggcgcugaaaguggacuuucagauuccccuugguggagaaccuguucccgcagauguugcacuugaauggccucucuccgguaugggaacgcaaguggaucugcaaggcacugucacucccaaagaccuucgcgcagaaccugcacuuguguuugaagaaugccucaucggaaguacuuuucgcuucaaaggcagugacauuugguggcuugcuuuuucuuugcugggccaaggcagacaaggaguuuaaauccucugcaguuguuccgauguugggcaaagggcuggggaaaaccgaguuagcggaggcuugcugagguagaaguggauuagacgcaggacuuaauaaacugcuuauugcaaaagcuggugaggacgaugaugagaccgcuggguugcugacaugggaggccccagcacuugaagccacuuuuucagaggacggggugguaacugccgcugccaauauguucauauugggagaagagccgcuguuggauggaaugaugguguugccagaacugcucugagguagcuggauuggggguagcuguuucacaccacuaaugcuggcagauuggcuggcgaggcucugugccaauccagcugcugcugccagcugcugagauaaaugggaacuuagcguggacaagggguuggcagauguucguaaaguaccuugagaaggacuagaagauguuggcaagucugcauucugagaagccaacagcaauauuuggugacgaaucuguucgaucaauugcagcugguggaucugcugcugcugcagagcuaggaguuguuccaugagggcugggacggccagcuugcccccagaggccccgccgcaccucgcuuccugggagaacugggccaccgccaccuuggugcucuggagguucucgaugaugacguugcuguugauuacggagaaguugcccaguguugucagguccccgaguugagguagagagguugugaucgcugagguaccuguggaggagcugccgccgccgccgcugcugcugcugcugcugcugcugcugcuuggggcgguacugcuguggcugccgcuggaagugccgcugccgcuuuuguuagcaaccggggccuccaccuccauggacucuucccugucaaguccguuguguucugaaaggucgcugcaguccacuugaucuguuuuguuaacugugucauucauuuguucaucaggauuaucaggaggggggcugggggagaagguuucggguggggaggcuggauuuucauuuacgauuaaaacuaauugauuuuuaguacaguucuucuuguggagcagaagaucugauaauucaaagaacucggcacagcaccggccacagacgugggcauccuugcucuuaguagggcgacucgguugacccuuuucugugucuccuacaaaugucaaaaaggugcaggauuagaaaaggggccaggacacacagucaccuaugacuuaaaaaaaaaaaggcuaaucaaugguuuuccaccugcaaaacucaaaacuguagcccuugaaaaccaaucaauauuaccuaagaacauccauaauuaauuuguaaggguauggaggaauuccuauccauccgguauuucagagagucauggccuucauauaauucaucaaaauauaaaauacuacaaaugggagacauuggugcaugaugaaauuccauagcaaaauauugauuuccaaucuuuuauacaccuuauugucuacuuguccggagaggguccacaaaccauucugaggacuuauuaggcucuugaguuucugucaaccuuauucauuuucaaccgacucaaagauaucugugacaguuuguucugucacuaaacuaauuuguagucauucagguuccaaucaguuguugacaagggggaaaaaaaugcauaucaccaagcuguagacugacaacuugaaaaucaccucaagccccuaccucgaaccugcgcuaagucugaucccugacaaacgcacuuuagucacaucaguaacaaauccuccagaccguuccucaaaacucacuugaacacaaagggauggcaacacacacaaugaagagaaacacaaugauccuaauccauuacaaggcuugccuggcaccuauauaucaccccauggcauguuuauuuuuaaaauuaaagauguaacuccggcuaccauuccacuaaucaaagaauauaugccaccaugcuccgaauggcaacauuaugccucuaaauauuucaucaaaagugcucucuaugucuauaaaaacuggcacaagauuuacauuucugauuaaacaucaacuucaagaaggaugugcaguugagaagugcucccaucuccuaagaaauaauucuugguuuagaguuugaaaaugcuuugcagcucuccuugucugaaugccuuuaaaaacaguuugcucuuaacuguuaucaaucguuuaacagauuguccugaacauuuuauuauaaaaaucccuuuauuucauguuuguuuccauugguugcucagaugucuucucacuaagauccauuuguaaauuaaacagaaaaaucucuaacuccaagcuaacauccuauucaaagacaggauggcuucccauuguuugcccagcauggggaacaccaacuucuguuguacaaaugguguguggucaucuacgaaggcugugaagaaaaaaaaaaaacuguuuaauucaaggauuaccucccugcaugcuuuucugcagaacugaaucagauaauagguaguuuccaugacuuccaaauugaaucucccagaaaacuugcagaaaacaaaguaauugcagauaugaauaaauguaaaaucaaaaugcugcuuuuuucaguaaacuuaaaaguccguuggaaagggucagcuguuugcuuuuuuguaguaaacauuuuuaaaaacuugacuaguuuugcauuccagaaaauaaaauuaauaccuaaauacuaacuucuggaaauuccuuaacucuauuugccuugagugaugccgaaguugauuagaaucccuggugaaguaugccaaacguacgcacacuuuauucacugggaguguuauuugaguagcuaaguuauacuuaacaagcuagcuuuccuaauacccaucuuuuaaucuccacaagggcauagugcaagaugcauuaacaccaccaaacaaaucuuaguugcagcagaaaauaccaauaaugauuugguuuuaauuuaauguuuaagcauucuaauuggcacuggauuccuaugcacauggaaggugcuguuuuaagcccuuucugcuucuccccugccuuaaaaucauauaaacaaaauauuagaugaaauuugcugaaguuauauugcuuaacuugggacaaaaauaaugugacaaaaauucucuuuaaagcuucuuauuuugacaaucaauuuuaaaugaugcauccauuucagaugcuuauuuuaaacuaggaaaugcaauuccuaauauauucaacagaaauguuauuucuuucucuuugcacauuuccauauguaaugguuauguuuccaucuacuuuuacagccaauuaugaaggaacaaaagcuauucuguuuguucacacauuuucaacaaaaugcauuaaaacuauuaugucagcauguucuauuaagcucugcauucaguggaaaauacuuuucaaccagcucacauuuaucaaaacauaaagccacuuuaaaacacaguuuugcuuggucagcugggcuuagacaaauaaugacagauucagaacuaaauaacuagcaagggaaaucagaaaacugacuucaucaauuguacacauuacaauguaguugcuucaaauauuuagcacaucugugcucacgauuaaaagagauuuuaauucuuuauaacuugcaaacaucugauauucucauaauauacagagaaaauaaaaggaagguuacuuuacaggauuuagcugauuauuacuuuccugcacucaaauucugcauuugugcugccucgagacucacuugagaauuuucaaguuuuucaaucuaaacauuuuuauauuuaggauugugcuaacuggauggaaaauauagauguuuaaaaauaaaugcaaaugccugcuugcuuuuaagagacuguguuaaaaaguuguccauauuuuagcuuagguuuucacaacauuuuuaauaagcugacauuugaucucacuguagagugaacuaauuuaauuuccugauguuuaugaacacccccacauccccaaaauacugguaucuauuuugauuuauuucaaaagcaggugucgcuacacugcaauaauucuuaacuugaaaucuaucugcauucggaacaaaauuccaaggaaacagucuuuuacuuaaaaaaaaaaaaagacaaaacaugaggacuaguuggacucuuuaccaaagggaauauuuuaauuuguaguaagauacacacacacacauacacacacauucucucucucacacacacauacacacacacacacacacacacacacguacacacgaacauguuauaauuaauuuuucugauugucugcuaucuuguaucucucucaguaaucuguuacacaagauugcaacuggugaccccauuauaguaaauacaguugccuuguuccuuguacuauggugaaaauaacauuccuguuccuuuucuauggauuuugcauacagauuauuuuguaagcaacccuagucagauagcaaaauuuaagaagcagugguuuucuaaguaugugcacacaaacagauauuuggaauuuucugggccuuuuguugggggggcgggaagagugaucuuauaccuccaccaaauuuauacuaaaaucccagaugcuuuaguuccuguuguacuauuuagguaccugaugccuaauucaaauuugucaguuuuucaucaucugaaccaaacugcagagucggaagcagaaaauugaaguguucuaccauaucugucuacugagaaaauaaaaauaaaacuaugucccacacagaaagguuuagccagccaggaagggaaaaaacaaaacaaaaaacaaaugcaaccaccuuacucuacuagguuuaguuuucuuuuuuggagcucuucagaaagacacuucacuguacuucccauuaucuuaagauugcauuuacacucccuaauagaauuucucaugauagugguuuaggaguccuuaauuuuaacagccuguuccuuuuuuuaucacaaacauauuugauugauuggucuuuuuuuuuuuuuucuuuuucuuuuuuuuuuuuucugcaucgaccugggaaaagucugaauccaaauggaaaagucugaauccaacuuaggauuccaaagaaauuuuaaacacuacgacauaugcugugcauauuuucugugaugucuaaaguuuccucuaugugauaugccaccaaaugacaaauuuccugguacccuucaaguucacucacuguucugacggggauuagaguauucucuuguggaagaauacaagugaaaucucugaaaaaauaacaacauggacgaggcguugcuuuuaaaauagugauccaagcccaccuaauguacacaauaaaugaaaggggaaaaugucuuucccauggaugaaucaaacugaacacuagaugggguuccaguugcaaggguuuguucaaaaacuucuuuguggcuuuccuauugcagugacgcguaaaaaagagacuccuuaaggcgagaucuaaacuuugacuacauaaacauuggcaaaggcacaagaaacuaaaucccuguuguuugaggguaaaacugagcuaugggaacuaccugucaaucuuccccuuugggggucuggcaucugagggugacaggggaauaagguuaggaaaagacgccaagcugauaaggugaaacuaaaauaaacuacuaacuuccugcuaagugacuagcaggauucaauuugggggucacugggaagauacugaaggacauauuaugaucuggaccuugucaccuuugcaugggaggaggcuagcaaagguuaaaacagcuugacacaucuagguuuucuaaagccuggcacauaaacuuuuuucuuuuuuggggggagggguguuaguucuuugguuaacuuuccaccucuuuugccaaacuacuucaguuuuaauaaucuaagaauauuuuuggaauauucuggugcuaucugcaccaagaagugucucagaaaaaccuaguugagguuguagaaggaguuuauucuaguuccuacacagagcuuggcuuuugacaauuucaaaaacuuaaccagucugccuauuucugccccaguaagaucuccaccauaaaaauguggaguucuaccuucuaaaagguucuguugguaaagacaacuugcuaccuccaaaaguauaaagaaaacaaauagagcccccaaagaagaaccuauacguuggcacuugugccaaugaacucuaggggaaaugugauguaaaauaaaccacaaaacauucaguaucacauauucacuuucacacauacuacccucaugccuaacuagacuuugcucauuuauguguuuguuuuuuaauauuuuacaaaguauguguggccugaagcaaaucacaaaaaaaacaguuugcauuuucucauucagaaucuuccauuaugacaaacuuaaaacagcucugauuaaacaugaauucuuuccaacugccuuaucuugcagguguugguuuuuuuuaaaaaaagcaauuaauuacaguucucgcuaaccuuuugggcccagagaucaauguguugcuaugaagcugcucaaaaugagcaaauuacuucgguuaaauaauagaauuucauuauuaauauaaauaagaggaauuuuuaugauacuucauaugauuguuaguguuuuaucugcaauucaugguguuucauucuuccaauauuaucuuuuccuugaaaaaacugagcaccaaaauacuuuuuaaauaaaugaauggagucuaaaugggccauccauguagaaguuacaggaaucuuaaaaacgccaccaaaggaagaacuccaacacacacacacacacacacacacacacaugcacacaugcacuuacgcacacaaaacacauaacugaaaucccaauuuguaguaaagagcccacauauaaaaucauuagauuguaauauucccuuuccucagaauuauuuaacuugauaaacagucuuuccaguagcagucaucuuucugcaaguaauucaagacuuguugaauaucauuuaggagacaagucauauuugccauaaucuugguuucauaagaagcagaaaaauuaccaaguuuagaguguuucuggcauagcagcuguacacuaaaguaaaauaaaauaccagcauccugaaaucgaccaaauacucauuuuuguuuuuguuuuuguauuuuguuugcauuugcuucagaugaagcugucuguguggcuccuuagcauggucuggauuuucuuuguaagcacacacacacucaaacacacacaggcaggacacacaacaccaagcagcccuagcugcuuucagcuuugggagcugcuucuuuagggcuccuguaacuuaggucuacaaacuuuucuaggucucacucuggguagaagucauacaaucugaggugcugauaaaugagaagugcaugaacuagauuuaauuugguauguuucauauuucauuugucauauuucaaagaccaucucaagacauaagaaaaaguaaucagaauguuugaaaaggggcuugccuucuaaaaauauaacaauguuucuuuacguaaaaaacaaaacaaaacagaaaauccagcuacuccuagaaguauggguuauauguggggagaagaaugagauugcugaacucacugcagaaaaggugacuuuuaaaagguaaccuugaguuaugucaugaacuuucaaugccauuuauuucagaacuacucccaaauaaaagaacuggaguauguuaggcccuccuguauguccagcguugggggaggauuacuuguguacuaauauuauuacaacacacuaaauccugaaacccuauuacaaaaucuacccucuaggcaacuucucccaaacuuauuguucaaccauguaaaaacagucauaaccuaaaaccauuacuacugaagaaaaagaggaggggguggggagaggugaggaaagaaggcugggaggggguguuuccuagggagccccuaacaguuuacugcuucuuuaggacaauguaccagcuuuugcgaagaaaaaagaaaggaaggaagagaaagaaaucaaaagaaggagagaaaagagaaagaaaggaaacuugauugaguuacuuaacuuaccucaaagcucaaauaaacuaaauugaaaaaaauaguacuaauaaagaauaaugguaagagguagugaacuccuuuuauauuauugcuuuaugagaagacuuaacuauuaaaaauuccugauacugaaggcaaaaggcaaagaucuuccacgcaucauuucuccucgaaggccgagacuuuuuuuuuuuaaauguagaaaaccaguacaaauuuacaaaacacacuauauaaugcucucuuaucucuaguuugcuuuuuuguguacaaacuguuaaccugaacaguuuuccggugcaaaaggucucaccagaaacuuuaggaaagaugagugugacugcgggaagcagaagaaacuaagcugagaaaacccggaaaaauacucggcgcagcugcugcggccuugggucaucucaccuccaucuaccccgcgugcucgcuuucgcuugggguggaaagcgggguucaggggcucuuuucagcggacugagaaaucgcagaggccguggguaaggauucaagcuugaggaaacacugggggccgggaggagggcuauuguaaagcauuucuuaauuaauuucaaguccuccauuuuuuuacagggaccccaagucaggauuccccuuucccgacaucagggguaaagggagcgggggucccuucgcuucacugugccccagcucuaccgagaggcaggccucugggaaacgagccggggaccugggggcccgggcggccgcagcuuagugggcugaggugccgaucagggucacgcuucggagcucugucggggcccagcucccuccuucacaccccaaaaugccgccuagggcgugggcaucccgaguggcauccggagccgcugagaccccgccgagauugcuccuugugcguccucccacagccgagaggccagcaucgugccgggacgacccggggacccgaguccgggcgccgcuacaccgccucgggcgcuaggccugggagcuuugaggccgguaccgugaaacaccuuuaggagcaaggagggauuccagguguccucccuuuguaccccaacucccugcccggaucucuuccacucucugccauagcccccacacacaaacuuuguucuggacuuguucagccccuucgggacccacaguugucgccuccaucggagaaaacaagugccccuguuucaggggggauuccacucuggcuggccacccgcaaaccuggaaaacuauucuaugacuucuucccugaccccccuggaaguagggagcaccacgauccgcagagggcgcauaccgaccagaaagauuuuggggggcagagggugcaaguguugugggaagagaugcggagauaaauuuugcgagccagaccccgacacuuuccccguccguuugcaccgucuccggaacaacuggcggccagcagcacucuccaccccggccgcaaccccagcgggucaggcgcuggcgccccgacaccaguccccaucuucuugcagcucugaaccuccaaagacacccgguucugccucgcaggccgagggggagugugcgugggggcaggggggcgcagcgaacucccccacgcucggaguucagcccagcgcccgaaguaaacuuccuuaccgcuggcagcaaggccgggcggcggaggccgggccgggugcccuggggccggcgccgggagcgcuaggggccccgugcggucaggccggggcgaccuccacccgcacccacgccucauggggcucccgggucuuggccgcggcugggauccccggaaaagcagggacggagaagccaggccggcaugcccgcccuccuucccccgggaggacccaacaacuccggaaagauccugccgggagaugugcucgcuuuccccggggcagcgggggaaagcccagcaaaggcacauugaaaauuaaaaagaaaaaaaaaauuacgccgaguggaagaagcaaucggggccgcggcggcggugagguagggggcgcgggggccagccgcgugugaguggguccgagugugcgugagugugagugcguguguguguguccacggcgcgggccggagcacucaccaucucgccgggggagcgaggccacuucggggucggauuggaaauguugaggcuucgcuugcuuccuccgcgacaugcuggcucaaacaucagcuggggcagaauaaaaaauuacuaaaaaaaaaucuucucaaaauuacggaaaucgagcggcggcggcggcggcggcuccccccgcccgccggcccgcccgcccccuccccggcuccccggccccgggcgcagcgcgcauguguccugcuauaauuaugauuaucaauaaugcauugcgauuaaucauagaggggcucuuugaaaggcgauuggcaccgggccagcgcuauucaaacccgcucgccuuaaucaauuaguucgugauuugcugcagaccccugucucuccgcgcgcuggcccaauaagccggccgcggggcuggcucugcgcgccgcgccgcccgacacuggguuaacccucuuugcgaccgcccgggacuccgcggcccggccgccgggggccggccuccucuccacugcgggcccggcgccccggcaggcgccccccgcucucucccucuccccucccucuucccucccuccuucgcccccccccacaaucccgggcugggccgacccaaauuagcaugcccuccccggaauugagccgccccgggugggggguggggccgggcggcgagggcuggggacccgggcugccggcgcgcugcgaacuucccaacucgggggcgaggcgcgccggcccgcggggggagggagucccgcggcgggaucaggggggagggcgucccguuucgugaguguuucuucguuucuuuaagagcuaccagaaagcagcccacccccacccccauuaaaaaaaaaaauaagcgaguggggaagagccagccccacgccgguccgccucccgcccacggcucggccucccucccgccuggcucggcgcuccuccgccccgaguucuccauccccuggaucccgggcucgcgggggcgcggagaagaggauccaggaaagguuugggaaccugauggguuuguggcuggggggaggggcaguucucccgccaccccauccccuccccgccaggggcacugauccuccagcuucuugcuugcucccucgcucccuuucucuaccucggacauucccaggacaauuagggcugaaguuuucgggagaagcagccccgagcccgugggauaagggggcggcccggcuccgcccaggaccccucccggaccucccccccggcugccccgguuggcugcagggcgcgucacuccgcggggaggcggcggcagcgguggcgccgcagagccccgggcgggcggagagcggggaccggccugggcuccgaguucagcuccggccggggggaggggaggggcugcggcucacacugagcgcagcagcgagcaccggccuagggagacacagcccgggcggacccggcacuggacugggccagucccugggaccccugggcaccccgcccuggggagggggccgcgccccagccuuccgggacgagguggcggcgcagagccggaaagcgggguggggggagggcgguggggagguguucuguccgaggcugccuggcggcgccgaagcucgccuccacuuuuugggcacuugccgagcgcggcgcccgaacuuuucgcucuaucaccaucucccucaagcugagaugcaaccucccuacccucgccccagagcccagagccaggagcccgaucccucugccgggcucaggcgcccgcgaaccugagacucgguacgcggcucagccuagcucuuuccccucgcgccucggggucuccucgcuccaagguucucga

SEQ ID NO: 15716 - RNA, 1145 nt, Homo sapiens
aagcugucucuuuuacuucuuaauuccuccuugagcugcaagaacaaaaaacaaacaaauaagcacaucuccuuaacguuagagcugcaauguaaaaucccuuugcccaggcaagguauggaguggugagauaaacagacccuuugaaaggugcccuugugucuccuuugcaaccuacagaacuucucauccuuucaaauucugauagaaguaagaguuucuguuuaguucuuucuauuguauacuuagccauauuuguaagaccuuuuuguugaucccaaacccuuuaaguguugucgcuguuaccucugggaacaaguaaagagccuccacuaaccccagagacauuucugaaauuauuuaauccugaaaaauuucuaaaauuuaccucaggccugcaaaaauuacacaaauggcuaaugacuagcgcccaaugcuaugccaaagaugugacauugcccccccccccaaaauacagaauaaaugauaaggggaugaacaugaaauaucuggguuaauuucugauguggugagacaaauugacacaugcaugugacgaucuuuacauaaugaaagaucuuucugugagaucugccguuucucuccugcuaacacuucuucuaggaguuaagauaauaagagucacugcuugaaggggcuuggguuugccaccagguugcaacauuggcuccagccaugagguggccucucuucaauugcuggcugggccuucugaugugugcaaagagcuucgaagucccuuugguuugaacaggugcugaaagcuggggaaagccaaaauauuuuuuucuuucugggucaugaacuguuugcuguuggaaacaucuguauggacaggcguaugggcuaaacaaaacagaagcgcaaugaacgaugauaccagucuuugcuagggagcccccugaggaccccaauaaaguucacuuuuuaagcacgagcugugcacagcgacaggcaaugaauuauccacguugguuaaaaggccaaggucaccucauaacaacguugcccauauucugcaguuaagucaggccuguccccaaauauuauuuggggaagauguguguguguauauguguguguguguaugcaugcaugugugugugagcaugcaugcaugugug

SEQ ID NO: 15717 - RNA, 2113 nt, Homo sapiens
accagcauccuagaggccauuuauuauagggacaaauuuugcauauuuuagagaacauucacugauuaaaauggcauacaauaauguugauaauuauagcacugcucuuuaaugaccaagccuaaguaauuuucagagggcugcauucaagaaaacacgaacguucucuaucagaugauggggaggccgcucaaguuuuucauuuaagugggaugucauucugcugugaugucagauagaugagauguuacuggccuuaaauuugacucaacaaguugaauuugcaaacuaaagcacuauccaaauaagugguguggggggccccagagauaaacucuuucugugcauucuuggucuaauaugugguuguuauaaguauccuucagggaaucaaaguuggaacuguaaccgcccuuucagcaggguuucuucccagcccugucaguaucucagcuaaauagaguuaugcugauccacucuggagggccuucauggggaauauaaagaaugaaauuacuuggcaaauaccacuguguauaccgcagccauuccauucuggcuaggcauaaacaagcgcagugucgcuccuuagcggaggcugaaauucaagagauuucugucaacugugaacgugaaauaucaccugcacuggaucggaaauggucaacaguuuugaacaaacauaaaguaggccgaccgaaguucaaacauuuaauucuuuugucuagcucacguuuucauauggguuuuaaauuuuuaauucgguagaaagccagcuaaggaccugaaaggaggagacccuuagaauuuuagagcuggaggacuuuuggacaacuugugcagccucuuccuuuuacagaaggcaaaaccaaggcccuaggacacgcuaggauuugauguaggucacucaguuaauucgugaaggaucgagagggaacccagguuuuccaguacgcccccugcuccuaaaccaguaucacccucccccacggcugucucucucucuucuuaaauucuugcguuuauuuuucucucccuucguaacugugcaauggagaacgggagccugagccucgggaagacaggguugcaaccgcaggcuaggugcgcgcucuccccuagcucgcggcguggagcugggucuccgcggcgggcgccggcuacugcaggugcuggcaccugggcucaaucgcagcaucaucgcgacacgcuccgugcucccgauucuacagcacgggcgcgugacacccgggucuccgcgcgaaaggagaacgugggacuaaauccacggcuccuuaagaaggacgucuuuggaaacucucgcccuuccucggcggacccgagcugcccgagagaugcccugcaugugagugaccucugcgccgaccccgccacuggucagcucgcggcuggggcgugcccugccggggccugacguggcggcggggccgcggggcgggcggcgcgaggggagaggccgccgugagggcgcggccugacguggcggccgcggcggggcugccgggggagcccggaccacugcacugccccgcgcuccggccagagggcgcccggccccaagccuuccccgccccgaggccgcccagggcuccgggaguaaccgcgccagcgauugggucggcggcgcggcggggccauguuggagcggagcaacgaccccgccucgcaccgcccuccgcccugggucgggccgcgccaggagggaaggggagcggcgaaggggacgcucccucuuaggcagcccgacgcggcuggagccgcggcaggagcggcggcggucacgaccgccccuccgcgcccgggccaaucagcggcgcgggcacaaauaugcaaauagcgcgccggugcugccggagugccgcucgcaggggcugguggggucgcgcugggggagugaacugggccaaucaggcgggugcguggcggcgcgggggaggcggugccccuucacuccucccuccacucccucccugccccgcgcugacaggggggccuggccgcgcagccgguaagugccgccgccgccgccgcugccacccaccgccucgggcguggggaggaagcccgggggcaccgcggggcagcggccgcu

SEQ ID NO: 15718 - RNA, 2113 nt, Homo sapiens
agcggccgcugccccgcggugcccccgggcuuccuccccacgcccgaggcgguggguggcagcggcggcggcggcggcacuuaccggcugcgcggccaggccccccugucagcgcggggcagggagggaguggagggaggagugaaggggcaccgccucccccgcgccgccacgcacccgccugauuggcccaguucacucccccagcgcgaccccaccagccccugcgagcggcacuccggcagcaccggcgcgcuauuugcauauuugugcccgcgccgcugauuggcccgggcgcggaggggcggucgugaccgccgccgcuccugccgcggcuccagccgcgucgggcugccuaagagggagcguccccuucgccgcuccccuucccuccuggcgcggcccgacccagggcggagggcggugcgaggcggggucguugcuccgcuccaacauggccccgccgcgccgccgacccaaucgcuggcgcgguuacucccggagcccugggcggccucggggcggggaaggcuuggggccgggcgcccucuggccggagcgcggggcagugcagugguccgggcucccccggcagccccgccgcggccgccacgucaggccgcgcccucacggcggccucuccccucgcgccgcccgccccgcggccccgccgccacgucaggccccggcagggcacgccccagccgcgagcugaccaguggcggggucggcgcagaggucacucacaugcagggcaucucucgggcagcucggguccgccgaggaagggcgagaguuuccaaagacguccuucuuaaggagccguggauuuagucccacguucuccuuucgcgcggagacccgggugucacgcgcccgugcuguagaaucgggagcacggagcgugucgcgaugaugcugcgauugagcccaggugccagcaccugcaguagccggcgcccgccgcggagacccagcuccacgccgcgagcuaggggagagcgcgcaccuagccugcgguugcaacccugucuucccgaggcucaggcucccguucuccauugcacaguuacgaagggagagaaaaauaaacgcaagaauuuaagaagagagagagacagccgugggggagggugauacugguuuaggagcagggggcguacuggaaaaccuggguucccucucgauccuucacgaauuaacugagugaccuacaucaaauccuagcguguccuagggccuugguuuugccuucuguaaaaggaagaggcugcacaaguuguccaaaaguccuccagcucuaaaauucuaagggucuccuccuuucagguccuuagcuggcuuucuaccgaauuaaaaauuuaaaacccauaugaaaacgugagcuagacaaaagaauuaaauguuugaacuucggucggccuacuuuauguuuguucaaaacuguugaccauuuccgauccagugcaggugauauuucacguucacaguugacagaaaucucuugaauuucagccuccgcuaaggagcgacacugcgcuuguuuaugccuagccagaauggaauggcugcgguauacacagugguauuugccaaguaauuucauucuuuauauuccccaugaaggcccuccagaguggaucagcauaacucuauuuagcugagauacugacagggcugggaagaaacccugcugaaagggcgguuacaguuccaacuuugauucccugaaggauacuuauaacaaccacauauuagaccaagaaugcacagaaagaguuuaucucuggggccccccacaccacuuauuuggauagugcuuuaguuugcaaauucaacuuguugagucaaauuuaaggccaguaacaucucaucuaucugacaucacagcagaaugacaucccacuuaaaugaaaaacuugagcggccuccccaucaucugauagagaacguucguguuuucuugaaugcagcccucugaaaauuacuuaggcuuggucauuaaagagcagugcuauaauuaucaacauuauuguaugccauuuuaaucagugaauguucucuaaaauaugcaaaauuugucccuauaauaaauggccucuaggaugcuggu

SEQ ID NO: 15719 - RNA, 3664 nt, Homo sapiens
aagacaucugucccuucgcuuuuaauaauuacagucucugcuuuuugcugcccuuagcagaagaaaguucuuuguguuucugauccagauuacuccauaaaaccugauaacuccauaaaaccuccucaaaaauguguaggaauugaaacauuguauaaauuuagagcaaagauuaaaugagucuagagauaggguuacuuuuuucccccaagauacagcaacuuaucuuaaggaggcaaguguuguuaauguuauuaccauuguuacugucauuauuugaacaguuuuaugggggacaaaagccaauugacuucugugcaucuuauuuauaaaaucaacacaugggcuuuagcaugaacucuguuucuggcagguuucugacugugaucaguugcuggcuggcuguuucuuaggggcagugcuucuuaaacuuuuugagaaaacauugauucauuuauuuauccaacauacauuuauuaagugucuauuguuuucuaagcacuguuccagguucacagcagugaacagaacugaugacaguucuuucauggagcuuauauucuaguggaaugacagauaugaacucuuuuccuaagcggaacucugaaaauuucuuuuauaaaaugugcauauaguugcuaugcccuguauauucaccagcacucaacagugaccaaaauaaagucauucaguugagauaaagauacacaguucucuuuucugagcuuuguuauaaaguaaucacuuguuauaaaauuuacauuucaaguugcagugggucauauuugggaaguagccgugggaugccaguuuucugaggaacaccauccuagggaauccguaacauaaauucuccuucaauuauccguaccgugguucccauuuacuuuuccaagaccugcgucacuuuaaaggucuucauuugaaggaaggcuuaaauucaggccacauuauauugacaaaucucucugaagagagaaugggcaaagccauaccuaucucauagguguugggggauuaccugugauaaugcacucaaguacuucauaaaugcuggguuuuguuguugggagugaucugucagucaugcguugguucugcaaauauuucuuaagugccuaccugguaugaggagcuaucuuagguccugagguuguagagaugaguaacauuugauuaggggaaauguauuacacaauguagaaucauaaauacuauggaagagauugagucaugauuccauagaaacccacaucccagggaagaagacaggcucuccuuaaguguucucauaagacucucauuaugugcccagcgacagugagaaauacugcuccauuccccaauuguguuggcuaccaguagauagguagcuauuugucucaaagcaugagugagaaauaggagagaaauuuauacgugaggauaggucauuguauaaaaguugugcuaccuucuuuccauuguauaaaguuuguggaggaaaaaugguuuucuuucagaguaaauuuaauuaauauguuugggggcauagauucugaaucagauugccuggguuugaaucuuggauccacuucuauaacuccaggcaaguuacaauuguggauuguaacuagaugaguuacuuaaccccucugagccucaauuuucucguuuguuauuugccuaggggaugauaauaauagaacccauuucauaggguugauuaagugauuaaauguaaaacacccagagcaaguaccuguaacguauuagguguucaauaaaaaugaccuaucaugaucuucagaucaaaacaauaaagccaggaauaaacccagccacccuuauccaaauuggccucuccuuugagagaaugccucaugaaguaaauauccuagccuccugguaggggccugauauugcaaaauuggugcagggaagaacacuagacagaguuggugcucugugcucagcagugucacacagaauugacagguggagggcuggacuccaguuugaaucccaucauuagugacuauaggacucugggcaugucacagacacucuacgccuuagcaacuuuauguaagaaagaagcgacuugaucucgaucgccccaaaagugggaggcaucuuccagcucucacaaggaguggcuccauacgugagauccccgggagcagggaaaaguggauguuacuccugauggguuucacuccucuacuuccacuuucccugaagucugcaauuguacuaauuuuaacaacaauagcagcugacauuuauugagaagucacuguguuccagacagaguuuuaaauguuuuauaugaugagaaaaccgaggcacagaggugcagaguaacuugcccaaggcaacagcuaguaaguagugaagauggaauuuaagccaagacggcccagguuggccaagagcaauaacaaagcuuuaguuuuuaaucaaccacugauacgauucacuuaguauuuuagagaccuucuaggauccuucucaguguggagauaggcagguauguaucuuuacauauuuauuuccucugguaccuaacauguuuuacacuuuuuaguugugggugcaucucuauaaggaaauaguauccagcuaaugcauuaucaaucucccugccauggaucuuuuaaaggaaaguuaucaccuuuauaugcucugucauuucuuuuauauugguuacagucuuuuagaaggugggagaguaggggugaaaauuagaacaccaaaguuuagccuccaagaaucuguaaaucucuguaaauccucuaagucaaguaauuuuggggcugcguuagucaaggcugauuucagugggugcccuuaaggugaaaggguagcaauuuaucuacuccauaauggguuaaucaccagcuguacaguuuguuuauaucuaggaaacaauuuaccacacaugaagaguaguaauuuuauucuaucucagggguauccccaguguauuuuacaaauuuacucuguaauguuauagauaaaaguuuaacucuggcuuucaguugaggaagucaugguggaggaggaugggggaaggggaaggaacagcucuacuggccuguaggggacacuguugcaucauuuauuagaauuuuccagucuauugucccaggacaaaaaaaacaaaaccaaacaaaucagaaaacaaaaaaaaauaguugaaucaccuugaaaaugcuuauuagaauuauuugaaucguuccaauguguuuagaauguucaggacuucucagguauuggucagacuguucaguauccaugcgugaaagaaauagguuagugguucuuucugagacaggaguguuugaugggacucuucugauuaccuuucucuccauagucaacuuuggauagggugcucaggacguuacuuuuuaguuuaauaaaccuuuagguuuaguuaaccaucuucauuuuuuauuaagauaugcucauauuaaguuguuuugcuuccagaauguaugcuaaauaaaugucccaauccuuggaagggcguuuuggaaguuccuauugucuucuuuuuauucuuauauuuuuuuucacugaaaaaguugcuguuuacugaaaaaaugaagucauaucuacaaggaaggcuuauguagggccuggucugaacuccaggaagcauaugaccagaugcugu

SEQ ID NO: 15720 - RNA, 1379 nt, Homo sapiens
uaggcggauggcauggaacuuuuuauaaaugagauauuaugaaaaaugauguuuuaggacucucauuucuacagugggaguaggucacccauugcaauuuuggauuugcuuaaaaaaauucuugccaucaccuucuaauggaugaucuguguacaacaauuguuuauugacucugaaugucuaaguaccagggucagucuauuucaaggggagggaagcauuaauuaaccuccagcauuagauucagugauucuuuuccaaugaugcaguucaugacuuugcucgcauuuacuuuucaucaauccugaaagaauugagguaaaauaguuccucugcacaugugugucaagcuaaauggauaacagcagauacagaucuguuugccugucugcacuugccuuuagacaaaauucaucaauuuuacaaaagccacugacuaaacauggcaccaauacaaaugaagcacuucuagcaggcggagauucccuuuguuucugaucugguaaaugcgguaguuuccugcugagagaugggaagugcuggccuaggacagcaaggugcccuacagguggggccaaaagggucaagaccguucuacaggaaguuuaggagaaguucaaugguuccagauccugugugcuucggguaauucugacccucuucauuagugauaauggcaugaagcucuuucacacagucuuuuuuuuuuuucuuuuuuuuuuucagacagggucucacccugucacguaggcuggagugcaguggugagaucacggcucacugcagccucgacuucaugggcucaagcgauucuccugccucagccuccuaaguagucgggaucauaggcacuugccaccacauccggcuaauuuuuuuguagagacaggauuucaccacauuacacaggcugguuucaaacuccgaggcucaagugaucugccugcaucggccucccaaagcgcugagauuacaagcgugagccacuacgccuugcccuccacacagccuugcuugguguuaaagauuaaacaaagaccacaggugaucacugucuucguggugccaguuucaagggcacccuucuucccuucccagccuccgagagaaggagagaggguccacaagccagauccauccccauccacacagguaaaaccacgacugugcagcuagcagguggagauaacauuuggaaaaaggcuuuguaaaugcuaaaguccuacucaaguccaagggagagaaauuauuauuauucguuuugugaaaccaauuuaguuuggcuggguaauggaagaauuucuacauacauucauuacuucugaucaggcaagaccagucugacacaggaacagucuauggcucacucuuaaagccac

SEQ ID NO: 15721 - RNA, 1016 nt, Homo sapiens
gcugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauuc

SEQ ID NO: 15722 - RNA, 3611 nt, Homo sapiens
gggcagacaggcggguuauagucaaaguggcagcagcucauuuauuuagccaaaaauagauacuuucucguacaauuugguucacacauauguacauuucucuguauauauacacacacacaaaggcagacacguuuauucucacugaaacuccaccccccaaaaucaaccggacaaacaaaccucacagcgaaugcggggugccacagaagcgacuuggggagggcugaggaggacugguuuuauuucuuuuucuuacuuucuuuguuuaguuuugcuuuuagguauuuauacacggacaugcuuacaaguuguaacuauacagagcgauuuuuuuuauacaauuauuacaacgauuaaaaaaaguuuuuuuuguuuuuuuguuuuuuuuaaagaacuaggaugaggagagagccgauaagaccagggcggcguccagaugguucuggggccuggaagagagagacaguaguagcaaaagaggugagauucaggagcgcagaggcugccuagggcggggagauccuacuuggauuggggccgaucgucaggaaggugucgcaauguaaaauuauguccaguuguagauguguguguugggguuuaacuguagggugggcacgaggcgucaggacccgaggucuggggcuggaaagaggugggcgucagagaaccgccacccgccccaggggccugugggcccagccacgcaaggcuuccccuagaagguacaagcgcuguacccuccggccgcgccuggggugccugggcuggaccuggagagcugucgcagggccgacaggggcgacugaaaaagugacuuucguccccuuuuacaaaaugcgucccagcaggguuccccccuaccccggggcaaaaggccgugcguggugcucggcguccucuccuuuccccgccagccagucccccuggccccucaaccucgggguuucuuaccgccugggcacgggcuggaaagcugucuugaguaacuuuuucuccacuuccaaggcacuacagcgaucuaagggaagcgggggaagaaaaaggagggccuuuagagcgcucggugccggcgcccagggccgcagaaagcaggaguggagagggacgcgcgcccugcgccccccgggcccugccccucccggccagcuccggcacuacccgcagagcccgcccccgcuccgcgcccagcgcucagcagucaccuguuccgccuucgggcuccgcuggccgagcgaaggcggcggcggcagccggguggcccgcggcuccgggaagucccagcaggugcggaggggcagagcccagcagggagagcgggugcaggcgggggccgggcggugggccuggaaacggccgguugguccaagccgggaacuugcccagcggcgcugagaccagucugugagcggcggcggcggcggcggccggagagagcugcagggcggaaggcgcgaccgcugcccccgguggagacccccccgcgccgggaggcgagcggcgcggguuguccgggcuuguggcagucuccgcgagggaccagaucuugggcuucugcagggcggaggcgggggcuggugcgggagcgcagggguccaggcucacggggggcgacggcagagacggcgaggccacggccacuggugguggcgcuggagccagacucaggaccgguaguggccgguccucuaagcccucagagcuaucuuccgagucgcuauuuuuggaguccgaaaugggucccaggccuaggucgccaucccugcgcgccgccccagccagggacagcucaggcucgguggccgcgccgucuaaguucuccaaaucgaucuccucguccucgucgucgucagccaggcccucgccccccguguccuccuccucccccccgagcuccuccuccuccagcucuagcucgcguuugccguccuccucguccuccucuucgucuuccuccucgcgcucgcucccauaagcguuucccuccucgucagugcggcugcgaggcgcccaagucaucuuauucuccuucuugaggcgccggcgcgcguuggcgaaccagguggacaccugggugagggucaucuuggugaugauggccagcaugaucuucucgcccuuggugggguagggguucuugcggugcucguugagccaggccuucagcgugcuggugcucucccugguggcguucuugggacgggacggguccccgaacugguacuggccauacggguagaaggcggggugcgggugcggaaacgcggcagccgcggccggaugcugcaccccggggcuguccuucagcucauacugcgcgcccuguacgcacauggagaaggaagggacacgcgcggagggagcgcgagugagccccagccaucgcugccuccccccuccuggccugcaccccucuaguccggcccccgcgcgcucagcucgcccugcgccccagcgccaaccccuccuucccuggcuccgcgggcucuuaccagcugcgggaagaugggcagcuccgcggcguagggcaggaaggcgccguagccuugggcggcggcggccgcagcggccgcggcguagggcgccccguacacggacgagagcacguuggacagggaccccgaggcguucagcuccgaggcuccggcacccaggccgccccgggcccccgcgcugccgccgcugccgccagcggcccccgggcgcucggacggguaaagcgggcggauguauugguaucccagcugggggaaggacaugguggcccgcggggcacggacggagaggggggccgacccccgggccgcccagcucagcgccgcccgcgggcuccggcgcgcaucgggggcugggccgggcuuggggccgcgcugccgcccgcgcugcgcugugcuccgcguucgccuauugaucugcuccgcggcggcgacggcggcggcgagggcggcggcgaggagccaggucagguccgaacagauuggcggagauucccggggcuccgggcucugauugacauuucuacggggcgcaagccccuccucucugcgccgcgcucccuccucucggccgccggagcugccucugcccgcuccucgcuccucacugcccuccucuccccagcagugucgcgccucgcuuccuucgcccuccucuaguuuucacucccccuccucgcccuuccucuccccuccccucuccgcacuccucuuccccccaggaucgcuuccgcugcuucgggcuccugcacugcccuggacgcuaugaaacucuccuuucuccucuccccuucucuuucccuuucucacgagggcuuuugcucuccgguccguucccuucacuucuuccuuucucacuacuucuauuuuguaaaucucucucuuuacucacacgauacuccccgcgaccuuuccagccucugcgcccugggcuaaguaaggcagccaaaaguuguggacacuuagggugccgcgcggggggugugugucggugucugucuguccauccccgcccuuccacccccucccucgccuuuccccaaaucucgggucugacgucgcgcccucuuauucgacuuuuccccgcgucucuuccccgagucgccaaucgcc

SEQ ID NO: 15723 - RNA, 3611 nt, Homo sapiens
ggcgauuggcgacucggggaagagacgcggggaaaagucgaauaagagggcgcgacgucagacccgagauuuggggaaaggcgagggaggggguggaagggcggggauggacagacagacaccgacacacaccccccgcgcggcacccuaaguguccacaacuuuuggcugccuuacuuagcccagggcgcagaggcuggaaaggucgcggggaguaucgugugaguaaagagagagauuuacaaaauagaaguagugagaaaggaagaagugaagggaacggaccggagagcaaaagcccucgugagaaagggaaagagaaggggagaggagaaaggagaguuucauagcguccagggcagugcaggagcccgaagcagcggaagcgauccuggggggaagaggagugcggagaggggaggggagaggaagggcgaggagggggagugaaaacuagaggagggcgaaggaagcgaggcgcgacacugcuggggagaggagggcagugaggagcgaggagcgggcagaggcagcuccggcggccgagaggagggagcgcggcgcagagaggaggggcuugcgccccguagaaaugucaaucagagcccggagccccgggaaucuccgccaaucuguucggaccugaccuggcuccucgccgccgcccucgccgccgccgucgccgccgcggagcagaucaauaggcgaacgcggagcacagcgcagcgcgggcggcagcgcggccccaagcccggcccagcccccgaugcgcgccggagcccgcgggcggcgcugagcugggcggcccgggggucggccccccucuccguccgugccccgcgggccaccauguccuucccccagcugggauaccaauacauccgcccgcuuuacccguccgagcgcccgggggccgcuggcggcagcggcggcagcgcgggggcccggggcggccugggugccggagccucggagcugaacgccucggggucccuguccaacgugcucucguccguguacggggcgcccuacgccgcggccgcugcggccgccgccgcccaaggcuacggcgccuuccugcccuacgccgcggagcugcccaucuucccgcagcugguaagagcccgcggagccagggaaggagggguuggcgcuggggcgcagggcgagcugagcgcgcgggggccggacuagaggggugcaggccaggaggggggaggcagcgauggcuggggcucacucgcgcucccuccgcgcgugucccuuccuucuccaugugcguacagggcgcgcaguaugagcugaaggacagccccggggugcagcauccggccgcggcugccgcguuuccgcacccgcaccccgccuucuacccguauggccaguaccaguucggggacccgucccgucccaagaacgccaccagggagagcaccagcacgcugaaggccuggcucaacgagcaccgcaagaaccccuaccccaccaagggcgagaagaucaugcuggccaucaucaccaagaugacccucacccagguguccaccugguucgccaacgcgcgccggcgccucaagaaggagaauaagaugacuugggcgccucgcagccgcacugacgaggagggaaacgcuuaugggagcgagcgcgaggaggaagacgaagaggaggacgaggaggacggcaaacgcgagcuagagcuggaggaggaggagcucgggggggaggaggaggacacggggggcgagggccuggcugacgacgacgaggacgaggagaucgauuuggagaacuuagacggcgcggccaccgagccugagcugucccuggcuggggcggcgcgcagggauggcgaccuaggccugggacccauuucggacuccaaaaauagcgacucggaagauagcucugagggcuuagaggaccggccacuaccgguccugagucuggcuccagcgccaccaccaguggccguggccucgccgucucugccgucgccccccgugagccuggaccccugcgcucccgcaccagcccccgccuccgcccugcagaagcccaagaucuggucccucgcggagacugccacaagcccggacaacccgcgccgcucgccucccggcgcgggggggucuccaccgggggcagcggucgcgccuuccgcccugcagcucucuccggccgccgccgccgccgccgcucacagacuggucucagcgccgcugggcaaguucccggcuuggaccaaccggccguuuccaggcccaccgcccggcccccgccugcacccgcucucccugcugggcucugccccuccgcaccugcugggacuucccggagccgcgggccacccggcugccgccgccgccuucgcucggccagcggagcccgaaggcggaacaggugacugcugagcgcugggcgcggagcgggggcgggcucugcggguagugccggagcuggccgggaggggcagggcccggggggcgcagggcgcgcgucccucuccacuccugcuuucugcggcccugggcgccggcaccgagcgcucuaaaggcccuccuuuuucuucccccgcuucccuuagaucgcuguagugccuuggaaguggagaaaaaguuacucaagacagcuuuccagcccgugcccaggcgguaagaaaccccgagguugaggggccagggggacuggcuggcggggaaaggagaggacgccgagcaccacgcacggccuuuugccccgggguaggggggaacccugcugggacgcauuuuguaaaaggggacgaaagucacuuuuucagucgccccugucggcccugcgacagcucuccagguccagcccaggcaccccaggcgcggccggaggguacagcgcuuguaccuucuaggggaagccuugcguggcugggcccacaggccccuggggcggguggcgguucucugacgcccaccucuuuccagccccagaccucggguccugacgccucgugcccacccuacaguuaaaccccaacacacacaucuacaacuggacauaauuuuacauugcgacaccuuccugacgaucggccccaauccaaguaggaucuccccgcccuaggcagccucugcgcuccugaaucucaccucuuuugcuacuacugucucucucuuccaggccccagaaccaucuggacgccgcccuggucuuaucggcucucuccucauccuaguucuuuaaaaaaaacaaaaaaacaaaaaaaacuuuuuuuaaucguuguaauaauuguauaaaaaaaaucgcucuguauaguuacaacuuguaagcauguccguguauaaauaccuaaaagcaaaacuaaacaaagaaaguaagaaaaagaaauaaaaccaguccuccucagcccuccccaagucgcuucuguggcaccccgcauucgcugugagguuuguuuguccgguugauuuugggggguggaguuucagugagaauaaacgugucugccuuuguguguguguauauauacagagaaauguacauaugugugaaccaaauuguacgagaaaguaucuauuuuuggcuaaauaaaugagcugcugccacuuugacuauaacccgccugucugccc

SEQ ID NO: 15724 - RNA, 7692 nt, Homo sapiens
guuugaaaaugcuuaacacaauuauuugguaaauaauaauaaaucaacauuauguuuuuaaucuuuuuuuucuuuuuucuuuguuuuuuugagacaaagucucgcucuugucccccaggcuggagugcaauggcgcgaucucagcucacugcaaccuccacuuccugggcucaagcaauucuccugccucagccuccugagaagcugggauuacaggcaccugcuaccaugcccagcuaauuuuuguauuuuuaguagagaugggguuucacuauguuggccaggcuggucucgaacuccugaccucaggugauccgcccaccucggccucccaaagugcugggauuacaggugugagacaccgcgcgcccagccuaaucuuaauuuuuuuauacgcuccucaacaguccuagcucuugagguugucaacauuauuuuagguagugugcagucuuggaucagagaauuaaauuaacacugaauuaaaugaacauugaauagugagaaacauucucuuuucaauugucucauuucuuccgagaaagauucaguauuuaacacuuccaacacuugcuaaugacacacacacaccugagccucuaggagucuuuccaagccagcaaaacggcuaacauguauuaacauugcuugguuuuagcuguguuuaucuuuuaccacuuccuuuucuggugaguaacagcuacuuuucaauuuacagugguaguaucagauuuucuuuccaaaaauauguacuuugauuuuaaaaaugagucaauuuaaggaaaaauguuaaguaaauaauaaagguaguagcgggaagcuugaaguuugggaaacucgacaccagacaauuccagacaaggccagaccuugauguucugaauucccagcaaggcucacgucgauuccccacaagcuuaacucagaguuugccccucgaagcuccugacuuuaauaaaccuucagcuuauugaaaggcguuccugggucacgccuccugagcgccuuggaccuuaucagggaggggcagucagucccuccugaaugacugaagugggcucagccagggcagaggcaggauccgaguccugacagccgaaaggccugccuacaaccuccccuggccaagcgaugccaaggcgcccuccaagauuaacgaggagcgagcggagcaggguacacaacaauguggcuguguuugaucccgcgacgugucacuuggaaucucaauuuauugccaauagacgacguugucaggcacuaauuuucugguggcgcuccaucacaggccucucaaaucaggggaggggcucagaggccggugggcaggggggcucggaggagccgucgcgagccagccggggguuccuguaacgaggcuuuaaugaggggagcgcgacggccuuuguggacaaaccggaggaggaggcggcggccgggucaggagcucggcaaggucgcuuccucccccggcccccagagcccgggaauccggagagggucagcggcggccgccaggccgggugccuacugaggggcuguccugggcccacaccacccucgcccacuccgaacugcgaacugcggcaggaaacacaacauuuccaagcaacaaugcaaacgcgcucauuaccaucuccucaauaugcaugaagaaaaugcacagcgcuggccgagcccccucacacggcucuggccucggcguccaauaaggcgacaaauucaucucccaggaugaaugaggagggggcgccggggaggcagauccacgugggggaggggacggaucccggagagggagaggagagaauauuuacggagaggagaaccugagagacagaaccugagagacagaaauccaaggaggaaauaggagaggauccggauggaaguggggaggaaagaaagaaaaucaaaaacggcaacugcagaugggggaaagggacacagucacagacucagggcgaggaaaaaagagacauuaagaagggggugagggagggagcagaagggagaaaagugaacugaaaagugguccagggcaaaggcauaaaaacagcacaaugaggaagcggaggaaagagaagaaaagcgaaugaucuagaaaucgaagauagaggaaauugugaggacagacggagggaacgagaaaaaaaaggcaugggggagggggcugcucaagucagguggaaaacggcugauccagaagagguaaagcaaaagaaaaucguucccgccgagggccagguucuuccaucaaggccacucugagcgcugcgccucucgggccgcucagagacgcagggaagugagacgggucgcgggaggcgcaggggcgaagcggaggagcaaagagcccaccggccucacgccccacuuugggcaucccgacgcgcuccagggugcccagcacuggcccggggcccacccugcgcgucgcggcccgccgccgcugcugcaccauuccggccagcggccucuuccgcgccaagagcgaaguuggcaaaguuuuccccuaaguguccccgucgcuucuccggacccaggaagggccuccgagucccugguggcugguggggagcggcagcacgcuccggagagcucuggaggcccccgguccgcgucuccugggaugaucggaguccggauuccuggccaaauacgaauuccacccugugcggacgccaggccacgcucucaggaguccgcggcugcuaauagcggagaaagagaacgcgaaagugggagagagggagagagaaggaaaaaaaauauucucagcucaauuuaagucucauggaaagggcuuacaacuguaauuaaaucauuaaauucuugucuacgcuucacagagcggagagaaauuaacuucccaccaaccucauuuucuauuugaacaugaaauaaugauuuucugcccgucuaauuacaaagccaacaucugaucaagccagcauccagaggggauuaucgcaugcacgaguauuagaccucauuaccagcuugagugcaaaauuauuacaucuuguaauuggauggugagauuuauauacagaucggcccgguuucuguaagauuguaauuacaagcuucguugguuagcuacuuaucagaacuuugcaggaaaacaaaacaaaugacugaggaaaacgagcauuucauuaaccuguaacccgagcgcgagggggagggaacggugggagcgcgcgccgcagcgccugcaggaagcucagagaucgccggcccgcaccgcagcccggggacuuagggccugggagggaaggauagaagaugagccggggcugggaguccgagggcugccgcggcuccccucgacggggacgugugagcaccgugaggcugggcgaggagggggcaggaagcgggccuggugacuccccucuugugaagugcgaggcgcagcccccagaaccuggcgggccgcgggcccugggcacacgucgggcagccguucccggugcgcauccggcgcacgcgcgccaagcgugugcgauggacagacacccucuccgaacacuccccgcucccugggcugcauugagagggccugcagucagucuccaaagcgcuuugugcgcugggaauguugaaagaaggcaagaugauggagaagcuucugcgugaagcgcguucgugcgcgcgacuuucccaaaucuacuucugugcaccugcuuuucuucccugugcgagugugucacucugacccauuuaaucuguuggauuaaaaaucccuggaaaagguucagcugcccucggacccucgaguucagcccacagccgggcuccacuggaccugucgaguugggggaccagcgccacguugggacgcggcugccugggacgcugagucucgacguggcgcgcagauggcccggacagaccagggcuguucucaauuggaaaguaggguagccaggaggccgcuucugcucgaggccuggggagccuggagggaucuaauaugcgagguucuugggugcacgucucggucuggagguucauccccugggcugugggcgccccccccccccacccgccggcgugacugagucccuaagagccgccuggcccuucccuguccucuuucucgccgcccgcaguccgacgcagacaggucgauagcugguuaaugcagaaggagcaucuccgaggcucauuauuguuuuuucuuuuccuucugaaaaaagcuaaauuaaauaucgggagucucacucggucacuuacagcgcagccccauuccccccaccucggaaucucgcucucagcuccuccuggucuggugccaccacuuuguacaaacacuaugacuucagggccgucgaggcucgaggucugacaccuaggaaacaucccggaaaauaacguuacucucaauuuuguaaccccaaguuucuucgcgugaaagugagcccaacauucccuaugccacucucugugagguuuaacgggaaacgaaaucaggcgucgaagagauauuucaaagccagggcggccccugaugacgccuccuccggcgaggcuccugagaaggcaccaggcuccccagcaccaggcagaggcggaagagaaggugauagggaaacuacucagaugcagucugggaauaccccgcuuucccucauugcccccaaaaccugguccuccccaaacuuucccuuguuuccuccccgcccccaucccgcccgcgcaagguuuuuggcguucacaccuacuagggccgugggcuugugccaagacccacggaaagaggugggaggugggaagugggaggugggcggugggggugggaucaaaacugggugucugccguggagguggaagaauuuuucauuccagagcugggcuccccagagcugugaucagagacagccggggccaagacccucugaucuccucugaucccgccacucugguggaauucgaauucgauuccuggauccauccaugcaaggugacgguuuccgccuccgagcuggggcuggccacuccacggcagagucaccacccccguuuugucuccggggcgugcccacugcaggccuggccggcuugugggucgccgccgcggccuaaagcucugagcccccagccgcggcaaugcugggaauuucaaugccgcuaucgacugcacgcccuaauccgugaaggugggcgcccgauccugagauuucaaguuugauuuaggaaauaucccaucauuaaaccaaaacucuugcuuuccauccccaccggaggcggugggaggauccuugcagagagaaaagagguuagcgccgggaccgggagaagggguaggggucgcgcaaggaagguucuccacagacaaaaacgccaauacagaaacuucucgaagagcucuccaaaaguuccuagggccuccgucccccggcgcccugcuccucccccauucccagccgccuggggcgcgggccugcuucaccgauuuguggcggcucccuacccuuccagugcccccgggcugccacccuucagcccccggagccagcccgccauuuuuaguaagggauucgcacacggacccgggggcggcguuaaguggcuaaucucuggguuugguccugcuggguugggggcugccucgcccccgcaaggcagcgagguggccucuggagacucuguuaggacgcacucccucgcuccccacccccacgccggcugcuagcucccucccuaagcugcugaaaguggccgggagucgagaggugcgagcuguaaaaggggcccgggcacaggggagcucccggagccagccucggcccaggucccgcgccucagccuggggacaggcucggaggggcgggaggcgggaggggcgagcugacccugcacucacccaguccccgcgccucucgcucccccgcccggcgcgagcaggagggggcgggcagggacucgcggcgcuccggcucccgccccugccccgccccgccccgcgcgcgggauccgcgggggugggcggccucgcccguaaggcgcccaggcgauuggcgacucggggaagagacgcggggaaaagucgaauaagagggcgcgacgucagacccgagauuuggggaaaggcgagggaggggguggaagggcggggauggacagacagacaccgacacacaccccccgcgcggcacccuaaguguccacaacuuuuggcugccuuacuuagcccagggcgcagaggcuggaaaggucgcggggaguaucgugugaguaaagagagagauuuacaaaauagaaguagugagaaaggaagaagugaagggaacggaccggagagcaaaagcccucgugagaaagggaaagagaaggggagaggagaaaggagaguuucauagcguccagggcagugcaggagcccgaagcagcggaagcgauccuggggggaagaggagugcggagaggggaggggagaggaagggcgaggagggggagugaaaacuagaggagggcgaaggaagcgaggcgcgacacugcuggggagaggagggcagugaggagcgaggagcgggcagaggcagcuccggcggccgagaggagggagcgcggcgcagagaggaggggcuugcgccccguagaaaugucaaucagagcccggagccccgggaaucuccgccaaucuguucggaccugaccuggcuccucgccgccgcccucgccgccgccgucgccgccgcggagcagaucaauaggcgaacgcggagcacagcgcagcgcgggcggcagcgcggccccaagcccggcccagcccccgaugcgcgccggagcccgcgggcggcgcugagcugggcggcccgggggucggccccccucuccguccgugccccgcgggccaccauguccuucccccagcugggauaccaauacauccgcccgcuuuacccguccgagcgcccgggggccgcuggcggcagcggcggcagcgcgggggcccggggcggccugggugccggagccucggagcugaacgccucggggucccuguccaacgugcucucguccguguacggggcgcccuacgccgcggccgcugcggccgccgccgcccaaggcuacggcgccuuccugcccuacgccgcggagcugcccaucuucccgcagcugguaagagcccgcggagccagggaaggagggguuggcgcuggggcgcagggcgagcugagcgcgcgggggccggacuagaggggugcaggccaggaggggggaggcagcgauggcuggggcucacucgcgcucccuccgcgcgugucccuuccuucuccaugugcguacagggcgcgcaguaugagcugaaggacagccccggggugcagcauccggccgcggcugccgcguuuccgcacccgcaccccgccuucuacccguauggccaguaccaguucggggacccgucccgucccaagaacgccaccagggagagcaccagcacgcugaaggccuggcucaacgagcaccgcaagaaccccuaccccaccaagggcgagaagaucaugcuggccaucaucaccaagaugacccucacccagguguccaccugguucgccaacgcgcgccggcgccucaagaaggagaauaagaugacuugggcgccucgcagccgcacugacgaggagggaaacgcuuaugggagcgagcgcgaggaggaagacgaagaggagg

SEQ ID NO: 15725 - RNA, 8596 nt, Homo sapiens
aaaauaccaguguaaggagagccuccugagauccauaaucuggaauugucaggggauaagaauugucugucuuuuugauaaaagaugucagcuacccuucuggguuuuaaacagagagaaauacuucugauuaugagacuggcuguguaucaugaagucuguugaaagaauucaugugugcaauaaaugugcuugccuugcccaucaauguccuuaaaauuuccuuaucagaaggaaauucaacuaaaucagaggcacgaaaaguacacaacucuagaguggcuuguuuuugucugagagcuugcuucgugaagcuguaguuuccugauuacuauucagcucaaaaagccuucaaagaccacuccagaauuuggcaauuauuauuuuuuuaaggcuuaggacuaauuagccucaugaaagauuguuuuguugcuuguggucugugguuguuauauggcuuguuuugccuugaaaaaugcugcaauugcuuuauucuuacucaauugaaauucaacaggggaaaaaauagcccaauuaggaaucaucagcagacugccgcacacaucauaagccccaaauaaauaaauauuuauugaaugagugaaugagugacugaauauuaaacagccucacugacuagggcacacuaaagauccaaaauaagaauuuaaauagccaucaacaccuguugaucaaggcaagcuagaggacuuggucuuauuaauacuggucaaacucucaaaugaccuucagaauauugugaaaggccaguuauucaaucaacaaacauucauggaguguucgcuguccuccagucugcuugcuaggugcugggggcgcagcagggagcagaauaccacagucccugaccaccugcagcuccuacucuagugggggaaggcagacaaaauacaaguacacaaacuaaagaaagaauuuagguuuaacucaauacugcaaucgagguugacaggaguuaaccugcucugguuagggaagucugugaggccacucugaggaggugucauuuagucugagcccuggaguaugagacugcaucagccagccaggcuccauggcucuugccuauaauccuagcacuuugggaggcagaggugggaaucucgcuugaggccagaaguucgaggccagccugggcaacauagagagacccuguaucuacaaaaaauaguaaaaauuagccaggcauggcggcucaugccaguagucccagcuacucaagaggcugaggcaggaggaucacuugaguccaggaguuagaggcugcagugagcuauaauuguaccacugcacuccagccuggacaacagagugagacccugucucuaaaaaaauaacaaaaaaguaaauauaaauaaauaaauaauguuuuuuaaaaagagaacacaucagccacgcgagauuguggguguuuguggcauaggaaggaaaugaugcucagaauggauuuguuuccugaggcuacuggaaacuaccagaaacuuuguggcuuagaaaugacagaaauuucuucucuuacaauuugguaaaccagaaguccaaaauuaguauccccagacugaaauuauggugucugcagggccacacuccaggggaggcuuucccucucuugcuccuccagcucugguggcugccagcguuccuuggcuugugacggcaucgcucccguuucugccuccaucuucaccuccucaucucugugugugugucuucuucugagcccucucagaaguaccuugaaugucuauuacuucugccaacagccugauugagacaaucuagcguuuuuucccucaugcgccuuaaaauucuuccuguuucuauccauucuucaauuccaaagccacugccacaguuuucagccagugucacgggggcaucucacuuucuuuagccagcugaaaaucucaucaguuauuaagauguuugucauacagucagacuuggcuaucuggcaggcucaggggccaugugauuagaggcuaugggauguauuccuucuuugcaccaauuucuuuuuuaucuuaaccauuuugucuggcaauacaccugcaauguacucuguuguucaguauuguauuuucuuuucuuuuuuuuuguuuuuugagauggagucuugcucugcccccagacuuuagugcaguggcaugaucucagcucacugcagccuccaccucccggguucaagccauucuccugcuucagccucccgaguagcugagacuacaggugcgcgccaccacgccaagcuaauuuuuguauuuuuacuagagacggcauuuuaccauguuggccaggauggucucggucuccugaccucaugauucacccaccucagccucccaaagugcugggauuacaggcaugagccaccgcgcccggcccaguauuguauuuucuaaaacaaauaaugcuuacuauaauuuuaucuuuucuggcuagcccuggggucaugaggauaaacuucuguuauugcaggagagcaaaaccugguccaaagacaacggagugugaugcuggugaccacacacuaaacauucccccauguuagcuuuugugccuaaaagucgagguuuuccccacauugcuuggcucauucacuccuuuugcccuugggucuucuccuaggcuccgugccagauuguaacacccagagucuuagccucuugaguuucuguguuggaaacauccagcccuuacuugaaauucugcccugaaaaaaggagguuaggccgcugugaucuuugccaaacacaaauggguaggucaccgccccacccccacaugcuuaaaaucauguaaugguuucccauugcuuuugggauaaaguccaucacuuuacauggugcuggcauugucaacauggcccagccuaguguggucaaagcggaccucuccagacccaccccuaacucuguccuccagccaccccucaagucuucacgccucuucagucccucaugucugcgaugcucucuucugccacggauccuuugcacuugcgguucccuuugcugggaauguucucuuccugucgcucccuugucuggugagcucuucucaugcuucaggucucagccccagugucuccuuccuggggaagccuuuucugacuuugcugaccagggauuuuugcccuacaggcucccaaagcacuggguugcucuccucgccaguucucacggaagaugaacacauuuugcccuuguugacgugcugcuguaacugccuccuugucgccuggaucauuugcuccugagaggcugcaucuguucuauucauugccgugucccggugcauugcagagugccugcuccacacgggcugaaugaguggaugaguuagugaaugaacaaccugcuaaaguccuagaucaccaaggaaaaugaugaccucaggccaggcgcgguggcucacacacaggacaguuccuguuggggggaacacaggacuuccauggccucacucacauccacaguugucaggacguggacuccagucucuggcuauguggguccccaugccauggugugaccuucagaauuuauuuaaccuccagugcuuuuguuuccucaucugaaaaaugggcuuuuugaaaagaaguuccuaucuccuaggaucgaugauaagauuaaaugaguugauacaggcaaauacuucaaacggggccacauaaauagcaugagugcugcagguguagccgucgcuauuacuggugguguugacaugcuguaaauaccaucuccccuuaagcauuggaauggucaaggcauaagaugaauggauuaauccaguuuucuggguugggccagaugaaggggcaaucaaucccuguacauaucaauuuucaaauaaugcacuaucauaaaauaacaugcaagcuggagggaauagaaucaaccucuuuggugagucagaaugauguuucagacccaacaaggcucagggauccccugggagucccugaugcaggcagcaccacgugagguuaacauugcagaaccuggaaccgggcucaccuggguucaaauccuggugcugccucuuucuggcuccccugcacacuuccaugauccccucucuguucucaucuggaaaaugggaauaauauuagggccauugugaggacuuaaucagauaauugacuuaaaagccuucagccucugucucagcacagaguaaguacuugacaaaugauugcuucuauuuguuaggauuggacagaauucaacacugcaaggcacaggggccacccuccuagauccucaauggcugacgauguacaagaugcaugcuggauccuguaggguuuuuaacuaaaacccugauguccucuuauacuucugcuacuugucuuguucuuaaaaaccaagaacuagcaaauacugggugacaggcgucagcuugcugccuggguucugcccuaacaggaguugacaauauugcagcaaaucaacacuacacgcuuuggacaaaacagcagcccugccuugcuacuguaaagggcauuugucauguuguuugcaguagggggaugguuuccccucuccuucuggacuugcaccuaauuccgaccggaguguguaccagcugccugccccagacuggcccagcagucaucuaucuagaugagaagcaauuucauaaauucaaacggggcacauuuccuaugcaauuuauuuagcuuaacaaguuaaucagaguccacgagcccaauuugucacugugcuauuuucuuuugcuggcugcucuaauuguauaaauaugcccagagguuugacgaaacuucuaacacaucaaacaauaaauggcccacuuacagaguguacuguggcuauuuugaagcaaggcuuuuccccucuugaagcuggcagcuccuacccaucuaacagccuggcaccaugcuggcagcuccugcccaucuaauacccuggcaccauuugguuacuggucuuuugcuuuuuuuuuuuuuucuuuuuugagacagggucuuguuuugucacccacacuggagugcaguagugcaauccacagccucaaacuccugggcuccagagauccuccuaccuccaccucccaaguagcugggacuacaguugugcaucauuaugcuuggcuaauuuuauaaauuuuuuaauagacagggucucacuauguugcccaggcuucucucaaacucccgggcucaagugauccuccaacccugaccucccaaagugcugggauuacaggcaugagccguuuugcccagcgugguccuuuggauucacucgcagcacccaggaccugaacggcagcaaacagggaauggugggcaagguggaaagaugccgcaaaaugcagcugucucugacuccuggucuaauuccagaaaacaccacaucguauccuccaccaggucuucucccucuuugggauuaggcaaaagggcaaauggccagacuugggggcucaagagcuugcuuucucugagacgugggccucuucugucaaauucgcaucugaacugcuuucagugccugauuuaugaagaggcaggcagcgaggcuguucggcuggucccuggaaaccgaucauaaaucugaggcguguaucacaggugguagacuucucugagcugauggccaagagaagcguaggaaaccgagacgaaugugucugcauugaguccuggaagugugcguuuccaggauuuccuuuuuauucauuuugaauucccuccucuuggauuuaaaccuucugucuccucuguguucacgugaacauuucaaccuaucaauuucauuuuaauaaaggagguguccagcgaggagauaaaacguuuuuuaagacagaaaacuucugcccccccaccccacccccauuuuucacacauuuuguccccagucgcagauguuuccucugccuuaucggugugcugaaaagaaaugcaauacgcugggcuuucaaauuuuccgccacggaaacaaaagacaacaggaggggagaggggccuugcuuaaccuggagccaggauaggcuaaggggaaauggaaaaaggccggugccgugggagcagaguuggcagagccaaugccacagauccuguuuccuugguucagugcugaaaagcagucaaguaacaagugcuccacccuccuguccagcgccaccgcggauauagcccugaugucaccuuccuuaugaucucagggcuccagcuucaggcugaguugggauugugcacaggggcccaguagacagcccccucccagucuucucucugcucuucugcuguacucgcugggaauuuccacguccccaugauguuaauugcaugcuuccugagccauagcccuuucuaucauguccaggaagucagugaccaaguccucugccccacccugccccacuagcucagguguaaccuaacucucaaagcacuuuauuuagaauuuuaacuugaaugugcacagugggcccccuugugaugcccacagccugcacccaggugugugaacugugucacuaaucaugcaggccucaagacauucugaggaggccauugccacaugccagccagcaacuacaucgcccucuugccaaaccccccuaaauggguauccagaguguccccucuuaucuggcagcuaccaccaccuuaguucccaccuucaccucucucagucuccagcaugggcaaauguuuuauuuuaauauuauacuuagauguuuauuuuaauggauaauagaaaauaaauugggguggugcaucguggcucaugccuguaaucucagcacuuugggagguugagauagauagaucauuugagcacaggaguuugagaccagccugggcaauguagggaggucuuaucacuacaaaaaaaaaaauguuuuuaauuaguucaaugucauggugcaugccuguggucccaguuacucaggaggcugaggugaaaggauugcuugagcccaggaggucgaggcugcagugggcugagauugugccaaugcacuccagccugggugacagagugagacucugucucaaaaaaaaaaaaaaaggaagaaaauaaguugcuuuuucauuuuauaguaguaauauaaagcuaucuuuucaaguaaacauaucuaaauaaagaaguaaguucauugcgccgggcauggaggccgaggcgggcagauccccugaggucaggaguuugagaccagccuggccaacauggcaaaaccccaucucuacuaaaaauacaaaaauuagcuggcuuguagucccagcuacuaggggggcugaggcaggagaauugcuugaacccaggggguagagguugcagugacccaacaucgugccacugcacuccagccugggugacagagugagauuccaccucaggaaaaaaaaaaaaaaaaaaaagaaguaaguucauuuacauuuugaaaaguuaagacaggcagcuuguagcaugcagauagggcaaaacaagggccacaugaugugcuggucgaggacucgagccugagucugaagcccagcucuguaacuggcuagcugugugaccuugggcaaguuccuuaaccucucucuguuccuccuaggguugcagugagguuuaggugaguuacugcuggacugagcagggugagugucgcacaguguugccgccucaccacuggggagcuccagacuaucacaccaggcuuccccgcgccuccuggagggaugguucuaaaagcugacccugaucuugucauuucucugcuguaaacucuccccacgaggaagucugaaccucucacaauggcccccaggggcuucugugaucugucuccagucgauuucuacaacuugcucugccauuugucauuuguacucaauaaugccgcaaugccaggcucaugacugccccccagaugcaccucgcucguucaggcuccugugcagucccaugcuacacccucugucaguccugccucucccucgucuuguccauugaugggcaaacuucuccuccuguguccaggcuuguucaaauaucaguuccccaagauaccuuccuugauucuuccuccauggaugggguuaggcacugaaacagcagaaaugugcuaccugugccuccauuuaaaaucacaaagcuaaaacuagguaaaauuccagguuauuuuuuaaaauuaugaacaaaaugauuagaggccaagcaugguggcucacgccuguaauccuaacacugggaggccaaggcaggugaaucacuuaaggucaggaguuuaagaccagccuggccaacauggugaagccccaucucuauuaaaaaaaaauaauaauaauaauaauaauuagccaggugugguggugcauucuugcaaucccagcuacuugggaggcugaggcgagaggaucacuugaacccaggaggcagagguugcaaugagccaagaucaugccacuacacuccagccuggaugacagagcaagacugcaucucaaaaauaaauaaaaaaauaaacaaguuaugaacaaaauaucauguuaauagcgaaaaaggguuugacuuaagauuucaacuugauaaaugaauagaaaauuacuuca

SEQ ID NO: 15726 - RNA, 3120 nt, Homo sapiens
auauaaauuucuuuaagguuuaucuaaauauuaaucuauauggaagguaauaucuuaauagaucuuuaaaaacaacagcuuaauauaucuuaucauaaaauaauucuuaaaacaagacauagaauuucuaaaugacauguuaaauacaguuuacaaauuauuuuugccaaagaccauuuuuuuuccagcccaaagaacagcuauauuucaaaauaaaaaagucaaaauuggccuagcgugguggcucacaccuguaaucccagcacuuugggaggccaaggcggguggaucaugaggucaggagaucaagaccagccuggccaauauaguaaaaucucuucuguacuaaaaauacaaaaauuagccaggcauaguggugcacgccugcaaucccagguacucaggaggcugaggcgggagaauugcuggaaccggggaggcagagguugcagugagccaagacugugcuacacuccagccugggugacagagcaagacucugucuuaaaaaaaaaaaaaaaaaaaaaaaaaaagucaaaauaaagaaaacuugugcuuugaauacaaguggcacagauauuuuuuauauuaagaaauggauccgaauuuauuccaaaacacuuauguaucuaguuuugaaaaauaauaauuucggcugggcgcgguggcucacgccuguaaucccagcacuuugggaggccgaggcgggcggaucacaaggucaggagaucgagaccaucuuggcuaacacggugaaaccccgucucuacuaaaaauacaaaaaauuagccgggcgcgguggcgggcgccuguagucccagcuacucgggaggcugaggcaggagaauggcgugaaccugggaggcggagcuugcagugagccaagauugugccacugcaauccggccugggcuaaagagcagggcuccgucugaaaaaaaaaaaaaaaagaaaagaaaaauaauaauuucauuaacugacuucuaauauguggccaaaccacaaccaaacaaaacaacacccaguucucuaaaaacaugagacggucauaauuaaagucacuaucuuuaguaucaggguccccaguuauugcacgcagcuaaccaguuggaguuggucaucaaaucccagacagccuccacccaucuccagcugcagcagcaggaugacgacuagcugaagauggugagacuuugaccccucaggaucacaugcccauuaaguuccccuccuugugaccugacacucccuguacucacagggguuggcagccccaaucuacacagucagaacuaagucuuaccuauuauccaccaacaccaguacgugaagccagugagaaaacuccaccaaccuuggaagcagaggaucuaagcucaaacuugagaaugcgaacagcggugggaucuaggaugggucacuucacacgucugcaccccugaucuccuggcucugacaugggggacaaugcaaucucugcauuguucucaagguccaaugagaaaagacgaaguugcugcagaagcuguaaagcagcauguaaauauaagauacccaaggcuuccaggcuaacgcucaccugccauuuaacaaagcauuucucaugugacugugcaaagugccuaaaguaaaaaauauaugcagucaauccauaauaaugugccuaaagaaagagguuagaaucauuguggacucugcaguuuucacuagagaugcuguuuuagaauuaaggcuuuagcccaagugcggugccccaugccuguaaucccagcacuuugggaggcugaggcgggcggauuacuugaggucaggaguucaagaucagccuggucaacagggugaaacccugucucuacuaaaaauacaaaaaauagccaggcaugguggcacgcgccuguaaucccagcuacuugggaagcugaggcaugagaaucgcuugaauccaggagauggagguugcagugagccaagaucguaccauugcacuccagccugggcgacagagcaagacucugucucaaaaaauaaauaaauaaauaaaauuuaaaaaucagggcuuuagacuuuagcuuuagucccaauaaauugcaagucaaaagaagauauguuuagaguuuauuaaaaaaaaaaaaaggaccaaugggauaaagaagacaaggggaauuuacaggagauuaucucaauauaggugucauuuaauaaacuauaaacuuaaaaugaggccuguuuuaauuuuauuuucuaagguguauucaaauacucaaauauuucccuuaguucccagacucaaggcccgauggcuccccuauccuggcuagaaucagccucugaagaacucugcgaaguggagaaggaugucagaggagggaguuagagcagaugucccucauuuuaacacccaauuggcuaaaauacacagagaacugagaaaagacuugcuugcaaguuaauauacaacuguggcaucuggcccauuagugggcucuggaagcccuuuuucaugcuggcuguauucuacuuagcuccacuaccuggucuccaaguccgcaggagcauaaaagcagaauuuugaagggcaggucgaggccugcagguagggccaacgagaaauacagcugacagcaauugaagacacagaaagcuucugagaaaugccaaugagaacuaaacagaaaacaaaaaaccaaaacaacuaaaaacgaaaaggccgaguccuuucaugagaacugaguuauacaguccaauucuuacugaugacgaugaguuauuaccaaaguuaaaugagacuugauaugcuuucaagaugagacgggaaaguauaauccauuuuagaaagauuuccaucacaaauaguuaauguuaauuccuaaaacugggcuaucuugaauaacccauucccugaggguuccagauuagcaucauuucacuguaguuagauaguuuuaugguuaauguacugugguauaaauaaauauagcuuagccugucuccacugaaaauauguguuccauaaaacaacaaguaaaauaggucaauaagcaacccauaguaaauaauucaagcauaaaaguacauaacauuagaaugaaccaagauaaaccaguccucuucaaaauugac

SEQ ID NO: 15727 - RNA, 3642 nt, Homo sapiens
caguccucccaccgacuacaccccgggaaggaggagcuucgggcgcgcacaaggcgucagaauccucaauuuccaacuuagcaucuuggcaggaccuuugcaaaggcaaaagcagagccccccggugcaaagagcgaggggaaaaaagagaaagcagcaagggaggggaggggaggggaaaaaaagcccagcuggggcgagcgaggcgcgcagaggagcgggcgcggcggucgcagccggaggcgcgcgggaagccagcgaggaggcgccgcgggccggagccccggagccggggccagaggagcggcggcccagggcagccagaggccaggugcccgcccgcucgcccucgcagggcgccgcccggcucguuggcggccgcggcgcggcgcgccccaugcccguguguggccauguccuauccgcagggcuacuuguaccagccguccgccucgcuggcgcucuacucgugcccggcguacagcaccagcgucauuucggggccccgcacggaugagcucggccgcucuucuucgggcuccgcguucucgcccuacgcuggcucgacugccuucacggcgcccucgccgggcuacaacucgcaccuccaguacggcgccgaccccgcggccgccgccgccgccgccuucuccucguacgugguaagugagcgggauccgcggcgggcgaggggcagcaggggccgggcgggaggacgggggcggagggggacacgggccuaggcgccaacaccgaccucccccgccaagcuucgcggccccuucaaacuugggcgauugucuccgccagcuucgcccaggccuuggacucaagaguugcucgcaaaagagagccgcgucuugcucggaucgcugagcuggcgggaagggguucuguggggagagguagcugcaauuaaagagcagcauuugguguaaacguaagcuccgggcugcccugcaaauuuuauauuuuugguuuugccauuuuggaaaaguaguucaaaagaaauagacucgaaauuugagcagaagcgugcuaagucuauguaaauguguuuggccuagccuuuaauuaguccuccaaaauguugcaaauccguaauccuaucuucgcaauccgauuugggaguauuaaauuucugaaaagucggucgagcugcggugcauccgggauuuuucggccggguuguaacuucggucugggguaguauuuuuggagggugggagugcgugggcauggcucagcuuuuuguuugcauuucuuagcuguugaaaaaagaaaaaaagagccuugacuucccuuguuuuccccccuugcgcccaacgugcguccgcucccccgccgagcgcggagucgccucaguugcccaggccucuaucugcauggagggccgggccgccguggccagaucugcgcacgggguacggacgugcccgggcagaugggggccuacggggugacaccgaggccgggacagcuucaggggccccagaaggaccugacccagaaauugagguccccgcugccuucugaggagggggaggaguugcuccuaggucugaaccccgccagccuugccccguaggaagcuggagugcgggccucguccacccacagaccccggggagcgcagggaaaagggugcuucggucguuccgauggcaguggagaccacgguccacacucaccucucugcgucuccaccgcagggcucucccuacgaccacacacccggcauggcgggcuccuugggguaccauccuuacgcggcgccccugggaucguacccuuacggggacccagcguaccggaagaacgccacaagggacgccacggcuacccucaaggccuggcucaacgagcaccgcaagaaccccuaccccaccaagggcgagaagaucaugcuggccaucaucaccaagaugacccucacccagguguccaccugguucgccaacgcgcgccggcgccucaagaaagagaauaaaaugacguggacgccgcggaaccgcagcgaggacgaggaagaggaggagaacauugaccuggagaagaacgacgaggacgagccccagaagcccgaggacaagggcgaccccgagggccccgaagcagguugguggacaugggaaagggcguguugggcgggaguaaaaaggaaaagagaggccuggagggggcgcgcacggggccuggagguugggggcaggggucccugccuuugcgggcgggaaccgggucccgccgcgcggccucugcgccccugacagccuggguuucgcccgcaggaggagcugagcagaaggcggcuucgggcugcgaacggcuucagggaccacccaccccugcaggcaaggagacggagggcagccucagcgacucggauuuuaaggagccgcccucggagggccgccucgacgcgcugcagggccccccccgcaccggcgggcccuccccggcugggccagcggcggcgcggcuggcggaggacccggccccucacuaccccgccggagcgccggcgcccggcccgcauccagccgcgggcgaggugccuccgggucccggcgggcccucgguuauccauucgccgccuccgccgccgccuccugcggugcucgccaagcccaaacuguggucuuuggcagagaucgccacaucgucggacaaggucaaggacgggggcggcgggaacgagggcucuccaugcccaccgugucccgggcccauagccgggcaagcccuaggaggcagccgggcgucgccggccccggcgccgucacgcucgcccucggcgcaguguccuuuuccaggcgggacggugcugucccggccucucuacuacaccgcgcccuucuaucccggcuacacgaacuauggcuccuucggacaccuucauggccacccggggcccgggccaggccccacaaccgguccggggucucauuucaauggauuaaaccagaccguguugaaccgagcggacgcuuuggcuaaagacccgaaaauguugcggagccagucucagcuagaccugugcaaagacucucccuaugaauugaagaaagguauguccgacauuuaacgcgggcugcgucggucccggacuuuucuaauuuauuaaaaacauggccuuggcaguuauuuuuccaucaccgagagagagagacagagagagaaaauaaacuaccccuccuauucagaaguuuauaguuuauggagauggaugacauaaaaauguaaacaucuccacacaaaaaaaaaaaugucuuaaccaaccgaaaagaaaaauuaaaaaaggauuuguauuaaaucuuauucuguauauuuaauguagcauuuuuguauuuaaauugauaauucaauaucuuugaaguaaauuaugaaaucaagacaccuguacaggcauuuaauguuuuuuuguaauauaaauauauacauuuguguuucccccaaaacuguuucauaguuaaaaaauacaaguuuaauuuaauuuuuuacaccuauugauucugcuggguaugagcuaaaguauuacagaaaggaaacagguuauacucuuagauuuaaaaagugaaagaaacugcaggcgccuuuguaaaaugcaaaauauuuaauuaaaagagauuuuaacauaau

SEQ ID NO: 15728 - RNA, 27123 nt, Homo sapiens
cccccgcccccagccccgcucugccagcucccucccagcccagccggcuacaucuggcggcugcccucccuuguuuccgcugcauccagacuuccucaggcgguggcuggaggcugcgcaucuggggcuuuaaacauacaaagggauugccaggaccugcggcggcggcggcggcggcgggggcuggggcgcgggggccggaccaugagccgcugagccgggcaaaccccaggccaccgagccagcggacccucggagcgcagcccugcgccgcggagcaggcuccaaccaggcggcgaggcggccacacgcaccgagccagcgacccccgggcgacgcgcggggccagggagcgcuacgauggaggcgcuaauggcccggggcgcgcucacggguccccugagggcgcucugucuccugggcugccugcugagccacgccgccgccgcgccgucgcccaucaucaaguuccccggcgaugucgcccccaaaacggacaaagaguuggcaguggugaguugcugcgcuggccucaaggaaccacguuuagacaaacuucggaggcaaaggaugggggugucucucccccugcccucggcggugggcacacagcgugggggaggggcuucgguaaacagcuuggggggucuuuggcaagcuauuggagugaucucuugcaaacggugggggaucuuuuguaagcaaagaaaaccuuugauaaacaauuuggcaaccuucagcauacagcaguggggcgaaaaacaagccagagagugggagaggggugaccuggcaaacuacuggaaagggacucuuauguaaauagcggggacauccucuaguaucugggacauuuggcggggggggggggcggucuuuguaaacaacuuuuggacacaucugggcaguugcuaagggcucuugccaagcgucuagguaagccuuuggcaaacagcuacaggggucguuuuugcuaauguaggacuuugggaacggugcucuggcacacaauuuggguaaacuuaugcgcgcauaaggaugggagggagcuuggucaaagcggggcuuggcaaauuucuaggaaccuucggcacagauccggagagggaccuuuaaacaaacagcucgagggggccauuugggaagugauuggggcaggagggaagcagagagcgcaucuuuuuucuccuggcuuaauggacaaauuggucaagggcugggccucggaaaguuuccucgaacuucuccaaagggucggagaaaagaaggagagagcuggcccggcaggagggaggaggaguggggcaggcgcuggagggcccggcgcguggggcgggggcggacugcgcuccgcucgggucggagagcggccagagagcccuccuuccuggcugggcucccaaaccgcgguucagauguugucuugugagcgugcgcgcgccuggcuggaggggcacugagccuggccgcaguguugcguaaguagggccugaggagagaggcaggccagggacccaucaagauguccuuuccaguccaggggauaucugcucccuuguugcuucagccacccugcccuccagccucccccucaaccuguccgggagaagacgcccaugcccucuggucacccuaggaacuccuucaggaggugacaacuacccucucccaacucucacccuuccaaacagcuaggucucagcccccucuggauagauggguugggaaaccuccauacauuuuuagagggcuacuuuuuucaaggaucuggagcuggcuggcauaaugauguggcuguugggugggggugagaguggagcuuugggacaaugacaaagcuacuugguuuccuacaccuuuuccagccaaugggucacaggaugaaccccuaaauugggguucagccugggggccacauggguucuuggcuugcacaggaaggaauucaagagcgagccaacagaguaaagugaaaacaaauuuauuaagaagguaaaggaauaaaagggugauuauuccauagacagagcagggaaugggcugcuggacugaguauacauaugguuauuucuugauuauaugcuaaacaagggguggauuauuuaagaguuuuccagaaaaaggguggggaguuccuggaaccgaggguuucucucccuuuuagaccauauaggguaacuucucaauguugcuauggcauuuauaaacugucacagcgcuggugggagugucuaauguauuuaacaugcuaauacauuauaauuagcauauaaugagcagugaggacgacuagaggucacuuucauugcagucuugguuugggugggcuuucuccagcuucuuuacugcauccuguuuuaucauaggggucuuugugacccgaacuguauauggugaaaucaguccuaccaaccuccugucucauucugugacuaagaaugcaugccugcccuccugggaaugaagcacagcaggucucagccucaucuuacccagccccccacucaagauggaggugccugguuugaacaccucugacaaauggaagucuguguuguccagaggcaaugcagugggggcuuaagaagauaacucuggacuuagaccgcuuggcuucaaaucaaagagugcaugaaccaaccagcuggccuagugaugauguuaggcaagugacuucucaguuucuucaucugcaaacugggaaauuuccuaucucaggguuaaaagagagguaaucuuaggugcuuaccuagcacaugguaaguacucaauaagcacuagccauuauucuauuauauuauuauuauuguuauguccuccauuuccccuuuccuaacuacuuccaacaaggcuaggaccguugucagaagaucuccuggcuccuuucaacauucuaacacaguacuuaucacauacuucauuuuguuuuauuugggaucuaucagccucccugcuaggauuugaaccuuagagacagaauugucuaucuuuuucaccuguuuuuccucagcaguagcacugggcuugguacaugguagguauuaaaaaguauuuguugaauaaauaaaugagucgguugcucccugaaccucugcagggaccugcucaguuugggccucaguuugggcagggccaguuguaugacucaugaaggacaggacuacuuucuuuuugcaaauggcugauucaggauuuaaacccaggucugucuacugccagagcccaugcacauaguccuugaaucucuuuagaagaaaacaggaggaaaaaaguccccaagucaccagccgcaagguagauaaaugaguugauagagguaaaggaaggaugcuggaguauaaugauuccauaucacagccucuggagccagauugcuuugucccaaauccagaucuaccauuugugaacugugugaucguaagcaaguuucuuaaccucucugugcuucaguuuccuccucuguauaauaggguuaguauaucuacauuacagaguuuugagcauuaaaugaguuaacauauucugacuuuagugccuggacauauagucagcacccagcaccaacaagugguagccaugcucucuauagcuguauguccugucgcucaacuaaugggugaccgugcugguuugggaacccaguacuccacccagugcucugggaccccuggcuuauuuccugucuggacuauggcacuggguuggggggcugauugcuacagccugcuuuggucaguacugugccauccuaauguggcuaauugccuugggggugugcauuucuuucagcaauaccugaacaccuucuauggcugccccaaggagagcugcaaccuguuugugcugaaggacacacuaaagaagaugcagaaguucuuuggacugccccagacaggugaucuugaccagaauaccaucgagaccaugcggaagccacgcugcggcaacccagauguggccaacuacaacuucuucccucgcaagcccaagugggacaagaaccagaucacauacaggugccggggcagggcuuggggaggcagggccauggggcugagggacacgagucuccuugacccaugcauucucuccacucaggggauccaugaggugucuuuugugaaggcuugacaucuuagggaguuucaauacacaguucuuagaaaaugaagucagacagacuugaguuucauacuugcuggccaugagacauuggguuacuuuucagugcugugaauguuggcuuuccaaucuacaaaauggggcuuaaaaaaugcccuuauaugguauguuggggaacuaagcuaggcugaacuaauacaaacggcuucuaugauuuuugacacagagcaagaguguaguaaugcuagucauuguuauuguuuuuagaugaggucauugggaugggcagaaggaacgugaugauugguagcuaauuggguuuagcagcccaauuggguuauaacugguugcuaauugggccaagagcugugcucuguauggguggugcuggguuccaauggugggaucuuugcccugugccccauaaugcacuacuuauggcccucccccaccagccagaagugacagauggaacuccugagcuggggccuaaaaauguuggcuggccugggacucccugggucuucaaggcauucugggaggguuguccuuggcagugagcccugcccagccuacacacacauacacgcaggcacaugcucacauauacauacacauaccugugcacccuucccgugcuugugcauauacuuguauguucacauacacacacacacucaaacuuuuucauacaucugugcacacacacauacuugcauauacauacacuuaugcacaugcauacacacucacaugcaguucuaccaccuccaggaucauuggcuacacaccugaucuggacccagagacaguggaugaugccuuugcucgugccuuccaagucuggagcgaugugaccccacugcgguuuucucgaauccaugauggagaggcagacaucaugaucaacuuuggccgcugggguaggcagaagauggggcagaagaggggccagcagggaucaguguugagacgagggggugagauggacauuagaggggcguggggauccuaagggcggcuuagauaggacaguagauggugugggcccugggggugguuuagaugggggcagcacaacacggaguggacacuggagagccacguugacaugggggcagaugguguguugugguauaaccuggaggccgucuaaacccgaagcaaguggucuacugugcuguccaauauggcagccauuaggcagaauauacauggcuguuuaaauuuaaauuaguuaaaaauuuuaaauuaguuuccuggucacacugggcacauuuuaagugcucaaaagacacaggaggcuagugacuauugauuuuggacagcacagacaaagaauauuccucuuaaucacagaaagcucuguuggaugaugcugguagacacugaggaacuguagauauaugagagugguuuggaaacaguggagcaguguagacacuagaggaagggucguagaaccuggggccagguggccaugugaguuuauggugugaacacugccaguagcacagacauaaagguaugugguauagacacugagugguaagugaugaagguaaagagcaggggaaacaauguagacaagugggugggugguacaggccuuggugacaaggugggcaugaggauucauguugcagauauuggugauagugugacaugaaggcaggauugugguuaagagggcaguauugacaggauggaggauggcauagacacuggggaugaugaagauggggugaggacacuagugugguaauguggguaugugguacauauagugucauggugguagaguagacaauggagguagaggguauggauacugggagucauguaaaccugggagagcaguguagaccauaggaugguaacaaccaggucagcagaucucuacugagcuccuguugacaguccuggauaaccccacugggacaagggaaggggacagaugcugggugggcugacaggcuccacauguagaugggguguggagggguuucagggucuagguggcacagcuagacgcuaagacccaguguguguuucagagcauggcgauggauaccccuuugacgguaaggacggacuccuggcucaugccuucgccccaggcacugguguugggggagacucccauuuugaugacgaugagcuauggaccuugggagaaggccaaggugagaaaggggcccucugcaugccccagaccuucucuccuguccucucuccacuccauuugcuuggaccagagaggugggaggggaggaaagucacacaucugggugagucagaaucuuggucuccaaagaaggccuggagaaguccaaccucccccuuccaugucacucuuuagugguccgugugaaguaugggaacgccgauggggaguacugcaaguuccccuucuuguucaauggcaaggaguacaacagcugcacugauaccggccgcagcgauggcuuccucuggugcuccaccaccuacaacuuugagaaggauggcaaguacggcuucuguccccaugaaggugagcauccacucuaguccccaagacuuuccaccccaagccuccagcuucccgggcuccccagugugcucuucccuccacacucuccaggacuggcugccacugccaguuaaugagcaucccuccaacguccuucacucaguucccccccauccugaucugagccauugcuguuucucucccaccaguaccaugaugaacguaguacucuaauuaaaucaaguugauuuuuuuuaaguuucaccauuagcaaucauuuaggaagucacagauuugauuugcuaauuauuuauuucuaauauauauuggagugaacuuagaacuauuacaaugcccagugguucucucuagaaccagucuuuacacuucagucaagauugauacuucaagggcaugaggaaaggcuugcugguagcuggaaaccuagcagugugauagggaggcaggacucagaccagggcuggacucaaccugguuugcguacuccaacugaggaauuucagcuauugcuccugccuugguccugaugcugccucugcuaaugcgugugugugugugugugugugugccugugugugugugugugugugugugugugugugugugugugugucugggcacgggggcuauacuaucugccucucuugggcacugucuuuuucugccuccugucuagcuugugucugcaucucugugucuugauaaagacuuuaggcuugacucaguauuuguguuugugugcuugucagugccugagaugcaacauuucagagauuuugaagccacaugggggaaaucuuuuaaaaugggguacagauauugacauacacacucaauccuuuuuaaaaauauccuugacacacuuaauagucauaaaucacaaaaagacaauguaacuucauacucuaugaagucaucauauuugauaauucugcagauugaaagcccagaaaaccuggcgaaaauggaaaaaagucuaaaaauuuuuaacacuaucuucuuucccaugucacaaagacucuauagucuacauagacuaaagacugucuuuuugucuguaauuuuaugucugugaaucucccuaaccccacuguaacugaaaacuaagcaccaaccaucuugacagaaugaaagaaacaaagagcuaguuaauucccuuccuguuuaugcuuuuacuaccagagcuaaacuuuauauuaaguaagaguuuaagccauucaccauuaauaagucagacauuuugaaauaaaaauauuuuuuguaucuugcguuucccgguagggauuacauguggcguuaacccuucccugugucaccccucugauaggaacagaaagcuuuggugauaguuagauguggaaacagcuguauuucauaaauuugggaaggguuauucccugcauuggacauuagccauuuacuuugugcuuagccagaugcaaguacgcacaacacgcacgugucugggucucgaggcagagauuguuguuacucagccccugcugauggcugagucagugucugauucuugccauccuugucaggggaauuugggaggagacaggggcuuccugggugguagaaaugagaggucagaggcagggggcuggcauuggucgaaguuaacgcuuugccuuucucaacucugaggccacuaagguaucuggacucagucuugccuuuucucuaggugccauuguuucuggcauugcaggacaaggucuuuugguagagaggggaguggugaggauacagggccucgaguucuguggugggaggccagggacugggcuccauuccggccaugguggaguuaacgggggcuggugaggucaccucuggcgccguugugcacagaugguccuuguuauggacuugugguuuugcugguuggcaauuccagagacaccauuuuuuagcuuuggguggaugaggggaggauggggagaauccaagacagacaggccaggcucugaaccccacucccucccccaacucuccauuuauggccccugucuugaagaugucaaaguaggagcccagaguguuuaguaaaagggaccugaaggcaccaccucccucucccucccuccuccucuucauucuuucucuccuuccuacagagacugcaacaaggccauccaggaaggggccugggguugacaggagguaaagcaagcuuucuguguaugcgugugcacgcacacacacauauaugagagugacagacuaagcaagagagauugagauuaguguguuuuguaguuuuuaguuacaaccuucauucacuucuuucauuucugugaccaugagcaguuugagaaccaucuuuguccuagccuugauuucuccaccuaucaaauggagagagauucucgugguccugccugccaugacugauauauucaugucauacaucauuauuacaugaaauuugcaugguacagguguggaccaggcagaauggacagugcccuuggggcugaggcaggguucuagaagcccuugcugugugccaggugucaaucauuuuguuguugggugguccacaaggucccacgggagggauugggauaaccagggaagcagggguucucucugggagcucagagaagcagcuccuuaccaaccaguagagauguuuucuuaauauuuuaacaaugcaucaacuucacuggugugaaccggcaggugggcagccagccagcccugugcccauggaagcaugucucauucacauccuucccucucucccccacccuuagcccuguucaccaugggcggcaacgcugaaggacagcccugcaaguuuccauuccgcuuccagggcacauccuaugacagcugcaccacugagggccgcacggauggcuaccgcuggugcggcaccacugaggacuacgaccgcgacaagaaguauggcuucugcccugagaccggugggugccacucccucucccucccucagggcccagcaccugcugucugacaaaaaaaaaacccauaagacuccgagugcccaccuccuuuccccaagacaggggugcuaagacaucugugcgaaugacauccacaccaagauguccguguagcuagucaggauacuugucaccugguauggccugggcacugaaaucagaacagacauugggcaucaacaguugaauuggugacacuuaaaugucaggccugcucaggauccucugaccgaccugcaucccuuuucucucaggcucucuggcagagacuucucucuccuccucucugacccugcaaucucucuucccugccuuuccuggucuguaucuccaccuuuuagucuguuuuuuauuaagagcuccgugcuuuccucccugucuccuuccugcccuccucucuaucccucccuccuuuccuucuucccuuccuccaacaggaauuuacugagcgccugcuuugugcagcauacacagagguuggucucugcaaagcccugcccaagggggcucacagcugaggggcaugugcuggugccaucagcuucauccaacucccuuugccccuagcccaucugcccccuuccaugggaggcucauuagaacucuggaaucuggcuuccuggguuugaauugcagcucugauacuuccuagcaguguuggcuuagggaaauuucaucaucucucugaucuauuucccauccaugaaacgcggugcuauucagucccuccugcacaaggcuguugucaggggugggugagaugagucuaaagauacagugccugggacugagucuaacuuaggugugguucauuaaggucagcgucaugucauugcuuccuggugguagccucagacucuuugcugcgccuugacccguaucccuaaccccacagccauguccacuguuggugggaacucagaaggugcccccugugucuuccccuucacuuuccugggcaacaaauaugagagcugcaccagcgccggccgcagugacggaaagauguggugugcgaccacagccaacuacgaugaugaccgcaaguggggcuucugcccugaccaagguacgaggcccuggucauuggacagagacccuggacauugcccuugccccuaaacuugcuccaaaaaccuuccugagaccucacccacuucaagcauagacacugccccccagacacccaccuacccagacccgcccaccugggcugagacaaugcccaucucugguggagccaaggucccugcuuagauccugcccauccagguggaggcacagccuccaaaaucagacccugguagaccagaugcugcuacucaccuccuggguaagaacuggccuuccugaggggucacugcucuugucuuccccuucagccacccuccaggcgggcuugugacuaccaaaauuggcugaauucugagcacagauuaccagagagacaauucuccuaagagacauucccacugcacaaagaggugccuucaaggagcugguaggcaguagaagaaaggaaaaaaggaagagccucaugcuugaucugacaccaugguccacgcagcccugggggagcccccagagcccucucucccccaucagucagcaccaucuguuaccaggguguaaaugguggguccucgucaguccugggugcugaggauggagcugacugggacagcucucugcccccuaggacucacaagcucaggggagagagugaccaggagacagcuugugaccuuacuaugugcucagugcagugagcagggugcuuggggcccugugcccaaucuaggcuacagagcccaggguugcaggguugcuuaaagcucccugauggcccauaauggccaggucagugggcagguccagggccugucagaauuaggcaagccugucuuuauguugcuuucauucuuuuuaaucaucaugagauggaacuuggcagaugucaguggacagaggcuggccaaaggagguuuucuuauccccugcuaaauuccuugcuaggacacagucugauuuuaccagcuuaaaggugggauucuccaccuuccugagugguucaaguauccagagcucaguggcucacccagggugaauauuauagucuccuggggcugccaugacaaagugccacaaacugauggcuugaaacaaaccccauguauucuuucaugcuucuggaggcuggaagucuaaaaucacggcgucaguaaggccauguucccucugaaggaugcgucacuccagucuaugccucugucaugacauggauggccuucuucccccucugcuugccucuccuccuuuuuuuuuuuuuugagacggagucuugcucuugcccagcuggagugcaguggcaugaucucggcucacugcaaccucugccuccuggguucaagugauucuccugccuauuuccaaauaaguucacauucacaggucccuaggguuaagacuugggcaaaucuuuucuggggggacgcauuuaaccacaacagggugugacacagguuuugcucgcuggcuguggcucagccugugcaaccacgcuaagugugaaagguuuuuacugcuuucaccugggcagaaaugguggcaacauggggccagccuauccccacucuucuuaccucuucagagaggcugaggagcuggguuuguagagcucaucuuuuauagagagacauaaaaagccaggaagcaggauuuuaaaaugaaugggguuuuaaguagaaaauucgcagauacuacuuguucuguuccuuuauagcacaccuguccugauacugacuuggaaagagacaagaagacuuuggcugaccccacuuggaaacaauaggcacuaaucccaaaauuguguauugaucccagaauucucaggaaaagaaaaaaaaaaucaauacaugccgcuuccaggguucucagccuuacuguggggcuguccucaaaagucugcaucacugggucaggucuugacuucucucucaucucucuuccugucuuucaacccucucuccucccugcaacccucaggguacagccuguuccucguggcagcccacgaguuuggccacgccauggggcuggagcacucccaagacccuggggcccugauggcacccauuuacaccuacaccaagaacuuccgucugucccaggaugacaucaagggcauucaggagcucuaugguaaaccuccgggcggggguuggggguggagggugaggaggggggaggucauguagccugggauggaggcccagggggugggaccagcaagaucucauccagccaggagugcuggagacgagggcaggaaaugggaguguugaccuggucuugggaaggcagagcagcucuccaaggggauacuuggauaacucuucccuauccgaacaaugcuaauauccaugucacucuuagcgcuccauuucuggguuucucccauuuucuaggugaguaaggucaccuggugcaagguuacacagguuugagcaacccaguggaguuuagaauccaggagaauagccaaguacaggacagaauuuuccaucauguggaaugaccuuaacaauacggggguggaaguuucuaguuuucauaauaagcuuugauuuuuaguauguaguagaaacagaacaaccagugccuuaagccaauuauuuauuuauuuauuuauuuauuuauuuauuuauuuauuuauuuauuguugguucuuacagugaggcuagaguuuaaaaagucaguucauuuuuaaaaaauauuuaaugguccaggugauaucugagccaggccaaaauagugaaaguggugcuugagugaugaaguuuggggacugcuagacucaggaaaaagcccaaggucugccgugaggggugcuggguucaaauguggccucugcccuucacuagcugcaagauauuguguaagucuuuauaccucuuuggacucaguuuccucaucucuaaaauaauugcuuaucaugaaaagugccauacugucaguucuggacacaccagcggcccccugaccgcccugacucuugugggcauaagaaucugagcuuuggguuugaauccuugggcaagucacucaacuuuucugggccucaguuuccucaccugugaaauggugcaaucaugauaccccacucccagggcuauagagaggacugauuugggugaugucaguaaaaagcauauauaaaguacaaagggccccaggacuccccaaguccaggcaucuucuuguuaccuuacggagcuuacacuaaggccagaaggcgauuucuucugacucuuagaugguugggugggcaccccugggggcucacccuaguggggagaaccucuggagcugcagagagucuaaggucagguguucuccccaggggccucuccugacauugaccuuggcaccggccccacccccacgcugggcccugucacuccugagaucugcaaacaggacauuguauuugauggcaucgcucagauccguggugagaucuucuucuucaaggaccggugagugcaggagcuugcuucuuguccuccuugucuccuguccucugcucuuauaccauuauucuuuucccucacucuucgcugaagacuccgccaaaugcuucccagaaugaccugaauuaggcaguuucugcuguguaucaaacaaccuccagguuucaguggauuugcacccaagcauuuuguuugcucucucauagucugugggucuacuaguuaucuugacuuucagcuacaguuuggguucaggugugcucugccuguuguucucaugggauuagcagcuacucauggcagaugacagggugcaagaggccaaacugaacuacacaagcucauuuaaagccuccacucacaucuugucugagaauauuccacugccugaaauaagucacauggccaaucccaagaccuacccuagaggguaguacugcaaagucacauggaaaugcauaugaaugcauaauccuaaaaucaaaauggagggaagaauugggaaccauaauucagucuaccacaggccuucuagaauggcguugcccucaaauggccaaauuacucuguguauggguggugagugacugcagaguagaaagaggugguauucuucaugcuauagauaaagaucaccacucaguugacuaaagacugagguuuacccuaaugcccuaguucccuggagaauggcaggcaguaucuaggaccucauuaaagggucuguccuuccauucuucuaucauccauccaucuacccauccauccauccauaccuauaucuuuccauccaucauccauccagccagccagccaucuauuauccauuauuuaugauccagccauccauuauucauuauucauccauuuauucauucauagaguauaguaguugagaaaauggacucugaagccagauucucuggguuagaauucuguaacugcuacuuacugguuauguaaucauagacaaguuaauuaaguaucuucuuuguaccuugguuuccucauuuauaaaauggggcuaauauuccaaccuaucuccuagggcuguuguaaggauuagaugaacuuagugcugagaacaaaaacaaugccugacacagaguaaguguauucauauuagcuauuguuauugacaaauaauuguuuggcaucuacugugccaaauacuuugcuaggcuuuaguagcuggaggaggaagaaugauguucucgggacagugggguggggggcugcuagaucaguguucucaaagacaggcgcaugggccuccuauaacagaaccaucuagaguguggguauuaaaagguggguuuucugccccagcuucagacccuccugacuggaacucuggggcuaggccccaggaaucugcguuuuagcaaauucucccagugauucugaugcacauuaaaguuugugcaucacaaguccaguuugagaaauaggcauggagaacugacauggcaagaugaaagaaaagugaucgcagagguguuaggugcuuuugugagcacgucccagucaaggaaggcuucacagaugcagcagcauuugagcagagccuucaaaggagaagcaagaaucugaugggggugacaaguuaggagguucuuugagacagagggaccugcagagccaagccauagugaugugaaaguuucuggauuagccagugagaaucuggugaggcuagaagauguuccauaaacuuucaggaagaguuuccucuacucuaggcacugggccaaauucuggggugcagaugccuugcccuucacagggucugcuggccaauggggaaauggcaagaaugcaaugagagaugagacuuagaauguagugagaaaucaggucccgucaggccucgaaugcccaaaucaggauauauaacagcagaugucagcacugcucugcaguucccauuguaaggaucuggcaaugugcuucaucuggagcuccucccacuaagaaagcccugaccacacaugcagaucucagauguguggggccuaggaaaggaugcagagcccagacccaggcuggagccaucccuggccuaccacaucacaguuuucuuucaaaaggaacgugaugaguguuuaauggguuuauuugauuaaccaguaaauauuaaacuucaaccaugagcaaaaauugcugcuaggcacuggugagggugggggucaugaaggacaguauugcagggugauuaaacucagacuuuggagucagaucuggauaugaaucuugguaauaacuaauuuauuuagucauugauguagugauaacuaaguaauuugaauccuaaccucucugagcuucauuugcuaaauaaaaauugugacaccuuccuacgcuaggauguuuuucugcaaauaacagagaccaucccucugcaaacucaauccagccuaaacaguagagagaaauugcuuucauuugguacaaaguccagggguagagcugccugcaggggcagagagagggucagugacuugaugucuuuguccacugcuagccucugcacuuacuucauccuaaggccgguucuaccucauggucacaagaagguuaccaguggcaguuggggcucuaaucccugcccucucccaggaagcgagagagaaagagacacgcacagauacacacacacagacccccagaugugaaauacaagucuguguguuccgucuuuacaccacuguaagucauauggcaacugcugaaucaguaacagugcuagggaaugcuaaacucugauuggcuuagaccaguaguucucaaaccuuggcaugcguuagaaucaucuggaaggcuuguuaaaacacagauucugggccccaagcccagagauucuuaucuguagaucucuguaaggacccaaucauuugcauuucuaaugaguucucaggugacgcagaugcugcuggucaggagacugcacuuugagaaccaguggcuuauaccaaucaguaucuaccccuagaauggggguaggggacacagggucagaggaggugaaggcuggaucauaaauguggaguuuugugaagaaggaugguggggaaauagauaauuaaugcuagguagaccauccagagugcaugcugucuuaaaagauuguggggauuaaauuacaaggcacauaaauaaagcacauggcauuuaguaggacccucaauaaaugauaacucuuacucuugacaaaguacacaaauucauuucauuuuaauucaggaaauacuugagugucaucagcuccugccccaauuggccucuaaucaaauaggagaguuaagacaaacagacacuacuguuccaggcacucagaguugaugauuuugagaggcuuagagagggaaaacacaauauggauggagguagucagggaaggcuuccuggaggagguagagggagagaacaggguaggaggauguuucucagcuccagcagauugcagacaggaacucugcccguucuccaguccuucuccaaccuuccuuugauccugccucccacucccaucauggaaucaucucugggauguuucuggguggguuugggggugugugugguucgagcugcagggugacugaagaugugguuuccugugcccccuugccuccugccagguucauuuggcggacugugacgccacgugacaagcccauggggccccugcugguggccacauucuggccugagcucccggaaaagauugaugcgguauacgaggccccacaggaggagaaggcuguguucuuugcaggugugugggaagcacccuuccuuggcccucagcuccacagggcucugcaccagggcuccugggugucccaggcucacucccccucucaaaccacaguuccuaugcacccgugggugcucccuuuccuuuauggauucauucuuucaacauuauuuccugaagugcgcagcuccucugggagauugguuccgacacccaacaucagauagcauuaacccucaguguacacauuucauuuucuuaauucuuuucaauccgucucauuucuuuucuagaagaaaaaaagucucaguuuagugcuggugugucccuaacgccuuuguagugauacagucuuuggcagguaacaguuuuaguucgaauguuuuaaagaauauuuguuuucauuuuuacuuuuagacauaaauugguuuuaacagaggcaguuaguuauaauaguguggaguuucaaaucaggacagaaacggauuauucaguaacugauauuuugacagucaaaaaacauuuuuuaauaaauuuauuuuuaaagauuucaaaaugaauucacugaaagcagaauguuaaguaaauaauaguacagggagccccuagaagugguagaaaucaucaaggugaggucuguauggcuaagguuuacucauuuaacauuuauuggagcauuuccaugcgcugggcuuugccauacccuggggauacaagcucugccuucgcgaugcucacaaaccacucagggagacagacagcugggcucuuaugagggguaaagaaggauuuaggaggucccuguccuggucugaggugggauccuagagaagauaaaggcucagccaagacuauugucuccaccaccuggcucccaccucccccaauccaccguaaucaugggucccggagaggacaacugcuggcuccuagggcaccuuuuugcaaauuagcaaaaggugccucuuuaugacagcaaggcccuuagagugcacgacuuggugagcagagugugagcuggauuuaucccccaacucauguccuugaccaggcaccuucuguaauugacuucuaaagcccucugugugagcccugauucugggcacugcaaccaggagugagcaggaaguugcacucuguugggaauggcugcaguggggcccguggacagacagaugaugggaggaacaggcuggccuagggcaugucagcaccagccaacacacccuuugcuuccaccccagggaaugaauacuggaucuacucagccagcacccuggagcgaggguaccccaagccacugaccagccugggacugcccccugauguccagcgaguggaugccgccuuuaacuggagcaaaaacaagaagacauacaucuuugcuggagacaaauucuggagguaagggagggcgguggguaggacagcagcacaguuggcugcgagagacagagaagccgcccugaggcuucaagccuccugggcugaguucagagguuggugggcucuggaugcccucucucugguaucuaaccucuuuggucucuggcaccucugagauguugccaaaggugaaccauucuuguacacauugcugauauaauucugguggaauauccuuucucuuugcagaauucuuuugauuggcccaugucuggucuggacccucacauuuugaaaugacucacugaagaaggggguaauaaaaauaaagauaauaacugcuccuauugacacuaugugucagagacugucccaaggguucuaugggauaggaauuauuauuccucccauuuuacagaugaggaaaccuggguucagaaagguuagguaaccguggcugggcacaguggcucacgccuguaaucccagcacuuugggaggccaagauggguggaucacuugagcucaggaguuccagaucagccuggccacauggugaaaccccaucucuacuaaaaaugcaaaaaaauuagcuggacaugguggugcaugccugcaaucccagcuacuagggagacugaggcaggggaaucacuuaaaccuggaagacagaaguugcagugagcugagaucaugccacugcacuccagccugggcaacagagugagacuccaacucaaaaaaaaaaaaaagaaaaaagaaagguuaaguaaccagcuuggagucacauagccagguagggacagguugggauuugaacccuggcauucugucuccugggaaaacauguuagucuucacucuucacuacuauucuauacccgagaugguggaauggggguuccaagagaugggggaacaugaaggcaguggacaaaauaugaagaagacuuagagaugggugcaccagucauccauagaagccagcauccaaaucagaccccauggaaggagcaggugcccugugucaugcucacagcaggcccguggcugugggugcagguuggcaggggaacaauuuggaagcagaugguucugugcuccagguuaucuacaggaaaggguccaguucugaggggcuauagucaugaccagggaaccuaauauccaggaguggcuggugagagguagcccaaaccucaggaguuugacuguaauucuucacacuuucuagaaaaggaaacggagguccaaagaaauuaaauaacuuguucaagcuauagagauauguguauuugcacaaagccaggauuauagcuacuucucuuguauucuaacugaguacccccuccacuauaccugccaguccauuugauuagugaggaaagaguggucggggcacaaagacuuguggugugucuuuccauccccucccuccugguauccccacauuccuuccauggcugccacugcaucugggcccuacccaagaauuuuagagggcacuuccugaggccuuugucugccauccccaaaacaaucccgcuuacuuccuaaggccucugucuucucccccuucccuccuccccacuacucugccccccagcugcccugcauucagaaacucuuuauaucccaggccugcccaugucaggguggaauuccagacauauugcuaagacacuuagcaaccuaagcugauugauaucucaagccucaagaaagaaaacagucaggcaggaaaccacagagcaggcuuuccacccaccagcuccagacacuagccccagacagugugcacgcacacgcacacacacacacgcguacugcgaauggcaucucagcauuguaggagcccugaaucuccaagucuuagaauuguggcuggugagccgcacagacucacagaaacgugaaucuuagaauccuaaagcccugaaguuuucaaauuaugguguuggaagaacuuuuuaaaucacuuuuccaugcacuguaucuauguaaacaugcaaaaacagaccuguuccuagcauauaggaacaugauugugugcgcaugugcgcauacacacacacacacacacacacacacacacacacacacacacacaggcauggagguuguggcagugccuugcuggauuuccaggcagaguuauuugccucccaguccuuuuccacacaagcccaccucccaaagccagagccaggacagacagcgugcucuacagaggaaccacccugagacuuccugaaaagggacagagcugaagggccuaucagaagcucugggcuggcuuccaaaggagacagaucucuauuccaagagaaguggugaaugagcuugugacacuggcccugccguggagucugcagaggccccagaggcaucuuugcuggagaaggagagagagccccagagugacagaggcugagcagcugucuucagcaugccaagaagagcucaggcccugcuuguagaagcuuucacuaagccacaaauauauguuccacaucugcugugugccaggcacuuagcuagcugcuggagagacgggggucaaaaaaucaucacacccugcccucauguaguuuauaguagaaugagggaaaauuauguaaacacauuugaaucagauaaugauggcucucaguauggggccucuaccauagcccagccugaggcuaugcaggucaccuauauuucucaguugagguagauacuguuagcuccuuuucccaaguguggaaacugaggcuaaaguggcucaaggaaaagcugggacacaaauaucuguguucuuaacaccugcuauacauggcaacuucuacagcugcagagaaguaccacaucuucugacaccacagugcuuguauucuuucuggaugaaaagaacuuggaagcaaacuaauucucuuaucugagacucaguuuccucaucuguaaaaugggcuugacuucugccauccccaccuucuguggguagaaugagaaagaaaugagggccaguucaagugugggacacacaucuccaaacuauccuaacgcuagggaauguaguuugagggcucaguggaggugccuuggaugggaguguugggauuuugagcuagggaacuugguuuuggugacccagggcaugaggaagcaugccagguuuuguaagaaugaguuuuaugcugcaccugggauuaaggaaggcguuaguucuucggggugauggcugagggagaagucccuuugagggagaagucuccucuagaagggagcauauagggaaagcugcuguugggguccaggguggagguggucaaggcuggcugcagaaaggaagggagcccccuaggaggcacuguggagcaaaagguggcugcuaccaggaugggaugcgaacacagauucaucuagaaacagcuccacuugggcaagacuuguuuacuaggauauccauagcucccauagugggagcucaguaaauauuuauggaauaaugaaguggagaggcaaaggaaucaacaugacagcagcauuuaaaaaguucuccaaaaaucuuaaaagacagaaggauugcuagccagggagaagaacauacuaaccgaugcccaaaguauuuaccugaauuaaaggcggggcccaggauugcugccgccggaacugagguggcauguggcccacccugugacuaacaggccuuggacuuacacguaccuuccaccuugcauuguaaccucacugccccagccauggucaucucccagggcagggacugucaucucccuguggcagaugaagaagcagcaauuuuuccaagccaugaagugaaagaaugauggggcagauucccaucccugggcuucuaguuuagcacuccucggauuacagcagggauuuguuuguaagggagcuaacauuucuuaaguaccuacuaaauauuuaugagacauggggauagaggcucugcaugugcuguuuuauuuaaugcaugcauuaaauuaaauacacuaaauuagacacaaccccauuuuacagcugguaaaacuguagcuguauggaaagugguuaacacacuguuuggcauguaguaagugcuuuauaaauguuagcaguaaucaugagauuguuuuuauggggucauccaaagucauauaauuaaaagugguagaucugaggcucagacucaggucugauuccaugcccuuccuuccacugcagcuggcugcuucccugaagggcuagguccaguuuccgaggccuauccaggagccaucagcugggugcucccauccaggccaggggggaaguguccuuuagagaggcccugcugguucacugugucuguuucuuuacagauacaaugaggugaagaagaaaauggauccuggcuuccccaagcucaucgcagaugccuggaaugccauccccgauaaccuggaugccgucguggaccugcagggcggcggugagccacccaggacugucuccgcuuucuaggacuccccgccccuagccagggcccagcuccuugcaaauacacacuucuuuauugugcagggcaggcaggcaggcggcgcccaggaaaacaaaucaacuccuucauccuagugcugggaagguuuccagaucccugaccucugcuccuuggccuggcuccaggcaguaagacccagaaagacuucucacagcugcagggccuggagccagggcaggggagggcggaaggccugggccaggggagaaggaacaugggcucugugccguggauucauucugggguuugauccaggcccauuugcguuuugcaggaggccugugaccaccucccauuagcagaaggauggcuccauuugagacaaggcaaacuuugucaugcucuguugcucauguggcaaagauccuccacucaaccaguuugccccuggcccccugcugauuaaaacacaaccaguagcagcgagggauagaauuuggaguuugaaaaucauacucuugaggaggcaucugugagcuuucuaggguccuggaaauggguccaguuuggcuuuuuuuagaggagauuucaacuaaauuccacagauuuuuuuuuuuuugagcaccuacuguaugcuaagcacaggcccugaccuccaguagcugaaggucuuacauguccaagaaaaugcaguguacaaucagaugcuagauuaggaguuaucuucaagaauaaacaucuauugagcaccuacuacaugcuagcauauuaauaguaaaugagauuauguaugucaggagucacaaacuccaacagcuccaugugucaggcagguagcacaaaugaguaaagcaggcaggggcagacaguggggaacuguggagucugugcggaaucagagcacaugccucauuuacaggagacacuuucuucucaccuucagauaauuauuggcgggcaagauuaggggccuaggcagcugccaugguucacaccugucaucccagcacucugggaggccaaggcaggagaacugcuugagcgcaggaguuugagaccagccugggcaacauagugagacucuaucucuacaaaaaaauuuuaaaaaacauuagcuacacaugacggcgcauaccuguagucccagcuacuggggagggugagcagagaggaucgcuugagcccaggaguuuaaggcugcagugagccguguucaugccgcugcauuccagacugggugacagagugagaccuggucucaaaaaaaaagaauggggccugguguuguuagauauucuauauuagauauucuaguuuuuuuaaaggaagccagaaaucuguacuucugugugacuuuuuggauguuuacauguuggcaaguuauucagauuuaaagacaaaacaaaacaaacuugugagagucaaauaaaacccaucugugggccugacaggacuggauauauccuguuuugccaccucugguacauggaaugugcuuaguuugaugcuuguguuaaguggaguuauuguuuuuaauaauagcauauguuaucugacuuaaugcucacugcaagcccuagaagguugauaaucuuuauccucaucuuagagaugagcaaacagggaauaaaagagcuuauuucacagccauuucccuucuuccacucccagagggggcucuucugggcuuuuguuguguuuugguuuuguuuuuguuuucuuuucuucaaucagcucagauugaaacaauugaauuuuuuuuuuuuuuuuuuugagacagagucucccucugucgcccaggcuggagugcaguggcgcgaucuuggcucacugcaagcuccgccuacuggguucacaccauucuccugccucagccucccgaguagcugggacuacaggcgccuaccaccacgcccggcuaauuuuuuguauuuuuaguagagacgagguuucaccauguuagccaggauggucuugaucuccugacuucgugaucugcccgucucggccucccaaagugcugggauuacaggcgugagccaccgcgccccgccacaguugaguuuuuuuuuuggcggggggacaaggucuugcucuaucacccaggcuagaggcacaaucauagcucacugcagccucgaacuccugggcuuaagcgacccucccacgucagccuccuaaguagcuuggacuacaggaauguaccacuauacccagcuaauuuaaauauguuuuucguagaaaugggggucucucuaugcugcccaagcuggucucgaacuccugggcucaagcaauccuccugccucagccuuucaaagcucucuucucguuuaaaagcuucuucccuaugccaggcagaaauucaaaguucccaggaaccuucugugugccagaaugucaggauaagggggucacggucucuucuuucucuaucccaggucacagcuacuucuucaagggugccuauuaccugaagcuggagaaccaaagucugaagagcgugaaguuuggaagcaucaaauccgacuggcuaggcugcugagcuggcccuggcucccacaggcccuuccucuccacugccuucgauacaccgggccuggagaacuagagaaggacccggaggggccuggcagccgugccuucagcucuacagcuaaucagcauucucacuccuaccugguaauuuaagauuccagagaguggcuccucccggugcccaagaauagaugcugacuguacuccucccaggcgccccuucccccuccaaucccaccaacccucagagccaccccuaaagagauacuuugauauuuucaacgcagcccugcuuugggcugcccuggugcugccacacuucaggcucuucuccuuucacaaccuucuguggcucacagaacccuuggagccaauggagacugucucaagagggcacugguggcccgacagccuggcacagggcagugggacagggcauggccagguggccacuccagaccccuggcuuuucacugcuggcugccuuagaaccuuucuuacauuagcaguuugcuuuguaugcacuuuguuuuuuucuuugggucuuguuuuuuuuuuccacuuagaaauugcauuuccugacagaaggacucagguugucugaagucacugcacagugcaucucagcccacauagugaugguuccccuguucacucuacuuagcaugucccuaccgagucucuucuccacuggauggaggaaaaccaagccguggcuucccgcucagcccucccugccccucccuucaaccauuccccaugggaaaugucaacaaguaugaauaaagacaccuacugaguggccgu

SEQ ID NO: 15729 - RNA, 27123 nt, Homo sapiens
acggccacucaguaggugucuuuauucauacuuguugacauuucccauggggaaugguugaagggaggggcagggagggcugagcgggaagccacggcuugguuuuccuccauccaguggagaagagacucgguagggacaugcuaaguagagugaacaggggaaccaucacuaugugggcugagaugcacugugcagugacuucagacaaccugaguccuucugucaggaaaugcaauuucuaaguggaaaaaaaaaacaagacccaaagaaaaaaacaaagugcauacaaagcaaacugcuaauguaagaaagguucuaaggcagccagcagugaaaagccaggggucuggaguggccaccuggccaugcccugucccacugcccugugccaggcugucgggccaccagugcccucuugagacagucuccauuggcuccaaggguucugugagccacagaagguugugaaaggagaagagccugaaguguggcagcaccagggcagcccaaagcagggcugcguugaaaauaucaaaguaucucuuuagggguggcucugaggguuggugggauuggagggggaaggggcgccugggaggaguacagucagcaucuauucuugggcaccgggaggagccacucucuggaaucuuaaauuaccagguaggagugagaaugcugauuagcuguagagcugaaggcacggcugccaggccccuccggguccuucucuaguucuccaggcccgguguaucgaaggcaguggagaggaagggccugugggagccagggccagcucagcagccuagccagucggauuugaugcuuccaaacuucacgcucuucagacuuugguucuccagcuucagguaauaggcacccuugaagaaguagcugugaccugggauagagaaagaagagaccgugacccccuuauccugacauucuggcacacagaagguuccugggaacuuugaauuucugccuggcauagggaagaagcuuuuaaacgagaagagagcuuugaaaggcugaggcaggaggauugcuugagcccaggaguucgagaccagcuugggcagcauagagagacccccauuucuacgaaaaacauauuuaaauuagcuggguauagugguacauuccuguaguccaagcuacuuaggaggcugacgugggagggucgcuuaagcccaggaguucgaggcugcagugagcuaugauugugccucuagccugggugauagagcaagaccuuguccccccgccaaaaaaaaaacucaacuguggcggggcgcgguggcucacgccuguaaucccagcacuuugggaggccgagacgggcagaucacgaagucaggagaucaagaccauccuggcuaacauggugaaaccucgucucuacuaaaaauacaaaaaauuagccgggcguggugguaggcgccuguagucccagcuacucgggaggcugaggcaggagaauggugugaacccaguaggcggagcuugcagugagccaagaucgcgccacugcacuccagccugggcgacagagggagacucugucucaaaaaaaaaaaaaaaaaaauucaauuguuucaaucugagcugauugaagaaaagaaaacaaaaacaaaaccaaaacacaacaaaagcccagaagagcccccucugggaguggaagaagggaaauggcugugaaauaagcucuuuuauucccuguuugcucaucucuaagaugaggauaaagauuaucaaccuucuagggcuugcagugagcauuaagucagauaacauaugcuauuauuaaaaacaauaacuccacuuaacacaagcaucaaacuaagcacauuccauguaccagagguggcaaaacaggauauauccaguccugucaggcccacagauggguuuuauuugacucucacaaguuuguuuuguuuugucuuuaaaucugaauaacuugccaacauguaaacauccaaaaagucacacagaaguacagauuucuggcuuccuuuaaaaaaacuagaauaucuaauauagaauaucuaacaacaccaggccccauucuuuuuuuuugagaccaggucucacucugucacccagucuggaaugcagcggcaugaacacggcucacugcagccuuaaacuccugggcucaagcgauccucucugcucacccuccccaguagcugggacuacagguaugcgccgucauguguagcuaauguuuuuuaaaauuuuuuuguagagauagagucucacuauguugcccaggcuggucucaaacuccugcgcucaagcaguucuccugccuuggccucccagagugcugggaugacaggugugaaccauggcagcugccuaggccccuaaucuugcccgccaauaauuaucugaaggugagaagaaagugucuccuguaaaugaggcaugugcucugauuccgcacagacuccacaguuccccacugucugccccugccugcuuuacucauuugugcuaccugccugacacauggagcuguuggaguuugugacuccugacauacauaaucucauuuacuauuaauaugcuagcauguaguaggugcucaauagauguuuauucuugaagauaacuccuaaucuagcaucugauuguacacugcauuuucuuggacauguaagaccuucagcuacuggaggucagggccugugcuuagcauacaguaggugcucaaaaaaaaaaaaaucuguggaauuuaguugaaaucuccucuaaaaaaagccaaacuggacccauuuccaggacccuagaaagcucacagaugccuccucaagaguaugauuuucaaacuccaaauucuaucccucgcugcuacugguuguguuuuaaucagcagggggccaggggcaaacugguugaguggaggaucuuugccacaugagcaacagagcaugacaaaguuugccuugucucaaauggagccauccuucugcuaaugggagguggucacaggccuccugcaaaacgcaaaugggccuggaucaaaccccagaaugaauccacggcacagagcccauguuccuucuccccuggcccaggccuuccgcccuccccugcccuggcuccaggcccugcagcugugagaagucuuucugggucuuacugccuggagccaggccaaggagcagaggucagggaucuggaaaccuucccagcacuaggaugaaggaguugauuuguuuuccugggcgccgccugccugccugcccugcacaauaaagaaguguguauuugcaaggagcugggcccuggcuaggggcggggaguccuagaaagcggagacaguccuggguggcucaccgccgcccugcagguccacgacggcauccagguuaucggggauggcauuccaggcaucugcgaugagcuuggggaagccaggauccauuuucuucuucaccucauuguaucuguaaagaaacagacacagugaaccagcagggccucucuaaaggacacuuccccccuggccuggaugggagcacccagcugauggcuccuggauaggccucggaaacuggaccuagcccuucagggaagcagccagcugcaguggaaggaagggcauggaaucagaccugagucugagccucagaucuaccacuuuuaauuauaugacuuuggaugaccccauaaaaacaaucucaugauuacugcuaacauuuauaaagcacuuacuacaugccaaacaguguguuaaccacuuuccauacagcuacaguuuuaccagcuguaaaaugggguugugucuaauuuaguguauuuaauuuaaugcaugcauuaaauaaaacagcacaugcagagccucuauccccaugucucauaaauauuuaguagguacuuaagaaauguuagcucccuuacaaacaaaucccugcuguaauccgaggagugcuaaacuagaagcccagggaugggaaucugccccaucauucuuucacuucauggcuuggaaaaauugcugcuucuucaucugccacagggagaugacagucccugcccugggagaugaccauggcuggggcagugagguuacaaugcaagguggaagguacguguaaguccaaggccuguuagucacagggugggccacaugccaccucaguuccggcggcagcaauccugggccccgccuuuaauucagguaaauacuuugggcaucgguuaguauguucuucucccuggcuagcaauccuucugucuuuuaagauuuuuggagaacuuuuuaaaugcugcugucauguugauuccuuugccucuccacuucauuauuccauaaauauuuacugagcucccacuaugggagcuauggauauccuaguaaacaagucuugcccaaguggagcuguuucuagaugaaucuguguucgcaucccauccugguagcagccaccuuuugcuccacagugccuccuagggggcucccuuccuuucugcagccagccuugaccaccuccacccuggaccccaacagcagcuuucccuauaugcucccuucuagaggagacuucucccucaaagggacuucucccucagccaucaccccgaagaacuaacgccuuccuuaaucccaggugcagcauaaaacucauucuuacaaaaccuggcaugcuuccucaugcccugggucaccaaaaccaaguucccuagcucaaaaucccaacacucccauccaaggcaccuccacugagcccucaaacuacauucccuagcguuaggauaguuuggagaugugugucccacacuugaacuggcccucauuucuuucucauucuacccacagaagguggggauggcagaagucaagcccauuuuacagaugaggaaacugagucucagauaagagaauuaguuugcuuccaaguucuuuucauccagaaagaauacaagcacuguggugucagaagaugugguacuucucugcagcuguagaaguugccauguauagcagguguuaagaacacagauauuugugucccagcuuuuccuugagccacuuuagccucaguuuccacacuugggaaaaggagcuaacaguaucuaccucaacugagaaauauaggugaccugcauagccucaggcugggcuaugguagaggccccauacugagagccaucauuaucugauucaaauguguuuacauaauuuucccucauucuacuauaaacuacaugagggcagggugugaugauuuuuugacccccgucucuccagcagcuagcuaagugccuggcacacagcagauguggaacauauauuuguggcuuagugaaagcuucuacaagcagggccugagcucuucuuggcaugcugaagacagcugcucagccucugucacucuggggcucucucuccuucuccagcaaagaugccucuggggccucugcagacuccacggcagggccagugucacaagcucauucaccacuucucuuggaauagagaucugucuccuuuggaagccagcccagagcuucugauaggcccuucagcucugucccuuuucaggaagucucagggugguuccucuguagagcacgcugucuguccuggcucuggcuuugggaggugggcuuguguggaaaaggacugggaggcaaauaacucugccuggaaauccagcaaggcacugccacaaccuccaugccuguguguguguguguguguguguguguguguguguguguguguguaugcgcacaugcgcacacaaucauguuccuauaugcuaggaacaggucuguuuuugcauguuuacauagauacagugcauggaaaagugauuuaaaaaguucuuccaacaccauaauuugaaaacuucagggcuuuaggauucuaagauucacguuucugugagucugugcggcucaccagccacaauucuaagacuuggagauucagggcuccuacaaugcugagaugccauucgcaguacgcgugugugugugugcgugugcgugcacacugucuggggcuagugucuggagcugguggguggaaagccugcucugugguuuccugccugacuguuuucuuucuugaggcuugagauaucaaucagcuuagguugcuaagugucuuagcaauaugucuggaauuccacccugacaugggcaggccugggauauaaagaguuucugaaugcagggcagcuggggggcagaguaguggggaggagggaagggggagaagacagaggccuuaggaaguaagcgggauuguuuuggggauggcagacaaaggccucaggaagugcccucuaaaauucuuggguagggcccagaugcaguggcagccauggaaggaauguggggauaccaggagggaggggauggaaagacacaccacaagucuuugugccccgaccacucuuuccucacuaaucaaauggacuggcagguauaguggaggggguacucaguuagaauacaagagaaguagcuauaauccuggcuuugugcaaauacacauaucucuauagcuugaacaaguuauuuaauuucuuuggaccuccguuuccuuuucuagaaagugugaagaauuacagucaaacuccugagguuugggcuaccucucaccagccacuccuggauauuagguucccuggucaugacuauagccccucagaacuggacccuuuccuguagauaaccuggagcacagaaccaucugcuuccaaauuguuccccugccaaccugcacccacagccacgggccugcugugagcaugacacagggcaccugcuccuuccauggggucugauuuggaugcuggcuucuauggaugacuggugcacccaucucuaagucuucuucauauuuuguccacugccuucauguucccccaucucuuggaacccccauuccaccaucucggguauagaauaguagugaagagugaagacuaacauguuuucccaggagacagaaugccaggguucaaaucccaaccugucccuaccuggcuaugugacuccaagcugguuacuuaaccuuucuuuuuucuuuuuuuuuuuuuugaguuggagucucacucuguugcccaggcuggagugcaguggcaugaucucagcucacugcaacuucugucuuccagguuuaagugauuccccugccucagucucccuaguagcugggauugcaggcaugcaccaccauguccagcuaauuuuuuugcauuuuuaguagagaugggguuucaccauguggccaggcugaucuggaacuccugagcucaagugauccacccaucuuggccucccaaagugcugggauuacaggcgugagccacugugcccagccacgguuaccuaaccuuucugaacccagguuuccucaucuguaaaaugggaggaauaauaauuccuaucccauagaacccuugggacagucucugacacauagugucaauaggagcaguuauuaucuuuauuuuuauuacccccuucuucagugagucauuucaaaaugugaggguccagaccagacaugggccaaucaaaagaauucugcaaagagaaaggauauuccaccagaauuauaucagcaauguguacaagaaugguucaccuuuggcaacaucucagaggugccagagaccaaagagguuagauaccagagagagggcauccagagcccaccaaccucugaacucagcccaggaggcuugaagccucagggcggcuucucugucucucgcagccaacugugcugcuguccuacccaccgcccucccuuaccuccagaauuugucuccagcaaagauguaugucuucuuguuuuugcuccaguuaaaggcggcauccacucgcuggacaucagggggcagucccaggcuggucaguggcuugggguacccucgcuccagggugcuggcugaguagauccaguauucauucccugggguggaagcaaaggguguguuggcuggugcugacaugcccuaggccagccuguuccucccaucaucugucuguccacgggccccacugcagccauucccaacagagugcaacuuccugcucacuccugguugcagugcccagaaucagggcucacacagagggcuuuagaagucaauuacagaaggugccuggucaaggacaugaguugggggauaaauccagcucacacucugcucaccaagucgugcacucuaagggccuugcugucauaaagaggcaccuuuugcuaauuugcaaaaaggugcccuaggagccagcaguuguccucuccgggacccaugauuacgguggauugggggaggugggagccaggugguggagacaauagucuuggcugagccuuuaucuucucuaggaucccaccucagaccaggacagggaccuccuaaauccuucuuuaccccucauaagagcccagcugucugucucccugagugguuugugagcaucgcgaaggcagagcuuguauccccaggguauggcaaagcccagcgcauggaaaugcuccaauaaauguuaaaugaguaaaccuuagccauacagaccucaccuugaugauuucuaccacuucuaggggcucccuguacuauuauuuacuuaacauucugcuuucagugaauucauuuugaaaucuuuaaaaauaaauuuauuaaaaaauguuuuuugacugucaaaauaucaguuacugaauaauccguuucuguccugauuugaaacuccacacuauuauaacuaacugccucuguuaaaaccaauuuaugucuaaaaguaaaaaugaaaacaaauauucuuuaaaacauucgaacuaaaacuguuaccugccaaagacuguaucacuacaaaggcguuagggacacaccagcacuaaacugagacuuuuuuucuucuagaaaagaaaugagacggauugaaaagaauuaagaaaaugaaauguguacacugaggguuaaugcuaucugauguugggugucggaaccaaucucccagaggagcugcgcacuucaggaaauaauguugaaagaaugaauccauaaaggaaagggagcacccacgggugcauaggaacugugguuugagagggggagugagccugggacacccaggagcccuggugcagagcccuguggagcugagggccaaggaagggugcuucccacacaccugcaaagaacacagccuucuccuccuguggggccucguauaccgcaucaaucuuuuccgggagcucaggccagaauguggccaccagcaggggccccaugggcuugucacguggcgucacaguccgccaaaugaaccuggcaggaggcaagggggcacaggaaaccacaucuucagucacccugcagcucgaaccacacacacccccaaacccacccagaaacaucccagagaugauuccaugaugggagugggaggcaggaucaaaggaagguuggagaaggacuggagaacgggcagaguuccugucugcaaucugcuggagcugagaaacauccuccuacccuguucucucccucuaccuccuccaggaagccuucccugacuaccuccauccauauuguguuuucccucucuaagccucucaaaaucaucaacucugagugccuggaacaguagugucuguuugucuuaacucuccuauuugauuagaggccaauuggggcaggagcugaugacacucaaguauuuccugaauuaaaaugaaaugaauuuguguacuuugucaagaguaagaguuaucauuuauugaggguccuacuaaaugccaugugcuuuauuuaugugccuuguaauuuaauccccacaaucuuuuaagacagcaugcacucuggauggucuaccuagcauuaauuaucuauuuccccaccauccuucuucacaaaacuccacauuuaugauccagccuucaccuccucugacccuguguccccuacccccauucuagggguagauacugauugguauaagccacugguucucaaagugcagucuccugaccagcagcaucugcgucaccugagaacucauuagaaaugcaaaugauuggguccuuacagagaucuacagauaagaaucucugggcuuggggcccagaaucuguguuuuaacaagccuuccagaugauucuaacgcaugccaagguuugagaacuacuggucuaagccaaucagaguuuagcauucccuagcacuguuacugauucagcaguugccauaugacuuacagugguguaaagacggaacacacagacuuguauuucacaucugggggucuguguguguguaucugugcgugucucuuucucucucgcuuccugggagagggcagggauuagagccccaacugccacugguaaccuucuugugaccaugagguagaaccggccuuaggaugaaguaagugcagaggcuagcaguggacaaagacaucaagucacugacccucucucugccccugcaggcagcucuaccccuggacuuuguaccaaaugaaagcaauuucucucuacuguuuaggcuggauugaguuugcagagggauggucucuguuauuugcagaaaaacauccuagcguaggaaggugucacaauuuuuauuuagcaaaugaagcucagagagguuaggauucaaauuacuuaguuaucacuacaucaaugacuaaauaaauuaguuauuaccaagauucauauccagaucugacuccaaagucugaguuuaaucacccugcaauacuguccuucaugacccccacccucaccagugccuagcagcaauuuuugcucaugguugaaguuuaauauuuacugguuaaucaaauaaacccauuaaacacucaucacguuccuuuugaaagaaaacugugaugugguaggccagggauggcuccagccugggucugggcucugcauccuuuccuaggccccacacaucugagaucugcauguguggucagggcuuucuuagugggaggagcuccagaugaagcacauugccagauccuuacaaugggaacugcagagcagugcugacaucugcuguuauauauccugauuugggcauucgaggccugacgggaccugauuucucacuacauucuaagucucaucucucauugcauucuugccauuuccccauuggccagcagacccugugaagggcaaggcaucugcaccccagaauuuggcccagugccuagaguagaggaaacucuuccugaaaguuuauggaacaucuucuagccucaccagauucucacuggcuaauccagaaacuuucacaucacuauggcuuggcucugcaggucccucugucucaaagaaccuccuaacuugucacccccaucagauucuugcuucuccuuugaaggcucugcucaaaugcugcugcaucugugaagccuuccuugacugggacgugcucacaaaagcaccuaacaccucugcgaucacuuuucuuucaucuugccaugucaguucuccaugccuauuucucaaacuggacuugugaugcacaaacuuuaaugugcaucagaaucacugggagaauuugcuaaaacgcagauuccuggggccuagccccagaguuccagucaggagggucugaagcuggggcagaaaacccaccuuuuaauacccacacucuagaugguucuguuauaggaggcccaugcgccugucuuugagaacacugaucuagcagccccccaccccacugucccgagaacaucauucuuccuccuccagcuacuaaagccuagcaaaguauuuggcacaguagaugccaaacaauuauuugucaauaacaauagcuaauaugaauacacuuacucugugucaggcauuguuuuuguucucagcacuaaguucaucuaauccuuacaacagcccuaggagauagguuggaauauuagccccauuuuauaaaugaggaaaccaagguacaaagaagauacuuaauuaacuugucuaugauuacauaaccaguaaguagcaguuacagaauucuaacccagagaaucuggcuucagaguccauuuucucaacuacuauacucuaugaaugaauaaauggaugaauaaugaauaauggauggcuggaucauaaauaauggauaauagauggcuggcuggcuggauggaugauggauggaaagauauagguauggauggauggauggguagauggauggaugauagaagaauggaaggacagacccuuuaaugagguccuagauacugccugccauucuccagggaacuagggcauuaggguaaaccucagucuuuagucaacugaguggugaucuuuaucuauagcaugaagaauaccaccucuuucuacucugcagucacucaccacccauacacagaguaauuuggccauuugagggcaacgccauucuagaaggccugugguagacugaauuaugguucccaauucuucccuccauuuugauuuuaggauuaugcauucauaugcauuuccaugugacuuugcaguacuacccucuaggguaggucuugggauuggccaugugacuuauuucaggcaguggaauauucucagacaagaugugaguggaggcuuuaaaugagcuuguguaguucaguuuggccucuugcacccugucaucugccaugaguagcugcuaaucccaugagaacaacaggcagagcacaccugaacccaaacuguagcugaaagucaagauaacuaguagacccacagacuaugagagagcaaacaaaaugcuugggugcaaauccacugaaaccuggagguuguuugauacacagcagaaacugccuaauucaggucauucugggaagcauuuggcggagucuucagcgaagagugagggaaaagaauaaugguauaagagcagaggacaggagacaaggaggacaagaagcaagcuccugcacucaccgguccuugaagaagaagaucucaccacggaucugagcgaugccaucaaauacaauguccuguuugcagaucucaggagugacagggcccagcguggggguggggccggugccaaggucaaugucaggagaggccccuggggagaacaccugaccuuagacucucugcagcuccagagguucuccccacuagggugagcccccaggggugcccacccaaccaucuaagagucagaagaaaucgccuucuggccuuaguguaagcuccguaagguaacaagaagaugccuggacuuggggaguccuggggcccuuuguacuuuauauaugcuuuuuacugacaucacccaaaucaguccucucuauagcccugggagugggguaucaugauugcaccauuucacaggugaggaaacugaggcccagaaaaguugagugacuugcccaaggauucaaacccaaagcucagauucuuaugcccacaagagucagggcggucagggggccgcugguguguccagaacugacaguauggcacuuuucaugauaagcaauuauuuuagagaugaggaaacugaguccaaagagguauaaagacuuacacaauaucuugcagcuagugaagggcagaggccacauuugaacccagcaccccucacggcagaccuugggcuuuuuccugagucuagcaguccccaaacuucaucacucaagcaccacuuucacuauuuuggccuggcucagauaucaccuggaccauuaaauauuuuuuaaaaaugaacugacuuuuuaaacucuagccucacuguaagaaccaacaauaaauaaauaaauaaauaaauaaauaaauaaauaaauaaauaaauaauuggcuuaaggcacugguuguucuguuucuacuacauacuaaaaaucaaagcuuauuaugaaaacuagaaacuuccacccccguauuguuaaggucauuccacaugauggaaaauucuguccuguacuuggcuauucuccuggauucuaaacuccacuggguugcucaaaccuguguaaccuugcaccaggugaccuuacucaccuagaaaaugggagaaacccagaaauggagcgcuaagagugacauggauauuagcauuguucggauagggaagaguuauccaaguauccccuuggagagcugcucugccuucccaagaccaggucaacacucccauuuccugcccucgucuccagcacuccuggcuggaugagaucuugcuggucccacccccugggccuccaucccaggcuacaugaccuccccccuccucacccuccacccccaacccccgcccggagguuuaccauagagcuccugaaugcccuugaugucauccugggacagacggaaguucuugguguagguguaaaugggugccaucagggccccagggucuugggagugcuccagccccauggcguggccaaacucgugggcugccacgaggaacaggcuguacccugaggguugcagggaggagagaggguugaaagacaggaagagagaugagagagaagucaagaccugacccagugaugcagacuuuugaggacagccccacaguaaggcugagaacccuggaagcggcauguauugauuuuuuuuuucuuuuccugagaauucugggaucaauacacaauuuugggauuagugccuauuguuuccaaguggggucagccaaagucuucuugucucuuuccaagucaguaucaggacaggugugcuauaaaggaacagaacaaguaguaucugcgaauuuucuacuuaaaaccccauucauuuuaaaauccugcuuccuggcuuuuuaugucucucuauaaaagaugagcucuacaaacccagcuccucagccucucugaagagguaagaagaguggggauaggcuggccccauguugccaccauuucugcccaggugaaagcaguaaaaaccuuucacacuuagcgugguugcacaggcugagccacagccagcgagcaaaaccugugucacacccuguugugguuaaaugcguccccccagaaaagauuugcccaagucuuaacccuagggaccugugaaugugaacuuauuuggaaauaggcaggagaaucacuugaacccaggaggcagagguugcagugagccgagaucaugccacugcacuccagcugggcaagagcaagacuccgucucaaaaaaaaaaaaaaggaggagaggcaagcagagggggaagaaggccauccaugucaugacagaggcauagacuggagugacgcauccuucagagggaacauggccuuacugacgccgugauuuuagacuuccagccuccagaagcaugaaagaauacaugggguuuguuucaagccaucaguuuguggcacuuugucauggcagccccaggagacuauaauauucacccugggugagccacugagcucuggauacuugaaccacucaggaagguggagaaucccaccuuuaagcugguaaaaucagacuguguccuagcaaggaauuuagcaggggauaagaaaaccuccuuuggccagccucuguccacugacaucugccaaguuccaucucaugaugauuaaaaagaaugaaagcaacauaaagacaggcuugccuaauucugacaggcccuggaccugcccacugaccuggccauuaugggccaucagggagcuuuaagcaacccugcaacccugggcucuguagccuagauugggcacagggccccaagcacccugcucacugcacugagcacauaguaaggucacaagcugucuccuggucacucucuccccugagcuugugaguccuagggggcagagagcugucccagucagcuccauccucagcacccaggacugacgaggacccaccauuuacacccugguaacagauggugcugacugaugggggagagagggcucugggggcucccccagggcugcguggaccauggugucagaucaagcaugaggcucuuccuuuuuuccuuucuucuacugccuaccagcuccuugaaggcaccucuuugugcagugggaaugucucuuaggagaauugucucucugguaaucugugcucagaauucagccaauuuugguagucacaagcccgccuggaggguggcugaaggggaagacaagagcagugaccccucaggaaggccaguucuuacccaggaggugaguagcagcaucuggucuaccagggucugauuuuggaggcugugccuccaccuggaugggcaggaucuaagcagggaccuuggcuccaccagagaugggcauugucucagcccaggugggcgggucuggguaggugggugucuggggggcagugucuaugcuugaagugggugaggucucaggaagguuuuuggagcaaguuuaggggcaagggcaauguccagggucucuguccaaugaccagggccucguaccuuggucagggcagaagccccacuugcggucaucaucguaguuggcuguggucgcacaccacaucuuuccgucacugcggccggcgcuggugcagcucucauauuuguugcccaggaaagugaaggggaagacacagggggcaccuucugaguucccaccaacaguggacauggcugugggguuagggauacgggucaaggcgcagcaaagagucugaggcuaccaccaggaagcaaugacaugacgcugaccuuaaugaaccacaccuaaguuagacucagucccaggcacuguaucuuuagacucaucucacccaccccugacaacagccuugugcaggagggacugaauagcaccgcguuucauggaugggaaauagaucagagagaugaugaaauuucccuaagccaacacugcuaggaaguaucagagcugcaauucaaacccaggaagccagauuccagaguucuaaugagccucccauggaagggggcagaugggcuaggggcaaagggaguuggaugaagcugauggcaccagcacaugccccucagcugugagcccccuugggcagggcuuugcagagaccaaccucuguguaugcugcacaaagcaggcgcucaguaaauuccuguuggaggaagggaagaaggaaaggagggagggauagagaggagggcaggaaggagacagggaggaaagcacggagcucuuaauaaaaaacagacuaaaagguggagauacagaccaggaaaggcagggaagagagauugcagggucagagaggaggagagagaagucucugccagagagccugagagaaaagggaugcaggucggucagaggauccugagcaggccugacauuuaagugucaccaauucaacuguugaugcccaaugucuguucugauuucagugcccaggccauaccaggugacaaguauccugacuagcuacacggacaucuugguguggaugucauucgcacagaugucuuagcaccccugucuuggggaaaggaggugggcacucggagucuuauggguuuuuuuuuugucagacagcaggugcugggcccugagggagggagagggaguggcacccaccggucucagggcagaagccauacuucuugucgcggucguaguccucaguggugccgcaccagcgguagccauccgugcggcccucaguggugcagcugucauaggaugugcccuggaagcggaauggaaacuugcagggcuguccuucagcguugccgcccauggugaacagggcuaagggugggggagagagggaaggaugugaaugagacaugcuuccaugggcacagggcuggcuggcugcccaccugccgguucacaccagugaaguugaugcauuguuaaaauauuaagaaaacaucucuacugguugguaaggagcugcuucucugagcucccagagagaaccccugcuucccugguuaucccaaucccucccgugggaccuuguggaccacccaacaacaaaaugauugacaccuggcacacagcaagggcuucuagaacccugccucagccccaagggcacuguccauucugccugguccacaccuguaccaugcaaauuucauguaauaaugauguaugacaugaauauaucagucauggcaggcaggaccacgagaaucucucuccauuugauagguggagaaaucaaggcuaggacaaagaugguucucaaacugcucauggucacagaaaugaaagaagugaaugaagguuguaacuaaaaacuacaaaacacacuaaucucaaucucucuugcuuagucugucacucucauauaugugugugugcgugcacacgcauacacagaaagcuugcuuuaccuccugucaaccccaggccccuuccuggauggccuuguugcagucucuguaggaaggagagaaagaaugaagaggaggagggagggagagggagguggugccuucaggucccuuuuacuaaacacucugggcuccuacuuugacaucuucaagacaggggccauaaauggagaguugggggagggagugggguucagagccuggccugucugucuuggauucuccccauccuccccucauccacccaaagcuaaaaaauggugucucuggaauugccaaccagcaaaaccacaaguccauaacaaggaccaucugugcacaacggcgccagaggugaccucaccagcccccguuaacuccaccauggccggaauggagcccagucccuggccucccaccacagaacucgaggcccuguauccucaccacuccccucucuaccaaaagaccuuguccugcaaugccagaaacaauggcaccuagagaaaaggcaagacugaguccagauaccuuaguggccucagaguugagaaaggcaaagcguuaacuucgaccaaugccagcccccugccucugaccucucauuucuaccacccaggaagccccugucuccucccaaauuccccugacaaggauggcaagaaucagacacugacucagccaucagcaggggcugaguaacaacaaucucugccucgagacccagacacgugcguguugugcguacuugcaucuggcuaagcacaaaguaaauggcuaauguccaaugcagggaauaacccuucccaaauuuaugaaauacagcuguuuccacaucuaacuaucaccaaagcuuucuguuccuaucagaggggugacacagggaaggguuaacgccacauguaaucccuaccgggaaacgcaagauacaaaaaauauuuuuauuucaaaaugucugacuuauuaauggugaauggcuuaaacucuuacuuaauauaaaguuuagcucugguaguaaaagcauaaacaggaagggaauuaacuagcucuuuguuucuuucauucugucaagaugguuggugcuuaguuuucaguuacagugggguuagggagauucacagacauaaaauuacagacaaaaagacagucuuuagucuauguagacuauagagucuuugugacaugggaaagaagauaguguuaaaaauuuuuagacuuuuuuccauuuucgccagguuuucugggcuuucaaucugcagaauuaucaaauaugaugacuucauagaguaugaaguuacauugucuuuuugugauuuaugacuauuaagugugucaaggauauuuuuaaaaaggauugaguguguaugucaauaucuguaccccauuuuaaaagauuucccccauguggcuucaaaaucucugaaauguugcaucucaggcacugacaagcacacaaacacaaauacugagucaagccuaaagucuuuaucaagacacagagaugcagacacaagcuagacaggaggcagaaaaagacagugcccaagagaggcagauaguauagcccccgugcccagacacacacacacacacacacacacacacacacacacacacacaggcacacacacacacacacacacacgcauuagcagaggcagcaucaggaccaaggcaggagcaauagcugaaauuccucaguuggaguacgcaaaccagguugaguccagcccuggucugaguccugccucccuaucacacugcuagguuuccagcuaccagcaagccuuuccucaugcccuugaaguaucaaucuugacugaaguguaaagacugguucuagagagaaccacugggcauuguaauaguucuaaguucacuccaauauauauuagaaauaaauaauuagcaaaucaaaucugugacuuccuaaaugauugcuaauggugaaacuuaaaaaaaaucaacuugauuuaauuagaguacuacguucaucaugguacuggugggagagaaacagcaauggcucagaucaggaugggggggaacugagugaaggacguuggagggaugcucauuaacuggcaguggcagccaguccuggagaguguggagggaagagcacacuggggagcccgggaagcuggaggcuugggguggaaagucuuggggacuagaguggaugcucaccuucauggggacagaagccguacuugccauccuucucaaaguuguaggugguggagcaccagaggaagccaucgcugcggccgguaucagugcagcuguuguacuccuugccauugaacaagaaggggaacuugcaguacuccccaucggcguucccauacuucacacggaccacuaaagagugacauggaagggggagguuggacuucuccaggccuucuuuggagaccaagauucugacucacccagaugugugacuuuccuccccucccaccucucugguccaagcaaauggaguggagagaggacaggagagaaggucuggggcaugcagagggccccuuucucaccuuggccuucucccaagguccauagcucaucgucaucaaaaugggagucucccccaacaccagugccuggggcgaaggcaugagccaggaguccguccuuaccgucaaagggguauccaucgccaugcucugaaacacacacugggucuuagcgucuagcugugccaccuagacccugaaaccccuccacaccccaucuacauguggagccugucagcccacccagcaucuguccccuucccuugucccagugggguuauccaggacugucaacaggagcucaguagagaucugcugaccugguuguuaccauccuauggucuacacugcucucccagguuuacaugacucccaguauccauacccucuaccuccauugucuacucuaccaccaugacacuauauguaccacauacccacauuaccacacuaguguccucaccccaucuucaucauccccagugucuaugccauccuccauccugucaauacugcccucuuaaccacaauccugccuucaugucacacuaucaccaauaucugcaacaugaauccucaugcccaccuugucaccaaggccuguaccacccacccacuugucuacauuguuuccccugcucuuuaccuucaucacuuaccacucagugucuauaccacauaccuuuaugucugugcuacuggcaguguucacaccauaaacucacauggccaccuggccccagguucuacgacccuuccucuagugucuacacugcuccacuguuuccaaaccacucucauauaucuacaguuccucagugucuaccagcaucauccaacagagcuuucugugauuaagaggaauauucuuugucugugcuguccaaaaucaauagucacuagccuccugugucuuuugagcacuuaaaaugugcccagugugaccaggaaacuaauuuaaaauuuuuaacuaauuuaaauuuaaacagccauguauauucugccuaauggcugccauauuggacagcacaguagaccacuugcuucggguuuagacggccuccagguuauaccacaacacaccaucugcccccaugucaacguggcucuccaguguccacuccguguugugcugcccccaucuaaaccacccccagggcccacaccaucuacuguccuaucuaagccgcccuuaggauccccacgccccucuaauguccaucucacccccucgucucaacacugaucccugcuggccccucuucugccccaucuucugccuaccccagcggccaaaguugaucaugaugucugccucuccaucauggauucgagaaaaccgcaguggggucacaucgcuccagacuuggaaggcacgagcaaaggcaucauccacugucucuggguccagaucagguguguagccaaugauccuggaggugguagaacugcaugugaguguguaugcaugugcauaaguguauguauaugcaaguaugugugugugcacagauguaugaaaaaguuugaguguguguguguaugugaacauacaaguauaugcacaagcacgggaagggugcacagguauguguauguauaugugagcaugugccugcguguauguguguguaggcugggcagggcucacugccaaggacaacccucccagaaugccuugaagacccagggagucccaggccagccaacauuuuuaggccccagcucaggaguuccaucugucacuucuggcuggugggggagggccauaaguagugcauuauggggcacagggcaaagaucccaccauuggaacccagcaccacccauacagagcacagcucuuggcccaauuagcaaccaguuauaacccaauugggcugcuaaacccaauuagcuaccaaucaucacguuccuucugcccaucccaaugaccucaucuaaaaacaauaacaaugacuagcauuacuacacucuugcucugugucaaaaaucauagaagccguuuguauuaguucagccuagcuuaguuccccaacauaccauauaagggcauuuuuuaagccccauuuuguagauuggaaagccaacauucacagcacugaaaaguaacccaaugucucauggccagcaaguaugaaacucaagucugucugacuucauuuucuaagaacuguguauugaaacucccuaagaugucaagccuucacaaaagacaccucauggauccccugaguggagagaaugcaugggucaaggagacucgugucccucagccccauggcccugccuccccaagcccugccccggcaccuguaugugaucugguucuugucccacuugggcuugcgagggaagaaguuguaguuggccacaucuggguugccgcagcguggcuuccgcauggucucgaugguauucuggucaagaucaccugucuggggcaguccaaagaacuucugcaucuucuuuaguguguccuucagcacaaacagguugcagcucuccuuggggcagccauagaagguguucagguauugcugaaagaaaugcacacccccaaggcaauuagccacauuaggauggcacaguacugaccaaagcaggcuguagcaaucagccccccaacccagugccauaguccagacaggaaauaagccaggggucccagagcacuggguggaguacuggguucccaaaccagcacggucacccauuaguugagcgacaggacauacagcuauagagagcauggcuaccacuuguuggugcugggugcugacuauauguccaggcacuaaagucagaauauguuaacucauuuaaugcucaaaacucuguaauguagauauacuaacccuauuauacagaggaggaaacugaagcacagagagguuaagaaacuugcuuacgaucacacaguucacaaaugguagaucuggauuugggacaaagcaaucuggcuccagaggcugugauauggaaucauuauacuccagcauccuuccuuuaccucuaucaacucauuuaucuaccuugcggcuggugacuuggggacuuuuuuccuccuguuuucuucuaaagagauucaaggacuaugugcaugggcucuggcaguagacagaccuggguuuaaauccugaaucagccauuugcaaaaagaaaguaguccuguccuucaugagucauacaacuggcccugcccaaacugaggcccaaacugagcaggucccugcagagguucagggagcaaccgacucauuuauuuauucaacaaauacuuuuuaauaccuaccauguaccaagcccagugcuacugcugaggaaaaacaggugaaaaagauagacaauucugucucuaagguucaaauccuagcagggaggcugauagaucccaaauaaaacaaaaugaaguaugugauaaguacuguguuagaauguugaaaggagccaggagaucuucugacaacgguccuagccuuguuggaaguaguuaggaaaggggaaauggaggacauaacaauaauaauaauauaauagaauaauggcuagugcuuauugaguacuuaccaugugcuagguaagcaccuaagauuaccucucuuuuaacccugagauaggaaauuucccaguuugcagaugaagaaacugagaagucacuugccuaacaucaucacuaggccagcugguugguucaugcacucuuugauuugaagccaagcggucuaaguccagaguuaucuucuuaagcccccacugcauugccucuggacaacacagacuuccauuugucagagguguucaaaccaggcaccuccaucuugaguggggggcuggguaagaugaggcugagaccugcugugcuucauucccaggagggcaggcaugcauucuuagucacagaaugagacaggagguugguaggacugauuucaccauauacaguucgggucacaaagaccccuaugauaaaacaggaugcaguaaagaagcuggagaaagcccacccaaaccaagacugcaaugaaagugaccucuagucguccucacugcucauuauaugcuaauuauaauguauuagcauguuaaauacauuagacacucccaccagcgcugugacaguuuauaaaugccauagcaacauugagaaguuacccuauauggucuaaaagggagagaaacccucgguuccaggaacuccccacccuuuuucuggaaaacucuuaaauaauccaccccuuguuuagcauauaaucaagaaauaaccauauguauacucaguccagcagcccauucccugcucugucuauggaauaaucacccuuuuauuccuuuaccuucuuaauaaauuuguuuucacuuuacucuguuggcucgcucuugaauuccuuccugugcaagccaagaacccauguggcccccaggcugaaccccaauuuagggguucauccugugacccauuggcuggaaaagguguaggaaaccaaguagcuuugucauugucccaaagcuccacucucacccccacccaacagccacaucauuaugccagccagcuccagauccuugaaaaaaguagcccucuaaaaauguauggagguuucccaacccaucuauccagagggggcugagaccuagcuguuuggaagggugagaguugggagaggguaguugucaccuccugaaggaguuccuagggugaccagagggcaugggcgucuucucccggacagguugagggggaggcuggagggcaggguggcugaagcaacaagggagcagauauccccuggacuggaaaggacaucuugaugggucccuggccugccucucuccucaggcccuacuuacgcaacacugcggccaggcucagugccccuccagccaggcgcgcgcacgcucacaagacaacaucugaaccgcgguuugggagcccagccaggaaggagggcucucuggccgcucuccgacccgagcggagcgcaguccgcccccgccccacgcgccgggcccuccagcgccugccccacuccuccucccuccugccgggccagcucucuccuucuuuucuccgacccuuuggagaaguucgaggaaacuuuccgaggcccagcccuugaccaauuuguccauuaagccaggagaaaaaagaugcgcucucugcuucccuccugccccaaucacuucccaaauggcccccucgagcuguuuguuuaaaggucccucuccggaucugugccgaagguuccuagaaauuugccaagccccgcuuugaccaagcucccucccauccuuaugcgcgcauaaguuuacccaaauugugugccagagcaccguucccaaaguccuacauuagcaaaaacgaccccuguagcuguuugccaaaggcuuaccuagacgcuuggcaagagcccuuagcaacugcccagauguguccaaaaguuguuuacaaagaccgccccccccccccgccaaaugucccagauacuagaggauguccccgcuauuuacauaagagucccuuuccaguaguuugccaggucaccccucucccacucucuggcuuguuuuucgccccacugcuguaugcugaagguugccaaauuguuuaucaaagguuuucuuugcuuacaaaagaucccccaccguuugcaagagaucacuccaauagcuugccaaagaccccccaagcuguuuaccgaagccccucccccacgcugugugcccaccgccgagggcagggggagagacacccccauccuuugccuccgaaguuugucuaaacgugguuccuugaggccagcgcagcaacucaccacugccaacucuuuguccguuuugggggcgacaucgccggggaacuugaugaugggcgacggcgcggcggcggcguggcucagcaggcagcccaggagacagagcgcccucaggggacccgugagcgcgccccgggccauuagcgccuccaucguagcgcucccuggccccgcgcgucgcccgggggucgcuggcucggugcguguggccgccucgccgccugguuggagccugcuccgcggcgcagggcugcgcuccgaggguccgcuggcucgguggccugggguuugcccggcucagcggcucaugguccggcccccgcgccccagcccccgccgccgccgccgccgccgcagguccuggcaaucccuuuguauguuuaaagccccagaugcgcagccuccagccaccgccugaggaagucuggaugcagcggaaacaagggagggcagccgccagauguagccggcugggcugggagggagcuggcagagcggggcugggggcggggg

SEQ ID NO: 15730 - RNA, 6889 nt, Homo sapiens
agcaugauaaauggguucuaucuucacaaagauugaauacuguagguuaacuguuuuaguuacuuaacagcugaauaucauuuaugacuuaaugaaggguuucuauaaacucucuaacuuucccaaauuaauaacugagaacagacacaccaaagauaaggugaguauuugagucacuuuuuguucaaauauacacucuacaccagccugcccuugccagucuaggaagucauaguauugguuccuguuggacaaggauuggccacauuuuuuucuuuaaaaggcagauaauaaauauuuaggcauuucaggccacacgaucuuuguugcuucucaacucugcugucauacagcagccauggauaguauuuaaguaaauaagcaagacuguguuccaauaaaacuuuauuuacaaaaauaaauagaguagugaacuuggccuucaggcuguaguuugccaacccccugcucuaggagcugugccaucugucccuaauuggcuuugcacacuggugugguguuccacuagcuaccguucaucugucugagguggugguuuugauuuuugaaaagcucagaucucuacuuugaugagcauaagaaguauuaauauagaugagccuucuggcaggaccguggaauuuguguaugaccagggaauaaucuaccccaaaugauucaauuuuaguauguaaaaauauguggaaaucuauuaauaaaauuauaaaaccugagacucuuugaagaggaaagagcauagacucagucacaugggcugagauauuagaugugguucccaguucucagcucuuugaccuggcuguuggcuguggauuuccccagaagcggacccugggacaaggauuugaaugcacauaguuugggaaguggucccaggaaucacagguuguggguggggaugugagcuggggaagggaggguggccaguaauggguuuguuaucaagcagguuuguuaucacugugggugacaagccccuucccauuuggggccucugggauccagugcagaacauaucccucgcaggagaugaggaacugggguguucacagaguaauucccucccucacuaguugagggcugccucuggggguggcugaacuaccucaugcagccagagaaaguccucaggcaaugaaauacagacacuggccagccagcacugagguggcgagaccuuacuggcugguccccagagugucugcagcauugugugagaucuuaaacuggcuagaaggacgguaacagcagcaccuguuucauaggacgugaagauagacgagacagccaugucccaguuuuccuuggugccaugccgaaguuagguguucagucaguguucucugcuguuaucauuguuuuuguugucuaauuacuguuauucaaaaggaaacuaaagugggaccaguugcugacucucaaacuuggaacucuagguuaggccccaggcuccuuugucuugcuuuuaaucuuuauggcauuuuaauuucuguggugcaguagacuuccuuagaguuacagguuggauuggguaccauagcucccucugcacaccaggguuucccugagucugugauuugauuucugugugacucuggacuguuuuugguacuguuucucuuccagcggucagauagcaucagaccugcauugaacaguccuguggaaaggccaagcagugaccaggaagagggagaaacuucugcucagguaaaacccgcacucuagugagagugaguucauggagcuguggagggggaauguggucccgacaguggucuuccucaguccugaagcuugcaaggcuuagggcacgaguacaaaagaaacugugcuguauccaucccaauaaugaaggguagcaaaucaggcugugcccgugguguggccuguguuuccacgcagggcuggcagucauucccuggggauugcccucaugugcuggaagagaaagggguuguguuccccggggccagcccugccaccuugagccugagugagagcccguggaaggacagaaggaagcugggcucgggaccgugagggugccuggacccaucuaaacucagauggggauggccuagggcaagcucuccagggagccgaggccauugagaugcccucccccacaccucacuugucaaacucaggauuuccagauacauccaugcauuuugcaaaacugagaccgccugagcugaguggggcuggggggaaaacauggcuuucuugagaaccagaucuguuuguugacccacuuugggugccuugagguggccacccuaacuccaagcagcagggccgaggugccaccuccccccacccccugcccgugcccucugcccuacaccuguggcccuggaucccacuccucuucugugguucccauucgcuuccucaguuaccauauugucagagcacuuucuuaugcgaccacaaauaaaaacuggacaaccccaccuuggccuuucuguguuugugccauguggggcuuuccugcacacaggcuugggucuaggguggugcugccuucccuuacuggggugcacaaggucuccucuagaagcacugguaaaugacacaagcuuucaccucuuguguuuuucucuacaaagaggaaacaguaaacacuacuaggccuucuucaaaucuguugcuggguuaagauuuucauauccaccuauguaauuggauuaugcaucauuugugaaauggugcauggcuucuaagggguccaugucuacauuuccaguuuuuuuuuuuuuuuuuuuuuuuugagacggagucucgcucugucacccaggcuggagugcaguggugcgaucucggcucacugcaagcuccgccucccggguucacgccauucuccugccucagccucccgaguagcugggacuacaggcgcccaccaccacgccuggcuaauuuuuuguauuuuuaguagaggcgggguuucgcuguguuagccaggauggucucgaucuccugaccucaugauccgcccgccucugccucccaaagugcugggauuacaggcgugagccaccgcgcccggccuccaguuuuugaauagcuggcgcagcugagauauggaugcugugggcuugggggcaucuguggguacagcauauucagucccugucuugauuuuccacugcugcuucuagaguuagcaugaagaguucuggauuuuauauauauauauguauauauaauggaggaaaguauguauuucacagggaaccuugcugugcaacauuuuuggucauuugugaagaaauacaaaguccuugaauaacaauuaguuaacagaaaccucaguguagcccaguaagcuugucagcuccacucucccucuguucuaaucucugcccugccccgcucaggcugguauuagucaggcaugcagcugcacagagcagggguugcggugggcggcuguuuucuuucuaacaucucgccucuucacucaccauuuuuucuaaccugcucuagggucaggcuuagaggagagggauagaauaggacagugagacuccagcgugugugugcguguguguguauguaccuacauguugugccaacuacgugugucuguguguguguguguacauguuaugccaacuaucucccuguccccaucuggccccagaaacuccuccuuugacccugggcuggcuauugaugaccacucccaccuucauggggguccuguuaccucuccaagugguccuuuugggcacaguuguuuucaacaaccuuagguugguucccuccugcaggagcccuauccaagcuccaggacacacacaguguugucuggagucaguggaaggugaacgugcucccgucacagcuccccuggcccuguauuuuauuggcuccugccaguuucuuucuguagauuucucaaguguaugcagccaccaguucccccguccuuugacucucggggauacgaaugguucucuugaaguucccucucgagcuuagcugaaggcaggaaaaagugaggguagguccagcaggaacucugaaguaaaacagccugccucucagcugcacccaccuccauucugucacagccuagaagcgggcaaugggcugacccuggccagcgcaggucugcaucugggagcaugagcagcgcagauggucaggcaccugcuaggaccugggggugccugggcauugucguggacuuuggagcuucaaccaaagccaaggaaccauauaauccauccugugucuuuucaaaagauccuuagggcugggcacaguggcucaugccuguagucccagcacuuugggaggcugagguggguagauugcuugaguccaguaguuugagaccagccugggcaacaaagcaaaacccugucucuacaaaaaauacaaaaauuagccagaugugguggcacgagccuguggucacagcuacuugggaggcuaaguugggaggauccccugagccuggggagguugaggcuguggugagcagagauugugccacugcacuccagccugggugacagagugagacccugucuguaaauaaauaaauaaauagaugccuagcaguuuuccuuuuuaccucuguuuucagagucaauugaggauauaaaauuugugcagaagauuggauaagacugguuuaaauguuugagcaauuaguagaagugaacagaaaauucccaggauguaaacucacgguugucguguugguagcguauucuaagagugcagcuugaaggugcuuacguuuuucaugcugguaaucauuuacuuacccucugaugccgaacauucugugugagucagguccuguucuuaguacuacucaagccauaggcagcaggccugcccucagggaagcugcugcuccauuauccguagcuugugguuccuaguuucugccucccugcuuggcagcagccuucucuuugcguccagaacagccgugucuggggugcccuguaggugaggaaccugcuuaggagggaggccugugcucacagcugccuccuugcuuccugccccguguccagaccgagcgugugccacuggaccucaguccucgccuggaggagacgcuggacuucggcgagguggaaguggagcccagugagguggaagacuucgaggcucgugggagccgcuucuccaagucugcugaugagagacagcgcaugcuggugcagcguaaggacgaacuccuccagcaagcucgcaagugagucgcuucuccagaccaccuggcauaauccagaucaaaaacuaguggcugaaggccguugucaggccgucuucucuuuuuaaacagaugccaacagugaaacggcauuacaugccaccccaaaacucagauuucaagccucucuugaaaaaaccagagcaucugguaacacugggccccacuggucuaccucugaugcugguacugucagucaucucccauggaccccuuuggccacgcuugccgagagagcacuugugugcuaaccugaucuaagcccuuuauaugaauuacuuuaacagcucuaagagggagcacuguuaacccauucagcugacauacagcugaagaaauggaggcuggagagguuagcacuggccuggcccuggcgucugucucccagguccucccuguugaccacucugccuuucagcugagcauuguacacacacucagcgcaucugugcgucacacacccaugguugguggcagcuacagcagguguguccuguggauagaggggguuuuguuccagcucuuaaggacagggccagcacuguguuccucaaguggguuugggcccuggcagacccugugauugugggaguucugugcugugucuguggguggaggggaugggcaggaagagacagcagggaacagcacugaaggguuccucccuggugcagagagaauuugcgcccaucuguugggggcuggaugucuuggucauuggguggugcugagugacagcuucaugaaggugccuggacauggggagaugugaaaucaaccuucuggcuguguuccacagcuccccaucucuccuaugagagagaaaaagucuucuguuuuuucuagacguuucuugaacaaaaguucugaagaugaugcggccucagagagcuuccuccccucggaaggugcguccucugaccccgugacccugcgucgaaggaugcuggcugccgccgcggaacggaggcuucagaagcagcagaccuccuagcgcucccuugccuuccucagcugccuccugcgcccugugcccgacugacuggaggaggccugucccaauucugcccgcuccauggaaaagcgggcuugacugcauugccgcuguauaaagcauguggucuuauaguguuuggacagcugauaaauuuaauccuucuuuguaauacuuucuaugugacauuucucuuccccuuagaaacacugcaaauuuuaacuguagguaugaucucuucugguguugacuggacugcuuggggugggggacgaucaggaggaagugagcagucgccugccugcagcaggcagcuucuacuccugccucaugcguacgucccacaaaugcagguguccugagcaccacacccagugggaagagugugggggaggcgcacagugugagcccgcccccacgucgugggguaacaucuguuaucaaacugcugucguuguuguggaagcauguagacugugccagaggccagacccacgggcucaugcaccccugagccagcagggcaucuuggaaaaggaacucuugguucgauaccuggagcagaggaggggaaaguccagggcuauagggugugaugaagucaccccuuucugucccacuac

SEQ ID NO: 15731 - RNA, 4044 nt, Homo sapiens
aggcaaccaagagugaaaacuuuauugccccaaguacuuuacaugaaugugaccaacaccacauuugggcaaauauauaaaaagcacaaccuauuguacaauuauuccaccuucucgauucaugcacuguacagacacuucccagguuucucuccuuggaaggggugggcacgauggauggcuuucaugggcagcagcugcacuugucugagccuccuuugcagaugcagccccgggcacauuuggcacagcccggggggcagcagggacagcagccugaaagagucaggagaugcgcagauccgcugugggucaacacuuccaucucaccacugccccucccacuacuuagaggaaguaggaaaagaggggugugugcaugagguuucaauccacauuagcaaaaaugcugagauaggagguugaggcauguuagaacuggaagggaucccagggaccaucuagaguccaucagaagcccacagaagggaggggguuugccaaggucaugagacaguggcaaaagcaagacuagaaccuagggcucaugacuccaggccagugcucuaucccuguuaccacugggcaggacagaacuuccccucaguccucuuccugcuccaaacacuguggaugcccuuaucccuggguagagaccugccauaggucucuacauaguucucauuucagaucucucccagauggguaaaaggcaucuagacccccuccccacaagccccaauccaccauggcuggaggauugaggguggggaugggaucuuucuuucuuucuuucuuucuuucuuucuuucuuucuuucuuucuuucuuucuuucuuucuuucucucucucucucucuuucuuucuuucuuucuuucuuucuuucuuucuuucuuucuuucucucucucucucucucuuccuuccuuccuuccuuccuuucuuccuuccuuccuuuucuuuuuugacugaguuucacucuugucaccaaggcuggagugcaauggugugaucucugcucacugcaaccucugccuccuggguucaagcaauucuccugccucagccuccugaguagcugggauuacaggugcccaccaccaugcccagcuaauuauuguauuuuuaguagagaugggguuucaccauguuggccaggcuggucuugaacuccugaccucagguaauccacccgccucggccucccaaagugcugggauuacagacgugagccacugcaccuggccuggauuggacuuuucuaacucccagcccauggugcccccagucaccauacucacucuuccaauauguuuuacaguugcagguugugcauuugcaguugucuccacacaugcagauuccuccuagaagacaggacagagccaccacaaacgugaggauggagauggaguggggaacauaaggcaugaugccgacugucagaguggcaaggcuccugggcuauauccuuggggacuggcuggacaagagggugacaaggcugcugagcaucgacccagugucaaggacucugcaauaguccacagucacaggccauggaugggaacuggcauggcugcaucaaucaugccugggauaacugugaaaaugcagauuccugggaccaacccuugagauguucugauucauaagucuugguggggaaauggaguccauauuuuugaaaagcaacccaaauaauucuuauguacaaugagaaccaacagacgaggccagcguuuccaagcccaagguuccucuaagaacuaucaaagccuuucacacccucuuggcuaggcacaguggcucacgucuguaaucccagcacuuugggaggccaagacaggugaaucacaugaggccuggaguuugagaucagcuuggccaacauggagaaaccccaucucuacgagaaaaaaaaaaauuagccaggcgugguggcacacaccuguaaucucagcuacuagggaggcugagacacgagaaucucuugaacuugggagauggagguugcagugagccgagaucacaccucugcacuccagccugggugauggagugagacucugccuuaaaacaaacaaacaaacaaaaaccccuuucacacccgugucaccuucacaagucaagaugaaaacugugaaugguuuaagaaaggucaaggaacgucagugaacucaaaacaagagccacagagccacaccuuguuuuguuuguuucuuccuuuccuuucuuccuuccuuccucucucccucauuucuuucuuucuuucuuucuuucuuucuuucuuucuuuucuuucuuucuuucuuucuuucuuucuuucuuucuuucuuucuuucuuuccuuccuuccuuccuuccuuccuucuuucuuucuuucuuucuuucuuucuuucuuucuuucuuucuuucucuuucuuucuuucuuuucuuuuucucuuucucccugucuuucucucucuuuucucuuucucucucucucucccccuuucucccuuucucuuucucucuuucucucucucucucuuccuuucucccuuucucccuuucucucuccuuguuucuuuccuucuuuccuucuuuccuuccguucuuucuuccuuucuuuugacagggucuugcccugucacccaggcuggagcaccauggugggaacacagcucacuguagccucaagcucuugccucagcuuccugaguagcugggaccacaggcacgcaccaccacaccuggcuaauuguuuaaaguuuuuguagaaacagggccuuguuauauugcccaggcuggucucaaauuccuugggcauaagugaucauccugccuuggacuccccaagugccaggauuacagaugggagccagcaccuuguuuuuauaucauaaugaucaucuacacuuaaaaaaauuaucccauuuuucauuuugaguuucaaaaugcuggaagcuucugccucuuuugcaaguuuuugguacagagacauccuguuaaggacaagggagucuugugagacuucauuuucuuucuuucuuuuucuuuucuucuuuuuuuuugagaaagggucuugcucuauuaccuaggcuggagugcaguggugcauuccuaguuugcugcagccucgaacuccugggcucaagugauccucccuucucagcguccugaguagcugggacuaaggugcacccuacuacgcccagcuaaguuuaaaaaaaauuuguagacauggagucucgcuauguugcccaggcugguauugaacuccuggccucaagugauucuccugccucagccucaaagugcugggacuacaguugugagccacaccacccagacuugugagacuucuucauaccauuuccaugauuguaaaagcccaggauggcuuugaacccugauuucucuccuucuggcuaacaugcuccguggaauuaagcaguuucagagacucaagaguccacauaaguuaggggaguccacaacuccccugacaucugcaggugcuuaaugguuuuagcacuuucauagcagcucugggaugugguuggcugggaauaaggaaccucagucuacaggugaggaaacugaggaccagaaagaauaagcgccagggaggggaccgcagcaauggacccaaaccagguugccagauucugguuuagagcucuucuccucacccuggugacugcccuuaggggccaacgcuagaaagaccaaaguuugcaagucccccucucagccauucccugagcuaggauaucgauucuagaaaaucaggcugggagccaacagagagugggagcugccccagagguggccaguccaccugucggcucccaggacgaaccccauugguggcuccuaauuagagggaagagaaguuuucaucagggaccugcaggcucccuguaggaagcugguccaagguucccagaccccagggagggcuucuuuacucaccagacaugcagacacauucccugggguccaugguccagguguccgaaaggcuccagugcugucacggcuggggaagggaggcugagu

SEQ ID NO: 15732 - RNA, 2409 nt, Homo sapiens
uacuuucauuuuguagucggccuucauacaaggugggggcugggaagggaagagcaguccaggccauuacccccaugaauucauuugacaaauauuuauuaagcgucuacugcaaacuuggcccggugcuggaagcugaagacacaauuccagaggcagacaaugacugcccuuggcauuuccaguggucagggguuggugaggaggggcagagacaccaauccaagaguccccgcaguuuauacauaccacaggcacggaaagcgccaggaggggaaagaacaggauguuuaccagcaccuuccacaggcagccacggucaugggggucaggacaggguccccagaggaagugacgauucggcugagcuagaaagacauuuccacaggaacuuacaguaagggcugcaaggacagccuguccucccccgcccaccaccucacuaaacuuucacuguggcaaucggcauucccuaagccugccaggaagcuuccaguaaccacuuccugacuccuagcaugacacacuucgggccuuccaagguugacgaucuaaggcccuuacacagcgccagacacgcgcaggcagggaggcaggaugugccucuccagacaggaauguggacgccaccugggcucuuccccucagccuccacaggggaagaauauucuugugggguuuuucccuuccaaaugucucagggcgauuccaguguucccgcuaguuccucccucccaggcuagaacacaaauccuucccacucccugccuggcaaacaccuucugacccucaggcccaaggcaauggcccaccuccucccaggcuggauggggucuccuccucucuguucccccagccccugagcuuccugaggaccaagcuuguggcuucuucuccuuacucuuccuccuuggugucucuauguuagagggccguuagcaucugcuggggccuggucgcauucacccugcucugccacucacuggcugugugacucuggacaaauuaacuucucuggaccugcaguuucuccucucuacaaugagaauacuggagaguccuuaucuuauggguugcuacagaauuaagugacaucucacacacaacacacuuccuacagucccuguuacacgcuaaaaguacucaacaugcaacggauacgucaucaguaaccaccccacggguuuacugugaugcugcacaauuauuaagccuuggcugcuacagaguuguaaccugucugcacuuccaaccgguuugggaaugcaagcagcauucccaagucccgcuuucacccgcgcgcuaacggcucagguucgaguacaggacaggagggaggggagcugugcacacggcggaggcgcacggcgugggcacccagcacccgguacacuguguccucccgcugcacccagccccuuccgcgccgaggcguccccgaggcgcaagugggccgccuucagggaacugaccgcccgcggcccgugugcagagccgggugcgcccggcccagugcgcgcggccggguguuucgccuggagccgcaagugacucagcgcggggcgugugcaggcagcgcccggccggggcggggcuuuugcacucgucccggcucuuucuagcuauaaacacugcuugccgcgcugcacuccaccacgccuccuccaagucccagcgaacccgcgugcaaccugucccgacucuagccgccucuucagcucgccauggaucccaacugcuccugcgccgccgguaagaggcuggggaugcccaguguagacuguagcgcuagagaagcaauuucugaccccucuuucuuucucuggucacucaauuucaggacaggaguugcuccuucccaaagaguuuugggguaucuuucucuccauucuagguuauucggagcccccuuuuuaccguuaaggagaucugaguuaauggcuugcucaaguucccaggaaucgguuguggacugaggaacucggccccgggcucuuaguacgccgucccuuguucagguauccagggacgguucucaccucugucuuuucuccuugcaggugacuccugcaccugcgccggcuccugcaaaugcaaagagugcaaaugcaccuccugcaagaaaaguaagugggauccucucuuuccucuaccccuucccuguccuccagccuguccccucuccaccauccucaggggaauuaaagcagucuggggaugccccauugcgcggaaauuguugccuccucagugauccuuaucagggagagcaggaauccuuauucccggugucgcuaguacucaucucugccgccuccugucugcccccaggcugcugcuccugcugcccugugggcugugccaagugugcccagggcugcaucugcaaaggggcgucggacaagugca

SEQ ID NO: 15733 - RNA, 4536 nt, Homo sapiens
caguccagccucuggcuucccaggccuucccagugcucaguaccuccauuguuucucugcacccccugcauuguacagguuuuuuuuuuaugucuguuccccucuuccccaugaacaucaagucugugagccccuugugggcagggacccagauuccaccauaugcaccccugagcccuggugccauacuggccugggggagccauugguuggggaagguguuguauggguucaucacugucucaaaaccggaggagccacagcccagaggaggaagccggcggaguucugguaucguugcugcagcugguguugugaaucaggccgacgagcagcgcauccucuuacccggcuauuucacgacaccaggguugcaucauacccauccucuccaggcgagccucgugggaccgggccggacgcaaggaccuggggaugggguuggggugggagucugugugugaaagcuuguccucuguagcucacuggaucucagcccagacugcuccucagaaucaccuggcagcuuucaaaaaacucugaugucugccccucaccuccucuugccgagguccacagaaucuccaagguggggcccuggaaucagcauuguuagagguuccagugugaugccgaagucugugaguagucaagggugggcccuggaacucauagccagggucauugucuguuccagccugauuguugccauagccuucaccuggcccucccuggccccauuucuuucugccuugcaccguucaccacaccacugcugcccugggccagcuuuucagaaacagauggggccugagaccccaggacaaaggccaggcuucuuacccuggccuucaaggccuucccaucaggguucucuacuuggaaacaauacaauaauuucccccauagagcucucccgugucccuccuuccuuugaacccugccccacacaaauccacaugcugguucuguuggcucugccuucagaaucugucucagcucccaaaccuucuuaccauccugccaucccacagcuauuccccaagucuggccaucacuguccuguaccuucaauggccccugacuaguuguuuuuuuuuuuuuuuuuuuuugagacggugucuuacucugucacccaggcuggagugcgauggggaaaucucgguucacugcaaccuccgccucccggguucaagcaaucgucccaccucagccucccgaguagcugggauuacaagcacccgcaaucaugcccagcuaauauuuguauuuuuguagagacgggguuucauuguguuggucaagcuggucuugaacuccugacuucaggugaucugcuugccucagccucccaaagugcugggauuauaggugugagccaccaugcccacugacuagucuuaccuagcccuucucccucagcccauucuccagacaacagccaaaauaagcuuguaaaaauaaaccugaccauuguagaauagaauaggacacuucuaacccuggccuauaaggcuggauguucccuuuuacaugucuugaaugccaacuccuuggucccucugcuccagccacacaggccuccuugccagucucgaagcccacaccacaguccugccagagggccuuugcacaugcuuugcccucaucuggaaccccugugcucauaccugcucacauguggguggcuccuucucauuguuggagcuuggcucgaauuucucaaagaggccuaauguacccuuccuaagaaaaaaaaagcuuuguuuucuuaacagcacuuaucacuaaauguauuauaauacuugcuuguuuauuuaccgucucuuccauuagaaugugagcucuaggagggcagggucucugucuuguucccuguggugccucccuugccuagcacagggcaugguaugcagugggcacucaauaaacgcaguggaaugaagaaacaauuggaucccuuuuagccucaucucccaguauuucuucccuccuuuccccaccccacagcacuaugugggccucagucccacugccucucccccugcaaugaccacaccccuccugagcuccuuucccuccucuccccugucaucuccccuccauccuuacccacacaccucccuuccccucuccccucuccuuccucuggacagccuuccuccucugcuggccaguugcaugaucuccuugcuggucugucugccagguuaggcugugagguccagugcuugguacacaggaggagcacaauaaaugcugaguugccucuguagccgcaaagacaggaggcccugagauucugagguugcagcagggccuucuguccucaccauuucaggaccugcaucugggguuucugcuucucugggguuuccgcaucugugguuuccugacggcugaaaguuucaguuucuucacugcuccuguucugucugagagccaggagauccgaggggcccacugcacucagccaggggcgagggaugccugguagaagugucauuucuauuuugcugcugcaaagcugauguucacccaggucaauuucacgcucaaagucauacagaaacggcgagaacugagacucugcggccaaaucaagggcuuugcuccagguacacagaaccucagaucagaaaggccuggcccauggguucuccuggaagccagaguccugaaagguagggacugugugugaccuagcacuguguccccaccaaccaucaaaaagagugccucuguaaacauuucugaaauugauuaaauuccauccaaaugcaggcuuccccuuccugggggucugugcuuugggacaaggugucugcagucucuuggcauguccuaugaugaguccuucgaggggaccugcuaaaacccucucuuaccccauagagaggcagaggggcagaagagguuucuugaagcagcaaauguaccccuccagagcagaaagggacuuuggagcugucuaggccaggguuuucuggagggaggagcaagugacuugcccaaggucacccuuggcaagcacagucagggccccucacucugcccaggaccacagcacugcuggaaaccagcccaggcccccucaggcuccuuccucugugagaucuuaaucaagaauuuuccacagcugcccagggacaggguguguaggaauggugugagcagauaaagggcagcugugauuuucgccagucaaauggcaguuuaaaaggcagacgagugauaagaucuaccccgagggcccagugggagguaaugagcagagagaggccuccacaaauccucuccccuaacaaagccaggguggggcccucaagccuucagccccacuggcagaugccucucugaggaggggcugggaauccagggaaguggguagggaggccugugggucauuaagaggcgcccugagaagauuuaaaaauuaacacauaugguaaauguauaagcuuugcaaaaaaaaaaaagugcacagugaucguaacauuugggguuugucauugagguccuguuauccucagcucaccucuagaugcgaaacuagaggccgaaugcugagcugggagggccuguggaguggccacuuucaucagccccgcuuggggucauucugucagccaaggauuuccauggaaucacccuuugcccucuuugcuucugcguccccuucauaauucaacaagcguuugucgaauacccacucucuacuguuuuguugcuugggaucaucccugaacaaagcagggccagaucccugcgcuugugagucuaacaagguggaugaaauuucugucuccucccuagaaaagugcacugacguaugaaaacuuauccaugauuuugugggacuccuagacacucaucuuggagguggauuccccaacaguguuugcugcccuaacacaggcugagcauuucaucuaccccuucugccuggcccuacagcuggguggguacaccuguccccagcaccucuggaagaggaguaagagguuagcaagagggacagagugagccagccaggccuuccugugaguucucaaucauccagugcugacuggcuguugggggucauggagcccuaaggauuucgagcaccauggagccaguccucugggggaccugugugaacucugugagcccaagcccgagaggcagggcuagggagggagaggaaguaugucccuccaugucccucccaaggaugaccagagcuacagcauaagccaagcucagaugucuacagcuggcaauagccuuucuauccccugccuccaggaagagcaacuuauucucuaagaaucaggucagggguccccuccuccagaagccuucccugguugucccuacccugacccuccuccagggacaccucucccauugcuacccucacuacacagcugggcugaucuguuuccaugcugauuuccugaacgaacucagcagcaucaugagcacaggcgcagugcccaccauguguguccuuggcuccuaucgcacccaccuauggcauggugggugguc

SEQ ID NO: 15734 - RNA, 12023 nt, Homo sapiens
cgcgcggccugcagcgcacccaaacauggccaccgaacccggguucccggggcacagccgcgccucugggugacgcagacgcggcggguugcaucagcccgugcccacgugcucgguccgcccucugccacccggauccggacgccgauugggccacguugggagagugccuccgccucagccaaugggcggcagccacagagcguucuguccgcagagccgggcgcggggcuucuauaaaaggcgcccgaagcgggggcgcgcgccccagagacgugaacugucguugcagagauugcgggcggcugagacgccgccugccuggcaccuaggagcgcagcggagccccgacaccgccgccgccgccauggaguccgagaccgaacccgagcccgucacgcuccuggugaagagccccaaccagcgccaccgcgacuuggagcugaguggcgaccgcggcuggagugugggccaccucaaggcccaccugagccgcgucuaccccgagcguccggugagagcggccccgacuucccgccccuaggcuguggccccccgcccucugcuggggaugccacguccggcugcccuguccuguggccuccucccgcugacggcugcgaucgcucggccggucaccucccccagggcuguggucuccccuucccugccccgccgacgcgggcgccccucuguugcccaguagccgucaguaaucagcagccugaccuugggcgagucauuucacccuccaagccuguuucucccccagcggccaggcaacucgguguuccuaauugggcuugcauccaauggcuagaaguaagaaaacauccgugcugcaaaaugagguuucugaacgcagccucucugcagggagaggagcgggcaggugccacccggggccguggcuugagaaaccuggggaccgcccagacacuguggacggaaggccccacacccagaagcaggacguggcucuucuccucccuggccaccuuccgccgugccccucccugucgcacuggaccgagcagccauugccgagucccgggguggagccccgugcacuuucugaccaagagcgacugagaagggaagcaggcaggagucgccuucagucugguuuuaggacggcagccucuccauuauuagcaagacuuccuugcuuuguuuugguugacacaucugucaacaucacccuuagcaccgccugcccuggccaccacgugaugaggcuguaagcuggcccuuccuguauuuacuuucugcucugauauuauguaagugucagcaguguucuucacugcccacgagcauaauucuucaucacacaggagagggcauccgggcaggaaaagauagugaagucgugaguuccagcuugugguagcgccugugucuguuuuuguuucauauggucaagaauguuuuagaagugaguuuuccuucugaguuguuauuuugaaauuugcauauuuauuuaguaagcuugcauuccauguccucuagaauucacccuggcacauuuuucaguuucaccauagcugcuuccaagaaacuggguggcuguguugccaugagaaugacuauuggguacacaaauuggugaagcagguguagccuaugguugcaucauauggcaaaaggcaggauuuuggcggaggauuuuuaaggucuuccuuugaugaggaaugccgcucccaucuguucagucugaagaccuaacauuguaaacaaauaccucucagguauacaaauuugugucuaaaaauuauuauggcugaaacauacuuaucauuuguuuucuguaguagaaaauggcauaauaugagaaggccuacuuuguaauaguuguuugcuuuacuuaauauuuuucaaaucagccaucugugugaagacucaauaucaaguuaggccuuuaaaagggggaaaauaauucaaaaccacuggcagcugugguuuuccggccuuuucuauugguugaacucuguaauaaaugcaggacccuacauauacaaaagguacuguuuuccaaauucacguauguauuagcauuuaccuuuaaaguucucauccgucagaaaaacggugaacacagcauucaguauauuuauuuugguuuaguuacacagugucaaaaaguucugauguauauggauaaguagaugcacuuuuugcuguuuuguuuguuuaaacagcuugcuuuaauuaucucaagcuacuuggcaggaacaccuuuauuccagguuucgcauaaucaguuauucuggcaagaguagauuaacacguuagugaucuccaauagacagauuauauguuaauauuauuugaggccauuauuuuuaaguacaauuuagacggaguuucaaauagauuuuaaaaaugagauuuguauaaaagagugugcagucccuaugguguuaaaaucacugauauggaggagaagagggguuggaauugugacacuguggcagcagaugaccuuggacaagucaguuuuucagacuuuccucccuuaaaauagggauacuaaaucucacagggugguuguguauaaugucacccacacgccaucuccucuauaacugcauuuguaugccaggaaauugucugugaaggcuucaguuuagaauagcuucauauuauuuuggggcacugcugggugauuuugguuaaggcuggccuugggaguucucugaguuuucucugaaaccaaacucaauuugguuguagguucccuguuugcuguuuguugcuuuuaguaauaggagucagucaguuuaccugggaguuaaguuuggacuggagauaauuugccauucuuuuuuuuuuuuuuuuuuuuuuuuuuugagauagggucucacucugucgcccaggcuggagugcagugacaugaucuuggcucacugcaaccucugccucccugguucaagcgauuccccugccucagccuccugaguaguuuggguuacaggcacaagccaccacgcccagcuaauuuuugcauuuuuaguagagaugggguuucaccauguuggccaggcuggucucgaaccccugaccucaggugaucugcccgccuuggccucccacagugcuuggauuacaggcaugagccaccaugcccagccgauaauuugccauucuguauuuauuugcguguuagagaccaguuaaaguuaagacacuuucuaaauagaagucuuguauauggggcuuuugagaaaguguuuucccgugaugcuggggggaaacacacauauucaaauuacuuguauaaaacaguuuauucuguguuuaggaacuuguaggggugaaaugcugaccuguguuacucuuucuuuccaugaucagcguccagaggaccagagguuaauuuauucugggaagcuguuguuggaucaccaaugucucagggacuugcuuccaaagguacaucacuuacacauuaacuucugaauguuuuuaagcacucaccagguuagguucagguccuuaaguaccuucguauuacuuuuagcaggaaaaacggcauguuuugcaucuggugugcaaugugaagaguccuucaaaaaugccagaaaucaacgccaaggugugucugccucuucaugaugguaacaauuuguaucauucagacuuucaggggaguaauaaaagaaguuggauaaaacguuuauugagagacuguaugguguuauuaccaaguaauauuuuguuucuuuccuaggaauuagaaacuguauuaucaacacaaagugaugaguuaauaguagcagauuguuccguuagugcuguaguagaaagguggaguuacauauugcacuaucuuaugggauaugauuugaucuaugguuacuguguaucuagauuacugaacuaacacuaaucggguuuuuauugaauuuagcacauagcaaguuucuucaaaggagucacuaauuuuuauaaagaguacaaaagugaauauauuuccuuuggaaauuuucauugugauuaguuggauaggaaaagaucagaguuuuuaucaagugaucuuuaaagaauuuuuuuuuuuuaaaaauggucucgcuguguggcccaggcuuuucucaaacuccugagggcaagcgauccucccaccucagccuccugaguagcugggacuacaggcaugugccacuagaccuggcucuaaagacauauaugacacacgaaaccauuuauuuuucauuucacaauguuuauucacauauaugguauuaguauucuaauguagugaugcacucuaaauuugcauuauauuuccuagaacaucugaacagagcauaggaaauucccuauuuugccauuaucaguucuaacaaaaaucuuaaaagcacuuuaucauuucauuucccugcacuguaauuuuuuuaaaugaucaaaaacaguaucauaccaaggcuuacuuauauuggaauacuauuuuagaaaguugugggcuggguuguauuuauaaaucuuguuggucagaugucugcaaugaguaaauuuagcaccauuaucaggaagcuuucucaccaaugacaacuucauuggaagauuuuaaugaaaguguagcauacucuagggaaaaaauaugaauauuuuagcaucuauguauugaaaauuauguugaauaaaugucagacuauuuuuuacauaacguugcuucuguuuaauuuugucacguucagaggugggggguaggagauguaagcccuugacagcaaaauaauuccuuuugcuugauuucagacaguugcaucagcuccuuuguucuguguucauguuacacuuauuuagguggcugaauccacagaggagccugcugguucuaaucggggacaguauccugaggauuccucaagugaugguuuaaggcaaagggaaguucuucggaaccuuucuuccccuggaugggaaaacaucucaaggugaguguuauaauaaagaucuuggcuuaugcaacaugaauguuccucguuugcaucaauuuaagaauaagguauguuuacacguauauaaucagaacuuuuaaacauacagaauuuugcuuuauaaauagcuucgcuuuaaagaucucuuauauauuuaacuuuucuuaauacacagccuuuuaguacacacaaauuuaaaaaguagguaaugcauauauugaaaaaaaaaagaaaauguaggcguuuuauccuuccauugugcugaccgcuugguugccgucaugauaggaaauuagugcugcugcaggagaaaacagcugucguaagcauugugcagcugcuuugcugaguggcuuugugcuuuauuguaacaaugggugacaacaagggagagacuguuuaagaaguguccuuccaaagacuuggggguacuaggaaaauuggccaauuucuuauaacuauuaaagcuuuucuuuagagcaaaagucagaacuaaaugcucuguuauuuggauuuuuauagcucuuggaauacauuguuuuuggggaaaaauucauuaacugcaaguugcaauucuguaacucuccaauucuccgucccccuuuuucuaguacuuuuuauacacaauauuuuauaaagccagguguuuuaggaaugaguuuuucuuccuuuucccccuuaauggaacuuucaaauauacacaacaguggggacuggauaauuaauccccacaccaucacccaggccuaauaaauaacaaucagaguuuuaccauagcucaucuauuacccuuucccuuuuuuuuaaaaaaagaguauuuaaaaguaauucccaggcaucauguuauuucaucccuauauucuucaguauauaacuaugaaaaccuuuuaguuaucuuguauaucuagaaugccauuaucagaucuaacagaaaucuuaaaagcacuuuaucauuuuauuuccaugcacuguaauuuucuuaaaugaucaaaaacagcaucauaccaaagcuuacuuguauuggaauacuauuuuagaaauacucuguguauggaauuuaguuaaaagauugucagcauauaaauuggauaauuauuggauagaaaauuauugguuagaaaaacuuaaaacuacuucccuuauucugauucaacuauucuuaacuugagaauugaggcucauauuugacucucugaaucucaccauauuuaaacuugauuuccuuuaacaaauauuuauugaacagccaguacauacaacuuugcuuaaggauaugaguugaccugcaggaaugaccacauaaccaauuucugaucuuugggcaauucuauuaugguuucaauuuugugaugugcuacugaagaaauugacuguguaagaagcacaaagccaaagaugacucgcauacaccugcccugugaaguugagggcuguguggccugauuaaagaagcaugcauuuggccgggcgcgguggcucacaccuguaaucccagcacuuugggaggccaaggugggcggaucacgaggucaggagauugagaccauccuggcuaacacggugaaaccccgucuguacuaaaaguacaaaaaauuagccaggugugguggcgugugcccguagucccagcuacuggggaggcugaggcaggagaauggugugaauccgggagguggagcuugcagugagccgagauugcgccauugcacuccaggcugggcaacagagcgagacuccaucucaaaaaaaaaaaaaaagaagcaugcauuugacaucagaccagcucugaaauccagcccugcuacuuacuagcucagugaccuugugcaaagccccugucuucccugagcuguacuuggguuccccuuguaaaaucuccuucaugagauugcuguggacccagcagccuguacaggacccccgguggucaguaagcaugcacaggugauaccacaugcacacuucacuauagauucagauggaggauggaggaagaaguggauauugggaggaugggagagauuuccuucaggaaagacugggagaaauguggcuuuugagcugcucucuaaaagaugaacaguggguugagaccugcagugagacucaacaagucaaaacugaggugggaucuacuuaacccaaaaagguuguuuauauaucugugcacucagcaagcagguggcaagggcuguuguuuuccugugggaugggacugugguagaagugcugugucauuuaguaccuucugugcuugugguacaugggugcgucauacagucauuuaccauguaacugccguaaauuccauucuucugucucuucgauuugaauucuugauuuuaauuuaaacuuaguuuucauuuguucauacucaacccacucaaaaugaguguuuuuucaaaucuauguauaggccugaagcugcccagcaggcauuccaaggccuggguccugguuucuccgguuacacacccuauggguggcuucagcuuuccugguuccagcagauauaugcacgacaguacuacaugcaauagugaguccuucccgccaugcuggguguggccagggcucccgggaauugaagggaauuuuauccauguuaccuguaaaguucagaauggagggaugaguguauuuucaucagucugcagagcccugcucuguuuggucuguggguagaguguaaaugacagcugcuaccugauuuguguauugacacaagggugcuuuugucugauacauaguuuagugacuuuauuuagaacauguuacuuucuuuucaauuugugcuaucuucaaaguuuugugaggauuuuaauuugcuacugugccauaaucuuacagugggcuugauguuuaauuucaggugaaauucaccuuguggcuuuucuuagaaaaggcauuuauagauauaguuaguaaggaaguucuucacuaaauugaagaaaaaucaaaggcauaucuaccuacuugaaauucuuaacaguaaaagacugcuguguaaauaagccacagacuucacggugcuuuggucucaacaguaucugccucugucguuuuuauuuuaguuuagcagccacugcugcaucaggggcuuuuguuccaccaccaagugcacaagagauaccuguggucucugcaccugcuccagccccuauucacaaccaguuuccagcugaaaaccagccugccaaucagaaugcugcuccucaagugguuguuaauccuggagccaaucaaaauuugcggaugaaugcacaagguggcccuauuguggaagaagaugaugaaauaaaucgagauugguuggauuggaccuauucagcagcuacauuuucuguuuuucucaguauccucuacuucuacuccucccugagcagauuccucauggucaugggggccaccguuguuauguaccuguaagcagaugguuucucuaauauaaauuacacuacacuguguucacacuaagcagauuuugcucuuuuuguuucuuguuuuuuuugagauggagucucgcucugucauucaggcuggaguacaauggcacaaucacugcaaucuccgcuucccagguucaagcgauucuccugccucagccuccuggguaguugggauuacaggcgcccaccaccaugccuggcuaauuuuuauauuucuaguagagacgggguuuggucauguuggccagguggucucgaacuccugaccucaagugaucugcccaccuuggccucccaaagugcugguauuacaggcgugagccaccacugcgccuggccagauuuugcucuuuuuugagcagucucaguuacuguagaaggagauguguuuaaauaguauaucacucuguggcugggcgcaguggcucacaccuguaaucccagcaguuugggaggccgaggcaggaggaucacaugaggccaggaguuugagaccauccuggccaauauggugaaaccccgucucuacuaaaaauacaaaaaauuagccgggugugguggcacgggccuguaauuuacuuggguggcuaaggcaggagaauugcuugaacuggggaggcagagguugcagugagccaagaucgcaccacugcacuccagccugggugacagagcaagacccugucuuagaauaaauacauaauaaauaguauguauucuggcacuuucgauacaaggaauucauggcuugguuguauggucccaagaacauaucaauccuguguuaauauaagaauauuaucuuguccucuagauaagcuaccuuaccuuccaggcucacaaaccacaaguauguagccauacugaggcauggaacagaaaacuguauuuguuuugaaugagaacacauuugccuuuaucagaccacagcugccuuccaggguaaagucaggcacugacuguuagcauggcccugaaaggcaagggaaccuucacauaccugacauuugguuuuagcuguggcccgaagcaguaguucucaacugggggugguuuuguacccucucuccccaggggacauuuggcaauguguagauauuuuugguugucacaucuaggggaagugguccugcuggcgucuaguuaguagaagcaagagugcugcugaauuuucuacaaugcacaggacaacucccacaguaaauauuuggcucaauaugucacuagugccaaagcugagaaagccuggccuagagugaugggucuucgugguugaaacuaaaagaagaaauuuuccuguauaguaaaaauggauuuuuauuuuagcuuuuaaaaauaaaaaaggaauaauuagaauauaaugaacacucaaauauccacaauuagucauuguuaauauuuuauuauauuuaagacuugggauuuaauugguuucuucaaauaaaacguuuaguuaauauuuucuguagucucuagaaucauauauuuaaaagaccaaauguagguugucauuauguuauauauaauuauagcuuuguagguauaugcauucuccccgcucuguucagguuuucaaggguaagguuuaguucgucauaagcauuuauugagugcauacuaugugccaggugcuguuuauauggcugggugugcaaugaugaauaaaacacagucccugccuucaaggaccuuacagacuggugagaaugucugggagacagugugaucaaaugccucuguagaugggucuugcagugagcuuaucagggugcugcugugauuagagguggggagccuuggauucuugaguaagucucacugugacaucagcuaagauggacuuuuaugugcuuccuuugaaggcaucacguugggugguuuccauuuagaccgaggccgguucagaacuucccaaaugaugguccuccuccugacguuguaaaucaggaccccaacaauaacuuacagguauggagccucccacgaagcccaggcgagcuugacgugauaugccaggcucuccaauccucaaccuuuagauugccagcuugcgguuuaccauuuuauugggcuaaauauuucaugauuuguucacauuucuucuuagagcagcagcuauuuuuaaaacgucgaaugugccaucacauucuaucacauauuuuugacguggcaauuugcauuuuggcuuaaguaaauaacauuuuuuuaaacccacuauuuugagcguucaguggucuguaacaguguguuauaccauaagaacugguaugaagugguuaacuacuaguuuaauaauaguugaagccugggcgugguggcucacgccuguaaucccagcgcuuugggaggcugaggcagguagaucaccugaggucaggaguuuaagaccagccuggccaacauggugacaccccgucucuacuaaaauuacaaaaauuaguugggcgugccuguauucucagcugcuagggaggcugaggcggaaggauggcuugaccuugggagguggagguugcaguaagccaagaucacaccacugcacuccagccugggugacagagcgagacucugucucaaaaauaauaauaauaguugcagaucuaguuguuucauuugauauuugcugccaggagcagucaaaacuaugacaacaucaacacaguugugcuguggaagccugagaaacagcccuauccagccuagggcaucauucccugggguccuggcugccugcugcugugccuauggggcagggggcagggauuuacccugcccuuuccuaacauuauuugguguucaucauagcccuaauuguuuucucauuguuucauuaccucauuguuucauuaccuguaggaaggcacugauccugaaacugaagaccccaaccaccucccuccagacagggauguacuagauggcgagcagaccagccccuccuuuaugagcacagcauggcuugucuucaagacuuucuuugccucucuucuuccagaaggccccccagccaucgcaaacugaugguguuugugcuguagcuguuggaggcuuugacaggaauggacuggaucaccugacuccagcuagauugccucuccuggacauggcaaugaugaguuuuuaaaaaacaguguggaugaugauaugcuuuugugagcaagcaaaagcagaaacgugaagccgugauacaaauuggugaacaaaaaaugcccaaggcuucucaugucuuuauucugaagagcuuuaauauauacucuauguaguuuaauaagcacuguacguagaaggccuuagguguugcaugucuaugcuugaggaacuuuuccaaaugugugugucugcauguguguuuguacauagaagucauagaugcagaagugguucugcugguacgauuugauuccuguuggaauguuuaaauuacacuaaguguacuacuuuauauaaucaaugaaauugcuagacauguuuuagcaggacuuuucuaggaaagacuuauguauaauugcuuuuuaaaaugcagugcuuuacuuuaaacuaaggggaacuuugcggaggugaaaaccuuugcuggguuuucuguucaauaaaguuuuacuaugaaugacccuggcagagacuccugucaucc

SEQ ID NO: 15735 - RNA, 12023 nt, Homo sapiens
ggaugacaggagucucugccagggucauucauaguaaaacuuuauugaacagaaaacccagcaaagguuuucaccuccgcaaaguuccccuuaguuuaaaguaaagcacugcauuuuaaaaagcaauuauacauaagucuuuccuagaaaaguccugcuaaaacaugucuagcaauuucauugauuauauaaaguaguacacuuaguguaauuuaaacauuccaacaggaaucaaaucguaccagcagaaccacuucugcaucuaugacuucuauguacaaacacacaugcagacacacacauuuggaaaaguuccucaagcauagacaugcaacaccuaaggccuucuacguacagugcuuauuaaacuacauagaguauauauuaaagcucuucagaauaaagacaugagaagccuugggcauuuuuuguucaccaauuuguaucacggcuucacguuucugcuuuugcuugcucacaaaagcauaucaucauccacacuguuuuuuaaaaacucaucauugccauguccaggagaggcaaucuagcuggagucaggugauccaguccauuccugucaaagccuccaacagcuacagcacaaacaccaucaguuugcgauggcuggggggccuucuggaagaagagaggcaaagaaagucuugaagacaagccaugcugugcucauaaaggaggggcuggucugcucgccaucuaguacaucccugucuggagggaggugguuggggucuucaguuucaggaucagugccuuccuacagguaaugaaacaaugagguaaugaaacaaugagaaaacaauuagggcuaugaugaacaccaaauaauguuaggaaagggcaggguaaaucccugcccccugccccauaggcacagcagcaggcagccaggaccccagggaaugaugcccuaggcuggauagggcuguuucucaggcuuccacagcacaacuguguugauguugucauaguuuugacugcuccuggcagcaaauaucaaaugaaacaacuagaucugcaacuauuauuauuauuuuugagacagagucucgcucugucacccaggcuggagugcaguggugugaucuuggcuuacugcaaccuccaccucccaaggucaagccauccuuccgccucagccucccuagcagcugagaauacaggcacgcccaacuaauuuuuguaauuuuaguagagacggggugucaccauguuggccaggcuggucuuaaacuccugaccucaggugaucuaccugccucagccucccaaagcgcugggauuacaggcgugagccaccacgcccaggcuucaacuauuauuaaacuaguaguuaaccacuucauaccaguucuuaugguauaacacacuguuacagaccacugaacgcucaaaauaguggguuuaaaaaaauguuauuuacuuaagccaaaaugcaaauugccacgucaaaaauaugugauagaaugugauggcacauucgacguuuuaaaaauagcugcugcucuaagaagaaaugugaacaaaucaugaaauauuuagcccaauaaaaugguaaaccgcaagcuggcaaucuaaagguugaggauuggagagccuggcauaucacgucaagcucgccugggcuucgugggaggcuccauaccuguaaguuauuguugggguccugauuuacaacgucaggaggaggaccaucauuugggaaguucugaaccggccucggucuaaauggaaaccacccaacgugaugccuucaaaggaagcacauaaaaguccaucuuagcugaugucacagugagacuuacucaagaauccaaggcuccccaccucuaaucacagcagcacccugauaagcucacugcaagacccaucuacagaggcauuugaucacacugucucccagacauucucaccagucuguaagguccuugaaggcagggacuguguuuuauucaucauugcacacccagccauauaaacagcaccuggcacauaguaugcacucaauaaaugcuuaugacgaacuaaaccuuacccuugaaaaccugaacagagcggggagaaugcauauaccuacaaagcuauaauuauauauaacauaaugacaaccuacauuuggucuuuuaaauauaugauucuagagacuacagaaaauauuaacuaaacguuuuauuugaagaaaccaauuaaaucccaagucuuaaauauaauaaaauauuaacaaugacuaauuguggauauuugaguguucauuauauucuaauuauuccuuuuuuauuuuuaaaagcuaaaauaaaaauccauuuuuacuauacaggaaaauuucuucuuuuaguuucaaccacgaagacccaucacucuaggccaggcuuucucagcuuuggcacuagugacauauugagccaaauauuuacugugggaguuguccugugcauuguagaaaauucagcagcacucuugcuucuacuaacuagacgccagcaggaccacuuccccuagaugugacaaccaaaaauaucuacacauugccaaauguccccuggggagagaggguacaaaaccacccccaguugagaacuacugcuucgggccacagcuaaaaccaaaugucagguaugugaagguucccuugccuuucagggccaugcuaacagucagugccugacuuuacccuggaaggcagcuguggucugauaaaggcaaauguguucucauucaaaacaaauacaguuuucuguuccaugccucaguauggcuacauacuugugguuugugagccuggaagguaagguagcuuaucuagaggacaagauaauauucuuauauuaacacaggauugauauguucuugggaccauacaaccaagccaugaauuccuuguaucgaaagugccagaauacauacuauuuauuauguauuuauucuaagacagggucuugcucugucacccaggcuggagugcaguggugcgaucuuggcucacugcaaccucugccuccccaguucaagcaauucuccugccuuagccacccaaguaaauuacaggcccgugccaccacacccggcuaauuuuuuguauuuuuaguagagacgggguuucaccauauuggccaggauggucucaaacuccuggccucaugugauccuccugccucggccucccaaacugcugggauuacaggugugagccacugcgcccagccacagagugauauacuauuuaaacacaucuccuucuacaguaacugagacugcucaaaaaagagcaaaaucuggccaggcgcagugguggcucacgccuguaauaccagcacuuugggaggccaaggugggcagaucacuugaggucaggaguucgagaccaccuggccaacaugaccaaaccccgucucuacuagaaauauaaaaauuagccaggcaugguggugggcgccuguaaucccaacuacccaggaggcugaggcaggagaaucgcuugaaccugggaagcggagauugcagugauugugccauuguacuccagccugaaugacagagcgagacuccaucucaaaaaaaacaagaaacaaaaagagcaaaaucugcuuagugugaacacaguguaguguaauuuauauuagagaaaccaucugcuuacagguacauaacaacgguggcccccaugaccaugaggaaucugcucagggaggaguagaaguagaggauacugagaaaaacagaaaauguagcugcugaauagguccaauccaaccaaucucgauuuauuucaucaucuucuuccacaauagggccaccuugugcauucauccgcaaauuuugauuggcuccaggauuaacaaccacuugaggagcagcauucugauuggcaggcugguuuucagcuggaaacugguugugaauaggggcuggagcaggugcagagaccacagguaucucuugugcacuuggugguggaacaaaagccccugaugcagcaguggcugcuaaacuaaaauaaaaacgacagaggcagauacuguugagaccaaagcaccgugaagucuguggcuuauuuacacagcagucuuuuacuguuaagaauuucaaguagguagauaugccuuugauuuuucuucaauuuagugaagaacuuccuuacuaacuauaucuauaaaugccuuuucuaagaaaagccacaaggugaauuucaccugaaauuaaacaucaagcccacuguaagauuauggcacaguagcaaauuaaaauccucacaaaacuuugaagauagcacaaauugaaaagaaaguaacauguucuaaauaaagucacuaaacuauguaucagacaaaagcacccuugugucaauacacaaaucagguagcagcugucauuuacacucuacccacagaccaaacagagcagggcucugcagacugaugaaaauacacucaucccuccauucugaacuuuacagguaacauggauaaaauucccuucaauucccgggagcccuggccacacccagcauggcgggaaggacucacuauugcauguaguacugucgugcauauaucugcuggaaccaggaaagcugaagccacccauaggguguguaaccggagaaaccaggacccaggccuuggaaugccugcugggcagcuucaggccuauacauagauuugaaaaaacacucauuuugaguggguugaguaugaacaaaugaaaacuaaguuuaaauuaaaaucaagaauucaaaucgaagagacagaagaauggaauuuacggcaguuacaugguaaaugacuguaugacgcacccauguaccacaagcacagaagguacuaaaugacacagcacuucuaccacagucccaucccacaggaaaacaacagcccuugccaccugcuugcugagugcacagauauauaaacaaccuuuuuggguuaaguagaucccaccucaguuuugacuuguugagucucacugcaggucucaacccacuguucaucuuuuagagagcagcucaaaagccacauuucucccagucuuuccugaaggaaaucucucccauccucccaauauccacuucuuccuccauccuccaucugaaucuauagugaagugugcaugugguaucaccugugcaugcuuacugaccaccggggguccuguacaggcugcuggguccacagcaaucucaugaaggagauuuuacaaggggaacccaaguacagcucagggaagacaggggcuuugcacaaggucacugagcuaguaaguagcagggcuggauuucagagcuggucugaugucaaaugcaugcuucuuuuuuuuuuuuuuugagauggagucucgcucuguugcccagccuggagugcaauggcgcaaucucggcucacugcaagcuccaccucccggauucacaccauucuccugccucagccuccccaguagcugggacuacgggcacacgccaccacaccuggcuaauuuuuuguacuuuuaguacagacgggguuucaccguguuagccaggauggucucaaucuccugaccucgugauccgcccaccuuggccucccaaagugcugggauuacaggugugagccaccgcgcccggccaaaugcaugcuucuuuaaucaggccacacagcccucaacuucacagggcagguguaugcgagucaucuuuggcuuugugcuucuuacacagucaauuucuucaguagcacaucacaaaauugaaaccauaauagaauugcccaaagaucagaaauugguuauguggucauuccugcaggucaacucauauccuuaagcaaaguuguauguacuggcuguucaauaaauauuuguuaaaggaaaucaaguuuaaauauggugagauucagagagucaaauaugagccucaauucucaaguuaagaauaguugaaucagaauaagggaaguaguuuuaaguuuuucuaaccaauaauuuucuauccaauaauuauccaauuuauaugcugacaaucuuuuaacuaaauuccauacacagaguauuucuaaaauaguauuccaauacaaguaagcuuugguaugaugcuguuuuugaucauuuaagaaaauuacagugcauggaaauaaaaugauaaagugcuuuuaagauuucuguuagaucugauaauggcauucuagauauacaagauaacuaaaagguuuucauaguuauauacugaagaauauagggaugaaauaacaugaugccugggaauuacuuuuaaauacucuuuuuuuaaaaaaaagggaaaggguaauagaugagcuaugguaaaacucugauuguuauuuauuaggccugggugaugguguggggauuaauuauccaguccccacuguuguguauauuugaaaguuccauuaagggggaaaaggaagaaaaacucauuccuaaaacaccuggcuuuauaaaauauuguguauaaaaaguacuagaaaaagggggacggagaauuggagaguuacagaauugcaacuugcaguuaaugaauuuuuccccaaaaacaauguauuccaagagcuauaaaaauccaaauaacagagcauuuaguucugacuuuugcucuaaagaaaagcuuuaauaguuauaagaaauuggccaauuuuccuaguacccccaagucuuuggaaggacacuucuuaaacagucucucccuuguugucacccauuguuacaauaaagcacaaagccacucagcaaagcagcugcacaaugcuuacgacagcuguuuucuccugcagcagcacuaauuuccuaucaugacggcaaccaagcggucagcacaauggaaggauaaaacgccuacauuuucuuuuuuuuuucaauauaugcauuaccuacuuuuuaaauuuguguguacuaaaaggcuguguauuaagaaaaguuaaauauauaagagaucuuuaaagcgaagcuauuuauaaagcaaaauucuguauguuuaaaaguucugauuauauacguguaaacauaccuuauucuuaaauugaugcaaacgaggaacauucauguugcauaagccaagaucuuuauuauaacacucaccuugagauguuuucccauccaggggaagaaagguuccgaagaacuucccuuugccuuaaaccaucacuugaggaauccucaggauacuguccccgauuagaaccagcaggcuccucuguggauucagccaccuaaauaaguguaacaugaacacagaacaaaggagcugaugcaacugucugaaaucaagcaaaaggaauuauuuugcugucaagggcuuacaucuccuaccccccaccucugaacgugacaaaauuaaacagaagcaacguuauguaaaaaauagucugacauuuauucaacauaauuuucaauacauagaugcuaaaauauucauauuuuuucccuagaguaugcuacacuuucauuaaaaucuuccaaugaaguugucauuggugagaaagcuuccugauaauggugcuaaauuuacucauugcagacaucugaccaacaagauuuauaaauacaacccagcccacaacuuucuaaaauaguauuccaauauaaguaagccuugguaugauacuguuuuugaucauuuaaaaaaauuacagugcagggaaaugaaaugauaaagugcuuuuaagauuuuuguuagaacugauaauggcaaaauagggaauuuccuaugcucuguucagauguucuaggaaauauaaugcaaauuuagagugcaucacuacauuagaauacuaauaccauauaugugaauaaacauugugaaaugaaaaauaaaugguuucgugugucauauaugucuuuagagccaggucuaguggcacaugccuguagucccagcuacucaggaggcugaggugggaggaucgcuugcccucaggaguuugagaaaagccugggccacacagcgagaccauuuuuaaaaaaaaaaaauucuuuaaagaucacuugauaaaaacucugaucuuuuccuauccaacuaaucacaaugaaaauuuccaaaggaaauauauucacuuuuguacucuuuauaaaaauuagugacuccuuugaagaaacuugcuaugugcuaaauucaauaaaaacccgauuaguguuaguucaguaaucuagauacacaguaaccauagaucaaaucauaucccauaagauagugcaauauguaacuccaccuuucuacuacagcacuaacggaacaaucugcuacuauuaacucaucacuuuguguugauaauacaguuucuaauuccuaggaaagaaacaaaauauuacuugguaauaacaccauacagucucucaauaaacguuuuauccaacuucuuuuauuacuccccugaaagucugaaugauacaaauuguuaccaucaugaagaggcagacacaccuuggcguugauuucuggcauuuuugaaggacucuucacauugcacaccagaugcaaaacaugccguuuuuccugcuaaaaguaauacgaagguacuuaaggaccugaaccuaaccuggugagugcuuaaaaacauucagaaguuaauguguaagugauguaccuuuggaagcaagucccugagacauuggugauccaacaacagcuucccagaauaaauuaaccucugguccucuggacgcugaucauggaaagaaagaguaacacaggucagcauuucaccccuacaaguuccuaaacacagaauaaacuguuuuauacaaguaauuugaauauguguguuuccccccagcaucacgggaaaacacuuucucaaaagccccauauacaagacuucuauuuagaaagugucuuaacuuuaacuggucucuaacacgcaaauaaauacagaauggcaaauuaucggcugggcaugguggcucaugccuguaauccaagcacugugggaggccaaggcgggcagaucaccugaggucagggguucgagaccagccuggccaacauggugaaaccccaucucuacuaaaaaugcaaaaauuagcugggcgugguggcuugugccuguaacccaaacuacucaggaggcugaggcaggggaaucgcuugaaccagggaggcagagguugcagugagccaagaucaugucacugcacuccagccugggcgacagagugagacccuaucucaaaaaaaaaaaaaaaaaaaaaaaaaaagaauggcaaauuaucuccaguccaaacuuaacucccagguaaacugacugacuccuauuacuaaaagcaacaaacagcaaacagggaaccuacaaccaaauugaguuugguuucagagaaaacucagagaacucccaaggccagccuuaaccaaaaucacccagcagugccccaaaauaauaugaagcuauucuaaacugaagccuucacagacaauuuccuggcauacaaaugcaguuauagaggagauggcgugugggugacauuauacacaaccacccugugagauuuaguaucccuauuuuaagggaggaaagucugaaaaacugacuuguccaaggucaucugcugccacagugucacaauuccaaccccucuucuccuccauaucagugauuuuaacaccauagggacugcacacucuuuuauacaaaucucauuuuuaaaaucuauuugaaacuccgucuaaauuguacuuaaaaauaauggccucaaauaauauuaacauauaaucugucuauuggagaucacuaacguguuaaucuacucuugccagaauaacugauuaugcgaaaccuggaauaaagguguuccugccaaguagcuugagauaauuaaagcaagcuguuuaaacaaacaaaacagcaaaaagugcaucuacuuauccauauacaucagaacuuuuugacacuguguaacuaaaccaaaauaaauauacugaaugcuguguucaccguuuuucugacggaugagaacuuuaaagguaaaugcuaauacauacgugaauuuggaaaacaguaccuuuuguauauguaggguccugcauuuauuacagaguucaaccaauagaaaaggccggaaaaccacagcugccagugguuuugaauuauuuucccccuuuuaaaggccuaacuugauauugagucuucacacagauggcugauuugaaaaauauuaaguaaagcaaacaacuauuacaaaguaggccuucucauauuaugccauuuucuacuacagaaaacaaaugauaaguauguuucagccauaauaauuuuuagacacaaauuuguauaccugagagguauuuguuuacaauguuaggucuucagacugaacagaugggagcggcauuccucaucaaaggaagaccuuaaaaauccuccgccaaaauccugccuuuugccauaugaugcaaccauaggcuacaccugcuucaccaauuuguguacccaauagucauucucauggcaacacagccacccaguuucuuggaagcagcuauggugaaacugaaaaaugugccagggugaauucuagaggacauggaaugcaagcuuacuaaauaaauaugcaaauuucaaaauaacaacucagaaggaaaacucacuucuaaaacauucuugaccauaugaaacaaaaacagacacaggcgcuaccacaagcuggaacucacgacuucacuaucuuuuccugcccggaugcccucuccugugugaugaagaauuaugcucgugggcagugaagaacacugcugacacuuacauaauaucagagcagaaaguaaauacaggaagggccagcuuacagccucaucacgugguggccagggcaggcggugcuaagggugauguugacagaugugucaaccaaaacaaagcaaggaagucuugcuaauaauggagaggcugccguccuaaaaccagacugaaggcgacuccugccugcuucccuucucagucgcucuuggucagaaagugcacggggcuccaccccgggacucggcaauggcugcucgguccagugcgacagggaggggcacggcggaagguggccagggaggagaagagccacguccugcuucuggguguggggccuuccguccacagugucugggcgguccccagguuucucaagccacggccccggguggcaccugcccgcuccucucccugcagagaggcugcguucagaaaccucauuuugcagcacggauguuuucuuacuucuagccauuggaugcaagcccaauuaggaacaccgaguugccuggccgcugggggagaaacaggcuuggagggugaaaugacucgcccaaggucaggcugcugauuacugacggcuacugggcaacagaggggcgcccgcgucggcggggcagggaaggggagaccacagcccugggggaggugaccggccgagcgaucgcagccgucagcgggaggaggccacaggacagggcagccggacguggcauccccagcagagggcggggggccacagccuaggggcgggaagucggggccgcucucaccggacgcucgggguagacgcggcucaggugggccuugagguggcccacacuccagccgcggucgccacucagcuccaagucgcgguggcgcugguuggggcucuucaccaggagcgugacgggcucggguucggucucggacuccauggcggcggcggcggugucggggcuccgcugcgcuccuaggugccaggcaggcggcgucucagccgcccgcaaucucugcaacgacaguucacgucucuggggcgcgcgcccccgcuucgggcgccuuuuauagaagccccgcgcccggcucugcggacagaacgcucuguggcugccgcccauuggcugaggcggaggcacucucccaacguggcccaaucggcguccggauccggguggcagagggcggaccgagcacgugggcacgggcugaugcaacccgccgcgucugcgucacccagaggcgcggcugugccccgggaacccggguucgguggccauguuugggugcgcugcaggccgcgcg

SEQ ID NO: 15736 - RNA, 15766 nt, Homo sapiens
ugccaguucccugcugcugcagagccuccugcugucccucucugagcugaagacauuucgguauguagacaagacauucacucaguccccuuugcagcucugcccugcccugacaccucccguuauucccagcccugggcucagaggacucuuacucugugucuuacucuguggacacaaaccacagguggcccuggagaugauuuuuagggguaccuagucguaaacaugaccuuaggaacauugagccacauggcaagaaaguuguucccuuuuuaacacucuuucauuguuuuucuuuuaaaauaacugcgaacuaacacaaaguuucaagaagacugagaacugcugugugccauuuacccaaauucacccuuagagcugggcgugguggcucaugucuguaauccuagcacuuugggaggccgaggcagguggauugccugagcucaggaauucgagaccacccuggacaacacggugaaaccccgucucuacuaaaauacaaaaaaauuagcugggcaugguggugcaugccuguaaucccagcuaauugggaggcugaggcacaagaauugcuugaacccgggaggcugagguuacagugagccaagauugugccacugcacucuagccuaggugacagagcgaggcucgguuuccgaaaaaaaaaaaaaagaacaaauucacccuuugccaaucuuuuuccacauuugcucauuucuucccucccuccuucuuucccaccucccuuuucuuucacucucucccucucuccuuuucugaaccauuuagaaguaaguuguaaucaugucccuuuacccguuaacauuucagcgaauuugcuagaaauaaggacauucucuuccauaauccaguaaaauuauaaaauccaggaaaugugacauugauacacuacuauuaucucaacuacaguuuauacuccaaucucaccaguucucccaauaauguugcuuauugcauuuuuuucccaguuguggauccaauccaggaucacacgucucauuuagugucaucucuuuagugucuccuucaaucuggaacacguccuuggcccuucuuugucuuucauagcauugucucugacauuuacaggccaguuauuuuauagaauguccuuccacuuggguuuguccaauguuuccucauguuuagaguuagagucugcccuuugggcaggaauaucacacaggugaugcuguguuaucgugccuuccaucggggcacaugaugugucagaguccucgggcuagugauguuaacugugaucaccugugacaguggugucugccaggucucuccacuugcaaauuuacuaacuuucccuuuguaaucaacauagauuauguggggagauacuuuaagauuauguauuaagucuuccucaaacucucauuggcaaauuuuagcagccguuaauaaaucuuacuuaaaucgaugaaucagcaugacaguugcaaaauguagcuuuccuaacuuuacauuuuauuuccaucuaacugauuacaccaagaagaaacucuugggcugggaacaguggcucaagcuuguaaucccagcacucugggaggccgaggaggaaaaaucgcuugagcccgggaguucgacaccagccugagcaacauagcgagaccacccccaucucuacaaaaaauaaauaaauaaaauaaauguuuaaaaaggaagaaacucuuuaggacagagagaucuuugacacuucuucaguauuugcuuuaaagaugcagaguuuguaauaaacaacaguaacuagcuaaacuacagugauaccuaauccuggcuuaaguugugaaguugcuaccugaaugacugcgguuuaggaaauacugaacuaguccaugcuucugcuuccaagcucugugguggcuuaaugaguucaugguggaagagauuuacgaagggaaggaggucuccucacauugcccgccacaucccuaccccacauccuugcccucugccaccagcauucagagcucccaagacccagggcggcuccugccugaccuguugcccuuugacccccaccaggcugaccuccagcugugugagcaccgagggccucgcccaccuggcaucuggucugggccacugccaccacuuggaggagcuggagugaguugcagaguggagggauuggggacaaguggcccagcugagggugagggguggagaagagagcagggcguuugggagggcaggcaaugagacuucaaccaaugacccuuccccugaugaagugcagcaguucuggguguggccuggggaaggaagagcaccacaguuuuggucugaauuucgccacugacucacagaggggcugugggcauggcuguuccacucugggcuuugauugccuuaucuaugaaaauggggcucaugagccuugcucugcugggcuggcugugggagucaggcuacggagagggcugaagaacaagagggugugugugugugugugugucccuagucccccagcuuccucucugcagccuucauccagggcauaguuucucagcugggccagcugugacuaucaugccuacccagagccugagcccuggagcuagggauacccauggggaaccuggacagcgaggguggcccagggcaugcagaugcagaguuggccucccaggggacagagcaggagaggggagcugacaggacagcucagcuccagggcugggcaggcugcgcuaacccuugccucugccuggucuucugcagcuugucuaacaaucaauuugaugaggagggcaccaaggcgcugaugagggcccuugaggggaaauggaugcuaaagaggcuggaguaaguagugauggugguugugggugagugaguggugggggugguuaauggaugguggaagugggugaguggugggguugguuaauggaugguggaagugggugaguggugggguugguuaauggggaauggggugagugaguggugggagugguuaauggggaaugggcugagugaguggugggagugguuaauggggaauggggugagugaguggugauggugguuaauggggaagggugugagaguggugauggugguuaauggggaagggggugagugaguggugauggugguuaauggggaaguguugugagugaguuguguuggugguuaauggggaaggagaugagugagugguguuggugguuaauggggaaggguugugagugagugguggcguugguuaauggggaagggggugagugaguggugauggugguuaauggggaagaguugugagugagugguguuggugguuaauggggaagggggugagugaguggugggguugguuaauggggaaguguugugagugaguggugauggugauuaauggggaaggguugugagugaguggcguuggugguuaauggggaagggagggagugagugaugauggugguuaauggggaaggguugugagugaguugugggguugguuaauggggaagcguugugagugaguggugaugguugguuaauggggaaggguugugagugaguggugauggugguuaauggggaagggggugagugagugguguuggugguuaauggggaaguguugugagugaguggugauggugguuaauggggaaggguugugagugagugguguuggugguuaauggggaagggggugagugagcgaugauggugguuaauggggaaggguugugagugaguggugggguugguuaacggggaagggggugagugaguggugguggugguuaauggggaagggggugagugagugguguuggugguuaauggggaagggggugggugaguggugauggugguuaaugggaagggagugaguggugauggugguuaauggggaaggguugugagugaguggugauggugguuaauggggaagggggugaguaaggggugggggugguuaauagggaagaguugugagugaguggugggguugguuaauggggaagggggugagugagggaugacagugguuaauggggaaaggagugagugaggggugauggugcuuagugcugcauggucagugaguagcaugccuaggaaccuuugcauguuuugugaacacaaaccgccauguuucuggauggacccaggugagcugaaugcccuuacaugaccuuuuacuuucuauucuggaucucagugccagcaagaaccuuggucauaggaaacagaauacacaacucaaagcaauccaagacagaaauauauuggcuuaugucauggaaaauuacgaggccaaugacuucaggcacagcuggauccagggguucuauauuugucaggcuucucucucacacacuucacucuggcccuuacucuuucucuguccaccuuggcuuccuucucaggcaggccaucccugcaccugcaggcuuacuuucucucagcuuaguggaaagggaguaccauucucucugugguuacaacaaaagguccuagacugagucucacuggacuagcuugagucaccugccccacccuaaagcaaucacuguggcugugagcacaaaauauucuccucacuggccagaccugggcgcaugcacacccuaucuucuggacuuagaggggugguauuucaggaugugaguaacagaagaggaaagaaacucugggcagaaaaaaaucuacagauguccacuacauuugucuacaguuguuuccuugguaacuggcagcuuuuacuacucucccccauaauuugaagucaucaaauucuuagaaaugccagaaacagccucagucuaaaagacagguccccguccugcacagauuccuguuuagacaguaucuggacagaaaauuuaacagaauaucuucugcuuuucaucucuuaacuuuuucugaugaccaaaaaaguuccaucuuucuagaaauauguaacaaauaacaugaaaugccccggggaugacacccccugagaaaacuucuguugaacgguuugugaauuuuucuccagauuuuuuuuucuacauauguuuugaauucagcuugaaaguagccuuuugacuuuuugccccuuaacauugaaauucuuccgcuugucccucuuugcuuguccuggggagaggaucagguaaaaggagaagagggauuacagagaccuuugaccacagggcccuccugucgucucacuggucuguuucuuugcccacuguccauguaccugcaucucggcucagccuucuggaagcuuuuauuuaggggauuggaggcccagugaggucauucauuggcucauucaugcauucgacaaauauguacugagcugggcaccugggccggggacaggacagauucauccaugccccugggggccuuuuucuuccuccugauuucccaggcaccaugugcugcuccuuaccuccugcugccuuaguugcccuaucuguaaacugggcauaauaucuucccuguccgaaggaaggggauggaucgucagugcccggaggucucuucccaucucagaucugucauuuccaaguguaacuccccacaggcaguuacccucaaauccagucagcuucuuccagcuguauaccugugauggaguggguaggagcauggacccuaguuaggagccucacugccuggguucaacucugggugggguaacugacacuuccaguuugcuuggagcuuuccccauuuuggcacccaaagucccacauccaggaaaaacucuucuguucugagccaaccaagacaguugaccaucuuuugcuucugccucuuauuuuauuauuuauuuauuugagacccagucucucuccguugcccaggcuggagugcaguggcacagucuuggcucacugcaaccuccgccucccggguucaagcaacccuccugccucagccucccaaguagcuggcauuacaggcacaugccaccaggcccagcuaauuuuucuauuuuuaguggagaugggguuucacuuuguuggccaggcuggucucgaacuccugaccucaggugauucacccgccuuggccucacaaaguccugggauuacaggcaugagccauugcgcccagccaguucuguuucuuaaugugugaacucgugccagucccucagccucucuguucuuuggccuccucaucuuaacuuugaggauaagagcaaucuccccugcuacgguuguugugaguauuaaaugagauaauauguguuacagucuuagagucuggucagaguucacacucuacaagugcuagcuauuguuauucuccucuccugccuaggcugggggccucuagaaguacaaucgccugggucacauaugguuggggcucaggaaugggaguucuauaguuuuugguucuguuccugaagcagccacuuuguguaugaccuuaagcaaguucucuaacucucugaaccuugguguuccucaccuguaaaauggggacgauaauaaacccaccuuuccagauggccccaagcccugaguuuggcccacauuuuaugaucaaugugugaccgccauuauuacggaucauuagucuugguccaugugguucagaacauagaacugcugccugccugaccucaguaauucaugcagagaaacagcauuuggaccucccaguacaguucauuuuguagaauuuuuacacuguguggauauaaguggcugucuuggaggucccuaggcuugcuaagcacagaggccucagacccccagacuggacagugccccacccccagaugucaaguucaccuggccuccucuucuccagccucagucaccuucugcugaacagcuccaccuuggccuugcuuacucacagacuaagccagaugaccugccugcagagccucaggugagugaccgagcggccccaugggaaugagugggaagaaacacuucccacucaguugggaccacauccagggaagcacugaggccaccucccaggggauccuuugcggaucccucccaggcccaucccugugcccucccaggugggugcccacugcucuugccuucuaaugccaucagcuuccuccugguuacaaaaguggccuaaagggcuuaggcccacgucguagaacaacccuugaggcacacacacaguucacccugggcucuuguuaaaaugcucauucugauuccccaggucuggaauucugccuagacugugcuuuuuuuuuuuuuuuuuuuuuuuuuuuuuuuuuuuuuuuuuugaguuggggccucacuguguggcccaggcuggagugcaguggcaaugcacaggugcaaucguguugcacugcagccucaaacuccugggcgaacgugauccuccugccucacccuccuaagcagcugggacuacaggccuaaggcguugcacccaaacuuagcauuucuuuuuuuguuuguuuguuuuugagacagaguuucgcucuuguugcccaggcuggagugcaauggcacaaucucagcucacugcaaccuccgccucccggguucaagcgauucuccugccucagccucccgaguagccgggauuauaggcaugugccaccacgcccggcuaauuuuuguauuuuugguagagacaguguuucuccauguuggucaggcuggucuugaacguccaaccucaggugaucugcccaccucggccucccaaagugcugggauuacaggcgugagccaccacgccuggcuucagacucugcauuuucuaacaagcuuccgggugguaucaauucugggggccacggucagcacuuugaguagugugggucuagacucagaugggguggccuuccuacacucccuuugugauuucacucccugcugcuaggauaaauaaacaugacacuuacuuucaaugugauuuuucaaaacaugaaaucuugugacuaaaaacaaauccaagcagugacacaaagcauugcuuuguuuauauccaaguacaccuccuacccccuaccucgggcagagcagaguagguaggaaaugagguuagagaguuccaggagguuauaucauauuggaccauuucacccaaaauuaauuuacugaaaggugauccauuaaaguguauuuauuuauuucuauuuuauuuuuauuuuuugagacacagucucacucugucgcccaggcuggagugcaguggcaugaucucacuucacugcaaccucugccuccuggguucaagcgauucuggugccucagccgcccaaguagcugggauuacagguaugcaccaccacgcccagauaauuuuuguauauuuuuaguacaaaugggguuucaccauguuggccgggcuggucucgaaccccugaccucaaaugauccaccugccuagacuccgaaagugcugggaauacaggugugaaccacugcucccagccccauuaaaauuuaauuugcaaaauaaaagaaaguaaaaacaacaugcaaacaaauacuucccaaggggcuaagaccauuugccucagcuauuuauuguuuuuuccuacccaggcagagcaaggucagggcucaguaaagacaauacccuggguuuaaggaaaaaccuaccauuugcauggaugagaacacauaugccccugagaacugaucugcgugaaucagagaaucccacgugaaaguggcauucagccgggccagcccggagaucccugacacagaggcugaggugaagcuuggcaaagaaauguagagacuccuccugggccaggggcucuggauuuguuuccacccagccugcaagucccuaagucucuggccagucacagcucacugcuggcucucaaguuuucucaccuggacacuggggacaauaauucccaccuugcucaccacuccccaccugccaugacccccagaaguuuugcuaccagcauaugaauuccugggcguguaaggcuuugcaaacuguagaguucuuagcacagcaccugcaaaggccuuuaagcuccugaaagccucuuggucuauucccugcuuuuccagacugaacaggaacaguaucggugaugucgguugcugccaccuuucugaggcucucagggcugccaccagccuagaggagcuggagugaguugcccauucugcccccagacccaggacaauuuuggccgggaaagaugacaagggcaaggggcuaccugagcacgcccuuugcuucuucaucucaucuccuucacccacuucuacacuguguaaacaaccuggggccuagaagcuugggggacccaaagacaggauguaagagugucaauuguagcaagagggauuuaggucagacaauggggagaacauccuaaacagaagccaaggguuaggagcugucacucaacauggggugauggggcucucugugugagucgaggcccuuccugggacuucagccuccccuucuuuuucugggagugggguguggacaagaugagacggcagaaggcugaugaagcuguuuucucccccaagcuugagccacaaccagauuggagacgcugguguccagcacuuagcuaccauccugccugggcugccagagcucaggaagauagagugaguagccagcccuacagaggagggccacaggggucacacgaugguccuaggagauacuggccccuagcugaggccagcaugguaaaaucuccccugcgccaaccucaguguccaggcaguggggcucggugaccuccuggcccucacugcgggaccuuaagccaccccagccccugcucuucucugggccuuucugccucauugucuggguagguguguggugucgggggguugucucuuaggcccccugaagcagggguggcagacccagcagaugugcuggggugucggggagagggggcaucagaggaccugauggcugccccccucccacagccucucagggaauagcaucagcucagccgggggagugcaguuggcagagucucucguucuuugcaggcgccuggaggaguugaugugagugucugcccagguggccucugcccucugugccccccagguccaccuggccuccucucccgcagugggcacagggcagggcgggggucccgagugggcaggcccaguacucaaugcucauuccucuccucuuccaggcuuggcugcaaugcccugggggaucccacagcccuggggcuggcucaggagcugccccagcaccugaggguccuacagugaguggcccccugcccauaccaugcagggcugguggggaggaggguccucgggagcaguggggggguccaggcccccaucaguugagcugcccugccccaagucaagcuuggcauauacccacucuccugccuguuccuucccugccucugaugucugcagcaagaaaaucaggaggcccagccuaguccuggcucugccacuggccccugccugaccuuggccaaaccccugccccuucucagccucaguuucuucacaugcaaaagaaguacaaugaucccaguucauugugcccugugagcgggucccugagggcgaaugagaaauccuggcagagggcuucgcaggagcacggugccaaucaacguggccucagcacuucacaaaugaccucauugcagccccauggcagcccccagagucccagagugcugggaccuuguuuuuuuuuuuuuuuuuuuuuuuuagauggagucucucucugucacccaggcuggagugcaguggugcaaccucggcucacugcaaccuccaccucccggguucaagcaauucuugugccucagcuaccagaguagcugggauuacgagcaugcccaccaugcccagcuaauuuuuguauuuuuaguagagacggcauuucaccauauugcccaggcuggucuuggacuccuggccucaagugauccacccaccucagccuccaaaagugcugggauuacaggcgugagccaccauggcuggcuggugcugggacuuuuaugugcucccuuuuccaggcaagggaaugaaggccaggagagguguggagaauuuuccuuacucauacacgaaggacccagguguugaauuugggaucucagaccccaaagccaggguccuugauaccuacccagguccuguguggauggggaauuagccagagacugucuacgggcuggcacugcagccugagacaaggcugaggguggggcucuggaaacgccagucccucaggcuccucucacccucuccucuuuccccagccuaccauucagccaucugggcccagguggggcccugagccuggcccaggcccuggauggauccccccauuuggaagagaucagguaaguaggggcugcccagcccaggcacggggacaguccugggcgggucuggggguuccucucacagguaucuccccuacccugcagcuuggcggaaaacaaccuggcuggagggguccugcguuucuguauggagcucccgcugcucagacagauagaguaaguagccuccccugccugccuaggggaccaguggcaggcugagggcagcccuucucugacugagccuaacaccuggggaggccuuugaagugauagaagccccagggauggugggggccuggcucaagaaaggaagucuuuccuaaaacgccuagcuuaccccagacccugguggcucuggaggcaggaccugcuagauccccugacucaaacaacccccaucccaucccaugcccuucuccauccccagccugguuuccuguaagauugacaaccagacugccaagcuccucaccuccagcuucacgagcugcccugcccuggaaguaaucuugugagugauuggaagagcccugagcuggcugggaaaaggaaaagucgggaggggucgggggaguuggcuccagccugcuguguggccuggagcugcucccauccucucuggccaguccucccauuuguaaauggggaagaucauccuuacucagacauccucucaaagacauuuuaacacuugagcugcagguaauguuggguaaaacaguuuaccuucuucugccuuuuuccccauuuguagauuggugggaggggagguggaccagauggucuuuaaagguuuuugguccaaccuuccuuuugggaggcaacuggauagaccaccuugccugcuugaugaaaccuccauuuaugaaccacaguugguagaaacaguggcuaaagccaggagaaagccacccccagaccugcuggcuggccgugcuuggcugucucuuagcaaucagaaucccccagaccuuggggcuuugcagugcugccucaugaguaaacuagaauucuaggacuagccugggacccuaaccaugguauggaggacaaagcuguuuccuaaagaacaggacacaagugauuacgagaagauuuuaguuugcauccuaaaggucuuaacccuucucauuacaccaaagcgaaagucucagaucagugguaauucaucuuuaacaccuaacacuggauucucccuuuuuaaccaaaaggguuaaaaacccaacaucuuaggaagggcauauguuccaacuagaaguuaauaccauuguuuguacuauauuuauuuuuguaacuaccuucuauauggagucuguaacacaaguuuuccauugauaguagcaauaaaaguuuccuuucaagauuuuuuuuuuuuuuuuuuuuugagauggagucucccucuguuacccaggcuggagugcaguggugcaaucucggcucacugcaaccuccaccugccggguucaagagauucuccugccucagccuccugaguagcugggauuacaagugcccaccaccacacccagcuaauuuuuguauuuuuaguagagacaggauuucaccauguugguuaggcucgucucaaacaccugaccuuggccucccaaagugcugggauuacaggcgugagcaaccacgcccagccaagauuaauuuuuuaaaguaagaaaaaagagggggccaauuuaaagaaaaauaugaugcaucuuaaauacaggagguacauguauguggcaaaaauggcaacaucuugugaacaacgucaugauucaaacuugacggggaggggagcagggaggaagguaaccugcacccugacgucuucaggggaggacacacaagcacccuaucagguggccucucuugaaaacccuugcccccacgacuggcacccugcuuuccccauucacugccuugucuccaccccucgaccuccuugcucuccugccgcugacuuugggaccccuacccugcaggcuguccuggaaucuccucggggaugaggcagcugccgagcuggcccaggugcugccgcagaugggccggcugaagagaguggaguaugaggggccgggggaggaaugggacgggcuaaagggggaccuacaucccgggaacaccaagaggccacugggucaguccccugccucccagaaagcccuuccuugaguugcacacucuggccuguuccaagccccugccaggcuuaguucccccuggguucuagccuucagccuuccugcugcaccugccaccaguccccuguugucuuuuggguucccugagaagguagugugggagacuguguccccugaccuuggccugaggaagggaccuaggaaacucucacacccauucucauggccguguuucucuuuccccuccccucacuguccacugagaagccuggagaagaaucagaucacagcuuugggggccuggcuccuggcugaaggacuggcccaggggucuagcauccaagucauccgguaacagaggccugcaggggcagggauggugggugggaggcuacaccaacccccagaucuaaugggacucccuggaggaggcggcagggccugggcuggggauuaucaaaggagacuuggaccacuccaccaagaauuuggcagcaagcagacuuggaucaaaccccagcucugccacuugccaacuguguaacuuuguagccauaacucaaccucucugaaccccaauuuucucaucugugaaauggggauacugauaguaucuaccucagagaguugugaagacuaaaugagcauauaaagcacugaacccaaugccuggcacauaguaagcacuuaaaauggcagcuauaaucagagccaucacauacaguuguauagguugugcacugcacaagggcauuaaaccuaaggggcaccauucacauugucaaccugcuagauuucuagcagaugagaguaaaguaccuuguucuaccaaaaucauauauuaugacaauuucagacagauggaaguaaaacaucuugaagaaagagggucuuuuccuuauuugcacaaaugugucauaugaguguggccuuagcuggcaucacuaucucccagggaggaagguugaguuggaggacucaggaggcaggugugggguacacccucucccuaggucagcuaugcuggucuaacaccugccucugccagguaacucuaggcacagcucuaccuuuuugggccucagccucccaaucugcagauacgacagauggcaaagaugggaggaugaaugagugccuauaucugugccccacagccucuggaauaaccccauucccugcgacauggcccagcaccugaagagccaggagcccaggcuggacuuugccuucuuugacaaccagccccaggccccuugggguacuugauggcccccucaagaccuuuggaauccagccaagugaugcacccaaaugauccaccuuucgcccacugggauaauugacucaggaaagaagagccucggcagggcgcucugcacuccacccaggaggaaggauacguguguccugcugcaguccucagggagaacuuuuuugggaaccaggagcugggucuggacaaaggaguacccugcauuacgugggauaugugugaucaauuggggacaugcgacacacaaugagggugucaugacaaugcaugacacguacgguuauauguggcagugugaccccuugacauguggcguuacaugaaagucaguguggcacguguucuguggcaugggugcuggcaucccaaguagcaggauacaugauuguuggucuauauaugacacaugacaaauguccaugucacaggacucauggcuggccagaugaccucaggcuggcccaagaucuaauuuauuaauuuuuaaagcaaauacauauuuauagauuguguguauggagcagcuaagucaggaaaagucuuccgcccgagcugggaggggagaguguccaugcacugaccaguccaggggcucaagggccagggcucuggaacaagccagggacucagccauuaaguccccuccugccucaauccucagccuacccaucuauaaacuugaugacuccucccuuacuuacauacuagcuuccaaggacagguggagguagggccagccuggcgggaguggagaagcccagucuguccuauguaagggacaaagccaggucuaaugguacuggguagggggcacugccaagacaauaagcuaggcuacuggguccagcuacuacuuuggugggauucaggugagucuccaugcacuucacauguuacccaguguucuuguuacuuccaaggagaaccaagaauggcucugucacacucgaagccaggcuugaucaauaaacacaaugguauuccacgucuagcgugaau

SEQ ID NO: 15737 - RNA, 34218 nt, Homo sapiens
aagcaguguuuccuuccagcccuguuuauucuauucuccuuuggguuugaacuucaaggucuacacuagauacuuuccaaggcugcuuccucuguuggucagaucagacgcugcuuuguuagcugugguugcuacagaagcucuguuucaguuccagagcucugugcugauggggacaauggaauaugaugcaaugaucaccagugauucucagucucuccugagacaccagaagguaagucacagucugaagagucucacucaaccuucucaacacaaucuagcugagagacauggggagagguggaagcacaauauucaguagaggaaaaacaagaucuuguucucugacagguuuauuagcuuucauguuaauggauguuuuuaaacccugcaacccucugucaacuucuuuccacaucaagaggccaugagauacaguaauggccucuuaagagucaugccacauaaagaugaugacuuugauguccuggccugccuccuguaacaaugugaggcuguuuuggguacaugcuguaauaacaacaggacuaucacaggaacaaugaagcagagaagcagaaggugccuacaaaguuuuaccuaaaugucuuguuugucaggauggagcugaugcgcccauacuggcagaacaauuagcacagaguaguucugaaaaggaggaagaauucacaaagcaucaguuaugggugcagggaagucgccaucugccaaugggcaccagagugucacuguacuggaaggggaaaaggagugggcuggaugagauccaggggccucucugcccauguucaaagucaguagcugcucugccugccggcaucacagugucaacacauuuugugugugucucacucagucucacacccaagaaaguaaaaacaauugauguaggaauaaggggaauggauaaagaaugguacaugcuuauucuaaagcaggagagccuacagauuguugucaaagcucaugucuaucucuguccucgaggccuccacaccaucucccucucccuccuccagaauccaagggaugagcccguuucccuuuaugagacgagguggagcaguaccucuaguuuuuggcugcucauggccucagaguugcuguuuggaaaggaaaaagagcagcagaggcagcaaagaaaaguacuagggcagcaccuuuagguuagaaauagauuccacaguuaaaagcacaaguauaauaugcauuaaacagagaagggccucaauagaauggucacaauaugcaagugugucccacucauuuacaauauuaggauuccaggagcugccagaaauaagucaucucauuaacauaccuaccugcaguucugaugucuggcuauuaguaaacaaggccuacguuuguuucucuaaaauuuagaaucuuaaacuaaauccuuuauuucaaaaacaaacauaaaauaauuucccaggcagagaaaagguuugagauggaagcguucuuguuagcagucccuuccugcauaaaugggguuggagagagaggagagagggaauggccaaggguauggaaagcuuucacaaugcaugccgagugugaagugacacccccagcagaugggguuuaucaucuuuacuuagucacacaacaucaaggacugguuaguuccagggaagggcuccauuucacuaccugggucaguucucuucccccgcaugcuccacaaugcaguagaaccaaacaacacauucauuuacaauagaauguuuaaauaacaccuguccaauaacugcccuuacuucuuugugcugucgggaaaagaaaaaacagaaagcaauaaaacccaaacccuuuggcaagccagccggugccuauucuccuggggcauuuuuaguggaacuucggcugggccuugcccuccucccaauaucagugaggaaaguggcagcgggacagguuuggucaucugcaguggaguagaaagaggaaccaaacacgauucgggccacagguggauucuggcacauuuuuagauuggauugguuaaaaaugucauguuguacacaggaugcaggcaaaggaguuuuuuuuugagggacauaaugccuauaggcagcaugaacgguccgaucuacccuuggggaggagcucccuguguagggacggagaaacuagggggccucgaggaagguguugguucggaagauggaggagacaaucuuuccgguggcauugauggugccuucgcugucugagcuggacucggagucgcugcucccagaguaggcacccaggccugggaggaugccgauacauacugcagcagaggggcaguggauggaggggccacucagggagguguuuccgagagacuugcaggaugagggcucugcaauaaaaggggaaagacugucacuucaucacccuuuuccaaaguuggggacugacuuaccaugugccaggcacuguaccaagggauuuucccacagaggagccuuagaacaaugcuaugcagccaauacuaucaucacccucguuuuagagauggggaaacugaaggaggaagggaggcuccaggaggugaaaggacuucugaaaguaaaggggcagagcugagacuugaaucaaggucuuuuuaaccccagagccugacuacacucucuuguuccccaucaaauccgaguuggagaacaagcuacucuggaguguagccuagagugcuuugauuucccugugcucacacagccgugagaaucugaaaacagauuaagagagacacugugagcaauauuaacaauuccauuaaguucucagcguauuacaccauuucuuauuuacugaccaauaagccagcuagcacagauacaauuuuaaggccaaacaucagcuacaaaauaacauucuuuucuuuuuaaacauuuuaaaaaaucggguagcccccuggacuagaauaggcucagaaggacucaccagaauaacguucuuuauuaagaagggccgcuuuucccaagugggagagaggagcaauucagaaaccaauuuaacacaaccuuugcuuuccaguuguguucuuuuacaaaugagaaaacugaagccugucagguaacauuuuaaggccaugcagaaugucaucuaggagcugggacucuuuuucuuacaggaaacccacaguuacucugccaccucaaugacaaagaccucaaucuagacaaugcagggcuuggcugggcaugguggcuuaugcguauaauccuggcacuuugggaggcugagauaggaggaccacuugaggucaggaguuuaagaccagccugggaaacauagugaggcccuaucucuacgagaaaauguuuugaaaaauuagacagugccaagugagguggcucaugccuguaaucccacacuuugggaggccaaguuggguggaucacuugaggucaggaggucaagaccacccaagguggguggaucacuugaggucaggaguucacuggccaacacagugaaaucccaucucuacuaaaaguacaaaaaauuagcuggguguggugacgcgugccuguaaucccaguuacuagggagacugagggaggagaauagcuugaauccaggaggaggcagugguugcagugaguugagaucgcgcuacugcacuccagccugggcaacagagcaagacacugccucaaaaaaaaacaaaaaaacuagucggguauaguggugcaugccuguggucccagcuacuugugaggcuaaugugaggauugcuugagcccaggaguucaagguuacagugagcuaugauggcaccacuguacuccagccugggcaacagagcaagacccugucucaaaaaacaaacacacaaacaaacaaacaaaacaaagaaagaaagaaggaggaggaagaaaagaaaaugcaggacuugaagaugaaaggaaaaguuaagaacucuacuccagcccuuccauucuucccugaaauguuuccggccuuauuuaaucacuacaacuugauguauaggcauuauccccauuuuacugaugaggaaagucaaaugacuuggcaagguuguagguugcuuagggcagaaaaugugaaacuaaacgugaaucaaaagagaacauacgaaaaugauaaccugagcucacugcagaguaaggguuggaguucauacuuuguugccacaggcugacaagcauacuaccuucuaggguuuugccuuagaugcacuaacaccucauuuacccagacaccucaaguaaaugugaaaagaauacacaguuccaaguauaggaaaccaggaguaagcaaacaauaccacugagcaguuagaagagauaucaaacggcccgcacacaaaguucaggagaucaauguauuugcuuguuugugcaagaagcucuaagaagggaaaaggaaguugccaaagauaagcaauguuaaaacacggagauggagaaaagucaaaugaaagccgacaguggcuacagagauagagcaaggcuacaaaaaaaaggcaggagcaaauacuuguacuaucauaaaagcaaauuuccuuaagauacuaagaguucuuccaaaucuguuaaaaaaacaaccaacaaccaaauagaaaagugaauggaaaacaugaacaacucaaagaaaaagaaacagaugaauuuuaaacauaacgggauaaacaauauauuaggagggaacauguuaggaacagcaaacuucauuugcuguucagggaguacagagaaauuuggcaaaguucuucgaacuuaaaugauguucauaagagaacauucauugcagcacuguuuauaguagcaaaagaguacugacaaccaaaauguccauuaauagaugacuaguuaaguaauggacuacuauucaaccaugaagaagaauaaaguagcugagcauaauggcucaugccuguaaucccagcacuuugggaggccaaggcaggaggaucauuugagcccaggaguuugagaacagccugaacaacacagggagacucugucucuacaaaaaauuuaaaaaauuagccgggugugguggugcacacuuguagucccagcuacucaggaggcugagguagguaggaggaccacuugaacuggcgaagcugaggcugcagugagccaugaucgcaccacagaacuccaaacugggugacagagcgagaaccuaucuccaaaaaaaaaaaaaaaaaaagaagaagaagaagaagaagaaagcaucucuguguguacuguuauugaaugauccccaagauauugugcuaaaugaaaaaggcaaggagcaggacagugugugaaaguuacaaucuggggcaaaguggccaugcccauguagaugcaugucagugucugagaacaauaaauaaaaacugguagcagaggcugcucaggggaaaggaaaugaguggcuggaaaaugggggagacuuacuuuuuacuccacauucuuuugucccuuuugaauuuuuccuuuucuuuuuuuucuuuuuuuuuuuuaagaacauaaggcucacuaugcugcccagguuaaacuccugggcucaagugauguucccgccucagccucccagagggcugggauuacaggcaugagccaccuagccuggccuaaauguuuuauuaugugcauauauuaccaauucagacaguuuuuuaaaaugcagcugugcuuggguagacaauuuuuuaaaaaagcaaauacaaaaauucaaagaacauccugagcccuuaaacuagggaggaauagucccauuuaucucuguaaccccaagagcaucccaguauuaaagcuaagaaggcuguagaagaugagagggguugcuuguguguauucuccacuaacgguaagccccuugaaggcaagcauucuuuuaucaccauuccacccccaggacauauagcacagggccuggcucagagcaggcuugcauucacaagggucagaaaucagaaugcaggaaaaugugucagacaguuuacaguuucauugcaaauggcuaauuuggggggaagggguauaaaaaugugaugcucuuuuaacauuuggaacauaacaucaaacuauaccauucaugacuuaaaaauacauuguaguacuuauguauaccagauagaaugauauuuucagcauucuguuagaaaaauuugguuguuuaaaaaaaacaaaccagccaggcgugguggcucacgccuguaaucccaacacuuugggagacuggggcggguggaccaccugaagucagggguucgagaccagccuggccaacacagggaaaccuugucucuacuaaaaauacaaaaauuagccaggcgugguggcacaccccuguaaucccagcuacuuggguggcugaggcagaagaaucgcuugagccugggaggugaagguugcugugagccgggaucgcaccaccccacuccagccugggugacagagcuagacugucucaaaauaaaaaaacaaaccaacaaagaaaaaaaaccuuaaaaggauauauagaucaguuaccuagaaaacuaauuuaugugaaauuguugaaugagguauuucauuuuaucaaguacagacaccccugcuuaaugaugggaauaugaccuaagaaaugcaucauuagacaauuccauuguugugaacaucauagaauacuuauacaaccuagaugguauagccuacuacacauguaggccacaugguauauagccuauugcuccuaggcuacaaaccuguacagcauguuacuguaugaauacuguaggcagcuguaauacaauggucaguauuuguguaucuaaacauagcuaagcauagaaaaaggcauaguaaaaauacgauauuaugaucuuaugggaccaccaucauauaugcacccaucauugaccaaaauggcguuauguggcacaugaccauauuucaagggcgaauggaauuuaaaguucuauuuuacauagaaaagaaggaugaaagucagagugccuguggggguagagaacuggccuaacggaagaauggaaguuagcuacagaaauauaaucaaggaaucuggaccacugugguaucagaagaguuuaagugaagagaccaaauaccccaauuaucuaggagguuucaagaaagaaaagagauugcaaaucugacaaauuucauuccaaaagcaguuaacuguccaaagagaacaaaauggugcccucugaucucacccauuuggugaaguuuccugccaacuucugcauuugcaggaccacauugucauaccaaauuaacacagaaaauuacuaauagagaauguucuuaguauucagacagaugcgugacuugggaguagauggggccaacuugugcauucacuggcucugcucagugcuuaaguucaaaaucuucgcugggggaagccugaauuucuaucagagucauaggggcccaagacggaaauccucccacugcuaaggacagggcugaagcaagcuucagggagcguucuucuuguggagccuuaauuccuagcaaaggaggacacuuccugccugguuucuguugcaagaaugcaggaguaggaagaagggauuuagaaugacaaaaagauggcucugaaacacagcugucugccugagauaguucaaagaauccacacaaguuuuccuuuccacugauucauuuguauaguuccuaccaggaaauaaguaccauauaaagagcgacuagcuuacuuguagaaauacauuuaagauuccuaugccaagagcauuuaaccccagcuacucaggaggcucacgugggggauuaccugagccugggaguuugugguuguagugugccaugacugcaccugugaauagucacugcacuacagccuaagcaacaaagugagauccuaucucuaaaaaaaaauuaauuaaaagaaaaauauucccuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaagaaaaauauuccuaugaagcuuuauguguguguguguauacacauauacaguauacauuuauccuauuuaagcaaauuuccuauuuauuaaaaagaugucagugaaaaauuccaaaauugcugaugggaguauaaauugggauaacuuauuugaagggcaauuuggcaauauuuaccuaaauuacaaauguauauccucucugaccuaucaagucuacuucaaaguauuuaaccugauagaucugugcaugugaaaaauuaugcaugugcaggauuauuacugaaacaucagaacagggaaagaaugaaacaaucuaaguguucaucaauuaaaaaguaggauaaaugauauacccaugcaauauacaauacuacacagccuuaaaaaggaacgaggaagugcucuauguccaguuaugcaaugauucccaagguacaauaacugcugaauuaagcaaugaacagaguagguuagauuaaaauacuacuaacaaugaaaguaugaaaacaguauauaauguauucuugccgaaaaaaccaacuugaucaaccuuccagaucaaacuaccauuuuacaggaaacacaagguagcaggaaacagcauggggaugcaaucaguaaaaucuagagccagagaaaugcuaaagaacaaagacccaguuucuccacaaauaaaauacaaagaaaacaaaauauaaauuuagaaaggaagaacuuacagauuaaauucaaauuaaaagguauauuagccuacugcuaagauggcaacauugccaaauuaaucuacagauuccaacaauuccuguaucaaaaucguaacugccuuuucugcaaaaacugacaagcugaucccaaaauucauauggaaauucgagacuccaaauagccaaaacaaucuugaaaaagaggagccaaguuggaagacucacacuucccaauuuuaaaacuuacuccaaagcuauagugaucaagacugugugcuaauggcauacagauagacauauauagcucaguggaagaagagaguccagaaauaaacccacacauuuauggucaacugauuuuuaaaaaauauaaaccacugagucguauccuuuuaaagggugaauuuuaugguaugugaauuauaccucaauacuuuuuuaaaaaaaagccauaguagccaaauauaaugucugguccuugcuaagaucauaauuuuuuuuuuuuuuuuuuuugagacggagucucccucugucacccaggcuggagugcaguggcgugaucucugcucacugcaagcuccaccuccuggguucaaugccauucuccugccucagccucccgaguagcugggacuacaggcauccgccagcacacccagcuaauuuuuuguauuuuuaguagagacgggguuucaccguguuagccaggauggucuugaucuccugaccucgugauucacccgccucggcucccaaagugcugggauuacaggugggagucaccgcgcccggccaagaucauaauuuuuaaaaagaaaaaacuuuuuugagacaauuggagaaaauacuaacuuaauauucgauaauauuugguaauuacugugauuauuauuauuauuauuuuugagacagagucucgcucuuguugcccaggcuggagagcaauggugcaaucucggcucaccgcaaccucugccucccagguucaaacgauucuuccgccucagccuccugaggagcugggauuacaggcauagccagcagcccgacuaauuuuguauuuuuaguagagacaggguuucuccauguuggucaggcuggucacaaacucccaaccucaggugaucugccugccucagccucccaaaguguugggauuauaggcaugagccacugcgccuggccugugauuauuaauauaaugguacuguaauuguuaaaacaaagaaacaaaauaagaacuuguauuugcuagagacauauauuaagaauuaugaaugaaaugauauaaugucuggaauugucacaaaauauuacaguugagagauauaaaugaaauaaaauuggcuauguguuaaaaacugcugacugggugugguggcucacaccuguaaucccagcacuuugggaggccgaggcagguggaucacuugaggcuaggaguucgagaccagccuggccaacauggcgaaaucccgucucuacuaaaaauacaaaaauuagcugggcgugguggcacaugccuguaguccuagcuaccugggugguugaggcaugaaaauugcuuaaaccaggaaggcagaggcugcaaugagccaagauaaccccacuacacucuaucuugggugauagagcaagacccugucucaaaaaaaaaaaaaaaaaaaauuguugacggucuuuccuguaggagauaccuuacaaagaaaaaaaaaaaaucagugaagcuugguaauggggguuuauuauacuuauuccaacuucugaauauugcuuaaauuauccauaauaaagcauuuaaaagauacauauuuacaauugcuugcacaugcauagaauagcucuugauggcuacauaagaaauguggcugggcuugguggcucacuccuguaaucccagcacuuugggaggccgaggcaggcagaucacuugaggucaggagugcaagaccagccuggccaacauggugaaauccugucucuacuaaaaauacaaaaauuagccaggugugguggcgcacgccuguaaucccaaauacucgggagggugaggcaggagaauuacuugagcccaggaggcggagguugcagugagcugagauugagccacugcacuccagccugggugacagagugagacuccaucucaaaaaaaagaaaaaaaaaaguauaauucuguuucccucuaaggagaacuagauggaagagauacggguaaaaggcaggcuccuuuuuuuuucccccagacucuucuuuuuaaaaguagguucuagaccaaaaggguaacagcaacagaccaccaccacuggugcuuaguagaugcauauuaaaaagcaucaucuuuuuuugagagaaauuaauguaagcccuguugaucgauggaauuuaguucagagucucaaucccacauggaguuagaauaaaacugaaaacacacucgaauuucucaucccuaauccagccccaguaacauucaccuucacuuacaaguucuugccucuuaauacagaggcagauuucaucacauaaaaguaaaaaccaaagaaguauacuccuugagauuguauuaagcuucuaggcucaauccaguacaacaaugagcaggagccagguauuuaccucccacugguagcaaaccaggugaaaucaagaaaccugacauuugggggaaacagaaaaacaccuuuugugagcagaggugguaugaccagggccugguaagcacuccugggagaguacuauuuucauugaucaguuucacugguuucuaauauaauaacuuuugcagguauaaaauccugccugguauaaacucuggccugguaauaaaauccugccuggcauaaaaaaguuggguaaauuaagcauagguaggcuugcuugaagacagaaaugcauucauuugcagaagcaaugcauuacagcccuuuacugugguucauguguauucugaguacaaggaaguaaugaaggcugccacccaccuugauucuugucaucuggcucaggguccgguuucagucuuuucacacuguugccacucucugagcuguaacaaaacacauggugacuugagccauguccaaucuuguggaucaaagcuuagggaaucaggagcuccaauaacuauuuauaugggucuuaggcagucucaagaggcugggaugauaaaaaugaaugaaaaguauucauuucagauucuuaaucuccuuccaauugcaucaucagucauaaagacaauuuaaacuccugacaaauccaggaaauaaagcacuguaucaaccaucacuucaacuucagauucuuggccgucuuuaucacucaaauugguuagaaccacagauggauuucaagaauauuuagacauguucauaaaugacaaacauuuaguaauuacagauugaagaaaacaucuuuagugacaugcuagagauucugagagucacccacaagauuuucacuaaaacaauguauaaggaauguauuucaaugaagaaagaaaugaucccagaaggaagggaccccagaaggaagggguggugaacaaauaaacuggcaaauacaaauauaaaucuaaacaaauacuguaucaaaaaauaaugucuaguuugugguguucaacagaccauacugaagucaccucuaagacuggggacauuacuguguguauguacuaguugguauuuucuugcagggaguacacagcagguuccauuuaagacuuaugugggaggcccgggugcgguggcugacgccuguaaucccagcacguugggaggccaagacggacggaucaccugaggucagguguuugacaccagccuggccaacauggugaaacccugucucuacaaaaaauacaaaauuagccaggcaagguggugcaugccuguaaucccagcuacuugggaggcugaggcaugagaaucgcuugaacccgggaggcacaggugugccaagauugcgccauugcacuccagccugggcgacaagagugaaacuccagcucaaaaaaaaaaaaagaaaaagaaaaagaaaagaaaaagaaaagagaaucagaguauacaaaaccacaugcaauuaaguuggaaaucaaugacaaaagagaaacauauuuugcagccucuaagacacuguuauauauauauauauauaucaucauaagguguuaaaacguguguggcgagggggaaggcuuaucuuuccccucacugaaauaugguuguuaccucaauauggagauuuaaaaaauacauuucuaaauaauuccugagucaaagaagaaaucauaauggauauuuuaaaauacuuagaaggaaauauaaaacucauauacaaugaaaguuaaggaaaauuuauagcuucagaugcucauaacuaaaaagacugcacauucaugaacuagguaucugacaguuuuuucuaacaauaaauaaaagaauaaacuagaagagaguaaagaauauuccuuugaagaagguaagaaauugcugcuuguuuuggucuuaugcuucaugacauauacaugccaauggcuuccagaccuucaccaggcagcagaaucacucauggaacuuugaaaacuacgacucccagacuucacuucaaacuuacugaaccagaauuagugcaaggccugcgaauauaaauuauuaacaaacucccaggugauuccaauaaacucagggucggacagauuaggaacuccugccccaggagacuaccuuacuacacaaagaaacauuaaaugauguuguuucaaaacccaaaagggguuauaugcaggucaccaaauacgcuacuacagagccuuuucuaaaggugaucuaagaacuaagggaaacaguuacaacacccauucugcgaccaccaagagcagucucaagggauaacaaauugaucaccuggagagcccucccuuggcauauuccaguaaaacugacccagguccaaauccugcgagucccuagucuugcaggaaagcuuaugugagaacuugaaaggaauaauucaugguuuggguagcgagcccuucucaggauaacuccuccccucuguugcuauaccagcaugacauuuuuacauguaggcaguguuccuaagaacaucugcagcagauggguggugugccaaaccacaagacugcaucaauacacucccuucaaaacauauggcugguugccaauauaucauauugauuuuccuaauagacugcacuuaaacuuaucauuucgcccacagucuguugggucaaaucuaaaugaccagauucaaucacucugaugacauuucaggauuuggaaagggaggagcaaacauagcaaagaacuuaucauagccuugagacagugcuaucacuuccacaucaauccaaaccuagccacagccaggucuguaacccugccagggcugccauguucuuucaggacaggaugccuuugcagcagcuauucccucugcuuagacuguucucucccuuguugcuugucaaagcccuaguuguccuaccuaaucagcaucuuuccaaugguuucccccaaccuccccaacaugaagaugcacacaacacccucccagcagcauuguaugcuccuccuccuugcucucaguacacccuacacagauccuuucacaagacucacuaccucauuuuucuagacagaagcccaaauaaugaacucuagcucucuguuucucuaugaucuugcacaaagaagggucucaaccucucaaacucuuggucuucucaucuacaaaacagggauuauaauuguacuucauaggguuguugaagaauacaugggauuaugcacaggaagcacuuaacacaaugccugguguggcagauccccacugaagaguagcuauuauuuauauuuguugaauaagugaucagagagacgagggucaaagccuauagaaggccucaaaucuggaaagggagagauaggugagcacaccaagggaacuucaccaggacucacgcgaggcaagcguuggcucuggcuuccauuacaagugguguuucagaguacacggucagagagaaaucugaguugugugagugcugacuaaccucuuaugcuucacagcuccugccaacagcuucgccugggagaacuuguucuugguuucuauaggcuucacagucaguuucuuuuccacuuccuucuuguucucuugagaaauuccaaccuucuugagguuauugugaguuaccaguuaagggucaaacuaagcaaaagggaagacaacaaauauaacccacuagcccuucggcugugcgauguaaugucuggccuacuuauuuaaauaaaugccccacccuucuuuauucugccagucaaauccagccaauucaaagauaaaugaaagagaccauggaggaagacagcauauaaagcccaaaauaauacagauaagcaaccuuuuccucugauucucaaugaaaaucugagcauagccacaaaacccacuauuaccaaggacauggccaauaucaugcuugaugaggaaaacagaucuuaaggaauauaaagaaaacagaaaaaaaaauguggcuucccugaaaacaugcuucccccuucaaggguuaaaucaaauuuugcagaauguuguucugacuaucaguggcaauuaaucuuagacaucacgaagacuaacuccugcuccacuggugcaaggaaacaucagaaucaccccaaggcucauuaaacaugucaagucccucccugccccaaaccuacugaaugagaccucuagaggcccgggaguuuguuuuaaacacucucugaaggugauuuuacacuugaucuuagccaaaaggccaagaaacaaucaaaggugauuuuaaugagaaauccugugcauauauacaagaacugaaaagcuauuuuuaaaagcaugaccaguucgcuuguaacaucaguuuuucguucuugaugccaaucucuggcucucaacuuuuuacucuuuugaagugaagaaaggccccauauuuuugucggggaggucacuuucacuuguucccuccaccagcccucccuccucucccuccacuucucccuccguuuuaugcucucucuugaaacgucuuagacaacagauaaguauucugacacagugcaaguccuuauuuaagaugcacuagugccuggaacaauagugacaucuagugcccaggaaaucuaagaagcaugaauuaucagcccaaaaagguggguggaaguagaggauguaugguuaagguuauuuaucuacgugucuuugaacaauggagaaaauccuaagauuuuccagaaauccuaagauucuaauucuaaucacucuccaggcaacuaacucuguucuuaugggcacaaguuaccuuaaauauuugcaguaugcaauggaaauuagauauaaugcuuaguacuauuaugaguuuaaugaauuuaauguuuuuagggucaucauggaaauagauaauguuaauacucauuuuuauuuaaaaaaaaauagauuggccaggcacaguggcucaugccuguaauccuagcacuuugggaggccgaggugggcagaucaacugaggucgggaguucaagaccagccugaccagcauggagaaacccugucucuacuaaaaagacaaaaaauuagcugggugugguggcacauuccuguaaucccagcuagucgggaggcugagccaggagaaucgcuugaacccgggaggcagagauuguggugagcugagaucgugccaccgcacuccagccuggguaacaagagcgaaacucugucucaaaaaaaaaaaaaaaaaaaaaaaaaagauuucaucuuucuaggagagaaugccaaaaaaaaauuagcauguugugauuuuuuaucugcaacuccaucauuaggagacagaaguucucaaaacucucaauauuaaauauuaaaaaaaaacaaaaauggaaaaaaaacacaacaaaagcauguauauauuuauacauuauuuauaccacgacauagacaaaacccaacauuuaacuuuuuauucuuuugaaaugaagaaaaguccuaaccuuuuagggguaggggguguuaauaaucuuauuuuugauccgcaaaguacaagcaauuuuuccuucuuaagccccucuucucccaaaaugcuuuaaaaacacaaacacaccucaaaaaucucaagaaauucauuagaucagcauucucuuaaaauugcaccguuuuuuaacauacacaauacugcuaaauacugguuuaaccugagacgaaacaagaguucuguuauuuacaugguuuaaaccacagcuuauuuguauucagaaguauccuauuauacaacauaucauauaguaaucaagcaaagccuagaaacaguuccuaacuuagagcuucaauaaacaaaugucuaauccuucaauuccuaucucaacaugucucuggcuacuugcaugcuugggauuaguguauuagaugucagugacuuggaaggccugcuuuucuucaguuuuucuagacagaacuuuccaaguuuccaguuaaagcccuuaucccuggagccucauuguacugcaauguuaccaggacacaaagguuucuuuugucucacugcugcccuguucauucuuuccuuuuaauugaaaaccaaagggcaucucacacucaacagcacuucuccccagaugcuacuuugggggacacuauaugucuuauuugcuagucuaccaaaauaaaacauaauaucauucaagugagaaguguaaugaauguauuuccuuagaggaaaaagcuuggugucugaaacaacacaauauggguaucugccuaucucuacaaacgaacacauauuauuuuggggucaucagggucagggaagggggaguucagaauaaucagccucaauccuacaguugagauugagguauaacuucccaugagcuuccaucuccauguugcaccugaaugccaguaacagaacugggacuggaagccaggucuuuuccuaccaguucugauguaaaucaauucccagggaaucagggaaucuguccaugucuucucccauacaacgcuuuuuuuuuuuuuuuuuuuuaagauaaagucuugcucuguccccagccuggaguacaguggcgugaccuuggcgcacugcaaucuccaccuuccagguucaagcgauucuccugccucagccuccugaguaguugggacuacaggcacaagccaccaugcccggcuaauuuuuguauuuuuagcagagacaggguuucaccauuuuggccaggcuggucucaaacuccugaccucaagcgauccuccugccucggccucccaaagugcuggaaucaaaggcgugagccacuguguccaggccucccacguaacucuuaaaauggaaugugcugcacauucucugcaagaaaauaccaacuaguacauauacacaguaaugucguccaucuuagacgugaagccuguuggauuacaccagugauguuacucaacauauaagcuugaaauauccaaauaagcuuccucacaugaagauaaaugguccuauuaauaucuccuaugaaucauuuauuaauuuauucacauauuuacugagaaucuacuauaugccaggcacuggagaaaucagaagugaccaagucagauagucuuuuuucuuauggagcucauuuacuuuacauucuagcaggaaagagauaaacaaaccaguaggcaaauaaauaaagacaacuuucagauagugacaaaucuauaaaaaaugauauuacuugcugggugcgguggcuuacgccuguaaucccugcacuuugggaugcuggagugggcggaucaccugagguaacgaguucgagaccagccugaccaauaugaugaaaccucgucucuacuaaaaauacaagaauuagcugggcgugguggcaugcaccuguaaccccagcuacuugggaggcugagacaggagaaucgcuugaacccgggaggcggagguugcagugagacgagaucgcgccacugcaguccagccugggcaacaagagagaaacuccaucucaaaaaaaaaaauugauauuaccgacagcaauuuuagguggggugcuuagggaagguuucuaaaagggagagcugagcagagggcugagcugugaaaugcaucuugcaaaaucugagggcagaacauuuugggcugaggaaacagcaagucugaggcccugagauugacucagaaagcauggugaaagagaacauaaagaaggccagcaggcugcaguacagucaacaugagaaagaguggcuucaagaugcaagaaggaggcggguuggccuaaauaauguagaaccuucuacggccugauacagaguaagacuuuagucuaaauguaaggggaacccacuagacuguuucaaauagaaaagugacaugaugccauguaugguuuuuaaaguucccuuucuugucuaaggaauagauuauugaggaugagagcagaaacaaaccaauuagauggucacaggagucgagaagaaagucuacuacuacuacaguagcaguagauaccaacaauucaagagauuuggaguacguuuuggaaacaguucuuggcccaggcaccuggaggcauaggacuaccaguuacugggacugggaggaccagaaaaagaagagacuuuggggaagggcagugugaugagagugggggugauguggcacaguauugagaauuuugauucagccaaguuucauuugggaugucuaugaagacauucaaguggaugaccaaaaggcaacacugaucuagagcaaagucaucuuugcugcuuucucagcccuucuaucaggacagggcaugcuauaccacuagagaacaucuuacuaagaauauaggaaaguugcuaaacauguucuuuuaaaacucagagcccaauuucuccccuggaugaagcugacugcacugcccaccugugucagaaucuaaucccaguacuaguaggauugaugccuugaguuaacccuaagaaggauguggacuuuugacuauaacacucuugcacacaacacaaacuccacaaaccacuaccagcuuuucagaauuacaggaauaucaguguucaaagggacuugagagaucaccagguagaaaacccucuuucuguugaugaggagacaacauccauagaugcugaugagaaaauggacaccuuacagguuuuccuccaaguacaaaggauauucuguauuccuucaguucuuucaguucuucuucucuucguugcuuuucuauuaguuccugcugucgagaaaccucaucaaggaaguuggucucaucuucaucuaagccucuuaccauguuuucugaggaaauaauuaaacaaggcacacuuagcaggcuaaagggaaaaauaagauuuuuccuuuccccuuuuuaaauaagcagcagauucuucaggggauuaaaaaaaaaagaacugguaaauaccauggcguuugaauagauaacagggcauaaaaaaaaacaaggcauuuuuucccauuacuaaauauuaccauagaauuaaaauggguguuuugagcucuaaacaaaaauauucaauguggucuagaaggcugaaggcugucucuuuuccaccaaauaagcauccggagacucgaaaaucaagacaauuccacggcuaguuaggaaaagugcugcacaaggcaaaagugcgucaaaaguaccccacagagccccuugaacucucuguuuucugaagcuuacugaauuugaacuguuccucguacuccugcugcuuccuguccuucuguuccuguagccuuucauauagagaucgagggucauaaaccuccucuggacauucugaaaggaaaaggagaggggagagagguggacggggaggagauauacacuucagauuguuuucauauuauuuuggaaucacaaaagguuuuaaagacaaagucaagucucugcaugaucugaggguguggauaacacaaaaauaguacaaaguccaguuucccuuuggaccucagagaggggccaccaguucucaaagccaacuaucaaugucaauagcgcccauggccugagacaguuaacugauugaggggccagcccaaacccuccacagcagcaguguucucaguuguucagaccauggauccaccuguauagauggaggagaggagcagaaucucuuggaaggaagugugguaggcagaaaagaagcaggaugugaguaugcuggcucugcucccagcugugcaggaccuuacauaggugacuucgccccugagucucaguuccucaacucuaaaguauggacaauuggccaggcaugguggcucacaccuguaaucccagcacuuugggaggccgaggcaggaggauggcuugagcucaggaguuuggaaccagccuggccaacagaugaaacuccaucucuaccaaaaauacaaaaauuagccaggcgugguggcuggugccuguaaucccaacuacucggaaggcuaaggcaggagaaucuccugagccugggaggcagagguugcagugagccaagaucgcgccacugcacuccagccugggcaacagagugagacuccgucucaaaaaaauaaauaaauaaaaccaagugaggacaauuaauaccuacucugcaggguugcuguguggauuaaagaccauuauacugacugucacaguauaccuucuggaucuucagguuuucgaacuuucucccauucuucuugccuccuuuugcgccguucaucuaguucugccucagacacaaaccucuuuuugauaauaagguuaccaucauccccuccauccauaaugaaacaaccaaucuacaaaacaaaaacaaaaacaaaaaaaaucauuucaagugagaacugcaauuaaaauucuaaagagaaacaaggagauuuagcuccaucucacccagcaacaaacuaaaaauuaucuuccaacuuugaauugaaaaaauucucggccgggugcgguggcucaugccuguaauccuggcacuuugggaggccgaggcgcauggaucacgaggucaggaguucaagaccauccugacugacauggugaaaccccgucucuacuaaaaauacaaaaauuagccaggcacgguggcacgcaccuguaaucccagcuacucaggaggcugaggcaggagaaucgcuugaaccugggaggcggagguugcagugagccaagaucacaccgcugcaccccagcuugagcgacagggcaagauucugucucaaaaaaaaaaaaaacucucaaauaguuuaauuuauaggccauugaugaaagcacaugaauacauuuuuccugacauaucagagaauuuuuauuaacaucgauguuaucuacacaguuggcaagaggaccugggauaauucuuauuaccugguguuccauaguaaaucucauauugcagcuauuucucugucccucuaaucuagaaaaauuggccuccugagcaucccauccuuuucccagcucucauccuccuuuauuucuguaacaucugacauuguuucuucuugaaauuccuguuucugagacauuacacuaucuugauucaccugcucuugccuccaaguagauuaagauggagaaucucagcuauugaagacuuaguguucaaguccagucuguauagcagggaaggugcacaaaccaugaauggagaaagugagacuggaagaacagaucucccaacuucaguuccacguacuuuccugaauacuaaucugacucuucauuuauaucucuucugaccuuccucccuguaaaccccuugucugugccauuuaagauuugaacuucaauccuucucuuuucucacucccacaaucaccucaaccauuuuaugcauauuuugacacagaagauuaccgaaucuguuauuucuaccugagcuuuucuucaaagaggagagaaggaaauaaagauagcagaguguauauuacuuauuacuccuuuuuuuuuuuuuuuugagaugaagucucguucugucacccaagcuggaguccaguggugcaaucucagcucacugcaaccuccgccucccagguucaagcgauucuccugccuccgccuccugacuagcugggacuacaggcgugugccaacacgcccagcuaauuuuugaauuuuuaguagagaugggguuucacuauguuggccaggcuugucucgaacuccugaacucgugaucugcccgccuaggccucccaaagugcugggauuacaggggugagccaccgcaccuggccauauuacuccuuuuaaacuaaaccucuguuuuucuuuauugguuucuuuccuuuugaguaacuguggaauuaaccccuacccagacauguuauucacagcacuaugugcuaacaaggaggcacauauucaauccaauguccauuccaagauaaccacuaacaacaaaaacaguaaguuuccacgcuaccacaaaaauaaagcagcuaacaguuaaugagcucuuaccauguauuauauuccuuuuauggauauuaucuaauuuacaugaucauugacccuaugagaaauauuaucuguuuacagaugaaguugagguccagaggaguuagauuauuugucuaaggugauacagguggugaaugguagagcugagaaccaaauccaggccugauaucaaaaaugcauacucuuaccaacuuuaccauacuccuccccagaaaacacuaaaucuuaguugaaaacaaagacaugucgacuucagcuuucuuccuacuucaaauuccagugcugagaauauucaugcaacauuuuuauuuaguaaagcuagaaauggaagcugaaaaaacaaacccaaacguucagaacaagagaauagucucagccugaauacuacuguugcugagguuuaguuuaauguaacaauaagagcgaauugugaaaauuacuagaaagaaaugaaaucaacugacagacgcuguugcucccaccuaaagcccacaaccuggacacuucugauuuagcagcacucaaugacuccagccagaggcucauuacugaagcagaacuguucagucucugugaaaaugccaaaaauuccucaaguucuacagaacaaccucuuaugaaaccagagccaacaauuucuuaaaugucucuggcagagaaaacgugaacuuucuagggcucuaaugguugggagagacauuccgaacccucaauuucccccuuucuuauccccuauuaaccgugucuccuuucucauccuguauuaaucaucugguuucuuuccaucacccauuuuuccuaguaaauaauucagggugggauaguccuuauagcccaccuaauaugauaauccacucgacaucugaauuuaccauacacacccaggagaaggucauccaacucauauauuaaaacuucaagagggaccacugcauucccuuccuaggcagccaacucccucucuaagcagauuugacuguuaggauaguucuuccuuaaacugaacugaaaucuguuuuacuauaaauucaauacauagguucaauccacugggacuauacaaaaagaaucaaaucuuuucuaacaugaccauacuucaguuguuugaagacaauucccauguuccuccuaauuuguugcuuuucugagccaaacauuccuaguuacuuuaauuuuauaagauggagaaaaauaaucaugucugaaggaaaugaauuuaucagauuagauaugauuuaaaccugggaaauaaauacuaggauacggcaaugccauuggugucccaguaaaugucucucuucauucuuguuauauauauauaauuuuuuuuuuuuaagacagagucucgcucugccgcccaggccggagugcaguggcacgaucuuggcucacugcaaccuccgcuucccagauucaagcgauucuccugccucagccuccugaguagcugggauuacaggugugugcuaccaugcccggcuaauuuuuguauuuuuaguaaagaugggcuuucauuauguuggccaggcuggucucgaacuccugaccucaggugauccaccggccuuggccucccaaaguguugggauuacaggugugagccacugcacccggccuauauuuuuaaaagagaaaauuuaaaaaucuuccaauaugccaaaaacaacaacaacaacaauaaaaacaaacccuagaauuuuacauuucuaccuaaauaagaauucagagagccuccugggcucaagcaguucucaugccucagccucccgaauagcugggacuacaggcaugcaccacuacaccuggcuaauuuuuuuuuuuuuuuuuuucgugaaacaggguuucaccauguugcccaggcuggucucaaacuccuggacucaagcaauacaaucugcccaccucagccugccaaagugcugggguuauaggcaugagccacugugcccggccuacaaucuuuuauacacagggacaaaaccagaaaucaguugguuaaugaaaauaagaaauaaaguaaaugcauauuuaaaaaaaaaauuuaaaggcaagcguugcaggggaaagaaaaauacaagaaauguauuucucaucagcucucaguggguugguguccugaaaacacagucacacugucaaaacuaaugcacacuuacaaaagucugcucuuuaaaacuaauaucuuaauucaggcugggcaugguggcucaugccuauaaucccaacacuuugggaggccaaggcaggaggaccagccugggcaacaaagugagaccccccaucucuacaaaaaauuuaaaaaacuagccaggcauggugaugugugccuguagucccagcuacucacaggcugaggugggaggaucauuuacuccaggaggcuaaggcugcagugacccaugaucgcaccacugcgcucuagccugggcaacagagugagacccugucucaauaaauaaauuaauuaauuaguaauaaaacuaauaucauaauucuggcauucccuugauccccaaauaaagaaaauaagccaaguuagauggacacacauaguaauaaauuucuguaaguuuaaaaagacuagacuaaaacauagacugcuuuaugcaucuuuuuucaaauuagcauuuucuucuguaggucuucauucucugcauggcuuugcucaggcuguucccucugccaggaaugcccuugcuuucuuuucacccgaugcaaacugcugcuccaaccgcccagaaucagacuaaagaccaucuccuuuaugaagcuuuccaagaccuccuagaguaguuaauauguauuuccuuccuuuguguuccugcuaugaucauucauaacucuacuacagcccuuauucuuuguguuuuaucaucugugacuguuccaacagcucuuugucuccacagugcuuauuauuauuagcacagugucuggcauauauuagguauucaaauacuuacugaauaaaccaaccacgaggagcugaagaaucugagcagggaggaaugaacucacaugaauauuccuagguacugugcaauguaaguuauagagauugguagccaucaagcaaguauuugcugaagugucaguaucaugggaauucuauucaaacgccauacaauuugugcaguaagaaacaaaggacuaaaaauuaaaucucuuuacuauauuauauaauugaugucaucuuucaaaaauaacugcuacuuuccguuaauuucaacugauuaaaaauggucacuuauccugcgaaagcaguacuugauggagacagcguuuuuguuugaagaguccaauggcuguuuauucugcaagaaagaggugauaaguaccuguaacuuacugaccugcuggaaguagacaaagaagcuagaaaauuagauuguguugacuucuaauuccuauugucuagguaaauuuucacaagucucuucuuuuucccuuuuguuugcuaggguaauuaaaaacaaaucaaaagacaaacagcccagggauaucagggauacgggcucuaacugugaagagcccuguaggaaugcagaggacuuacauuaggaaugcuuacuuuguccuuacuguguuccacuuuagaaagaguaaacaaaugcugucagcuuuccuuuacucacguuuuccaaagugacucaaguuuaauuaucaaacuaaacauuacauuauuuuuuaaaggauuuauucaauuucuucaaauagggaauucauggaaaacuaaaaccauuucaaaauucacuuuguccaccaaacuuagaguccaaauuggcacaaauaaagaacgugguuuucaaaucugccugaccgucaagaaaacaaaguucuuauauuucaagccaaaguaacugguaacacugaacuacuggguuuacauuggagaccgucccauuuaauuuccaggguggugggacaaaaugggcucaguucuuacauagcacacuacacauguuuuaaaauacaaaacuuacauuguugcuccccaaauaauugcuauuccuaacuugaaaaaugacuccauuuagcuagugccaugacacaaaguaaugagaucugguuuccuauggaauugaauuaugugauggcaaacuacuugaguguuuacaucacuggccaccauauccuucuaauucuaaaauuaauuagauuguacauguuaaaacacaccagaaucagguuucuguguucuguuguuuuaaggcuucacuuucaguagcaaaagcaauaggucaauccauuuccuuuugugaguaaauauagauuauugcuuuccaacauuuuuuacucugauguucaagucacacuguacuucaaaaugcaggacagcaacuaagaggaauuugccaucuggcuaacucaucuauauuucaaauaaagacuuauuucuggccagaaggcacuucuaccaagauacaguuauuuagauuuuuaaaaauuuagcugacuuuuccuauaucauaaaauuuauuuagagaacaacaacuacuaacagagagcccgcuguuaguauuuauuacuaggcaaagugaagucaaucuucuaacaccaaagcuuaauuaacauauuccgguagcaaaggagacuaaaagaaucuaaaaacuaaaccacagaaaaagaaauuuaauccauauuuuaaauguuuaucauaaggagcaauuugcaauaaccuuucaggcaucuaugaaacacauacaauaaaaaauucagcuuugcaauaaucuuucaggcaucuaugaaacacauacaauaagaaauucagccaggcaugguggcucacaccuguaauccuagcacuuugggaggcugaggcaggaggaucgcuugaggucaggaguucaagaccagccuggccaacagggugaaaccccauuucuacuaaaaauacaaaaauuagcuggcuguggugacaugugccuguaaugccagcuaccugggaggcugaggcaggagaaucgcuugaacccaggaggcgaagguugcagugaacugagauuucacgccgcugcacuccagccugggcaauagagcaagacuccgucucagaaaaagaaaaaaaaaaaagaaaagaaauuaaggccuggugcacuagcucacaccugcaaucugagcacuuugggaggccaaggcaggauuguuugagcccaggaguucaagaccugccugggcaagauggugagaccccaacucuauuaaaaacaaacaaacaaacaaacagacaaacaggcuaggcacaguggcucaugccugcagucccaaagcugugggaggccaagcugggagcaucacuuaaggccaggaauuuaagaccagccugggcaacacagugagacucucucucuacaaaaauauuuaaaaauuagccaggugugauggugcacuacuuaggaggcugaagugggaggaaggcuucagccaaggaguuccaggcuacagugagcuaugagggccauugcacuacagccugggcaacagcacaagaccgaccuugccuggcgagggggaaaaaaaagaaguuaaaaaaaaaguauugauuuauuuaucuuuccauagcacaagggcagggucucaaaugugcauuuaucuugaauucaccuauacacacuagaagaaagauaacuaauuuaaauaucgguucccuuagcugauccucauucacaugcaccucucugaauauaaauacuucccucacuaugcaugaaugauuguauucauuguauuuuuuacauauugugacuccuaaauacaaaccaacaacuucaucuggggcucacaggaagaaaaacagcaguuuuuuccaaagccgaaauaaaacuugccugaggauauagagaaaaaaaaaacccaaaccaaaccaaagcauuuuugcuauucucucacucaacaaucaacacaguauaauucugugagggauauguccccacacaccaagcaaccaaccaauucuguagcagacaccaaccagcuggguguccucuaauucaguucaauucugacacuaccuaccuggauggagaccgcgucagaucccauagguugaggggugagucccacaagacuagccuccauuuuagauaccaaccacaagaaucagguuguuuuaccuguaguucuaaccaacuggcuauuaaucaggguucccaugacccccuccuuagguucuauuaauuugcuagaccaauucacagaacuuagaggaacuuagaggaacacuuuacuuacauauacugguuuauuauaaaagcauauuacaaaggauacagaugaagcaaugcauagggcaaggcaugugggaagggcacagagcuuccaugcacucucuggggcaccaucauccaggaaccucucauguccaccuauccagaagcuccccaaucccagucuuuuggauuuuuauggaagcuucauuacuuagacaugacuaauuaaaccagugacgcugguggucaucagcucgucugccuucuccucuccccagagguuggacauugguugaaggucccaacccucuaauccugccugggucuuucaagugaccagcccccaugcuaaaguuacuuaggggcugccagccaucagucagcuccuuagcauauaaaaagacacuaaucauuuuggagauuucaaggauuauaggagucauaugccacaggagacagggaugaaggccaaauauguauuuuacaauaucacacuggccaugucagaguucugcaacacugguauuccuacaauuaacaugcugccucccugagauuucaaggguagcuuugcuuguaagcuauuuugucaucuaggcucgcuucagaaccuaacccacaccucaagucauacuccauccucccuccccccacccuauauaacuccacuucaagaccaaauuaaaaacaaaauaaaacaaaaaaacgcagucccaguuacucaggaggcugagacuggaggacugcuugagccuaggaguucaaggccagcccgggcaacauaaggagauacccauuucccuuaaaaaaaaaaaaaaaaaaaaaaaaacuuugcauuacaauaaccagacaaggccaacuaagauuuuuuuuuuuuuuuuuuuuggcgcaguggcucaugccuguaacccuagcacucugggagacugaggcagguggaucaccugaggucagaaguucgagaccagccugaccaacauggugaaacuccgucucuacuaaaaauaugaaaauuagccaggcguaguagcacaugccuguaaucccagcuacucgggaggcugaggaaggagaguugcuugaacccgggaggcggagguuguagugagccgagaucgcgccacugcacuccagccugcgcgaagugggcgagacuccaucucaaagaaaaaagauuuuugaagcaaauauuuaccgagaaccuauuaugugcaagauacaaugcuauguacuaaacaggcaacugaggaacuuacacucauucaguaaaagacauaagguuggcacacagcaauuuaaggaaaaguaaaacuagguuacaggccauaagaggcacuaagcaguucagaaaggaagacuagaauaagcauuggggaagcuuaauuuucauaauggcugugacgaugcacagugaaaagugguggaaauuuuagguauaugaagaauaaccaucuuuaacuuggaaaucacacaaauuucacauuccaaauuucagaauacagggggauuuucauuucuugaaauagugggcuagguaauugaaaccaauucuccaccucugcacuaaauaugcuggaaauuugucaaaaauaauuuuuuuuuugagauagggucucgcucugucacacagacuagagugcaguggcaugaucucagcucauugcaaccuccaccucccagguucaagcgauucuccuaccucugccucccgaauagcugggauugcaggugcccgccaccaugacuggcuaauuuuuguauuuuuaguagagacaggguuucaccauguuggccaggcuggucucaaacuccugaccucaagugaucugcccaccucgaccuaccaaagugcugggauuacaaguguaagcuaccacgcccagccaaaaauauuaauucuuaaauagaaaagcuaacaagauaguaaagaauuuggacacaaucuagaaggugaaaaccagaaauuaagcccaauauucaaaauggauuucauccugaggacuucucugaccuaaaagcuaaaguuucagugccuuuaugagauaacagaaacaaguucaagccaggagcccauccagggaguggagucugacaacuaccucccucuccaucuuaaucuugugcccaaaagaacuacagcuucaaaguaaaggugaacugggaaguaaaacagcaggaauaauggacaacagaaacagacucccccaaagggaauucagacaguggaauuaaacauagagauuauaaaaacaacuauacuuuccauguuuaaagaaauaaaauuaagccucaaaauaguaagaaauaaaaaacuguaaaagugucacaaaccaaacagaacuucagaaacuaaaaauugcaauauaugauuuaagauuucagaggccgaguuuaauaacaauggaaauaacuugagaauaaauuauccagaauguacuacgaaagaacagaguaaaagacauagagaaaagagugaaaagguuuaguuaaaucgauaaaaaaaaaaagagaaacaaugggaagaagcaauauaugcauauaaaauggcugagaauuuuacagaauuaaugaaagacacuaauccacagauucaagaagucuaauaaauaccaaacaaauugaacaaaaacaaacccauaguuccauagagcauaguggaaauacagaaaaccaaacacaaaacaaucuuuuuuuuaaacuugucgauacuugauuuuagacaaaacaaucuuaacaacauauucuauaguaaagagugaaacauaauauuuaagaaugaagacaaaguauguucaaaaggugacuaauggugaacacguugaaaaugcuuaauuuagcugccauaaaggcauaauuacacuaugacugacccuguacguacaucgcacuuguuacuugauuuaccacauacgugguuuucaauagcuaaagcagcagcuugauucuaaccaagcaucaccauucuuggaagaugaaagugaagacugauaaucaacuaaaugguuuugacacaauuauuccuuucuuauaucaugaagcacuuccccacaggguaaggacaugaagacuucaguugagaaagauaaucgggcagccucuacuuucagauccuuacaaauuguucgcaggucaucuaacuaaaagacuguaaaagcugcugucggcucaauacuuuguaucaaaaaggagucuacccacugauucccuucaaauauuucagaagggugccuuccauuuuauggugucccuguggacacaugaauacaccaaauaacugaugaaucgacaaaucuuaugucacaggugguaggcaagaggucaucgggaauuccgaucaccaggcucgcaucuggcuucuugggucccacuccugaacuaaccagucgggcuacccgagcgugcgggagucugagaaacugcauuuuaaaagggccccaggagaucuuguuuuccacuaacauuaaagaaccacgacuacgaacaaacaggucucccccuuuccucuguguggacugacagucacaaggaccaccaacucucaagcaugacgcuucaacucucuuuguuucuuaaguuuucugcaaaacgggccagcuggcuuguuuuccguaauagaaaauucgcuuggcacagcaacugguacauggcacacaauaaaugugcuucccauccugcacugccauucugggauucaaccauuuccaaccagacgccgcacauccgagugaguaaccuggaccuguuccaagaccucuggaacggagccugcuacucacuugaaaccuggguggcccuaccuagcagaaaauuggggaaaccccauuaaacgcccggcaguguugggcccgccugaaaggguccucgccgcgacccagaugccuucccgcgggcacccucagcuccccucaggcugggcccgcaagccccaggcuucggcuacuccggacaaggagcgggugcgcggacugagaacaggccuggcccuaacccuaacagcagccgcagcucaucucuuccguaaggaagcuggaacccaggugucgccgccaggccaggaccgaggccgcacucaccuaccggcgcgcgggaggcgagacgaccucaccucggcggcgcccaccccaaaccgccaccgcagagccgcucgcucuuaaaaaagaaaaaaaaaugaaaggaagaaagaaagaaacagaggaaggaaugaaugaaagaaagaaaaaaaaaaagaaaauagccuuugcuuuuguauuucuuuugacccuucagggcuuccuguuccucaccgccacaauagagucccgccccacuuccggcgacguaacccaauccgcggagcucuuccuccccgggagcccgauggaaauccgguacccugaaaacgagccggagagacuugauugggccauucacgccucaggaugaggacuggccagucugcgccuggagggcgggccggucccgcugaucacgugacacgauuuuugaaaggugauuggcugucaaggagagggcuugccaccgaggaaggggcguuuccuaggggacugagggagggcuggggcgguacgaagcgggggugggcucugcgcguaauggca

SEQ ID NO: 15738 - RNA, 6613 nt, Homo sapiens
gggaggcaccgauguuagcuucgcccaaagggaguauuacagagagaggcuugggaaagggaaggaaaccuggacaggcuuuucagcacugagaaaucacuuaaaacugauuugcuuucaguaacugguaugucugaaaugcagggagggaagaccaugcugucagcaaucaacccacuuuuuacagguuggcuccagggagagguugguugaaacgguguuuaaaggaaggagagugguuucaccagcuugcucagcucuccuggaacaaagacuaaggugcuacguguugcuuguuaggcuuauacuacggcgggucuggggcugcaggucuggaguccuuguuagugcauuuagugcuggugagaagggugggccccagucuuggacgcugaaguccucuaaagacaaggcagagacacagccucagaucccccgucaucuuccacugaauaagggggauggagaagaggucucagcaguuggccuccugcaagccgagaugccugccagccugggccugcuuccuuagcgcugugagagcuuaugucugacgggcagagaggagcaaaugcagucccuguugggcugacuccacgcagggcuccccagcuucaggcuugcagggugacccugcucugugacccagcggcggcuucagccccagagggggccguggcacaggugguuuaggcauagccgccagccaucugacugguggccgcauugcugccuacuccucgccaggccugguagcugaagaaggcacucacuccauaggcgaucaucaccaaacacgcaaagaacugaaagagaggugagaagggcuuaaggaccgagagggugacagugacacaagcuccaaccagaucucaggccaggcaggagggguuguggcagccgcaccaucucacacuuagccagaugcauuucacagcuguuuaucauggggcugaugagcaccaggguccugggauaccaacauuaccuucuaaccaugggaaacagcuaagaaccacaggcagggccugucagauugugauaagggcaaugaaggagaagauaagagugacagaggggacaccuagcaaggauuuaguucuaaaaagacaacauucaaaggacacccuaggaaucuccuagaaccaguucaagccucuauacuaacaccugcagccacauucagaagcuccccgucucuguccccaucacugaauuugcugauuucaaaacugcccucaucaggaagaguaaggaaccaaaugcgugcccauugaggcccugcccuccccugggcuuggccguggcuccaggccuggcguccaacuucucugagcaggagccuccugucugucaaaaggaacugguagucccuuccucucccucacugugggugucgcaggauccugggaggagauggugugcagggccugguggugugaagggugacaggcguggaggggacuacugccacuucacuggccaccugacgugggcccagaguuuggguuucaugggagagccuaugaaucucccagaaugguuuaaaccaaaagguuuuugcacgugcacuugucagugggagagcauguuuuucacauucuccaagggggcacgugacccuaaggcaguguggcacagcugauuuacaacaagguucaauagucagcccaggccgcguguggcagcucacaccuguaaucucagcacuuuaacaggccaaggcgaguggaucaccugaggucaggaguucaaaagaccagccuggccaacauggugaaacuccgucucuacuaaaaauacaaaaauuagccaggcgugagacuccaucuccaaaaaaaauacaaaauacaaaaaaauuagcggguguggcagcacacaccucuagucccagcuacuugggaggcugagucaggagaaucacuuaaacccaagaggcagagguugcagugagcugagaucacgucaccgcacuccagccugggcaacagagcaagauuccaucucaaaaaaaagaaaaaauaguuaacccaaaacuuccauugcccaccacacaccacucuccacuguuaauuauggaagccuggaggcggcccggcuccccucuaagacccacugaguguucaggugacaaccccucaggagguggcaggugccuggccucagaccaagcgagcagccugaguccuggggcugagacccugcagaccaccaagggagccugggaagcagacucaccgaggcagccgcgcgcugguuauaaggccgggugccccucagggaugucaggucaacugccgcagagcaggcgaugaaggcggugauguagagaacgguggcgcugauguuaaagaucauuaacugcaggacauggggguagggaguggggagagaaaaggcuuaagacacaaagagaggccagacacggugguucacaccuguaaucccagcacuuugcggggcugaaguggaaggaucgcuugagcccaggaguuagagaccagccuggggaacauagguaggccccaucucuacaaaaauaaaaaaguuagccaggcaugguggcgcaugccugugaucucagcuacuugggaggcugagaugggaagaucaccuggagccgggagguugaggcugcagugagucaugaucacaccacugcacuccagccugggugacacagugagauccugucucaaaaaaaaaaaaaaaaaaaaaaaaaaagacaagaccaacgguuggggcuucuugguucccacuggcacacuccuugaauagccauuggauggugaugcaaacaccugggucuuucccaccaacagggccucaagaggccacaguuuccagggagucagcccaugaggcccugguccccaggaggccugcugagcagggagcaugaacacaccugaggcuggaggaggggaaugacaggagggccucagugaugggguaguggcagugccagacccauuccucacagaaagagcccaauccaugacccaucucuuuguaccagcuaaagaaacacaggcuacuccuccaagugugguccagggccaagcccaggccaucccugguaccacugcaagguuuggcucuguggccaguccugggcugggccucacaucccucucugccuucagggggaagaauuuuugucucccucuuggccacauccuaagcucaaggcucuaagcaaaugccagggucaggaccaagaggaccagauauuucaagcuggauauggaaccagacuggcaggaaggggcccucugcugacaaccagggaccagucccucaucccaaacgcuuggccccaggagcccauucaccgucuucaaacgccugguccucaaacauucauucaguucguccaauauacuuuuaaaaaauuaccaacauuauaaaauuagauuucaugaaaaccugaagacuucauguaaaaauuuuauauuaaaaaaaucuuggccgggugcaguguggcucaugccuguaaucccagcacuuugggaugccgaggcaggcagaucacuugaggucagaaguuagagaccagccuggccaacauggugaaaccucgucuccaauaaaaauacaaaaauuagccaagagugauggugcccaccgguaaucccagcuacacaggaggcugaggcggaagaaucacuugaaccugggaggcagggguugcaaugagcuaagaucgugccacugcacuccagccugggcaacagagcgggacuuugucuaaaaaaaaaaaaaaaaaaacuuaggauaucaaaagauuucgcuccaaaggggcugcauucccacuaggaacagaugaagugaguauagaggcagcuugcgaugggcagauggaugcuggcuucuccagggucccuccugacccaauuuacucacauaucuugccuggauccuguaggggucuguagcccccaugccagaaaaucccaaauuggccaugcuaauccagccuucucuagaugcaguuaagcccucucugccccauucguugaggguccagaagcacaagaagcaauguccugccacuguggcagaagggagccuccuuccauuaacagccacggcuggagccccaaaucugcaccuaagagacacacaggcuuuuaucucuggagauuucucucuuagaggucccugggacgugagggaggggguggacccugagcccggaagucaaggcaccgccuccucgccccaaaaucuucccugcaagcccagcgaccccugcaaacgcugccuguuucugccagggaugucgagaucuaacaaacccauucugucuugaggaugacucacguuuccucgguuuaaaaagucauugaauuccaaacaaugccgccuagucccagccuugcuugucuuacaaucaugugccuuucucgccucucuucucacugaaagccucagaccccagcugcagggguuuuccgggucagaggaaaaaaaaaaccagcagcuuucugugugucuggccgggguacuucccauguccgcucucagcccuguguccuggggagacuguccuggggcaaaccuggggagcccagccucucccaggccucagggccucaccugcaggcagccaggugcccgagcuuguccugcacacuugaggcccuggccugggcaacuucugacagcuugccacagccuccagccacagggcugccuaccugggccaagcuacaaucucacaaacucacacaacacaggcacaaauucugaccacccccagagggaaauuuuuuuuuugagguggagucuugcucugucacccaggcuggaguauaauggugugaucucggcucacugcaaucuccgccuccuggguucaagcaauucuccugucucagccucccaaguagcugggacuagaggcgcgcgccaccacaccuggcuaauuguuguauuuugcuaauuguuguauuuuuuguagagacaggguuucaccauauuggucaggcuggucucaaacuccugaccucaggugauccacucaccucagccucccaaagugcugggauuacaggcgugagccaccacacccggccgggaaaaauauuuuuaagauuccaaauggccucuuacaaauccacucaacagccccucacuucuacuccccuccugggacaaagucaagccuguguccuuccuggcucaugguuccccaaaaaaccgugcaccuaggcaugguggcucacuccuguacucccagaauuuugggaggccaaagugagagaacugcuugagcccaggaguucaagaccagccugggaaauaaagugagacuccucuucuacaaaaaauaaaaauaaaaauuagcagggcaugguggcacgugccuguaguccuagcuacuggggaggcugagaugggaggaucacaugagcccagggguucaaggcugcagugagccauuauugagccacugcacuccagccugcacauagugagacacugucuugaaggaaaaauagaaaaacuggaccucugaaccaucaauccucaccuccaccccuggcucugcagaucagcuuaggucagugaggaugucaggccacccccccacacccugccacuucuucuagggaaagucacagugguccugucauagccacuuccaguacccccacccagacucaccaccaguggccagggaaccauguacaacuucaugugcagcugaaacagguagagguugaagaggacgauugucaccagccagaggaagacagcgacgaacaucacccagccauaggccggauacaggugguacgggguguccgcaaucagcgcccacaccagcagccccagcaccuaggagggucagacaaggcaggauuggccagagaugcgguuucauuucuuaucuagcuaagaaauacuggccaggcacaguggcucaugccuguaaugucagcacuuugggagcccaagguguaauaaucgcuggaggccaggaguucaagaccagccugggcaacagagcaaguccccaucucuacagaaaaauuaaggccgggcgcaguggcucacgucuguaaucccagcacuuugggaggcugagguaggcagaucaccugaggucaggaguucgagaccagccuggccaacauggugaaacccugucuccacuaaaaauacaaaaauuagccaggcaugguggcgugugccuguaaucccagcuacuugggaggcugaggcaggagaauugcuugaaucugggaggcagagguugcagugagcugagaucacgccacugcacuccagccugggagacaaaagugaaaauccgucucaaaaagcaaaaauaauaauaauaauaauaauaguuagccagguaugguggugcgcaccuguggucccagcuacucaugaggcugaagcaggaggaucacaugggcccaggaguuaaaagcugcagugagcuaugaucaugccacugcaugccaaccucagagacagagugaaauugucucaaaaaauagaaaaaaauuuaaaaaggaaugcugacuuggcucgugugauacaccacuguaccggggcccugcccugcacucucacuccucuugcaggucucagc

SEQ ID NO: 15739 - RNA, 991 nt, Homo sapiens
ccaggcccucugcccacucccugcaaccugauugugucucuugguccugcugcaguugccagucaccccggccaccugcggugcuaucucccccagccccauccucuguacagagcccacgcccccacuggugacaugucuuuucuugcaugaggcuagugugguguuuccuggcacugcuuccagugaggcucugcccuugguuaggcauugugggaaggggagauaaggguaucuggugacuuuccucuuuggucuacacugugcugagucugaaggcuggguucugauccuaguuccaccaucaagccaccaacauacucccaucugugaaaggaaagagggagguaaggaauaccugucccccugacaacacucauugaccugaggcccuucucuccagccccuggaugcagccucacaguccuuaccagcagagcaccuuagacagucccugccaauggacuaacuugucuuuggacccugaggcccagagggccugcaagggagugaguugauagcacagacccugcccugugggcccccaaauggaaaugggcagagcagagaccaucccugaaggccccgcccaggcuuagucacugagacagcccgggcucugccucccaucacccgcuaagagggagggagggcuccagacacauguccaagaagcccaggaaaggcuccaggagcagccacauuccugaugcuucuucagagacuccugcaggcagccaggccacaagacccuuguggucccaccccacacacgccagauucuuuccugaggcugggcucccuucccaccucucucacuccuugaaaacacuguucucugcccuccaagaccuucuccuucaccuuuguccccaccgcagacaggaccagggauuuccaugauguuuuccaugaguccccuguuuguuucugaaagggacgcuacccgggaagggggcugggacaugggaaaggggaaguuguaggcaua

SEQ ID NO: 15740 - RNA, 2198 nt, Homo sapiens
cugaggauaaagacuuuaaucugggcccuuugugcccauggcuccaguucagacaaggggaugggaucucccucacuguggcucuucuucgucccuggaaggccuccccuggacccaggcgcucagggugggggcggugaacaccaacgguggaggucccagguagucccgggagacagucaggagucuggggugaggaggcuucaagaccucucaaggcuuugcagguauuuaacugcauucuucacucucuuguuguugggguccgaacagauggcccugcccugcacaguuacaaaacuacacagaaggaggacguuaccaggaguggcagggggggaagggcccccagagucccugggacggcccgcccugugcugaccaggauuccaaggcuccaagaggggcaggaaguugcugcugucacacagggcauugguggcagaucugggacuucaggcucugucccgaguaaucucgacccucccagggagccagggcugcaggaacuugugcccaccccucagccugcccaugcccccagacagucuagagccugggacguggagacugcgggcagggcucaggcccaggcugggggaggugaccacauugccccugaccagcugugugaccuggggguguucauugcucccggggccucaauuucaccacaaaucaaggaauagguuggaccucauggccugcggcccuuuugggucccacaguguggggagccugcagggguuggggaggaaggccccgcugucucuucccugcuccccauuggccguccugggagcuccagggugcacuuguccccaugcuuggcccugaggagcagggguggagccagggggacuuacacgauggcaucccuggagcaguccucagaugucugguaccacgucuucagcuuucuaaggggaauggcucccuugaaguacuccaggcagcacucccggcccacauuggucccucgagcugcagggagaggagcggggcaggggugucugugagugucugcguguguguugcggggaccucugggggguguucguggaagaucugcaugugcguguccaugugugcaucugugugugaugacugcauguguaucacugccuauguguaugugugugugucuguguguuaccauacacaggugugugugaggcuucuguguauguuguggggucccguguguuugugggugugcauguuuugugugucugugggggauucuguguguccugugagugccuacgugugugucucugugcaucugugcgcgucccuguaugucuauaccuggcaaccuuauuucauuuuuccuuucccaaccuaauauaagaaucucuuuuuucagucugggcgccguggcucaugccuguaaucccagcacuuugggaggccaaggcggguggauggccugaggucaggaguucgagaccagccugaccaacauggugaaaacccauugguggcgugguggccgggcaccuauauucccagcuacucgggaggcugaggcaggagaaucgcuugaauccgggaggcagagguugcagugagccaagaucacaccauugcacuccagccugggcgacagcgcaagacuccaucucaaaaaaaaaaaaaaaaaaaaaaaaaagaauccuuuuuuacaugcucuuggaaacaauucuccuaucuuuaugcugauucccucauugugcauaaaaccuguuaauaaaacagaagcuaauaaauaauuuugagaauuguucauuuuccauugcacaacuacagccacagcccccaccucacggccauugcagcccaagaugugcucgccuugguccucaccaagcccacccgcaagagcuggggcaucgucaucaucaacauuuuucucugcuuguuucccucaaaauccuagugcugugggcuucucacgucuuuugugggaguaggugggguguaaauaauacacaaacguguguauugcugugguggucuucaugcccccaaccccuguccucccggugccugccccuggccaccuguccccugcucucaccugcguggaugugcugcagagaagcccccaggaggagggugaccagggccagcaucuucaguggggccauggugccaggagcccaggagggagucucugugugcaggucccucugcucagggagacacccugcuga

SEQ ID NO: 15741 - RNA, 20625 nt, Homo sapiens
cgcugugagucgucuuugcggaagccgcggaggccucgcugacugacuuccgguguuggcgguggcgccgcgcagucaccgcggagcagacgcggaggcugguggccccugggcgagaugccguacgccaaccagccuaccgugcggaucacggagcucacugacgagaaugucaaguucaucaucgagaacaccgaccuggcguaaggcuaccgagggaagaggcuggcggcucuggggcgccgggaggcccaagccggggccccggggcagggggcggggguguagugggguggggugggggcgauguccuuccagagcugccccccugcaccagggcuuuagcuuugggagccugcggcgcgggcccagccugucgaggcugcagcgccuucacgccccuuggcuuuugaucuuucaggguggccaauucgauucggagggucuucaucgcugagguucccauaauagguaagcgacuccccuuccucguucccgcgcccacggguuccugccccgcucuccacccacacacucuuuggggcuccuuccaguccuugguucgggcugagggugguagugcugagaaaagugcauugcuggagacuugaccauacccugugcccuuggcucaguggccgccucccuggcgcccacgggccacuuagguccacccuuguccuggguaugcauugcugagaagcauggguuuagcagugugcagacuuggguucaaauacuguuuucacuacuauuguuacaaaaguuuuuaaaauguuuucaacuuuuauuuuggagucaagggguacauuggugcagguuuguugccuggguauagugcgugaugcugagauuugggguauaaaugauccuuucacccagguagugagcauaguacgcaauagguaguuuuucaccccuagccccacugccucccuuccagcucuaguagucaccaguguguuuauugucaucuuuauguccgugcguacccaguuuuagcucccaugcgguguuugguuuucuguuccuguguuaauucucuuaggauaauggcuuccaggccgcgcucgcgccuguaauuccagcacuuugggaggccaagacugaggaacaccugaggccaggaguuugagaccagccuggccaacauggggaaagcccgccucuacuaaaaaugcaaaaauuagccaggugugguggcucccaccuguaaucccagcuacuggggaggcugaggcagaauugauugaacccagaagguggagguugcagugagccgagaucaugccacugcacucuggccugggcaauagagugagacuccuucucaaacaaaagaaaauaaaaaagaagauaguggcuuccagccacguccauguugcugcagaggacaugauuucguucguucuuauggcugcaucacuuacugcuuuugugaaacuugggcaaguuauuaaacuucugugugcugcaguuuccucaucuguaacauucggccacuaaugauccuuaucaggguaauguuaaggauuaagugagguaauccauauaagugcuuuguguuuagugagugcucagugcugguagauggcuuuuuuauuaaucuauuccuucaacagcauuuauggagcaugaaaguggcaggcauggugguaagcucugggaaugcaaagcuguagagaacaggguuuuugcccucauggaguccacagugagguuguaggggagagaugaauccacagacaacacuaaagcaagguagauuuugaucaguaguucaggagaagcauagcuguggugcacuuggcucuuagaggagggaagaucaauuucuggucugguuccagccacucugcuccaggugcuuaaugcauugauuauacuuguaugaaauacuucaagcauuucugagagucagcucagagaguuuggauuaggcaaaauaaauauaagucauagcuguggcaucaaauauucagacuuuuaaggaaauaagcaggccaaaugauuaggcaagagaacauuguaguuuauccacuaccaccaccaccccacccccccgccccccagucacuucuuaaauucagcuuggagugcuggaccucccccugccuaagcacuucaugccucuggaccucaguuucaucaggagucaggugagggaguuguacuucaugaugcagcccugccauucugagucuaaaugccucuuucccaacaaauucaguucuacaaauaauauugagcacccaugcuaggaauacaaagacaucccaggaccugcgugaaggaauuucugaagcuugagguauagacauaacauacacaaauaugacacaaggcacacuaugacaagugucuugagggaagucugaacagaguuuugugagagaggaguugaaagggagggaaugucacaucuguagcauagagagcaggcaaggcuuaguuuucaggaggcacagaggaucuuaaccuguacagcaaggaggggaagggugugcuggagggaagggcugggggauuaaagaggcagaaaagcuugggucaggguucucucaguuggcuuggacuggggaagcaaugggaagcauagcaggacagagcagguggaggccuggcagggggagguccucuuccgaccgcuguuccuagugucugugucccucguuuggcaguugggcuccagugccauuugauuccuggauuuaguugguuccaugcaaauguuuaugaaugaauaaauguguguuuaagucaagcaugugugaucgauaauacagucuuuacccuccuacgagcucauugcugcuagggauuggguucuauauuuaguauacuuugcgcauuaaaagaauucaguaaacauuuguugauugaguguuuaaaaagugcuaaguugggcaguccagucauuauauccuaaaaugagguauggccccauaagucuguguugcuucugugaggguuucccugacuuugaagugcucaaauaguucauguucuuggauuuagugguggcacagguagcagauuuaagugcuucucaugcaaauacucagcucaaauaaacauguuuccacuucuaugauauucuauaagucaguguuuucugugaagcagggagcccccugcauuaaauucaccugggcagggaggugagguguggugugugugggucuuauuaaaaugcaaguaccugggccccacucuaaugcuguggaaucagcccagcaaucugcaguuuagugucaggugauuccuaaaucuugagaaccacugcauuaagucuguagguaaauuugauggcuaaacuccaugucugcuucuuucauuuuuuagccauugacuggguucagauugaugccaauuccucaguucuucaugaugaauucauugcucacaggcuuggugaguacuccuuuuacuaggagguuaaagggaggguauugugccuagugucaggagggggccuccuuccagccucacccccagaaggcuucuggguucucauuuuggcuuggcuguuugguuuucuuuaaagugcuuuucuguuuuuuacaggauuaauuccccucauuagugaugacauuguggacaagcugcaguacucucggguauguugugugauuggguggaaugugagguuugguggggaggcuuugguucucaaagggauuuuuccugacauuuggcauccagcuugaauacuguuguaguucuggaacaacaacguggagauguugucuagagccugggcaggccuugguccugcguucugauggggcuucagauugauuagcacgcagaacaucagggaguguuguuaggcagcuccaccacagugcccauuuauacuuagaguggagguucuuccuuccaaagcaucucuucccaguagcaggggccuuaggaugcuacaggagucaacagaagguugggguaggcaaggagcagagggaaugggagcugucucacaagagcagcuccugggggacuaguccuggugucugcagauucaugcuguccccucccucgcaggugaugcugcuuaaacauggccacacucuuagugucucacccccuuccuccuggucguguuugcucccugauggcauguuaacaggccuucagaguuuggagagaguaggauaggagucgguuaccuucauccuuucacuaggcugcauuacacagcagcuuaaggcuacucccucuugauggcuuugggugauccagaaucaguccauuuucuaauauucucaagggccaugucauuuuugugauggcuaauuugauauaucuuauaaauauguguguauuuuuaaaaaagaaauauucagcuggaugcaguggcucacaccuguaaucccagcacuuugggaggccgaggcggguuuaucacgaggucaggagaucgagaccauccuggcugacacggugaaacccugucucuacuaaaaauacaaaauauuagccgagcguggucccgcucccaaguagucccagcuacucgggaggcugaggcaggagaauggcaugaacccgggaggcggagcuugcagugagccgagauugcgccacugcacuccagccugggugacaaagugagacuccgucucaaaaaaaagaaauauucaagcacagaaaagcauggagcuaguguaauaaauacucaugcuucuaccuaauacuacguugucacauuuuaacauuuugcccuauuuguuucagaucuccagauuuuuguuuuuuaauaaauaaaacauagauauugguggggaccguuguacaaccaauuaagagcaauuuggcgauaucuuacauaaagauacgcaugcucuaucaccuagcaguuccuuucauuaaaauuuuuucuaguauuuauugcacaaagauggcauggucugucucucucucucucuggcuuuuucugaaaaucuguagaaaaguugaaaaacuaaaauaauacccuuuacuuuucaccuauaguuaccaauuaauauuuuacauuugcuuuauuuuucauaugcaaauuguuauuuuugcugaacugugugaaaguugcagacauccuaacacuuccaaguacuucagcaugcauuuccuaauaagaauaguuuccuacauaacuacacuuucauugugccuaagaaaguuagcauuaaucuguaauaucaauauucagauuuuccuaguuuuuccccaaauauccuuuauuguuuuucuguuuguuugugggucagucuugauccagugaagauucauuugguccucauagcacuuuagucucuuuucaucucaaacagacuccucuccuuucaguacauuuuuuuuagguuaaauaccuuuucauauuuuuaucuuccauuacauuuugauucucccauuucauauuucuuuauuuuucuauuuuuucagacaggucucgcucugucacccaggcuagagugcaguggcaugaucuuggcucacugcgaccucagccucugggcucaaaugauucuccugcuucagccucccaaguagcugggacuacaggugcugugcaccaccacacccaaaaaauacaauuuuuuuguauuuuuuguagagacagucuugccauauugcccaggcuagucucgaacucuugggcucaagcgauccucccaccucagccucccaaagugcugggauuauaggcaugagccacugugcccagccccauuucauauuucuaaaagugauucugucucaagggucuggguugccuuccuaccucaccugugugugacugcagacgaccuaggugggaccucuagcugcugcuucuuccucagcaugcaaacaucaaaagaguguuggguuuuccucacuggugugagggagagaacagcuugcuugauugcauccuaguaacugucuucuugccugaagugaaacugcaauuaauagucccuaacaugggaaugagucaguuguuuuaagaauggcaaaauguuaauaauuauggaaggugguugaugguuaugggauggcaguuucuuacgugcuucucuauuuguguauauguaugaaauuuuccauaauagaaaggauuuuuuagaaaagguuaguguagaacuugaaagguacuuuuuucuguuccuuggugguuuuauuuuaaaugaugguuacauucccaagcugguccucuuaguucuugggaagcugaacuauagagugugaaagcauucuccugugccucauagccuugguucucugaggaagaguaguucaagggccagagggagauguuagcaauauguccccagagguggccuggcagcuggugggagugggaaagaaaugugcgugccaguguauguauaaguugucucuaaacuugggcaguccaugagaaugguauaccagauugucacagcccacaagaaccuggauacugaugaaccccuuuuuacaggugaagaaacuuaaggaacugggcauuagaugcaggaagccaagacaaggagccaaggcaggaguugccaucucccuuugacucauuccugcuucccuuccugccuuaggacugcacaugugaggaguucugccccgagugcucgguggaguucacccucgaugugcggugcaaugaagaccagacgcgacaugucacgucucgagaccucaucuccaacagcccccgggucauuccggucagugcgggagagcauccucuuuucccugggaucuuuucucuucucuggcuggcuccaagugggccagacugggguugauccuuagaaaauguuggcuuucccuguuacccucugccuuaaucugaucccuagaagugcuaauucuggauuccucuugggcaucguuagcaucguuggugcugcgcacccucuaucacccagggacucuuuuaaaggccauggaauuguuuugccugaggcuaccaccacacccugaaguggggguuggaguccugggggcaucugugccaccaccucgucagguguucguucccugguugacagauugcagucuagaggugcugggauauggaugccagaggaggugacuggggaggugagcagcuaaugaaugccugguggacucccuacaggugacaucccggaaccgagauaaugaccccaaugacuacguggagcaggaugguaagucuuccugaccugucaccgugugggccagcgggaaggagggaccagacacagccucucgugcugccuggucuccucgaaaauuggcuuuagaccguuuuuccagauguguguggucuugcaguggcacuccaagucagaauuuggagaagcaugucucuccuggcccuugacugacuugugccucucccugcagacauccucaucgucaaguugagaaagggccaggagcugagacuucgagccuaugccaaaaagggcuuuggcaaggagcaugccaaguggaacccuacugcagggguggcuuuugaauacgauccagacaaugcccugaggcacacaguguaccccaagcccgaggaaugguauguuccccuuaggagugauggcaggcauuugggguggguguggcauagaaauggcuguuguugacugagauguggcaggcucucuaggaacuugggugccccaaaaggagcaguggcaaccuugugcugaccuguguuugaccucaggccaaagagugaguacucggagcuggaugaggaugagucgcaggcucccuaugaccccaacggcaagccagaaagguaagagccugguuggacaugggaaggugaaguguggaagaagggaugguuuugguucaggccgugaguuaggcauucccucucccccaccucgcaguucucauaagcugaggaggggcugcugacugcuaaacuagaccugugguaugugcacaucccaggggcaggucgucagccccuuuuggucacugacaaagaggacccuccauuuauccaggugguuccuguucugauuuucagcccccaaagaagagauucuucaggucaacgcuaggggcagagauuuggacccaaguuccacagggugacugugaaaggucuaucacuggucacugcucacuugguuuuccacucucuccucagggggcaugcauacauacagaacuuuaggauuuucacagguaccuuaugagguaguuguagccuccuugagguugugcaaaguguguugaaacuacccuauguaagagguuuuacaugaaaggaaguuagcccuggcccaaggucaaguuccaugugggaacagagccaagacccggaaggaggaaggguuguccauggccagagcucgggucggccagccugccucgcagugcacucacuggacucuugccuccuagguuuuacuacaauguggaguccuguggcucucugcguccugaaaccauuguccugucagcccucucaggauugaagaagaaacugagugauuuacaaacucaauuaagccacgagauccagagugaugugcuaaccauaaauuaacugcagcuugccugcuucagcaaaaacggagauucaggccagcagcuggauaugggggucucucuucagacucuucucguuucugagaaucuagucuacuguugguugagcuucuuggcaggacaucaguaccaacuagaagugggucauagauagauuaccagggaugcagugguguuuaggcaggauaggucuuuacuggcccugacugcuguuaauaauuggcagcagugcuccccagaucccagaaggucccugcuggaguguuuccagugcaccuguagggaaccaacuagacuucucuccugguuaguccagcucuuuacucuaaacccuuucuguccaaaaugagucauuuucaguuguaccuuagaugucugguguugaggaucaagugccauagccuuuauucagggggccuauaaacccuuccaguucuugccccagggcuggccugcuagcgcuucaaauucccaggugucccuaauuugagaaguaaccuuuuggaauagcauuagacccuggcuguccccuccccaccaaauaaacaugauauuucauucucuguccagcagucaugaaccccuucaccuccaaugaccugaucauuuaguuugguggggguggggguggggguggggguggaagcagccgcaggagcaagggccccucccacauacacaggaggaguauuucauuucuccuuaaugaaggcucuggcccuaaccccucagcacugucuccagauaggaacaugcacaaagcaguuaauuaggcagccuggagaaaaccagagauccaguacagaaaggaaaggauauuuauugauuaacagaaguugucuuuuuaaaaguguuuauuuuuggcaauaaagagcacaacauaaucuccuucaugcgucaucgugccacuuagcugagccagccagcucugccucccuccccaaagaccuuuggaccccaguuccccucuacaggcuagcucaucccucuggguggucauuccccgggucacguugagagcgaggcugacugcaccaccucccuagcucaagggcuccuuugggaggggccgcgugcuuuaucauccuccugccacaacucaaauagugguuauuuacaagaaggucuguucccacaaaucaggacccuaaaguauuaaaaaacaaaacccaaaaaacaacaaaaaaccccacacaaccaaaaguuugacgugaauagaaagauagcccuucugcaugguagucaacaaauaccagcacuagaaaaucaauugcuuuaauugcauugcagcagggagccucagcaccauguggggaggaggaaaugggaaggucuugguuucagagugcuuuuggcuggccagaggguggccaaacagggcaagggggcucccucugcuugggcauuguccaccccuggucagugagaggggggcagcaggggugcuccccacggcaguccugcugcggccuucccuccuggccuauuccuggggcaggaacaagcuccagccuuccuccacauggcugagguaaucagcaccccuaccccaggggcaucuucccagccuacaaagcaggaaggagccugugcagaaguuacauuuuaaaaccagauuuucaccugaggcgucaaccagaugucaccucugcuuaaaacuccaacugcaaggcuggcaagcagcacagaggaagugcagauccuuccugugucacuccaggcccagaggaacugagaagccaccugcuguuccggcccuugggcugucugggaaaagccagcagucagagugccagccucaagcucugauuaucccccuccuguggcccugguaguucaagcagguccuggcagcaggagggcugugccauggaggauggacacgacugcacucauacucaaaaacagccuugaccguggccuggucaugggauuaaaaaauuuguguguauugguggggaaggauggggugagggugaggggaucucauugauacagaguaugucauaagccauauauauuaaaaucauuaacaguauauagucccacgguagcuccaaccccucacacaugcucaggugguguggccagcccuuugccucaguccagccucauccuugggggcaaggagggggcagcuugcucccuuucuccaggcucuuggccgacagcccccugaggcuguccacgguacacugcagccagccccgcagcaggcagcccccagcagucaucggugcucgccagcacuguggucacugggauggggucuuggccucacugcugucccccuggcugggcuuuggcuuuagcaggaugaaucuguugaggaggucuguuuccgagcuggccugggcugccccauaccccucaccugugggcacagaagcaggcucagaacucagagcuaggucaaaagaccccugcccaauaggccucauccuccacaaagccuccuggcagguggguguggggcauggaagcgacucaccagcauagcuggaggcuucggcgauguucugggaaccagugauguggugccaguaggcacugcgcggcagcauggucgugggugugcagggauacgaguaauguuccgugcccuuguucagcagcuguggggcaaaggaaggggucacucccauuaguggcuuacaguaucccugagcagccaccccaagacccuaccugccuccacuguguaccccaggcacuuggcccugccugcccgcccguuccccccuccccccguacccuggacugaugcccgcugccucacccucacguucuucuccauuuccagcaggacccgcuugugcugcucugcgauggccaggguggcacuguggacgcgcugguaaaucugcucccccucuugugucuggaagguauagaguccuuccccagcaucacacauccuggggacacagcacagagggcaagaugguggggacccaccacagacaugcaugugauuaguuaggcucucuugcaacugcaaguugugguugcauuccaggccgggaggacagguagggcuguggucuggggguccgaccacacggugcaaaugugcugagcauauucuauaccagcuggugcuugaaaugcauuauaagaauuaacccauucaguuuucucuaccaccucccucuggucucuguaccauuaaugguuuccucauuguuaugcauuuucccaaaccauuuuauagaugaggaaacugaggcauacagaagcuaaguaacucaaccaagguucugcagaggauuauauggaauuucagucuaggcagacugacuccagaguucaagugaggggauacccagucuucacuauaauucuaggagguuagguacuuuauuauccccgaaacccagacucagauccacagucacagaaguaguaagugccugaaccugcauuugacuuaagccaaaguaguauaugauuuuugguaaauagcuucacuugaccugcaugcugugggcaaguuacuccucuaagccuccauuucauuucuucgucuguaaaaugggaacauuacauucccccuugggauugcuaggccaauaaguaaaccaagcuccuagcacagugcccaacacagagugaauggcagccaccaucacaccauaguaggacagggcugggaggcgagaggguccuaccggccagccucgaagguaaagcguguggcaucccggccauagcggcgcagugagcagaggggccacgagacgagcuucacacggggguuguggaugucccagagguagauguucucgugggugaucugcagcuugcacucgccauacacguccagguuggggcagggcagcaggaagacauugaagcgaucuggagugggggaggguggacaagugggaccagaguugccccagauggggacuuccucccucccuuccucucuuccuccucccccuccccacccccagggccagggcccggccucaccugucuguucacacugcaccccuggggccaggaggucagguucucccagacugaugucguugaggcgggaccccagacacuccacagauagugucuuguaccacuccucugccucuagcucugaagaaaaugcuacuucaucaugcagcuccagagcccgguagcccaccccgucugcccagccugacuuaugccaccaugcacagcagggaggguaaggacaguggguucugccugccugucuugccucaacccugagggccugcucccugaaagcacccccaaccccacacacaccacaccaccaucuccacccaggguuagcccugcucugcccgcuccuagcuggaccucugaccaagaccaccccaggggaggcagauggaggcccauacucgcgccucaccugagucgcaggugaagguacgugccgagucaucagugaauaugauggccaccgccugccgcuuggucuccuuggggagccgcguaacacacuugacguugcugaucucagucaccugggacagcauccacaagggacuuagccaggccagugcaucucucucucucucucucucucucucucucucucucccucccucccucucuccccccuccuccuucucucuccuccucucccucucucccccuuucuccccucucucccucucuccccucucucccucucucucucuccaucccccacagcccugccacuugggggagcuagggcccaggccuccuaaccuuggggcagccccggaggcacaccgacuucucaucuggauacuucuccagccgcuggggccccuugcuggaggauuuccggaacaccagccagcaccuccgguagaucuguggagcgagaugacagggcucaggccucccuggaccacucccaccccaccagcauggcccugcagccaccccugccugccacagggggcggugccgcacagccuucccuggagccccagccuggggacaccgggggugggagucaccagcagugucaccucccugggagagaagccuccuccccaaauugaaaagucauugacuucuuggcuggcuccaaaacgcuguuccacaaagggugcucuccugaccugccauguacugugugcaccgcugaguuuagugugaguagccaacguuccugagugcuuccugcucacaccuguuauuagcacugugcacagucucagggccacuccugagaucaguucuguuaucauccccauuuuauagauggggaaagggaggcaucaaaacacuaaggaauggugaugcugguauuugcagcaggcugucuagauccagggcagacccucacagcccacugcaggaucuggccagggcucaggcagugccagccacaacagaggggucuccuggggauagggauuagacccuucccccugcccaccuguacauccccgugccccuaguucucugagucaggugagggucuuuacaaagguaacccccacucuugucuccuggggcuuucacucacccucucuuuucauucucuuaccaacccugaaauguaaggggcccugcuccagcugggaacccaaagcuguuugagguaaagggguggagcuaggaaucugaggcuccucccacagcauggugccuucccuccuggcccuggccacugcugaugccccuguaccuuaaacuaccuacauucucuguagcuucagggacucccccaaggggguggggagcagaggggagugaccacucuaggauugaagggacagacuggccuaucauucaugggugguggagagggaguuggccccagccaccagccagagcugcccuugcaugaccccucccuccugccuagacuuuuuucugcccaaagucuguggcugggguuuaccuacuccuuccagcgggcauuccaaaagcccgacagagccuguuccccaggcaucucugguguuccucuuacuggaaacaguagggagacugagugguggccgagagcacagcagaggaggccagggggccucuaggccccaccccuccucggcccuacugugccaugcguacacuagguccuuggcaggcagggucccagggugcaguggcccuaggcagcccccauuucaagauaccacucagagccaggccauuucuggcuccuaucugggacccuaggaggcaugucugcuccugcaccccugacccuggcuuggccccuguccuacccaccuaaaccacagcagcccucagcucucagcugcagcgcucccuuaagacagacacugaauuuuauccacagaauccucacucauauccugguagccucauuaacagccaugcuaaacaagugaaugaccauaugaaggaaccgugaaugaauggauggaugaauggauggaugcugccgacccagauacacccugccagggugggcuccaugcagcccgcagcaucaggggcagaaggccugggggccugagcaugccgguugccugguuacaggauacacauucacagccccagggagccacgcgcucaagagcccuccuucccacuucgcacagggcuuugaucagugcuucagaaacacucugccacagcucugccgcgggagaaaggcccuggcagguaggagagccggcuccugaucucuuucagccccuccccccucaccucugugggcugagaugagaauggcugcuggggagggaccacagccucucacaccaggggaagugaggcuccuggcuucagagggaagagaauucccugcauggauagggccuggcuaugccccaccuccccauccaggcugugcccaccugucagccacucagucucccucuggaacagguuugauacugagcccaaguggcugcccuuguggcuggugccuuccuggcacacucugcccugggcaaggccucagcccagcuggccccuggggaccugcuaagucuggggccauaggaaugagaagugauguuagaagcgaagccucugcuuccuuggccucccuaccucagccucagcuucucucuuuguucugugcuccaagucagugggcugaucccccuuucagaggaagagcaaaguagccgauggcugccagggcccagucucaacuagguugagccccagggcagggaggcacaggaggggaaguggggccagaaccaccuucuccaagaccagcccugcucugucugguacccagguagggaagcuggguggcagaucccucucccacuccgcaugccccccaaccccacucaggcugagccagggauccuugagcagccugagccgacccgcccccuucaaggcaaugggagagagaagggagaaggggacaggaguccugggucaaacacaagacuugggugaccucagucaccagggcuguccuuccuacaggggaaggggcaacugccagaccugucuuuggcaggggggccuggcagaggaauagaggcagcucucagacagccucgccgagaucaugaaguugauccccucugcuccugucuucuagggggucuucaccaguugggggucuacagaggguaggacaggaugcaugcccaguaagaccucuucucuguagccccuccaagcccccaguucagggccaagcaccaagcaagcacagagucacccaccaacaacuuggagggaagcagccugucccagagcacuggaccauucugcccaaaguucucauuuggaaaccacauaaauaucagcuucagugccucacaccaccccgucucgcccagccaaccacuccccuuuucaaacacuucuuuaacauuaaacucgacaaccaaaaauuuacuaaauaucugcacacggaaagcagucagaagcaaggggagaggaugaccuaaaagaaaagaggccaggagaggugaggggaggccggggguggggggcaaacggaagggagaggaggccaggggaagugagacgcugcuucucagcucagacacagcccggccuugccagccgccccugcugcugcuguggugacaacuucaacaauagcaggggagccgccugcccaucgguggccaccauugcugccacuaccaccaccacuggcccagcuguugggaugccagccagcccucuggggcgggggcugcagcaggcagaacccagcccaggcacaugccaggcagcacgcuggcgaggagccccgagaccacagaugcacgaugcccggcagccggagggcagccgcgugccccacgcgccaugccuccaagccugggaccgaguccucgggcccccaucccuuggcagggccccuccgcagcucagggucacucaccccgagcuuccugcucuucaucuucacguagccuugcuugacgaugucacugaaauuggucgccaugguuuucccaccuuuuaggggcgcggggccuggcagaggcgaggggaaggaugcccaggugccugggucuccggcuccuccaaucaccuguuccagacacucugucggggcugccgcgaggggcugcuccucaccucacccgccucagcauuguucuagcagcuccuucgccccgcgccugcuggaaauaaaaaugacagggagauuagagacagugacaucuuucucuuccucucgcugucucgcucucuuuuuuccuuccucuucccacacuccuccucucucccucuucccucccuccuuccucccgcccuucuuccuucccuucccuccccaccccaggacgacagaaccauucaggaaaaccgagguggaggcggcagugaggaaaaugguccagcccaguccccucccucacggcuggggcuggcaguuaaccccuuccugggaggacuggcucuggcuccuacuguggagguggggacccaggaagggaaguggcagggagcugcugucccucagcacuuugggaucguggccccaucaacugugauaacucuggugcaaauuuaggucaacuugccaagagcaaaagccccuuccuggguacaagagcucccagggguagcagggaagcgcuucccagagauggaggaggagggucgcaggagaugaccccugcgugucugagugaaccccaugcucugcaauguuaaagacaauuugccuggucagcucagcagcccccacaaaccccucuacccuccugccccacccgguccucuaccuguuucucuccagccccaggcuaagaaucacuaccucgagcucacgcagggccuguucccaggcccugcaacucuuccgcacgcagcucugggugcugcuuccugggugggagggcagaguccaguggggcgggccuccagauaagccugaggaaugugcugggccggcuggagguagccacugugggagcagacgccuugcccuggcccugggguugggaacgcuggccaguccgugaggguggggcccgggccccaacaggccacugggucuggccaagccaagcaggcccuccauguccugagcaugggcaggaguuaauuauaggaguaccagucagggcccuggggcaacaagacaugcaggagacaaugugggauaccaaggggagguagauauggagcaggaagugggaguaccagcagagccaccccaaaucaggcagaucuacagacaacaaagacucagacucagggggaggcucaguguugacccagucuaaccccuucauuuuauagauggagaaagaaaaguugcccagagaggguaagcuacaugacuaaggucacacagcaggccuggggcagagccagggaugaaggagaagguccaggguggugauggagaccagucuguggggggaacauccugcugccgucucuggcugccugccaccaccuaagccuucccugccauccauccucgggggcaggguuaugccagcaauguggccccugugucuucaggaucagcgggugggaacggagcagcauuucuggggucagcuggguaucugugcugccagaacggggcccugggacaggcaugcugcugguugugccagcagcuuggcauuaauuaauguccuggaggccugucuguugagugccuaacaaggaacagaugggacuaccccagugggcacacgcacagaugggacuaccccagugggcacacgcaaacaagggaggggcagagacgguaaugcgccccuaucccacuugcacccugauagccccucaauuccacuccugcccauucacugccucuaucccagcucccugggguccaagaaccucccacaguuaggcagucuacauuccuccuauaaggucuggucugggguccccucacuggcaacugauccccaacagcucugcuacaccugggcucuggcagccagagaugggucaauuuucucagcucugucuucaccgccugccucuggggcugccuucuccucagagcaaggaccagcucaggaguuccucuccaagaugauuagcaggcugaccacuggcugugggucuacaguguggaagcccccagucagaacacgccuacaggaagccacuggacccccagguucauccaacauagcucagacauagcacagcccggagugugaauccagcuggcugugugguccugggcaagccgcuuaagacccugugccuuaauuuccccauuggaaaaaaaugagaauaaaucuaccuacuuuaaaugaggaaaugaauucaugaggcaccugcuugcccacuugggacacagagcuucuacccuuuuucuuuuucuuuuucuuuuuugagacggagucucccucugucgcccaggcuggagugcagcggcgcgaucucggcucacugcaaccucugccuccuggguucacgccauucuccugccucggcuucccgaguagcuggaacuacaggcucccaccaccaugcucggcuaauuuucgguauuuuuaguagagacgggguuucaccguguuagccaggauggucucgaucuccugaccucaugauccgcccgccucggccucccaaagugcugggauuacaggcgugagccacugcgcccggccuucuuuuucuucuuuugagacaguguccugcucugucacccaggcuggagugcaggggugccaucacggcuuacggcagccucaaccacccaggcucaagugauccacccaccucagccuccugaauagcugggaccgcagguacauaccaccaugcccagcuaauuuuuaaaaacuuguuuguagagauggggcuuuuguuuuuuuuuuuuuuuuuuuuugagacggagucucacucuauugcccaggcuggagugcaguggcccaaucucggcucauugcaagcuccgccucccggguucacgccauucuccuuccucagccucccgaguagcugggacuacaggagcccaccaccauacccggcuaauuguuucauauuuuuaguaaagacgggguuucaccguguuagccaggauggucucgaucuccugaccuugugauccacccgccucggccuuccaacguucugggauuacaggcgugagccacugcgcccggccccuagagauggguuuucaccauguugcccaggcuggucuugaacuccuggggucaagugauccacaaggcucggccucccugagugcugagauuacaggugugagcaacugcgccuggccagagcuucugccuugaaaacuccaagggcuguguguauguauauauauauaguuuucuucaagaguugcugcccagacagggcggugaaaccaccagaagccagccugcuccuucccaguguugccccaccagggacuguggccccaagcucgcaggagugcuccugcugcgucuguccauaggccccaccccgucccauaccccagguccccagcgggaagagugaccuucacggggaaggcugggugccaaaguccugccagcucacuccggcccugagucacagggaccccuggccacacuuagucccuaaugauguuugcaagagcaagaccuaaccuaggacccaaaauggugggcaaagagggguucggaaggggagggaaaggucagggccaauagguggacccacaaauuugacaggcaguggggucaaguggugagg

SEQ ID NO: 15742 - RNA, 24324 nt, Homo sapiens
agggaggaggagacuccgcggcccucccucggccccuccggcggcggucgcagcugcacggugcccgcucuaccccgccgcagcggcugggacguacggagcccgcaagucccggcccgaggugagcgggggcggcaggccggggggcggcaggccaaggcggcccgggaacuugcuccaggccgcgcgccuuccgcgggaaggaagggguuaaguuguggggcgugcuggaggagcagacacagucggggcgcccgcggcaacccccgaacucagagcagaacuuucuagacgccuccccggccucccucagcccccggaaccccaggucuccgguggggaggggccgcggggugaugggggaggggaggcgccuccggaaugccgcggcccgggccggacgggagggggcggcgggcggggacggaauuugggacucucccgggggacccaacguggucgccauggcgaaugcgggauggacgggcggcgcuggccaaucagagcacggcgcccugcccagagccgcggcgacugccaaugggggccaugcgguggggugggcgggaccgcgcggcgcgggccgggaacccccuccacccuccgcccgucgcuagguggagcggggcgguucgcagggccagcggcuugggaggggucgacuaagugaggacuaaggcgacgcagggcuggggcuucaguuucaguaccuuaggugggggugguguccaccuucccacccccgcucucccagggcucuuguggggguuggauugguuuggguucgggaggucugcccaccuguuagagcguucaggaaucuuuuuagugccucuccccauccuguagguaaggaaacugaggcccagagagggcagggacuugcagauaucacacagcauaucagugauggagcugggacuagcgggaugucugcuguacaagagugaagaguucacgguguugccgagagggguggggcuggggucgggguggggcuggguccccaugaagguucaccccaccauuccagcugugcguauccacuuggccuggugccugcagaccccaucguguaggugcucucgggggcauugugccccucagguggcuaagauccagaagaggaggcaucccaucaccagcucccuacucuggccuugcugcugguccgcgguguggacacagacacguagcugucccucugggccucaguugguccauauguaaagaaaggaguucaaaucaaugauccaggcugucucuguggcuccucagucuaagauggggcuaccugggaauaggccaggggugccuaccccugggcuuagguccagccuggaggccuagccgccaucccuuccuuucccgccagccagcuccccccagagguccugcagcuggauccugggcagcaggucacagggacaggugcccgcagucugugggcugaccagccuugggcccugcacuuauucaaucaggcuguccucugugguuucccacugggcucugcuuucuguccacagccaggccuguggccaugggcuugucccagggcccuaccugaaaggcucugggaggaucuacaggguuucagagccggggaagggguuggggcacugggcuccccaucccuucagcuggccccuguccaggccuuggcauugcucauuccucucacugauauggagagacccauccaaacaugcugaggacaaaacacaacgcuguucccagugggucaauuaggcuuccccagguaaaaggugggacagccgacuuggccgugagaugaccucuuauuccaacccuggccagacaggcucagauaccuaccugucucagagccuggccaccgacugacuccugaucuuuaggaugacucaaccuucccaaacucugcauggucacaaggguaccccuaagagugguaccaccuucuuagggguaccuuccauccaucacgcaucugcuguaugcugggcccugugcugaugcccucgcucguggacuucaaaguaaggccuuugcuguagaacacggaggugccuggugcuuugggagcauacucugugcagagagguuagagaaggcuuccuaggggaggggacacuggagguggguuuugaaggauguguaggaguuugcugaugaaggaaggagagauauuccagacaaguccacaagcaacaggaaccacugggucacuuucugugggcagggcugaugagggccuagccugcagcaagugucagcucaaaauauucuuguuucuguccuggagugagcuaccagugagcacagcuguggggcugggguucaggagcccugauggaagcucuaaguggcacaagugucccaucuggaugagggaagccuguacugccagaagagagauggcagcuugccaggcuuggcugugggagguuguagggcugugguccccaggugggggugggguuggggagaucaaggcauuuccuggaguugguggcagcugaacuugaagauggguggggguuuuggagucugggacaugggcauuuggaauacaaacccagagacuuaaagcaguaauagaccugucuggcuguugggaggcaggacaacgaagggugggguaggaaaggcuccccggggccugugguggccggucccaccgugaccugccccuugguggggcaguaugccaagggaacaggaggccacgccccacgcacauagacaccccauggcaagagggcauugagccugguggaaggggcgggcagggcagcuggggcaucuccacgacuguaagccaugcucugcgcugcugcugccccucagugagugugugcguuaccagggcugugugugagugugcacguuacuggggcugcgugugagucugugcauuaccggggcuguaugugugugugugcacguuacuggggcugugugugagugcaggucccucgggccaugugugagugugaguguuacuggggcugugugugagugcgggucccuggggccaugugugagugugcgcguuacuggggcugugugugagugcaggucccugggggugugugugugagugugugcauuacuggggcugugugugagugcgggucccugggggugugugugugaaugugugcauuacuggggcuguaugugaguguguguccccagggcugugcuguaugaguggggcaggguagggggaggcguugcaaggcagggucuggcugcccuugggucuaugugggagugcaggauuccuggugugcugggggcggggugggcuucuccagaaaacuccccugaggaccccgacccccaccccuucccacacacccgcuccaggggacccugggccugaagugcaaaggugggagugcuguuccaaaacuuccgugcuccugcugugcccuuuccuucucccccagccccuaggaggggccuggccaggccgcugggaaggagaaugaggugagucuggagcccccaucucugccuuuagcaugggugccuggaagccauuagagaccuggguggugccugcccuggcccugcccaacaggcuuggauuccuggaagaagccgguggcccucucugggccaagcccugugccaggccuggcagcucccagaggcagggaggauguggcaguggcccccucccugccaggcuccuaguucagcggcugcaagaagggcccagcagacagggcccgggcccccauacccagcacagcugccggcuggcauucggguuuccugccuccuccuccuccuccccuccccccacaggcucucacauuguuuuucuuuuccaagagcuucucuauguggagcuaggccaggaaaaggaggagugugugugucugccucugugugugugugugugugugugugugugugugugugucugcuucacuuggggaugagcaugucuccuugcauguccuuguaccugugugucagugugcuggcauaugugugucuucaggcgugucugugucuacaggcaaaugucucuccaugcacccgugucguugugugccuguccguccaucugagcauaugugugucugccccugggucuuugcaucugugcaugggauugcaugucugugugugcacagauguuugugaaugcacaugggcaucaaggccagccagcucacugcacaggcggagagacugggucacagaggcacaggcugcuagggaucuccuggggugucagugguguacauggaaccagagccuggaucuguauggcugugucugggugcgugacacagauguuaucagggucgggguguacauguuguguuuauggaacuguggguaguaagaaagcaucgccaaauacucaaauaucccagacuauuaaaaugcaaauuccaagcuccacaccuagcaaacaugacucucucggguauagggccaagugucugggugaaucugaaggacacccugaugaagaagcacuggucucucucacacauccccccuucuacacauggggaaacugaggcccagaaagggacaguggcuuacaugagguuggugucagagcugggccuagaccucaugcaugguaaaggcagacagacaauaaacaaacagcaaauggccuagagaaaugcagcggggucgcugagcagcacggaggaaccuugacaaaaggucaugaguuuuaaaaaauacugcuccacguggugguguagaccuccaaugccuggcuccauaguugaagguaagagugggcaaagcaguggagggaacaggguuggcguuugccaggagaagccagaacaggaggggccuagggcacagagggugcuggcaagggagaaauuaggagcacagaaggugagcugggaaagagagggacaugggggugggcagugcaguggugggaucaguggcuugcggcuccugcugggauuggagaguauuuggaguugaguccuagagggaguaaccuuagaauugaggcuagggaggaaucaguauugguaaugacacagggaggggccaucagaguggucagguucuuacaagaacucacucuggcuguugcuguugagaauggauuugaaggaggugaaagugcaugaugggcagggagguggguguggguacuguuacccaggugagugaaggugguguggacccugacagguuagugacuguggacaaagaagguggauggaaggcggaugcacagcagauagacugacaagguuuggcggugggugggggaggaaagaaggcagauuucagggugccuucaaagcuggaaggagugaggaagugccuucucuggaaggagugaggaagugccuucucucggaggagcacccaggaggagcuggucacggggggaauggaggcagcaaguucuauuuuaaccaagaugagccugaaucaucuaucaggcauccgguuggagguaugggaagcucugagggcaaccugggcuggagagggacuuggaguuggggacauagcgagauggcucgggcagggauaucgugagaggagaagggggcccagggcccgaugacagccgcauucgagggauaagcccaggggguucaccugggaggcugacgagcagcuggagaggaggggaaaccuggagaggaagacguggaagcaagugaggcagggaagcaggugccacgguggguccagagggcacaccgucacaggggacuggaaaccagccuggcacagguggccgggugacagagcgccaagcagguagacggaguggagacggcgaguguggaccacuuuggaaggaccuuaaaagggaggugccaggggaggggagaagaaggugucaggagacacuucagcagggguaagaccccuggaaaggacgucacuggcuagggugggacuggcaggagggaggccuucggcucaaggaaggagaaccccucuguccucucaggggcagagaggagggggccguggggcuugacagcuuccuuuuucacugcaaaucaugacgauagaucaucugccgagaaugagguggguuagagauuggaagaagguggagaggggacauagagggcugccaggcagccuuggggacagccagugccgagucccaccgacaguacacugaucacucagaaagggugggucuuaggggcaggugugaagaucuguggaccagggcucucugccuaauggggaaggaaaagugugaugucccaaggggcuguugguggguggcagucaacagaggccgcaguggagggagacuggggacagagagggacaugccucucauuuauuuuaaggaggaggggggcauggcccauaaauggcagagcccagugcugggcgauggggaggcugaagugagacacagagaacaagagagcuguuugcggugagucacggugucagggaggggugguuccggcagagaaggggagagaacauccugcugcacucucagaagcccuuuccaucugaggacugguuuguuuccaucaucauccccagcgcgugcguucauucagcaaauccuuacuagaguuugaauuuguacucauagauaccauaaauggagguaaucauuuucuucaccuccacucuuuaaggaauaaaugagaucguucaccuaaagcccugggcacagugccuggcuuguggccugcccuccacaaauaucauugucaucauguguugggacuaaaacaguggucaggacccaguccuggaccacagcaaacucacagccuugguuaaagguacacagcagacacauaaaugacaggguaaguuagugcagugauggagacacauaaggggcugauggaccuggccugaagugcuccaggagggcuuccaggaggaagugauaccucagaagagucuuaaauaugagaagaguuagcccagugcaggaaaaggcagggaggggacuccuggcaccagcccagugcccccgccuggguccugugcggaaguugcauaguaguauaguauaagccaucagugugugagccgggaccgggagaauaaagaacagaucaagguuucagauuagcgccgcugggugaagggauuggagcagggagucgaggccacugaggaggccuuugcgggcccuugcuccaccaauccugccucauugggacucuccuggaacagaacucucuccuccuaccuuggccguucuguucccuccgccagggccuuggcgcggcugaucuucgagacugacgguggucgcaguccaauaacgguuguguucucccguagguccgaggaggcguccuccgcccgguggcccagagggaagcggggcacggcgucaucaugcacaguuguaucgcgcccgccgcgcguccccggagccgccccugagcccgaccgcgaguucgagcucagggcccgcccggccgcaccaugagccacgggcccagcccccggcuggccgaguccccgcagcuguccaagggcagccuccugaccauccugggcagcccgucgccggagcgcauggggccugccgacuccuugccgcccacgccgcccagcggcacgcccucgcccgggccgccgcccgcacugccccugccccccgcgcccgcgcugcuggccgacggcgacugggagagccgcgaggagcugcggcugcgggagcuggaggaggcgcgggcgcgggcggcgcagauggagaagaccaugcgccgguggucggacugcacugccaauuggcgcgagaaauggagcaaggugcgcgcugagcgcaaccgcgcgcgcgaggaggugcgccagcugcgccagcgccuggacgcgcucaccaaggagcuggcgggcgcacggcgcgagcgccaagaggcgcagggcgagugcgaggcacggggccgcgagcuggcgcggcugaggggcgcccggggggucgccgaccagacgcgcgacggccccgagccggaagcggagcgcgagccagugcgugacgucggguccgagaggccgccaggcagccaggugcgcggcgcgggcggggcguucgcgcuccagucucgaagugggcggggccgauuguccugagcugcugggcucagaaacaagcuaguaaaggccuggccuccuggagguuucacuucuccaggucggguucuacccuugcggggccucacaucauuuuccuuccagagaccucaggguggagaaucccaaguucugugaucccuccacucccacaccugagaagucaacagaaccaaggaaucauccccuuugagccaggagagggauccagcaacuugccuagaaguuagcugauucguagcagagccgaauccauugauucaaucagagcugagcggugggagaaaucagggcacugggaucacagaggaggucccugacgcaggcuucacagaagcuuuccuggaagaggucacauuuaagcugagacuagaaugaugaguaggaauuagcugugaaaagugccaggagggcaggacgacguggcucguaccuggaguaccagcuacuugggaggcuguggcugcggcagcaggaucccuugagcccaggaagucgagguugcagugaaauaugacuauacugcugcacuccagccugggcaacaacuccaccucuaaaaaauaaaaauuaagaaaaaaagugcccgaaggcauuccagcugauagaaacugccugugcaaaaagucuagaggccgagagggccuggugaguuuggaaaaaggcaguaauagcaacggccgucauucacugggcgcccacgcagcacuuagccgagcaugugcguuaucuagguaacccccacagcaacccucuaagauauuugcuccauggggaggauccugaggcacagagagauucagaaguaagggcugggcguggugguucacgccuguaaucccagcacuuugggaggccaaagcugguggaucaccugagguuaagaguucaagaccagccuggccaacauggugaaaccccaucucuacuaaaaguacaaaaauuagucgggcaugcuggugggcgccuguaauaccagcuacucggaaggcugaggcaggagaauugcuuuaacccgagagguggagauugcagugagccgagaucacaccauugcacuccagccugggcaacgagagugaaucuccaucucaaaaaaaaaaaaaaaaaagcagcagcaaugucugccagccggugacaacuugcugggguuugaaccuggacaaucuggcuccagaguccaggguaauaaucaggauggcugcugcauuaacagugggugcagagggcacccucuccugagccagcaggccuguuaccagaaagccaccuaggggcaggguccaagcucaguuccccagcucuguccccagcucagucccuggacaggccaacuccuccaaauaagacugccccuccucuauucugcccagcccccuccaucccguaggcuagcgugggcacugcugccuccuguggcugaaguccccucuucccuggggugaccugguguuuggaggugguguucacugcgcacaaugcuguuccuguccuauccuuauuccaguugucggucacaggccagagggcugugggcaguggcaggagcccuaggcuugcagucugaguuuguucuccagcccagccuuuucaugcuguggcccagaacaaguccucucucucccuguuccccauucguaaaauggggcuuuggacaccuccaccugaauaaucugagaaacagaagaguagcucucacuccucagggaguccucagggccaccgcuccaguccagcuagggaaacugagggccgggccaggaagaggcugguccagacucaucuggaaaggcugugggagaagcuggaacaggggcugugguccuuguggguuugugucagagacaggccuuggagaugggcggggcggagaagaagggcaggauggcaagaaggaaaggggcucggcccuggguuccuaauuucucaacugcuuccugucugggagcuggcucuccucacaggcacugcuucccugugucaccagucuccccaugccuuacuauuugccccugaaaaaacaggaucuuagagcuagaauuccuuuggaaggaaucuaggcuuaagccauuauaggaauuccugcuucaacauuuguucccaucggugccccgccguagguuugcauacuuccagugacagggagcucaccaccucuccuggggaaucuucuaggauacagggaaccaugguggcugacacucugcagcuccaggaggugaaaggggaggcccagagcagggugugucuuccuucuccagagauggagaggcaggcagcagaagaggaaacugaggcccagagacacugugugacuugcccaagguuacccaucaagcugaucucagacccagggccuggcuuggcggccacugguccagccuccaccuugguccccgcaggaacuggagcugguggagagccugcugaagagcaugccagaggagucugaggacugcugggaggcgcgcagccugggggcugggggcccgcggggcagcucaggccgccaggagcgcagccggcuacccugggaggacacagcugccacggaggaggaggccuccaaguugaccgcccugcggcuacggcuggaugagucccagaaggugcugcucaaggagcgagagugagucgugggaggcgggagggggcagggccagggccaggccgugcuacaacgcccucagaaucacagaacauuagacucacgaagaugacagguaguguuuagacuguaucuuggaacuguagagcagugguguuccacccaagaacucagugcaaguuuuuauuuauucauucaaauaauacguuaccaggcaccuguucugggccaggcacugugcucugcccugaggauacagccguaaauaagacagaagccccugccuuccugaaacguacuuucuaguugggggagagggcugugggcaggguaaaagcagggaauggagacagggaaguuggaagguugcagcugggaccuugguuuuggacgugugaguuugagauggcagggaggcagcuggggaugugaaugagucuggaguucaugagacaggccugggcuggagguaaaaaugcaagagucaccagugaagagaugauauugaaagccaugagcugggccaggcgcaguggcucacgccuguaaucccagcacuuugggaggccgaggugggcagaucacuugaggucaggaguuggagaccugccugaccaacauggugaauugaaaccccaucucuaccaaaaaugcaaaaauuagcuaggcgugguggcagacaccugcaaucccagcuacucaggaggcugaggcaggaaaauugcuugaagccgggagguggagguugcagugagccggaauugugccacugcacuccauccugggcgacagagcaagacucugucucaauaaauaaauaaauaaauaaauaaauaaauaaauaaaacgaugagcguggacaagggccaaggaaugaguguggauagggaacuggucagaggauccagcccugaagugccaaguuuagaggucaguuagaggaaagggaaacagcagaggagacaagagaagggagccgggcugggaaggggaaccacaagaaaccguuucccggaggacagagugaucaguaagaacagggcugagcccuggaccauuggauuuagaauguggaggucaccagugaccuugaucagagcaguuuagagggcacgagcuugaugauaaugaauauucugcaguuuuucuguccagaaauuaaauacgacaauagcauaaccuaucuacacacuccuuuuuaaaaaaucaauauaauggccaggugcagugacucaugucuguaaucauagcacuuugggauuccgaggcaagaggauugcuuguggccaaccugggccauacagcaagacccugucucucucucuauauauauauauauuuuuuuuagacagagccucacucugucagccaggcuggaguacaguagcacagucucgacucacuguaaccucugccucccauguucaaguguuucuccugccucagccuccugaguagcugggauuacaggcaugugccaccaugccucuggcgcauguucuuuguaguucuccuggaacugcauucccuauccaagugcaagugcccagcucacauuguggggagguggucgggguuccagagcacugagcauccccggacaaguaccucucuccugcugcaccucaggcucaucugaaaauggcuccaggagguggcggccccagcacuggccacuccacuccuuggcccaccuuguucuucucgaagggcugucaaagaccacccugcuccugucuguuuuguagacuauguucccugcaaggcuuggucugaacacauguuucugcagauagaaacacuggaaaacacuguccagugacccgaagagaggguucucucuugccaucgucacugugugggaucccuacauccucccauaacccccacccugccuugaucuugaauaaggcacuguagguuacaagcaugaugccuggcccuggcagaguaggugcucaccaauggcugagcucagcaucaccuuccagcacgcugcccuucaugaccccacaccacacuggccucucucucugagaguggaacacuccacgccuccaacaugggguucccagaggggacaacccagaggguggcuaaaaaauuagccaccagacccggcuaauuuuuguauuuuucauagagacggaguuuuaccauguuggccaggcuggucucgaacuccugaccucagguaauccaccaaccucagcuucccauagugcugggauuacaggcaugagccauugugccuggccuacaaaaaaaaaaaaauuagcugggaacggggcugugccacuguagucccagcuacuuggaaggcugaggcgggaggaucgcuugagcccaggaggucgaggcugagggagcugugauuguaugaaugcaccaguacccuccagccuaggugacagagagagacgcugucucaaaaaaaaaaaaaaaucacuauaaugccuuugugaagauguaggcagaggucagggugaugcuuuugcggacauuguugcaucuuuggccaaggaauaccaaagauggccagcaaacugccagaagcugggagagaggcauggaacggauucuuucucgcagcccucagagaaccaguccugccaacagcuugaucuuggacuucuagccucuagaaauaugagagaauaaauuuagacuguuuaagccaaacaagcaaaaaaaucaaccuagugcacuaacugaaauauaaaguagaagugaaaguaacuuuuuuuuuuuuuggagacagagucucgcucuguugcccaggcugggguacagcggcucuaucucagcucacuacaaucucuugucucccugguucaagcaauucucaugugucagccucccgaguagcuaggacuacaggcacacaccaccacgcccagcuaauucuucguauuuuaguagagacagguuuucaccauguugcccaggcugcucucgaacuccugagcucagggagcccaccugccuuggccucccaaagcgcuaggauuacagguguaagccacugcgcccagccugaaaguaacuuaaaauacacguguugugauaugggagugcuugggcauagcuccucuagaagaaauggugaaguggucagagugggugucuuuaaaugggaugauagugacgauaguuauaacagcaaagacauagcaugugcuccgagucagguguuguguugaaggcuuacauguaucugcacauuuaagucaccucgcaggacagcuacaaaggcggcucaugcaggugugcagacuuagcaacucaaagacacaaguggugucacugcgaugcgcuuucuugagagaugaacagccuuugguaaaguucugaacaaagcaaagugcagccgggcaccguggcucaugccuauaaucccaguacuuugggagcucgagguggcaggaucgcuugaguccaggaguuccagguugcagugagcugugaacagacaggaacaggguagucuuuaagagaugagccugggguacagcaggagggagguacuugcccagagaugcccagugcucuggagcccugaccaccuccccacaauaugagcugggcacuugcacuuggguagggagugcaguuccagggagugagcugugaucugcacuccagccugagcaacagagccagauccucucucuaaaaacaaagaaaagugcagucuuccuucaguuuauacagugauuccauuccuagaaaauucaguguauguuaguauaaaaauuacuuucuguuucaauguaaaucagaaugaggcuguaggcucagaucaucucuaccccgagcaauguccagugggcugugcaugcauucaguaggaugcaggaugcauccugaugggcaggacgcccagggcauugcagggagucaggcacccuggcccccguccacuaaaugaccccuaaucauugugauagccaaaaauguugccauggguuuucaacaugccuccuacagggugacguuguccccucugggaaccccauguuggaggcauggaguguuccacuuucagagagagaggccagugugguguggggucaugaagggcagcgugcuggaaggugaugcugagcucagccauuggugagcaccuacucugccagggccaggcaucaugcuuguuaccuacagugccuuauucaagaucaaggcaggguggggguuaugggaggauguagggaucccacacagugucgauggcaagagagaacccucucuucgggucacuggacaguguuuuccaguguuucuaucugcagaaccauguguucagaccaagccuugcagggaacauagucuacaaaacagacaggagcaggguggucuuugacagcucuucgagaagaacaaggugggccaaggaguggaguggccagugcuggggccgccaccuccuggagccauuuucagaugagccugaggugcagcaggagagagguacuugcccggggaugcucagugcucuggaaccccgaccaccuccccacaaugugagcugggcacuugcacuuggauagggaaugcaguuccaggagaacugcaaagccagggugcuucuagccacauagggugccugggccugaauaccaaggcaaggauuuuggacuugggcucaacaagugcagagggcacacagcagggccacccuuggugaggacuccaagcagagggccuuggugggcucacccccaugucugucccuuccccagggauaaacuggcguugagcaggaacauugagaagcuagagggggagcucagccaguggaagaucaaguaugaggagcugagcaagaccaagcaggagaugcucaagcaggugagucuuggagaccagagggucuuccuggaggcggcaggaucgcgcuguugaauuucaguaguggagauggaagagagaauucauucauuaauucauccaacaguuguucuuuuuuuuuuuuuuuugagacagagucuugcucugucaccuaggcuggagugcaguggugugaucuuggcucacugcaaccuccaccucccggguucaagcgauucuccugccucagcuucccgaauagcugggauuacaggcacccgccaccacgcccggcuaauuuuuguauuuuuaguagagacaggguuucaccauguuggccagacuggucucgaacuccuggacccaagugauccuucugccucggccuccaaagugcugggauuacagguguaagccacagugccuggcuuuauuuuauuuuaauuuuauuuauuuuuauuuauuuuauuuuauuuuauuuauuuuauuuuauuuauguuauguuauguuauguuauguuauguuauguuauguuauguuauguuauguuauuuuuucugaguuguucugagugcugggcaggcaaggucccugccuucaggagcucacuuugugggggcugugggcaugggagaccgacagucaccaggcagauucauaauuuaugaaggagucaaaacagaaugagagagauggggugguaggucagggaaggccuaagaagguggcauuugaggcaagaccuaaaggggcuagaggaagcuguccuugaaaagauacaggggagaguguuccuggcagaaggcacagcggugcaaagguccugaggcaggaacaagcccagcgugugcgggaaacagggagggccagguggcuggagagcaggaagugagaggcgaggccgcaggagggggccuuguagaccaggaugaagacgaggaggcuggauguggcauucauuggguuccuaucuguacuaggugucacugaagccucauggcagcccagggagcuggguccucauguccccaucuuacagauagggaaacugaggcuccagagaagggaauccaccacugcagugugggggcucagagcaggcugagcugccacuacggccuccugugcaggccucaauggccaccagagggcgcagccacccagggaacgccacacuggaucgguggguuucuagcagcugggaggaucacagaacuuuagagccugaaacuguccuggaggggaccaagacuggucuuacaugagaaucucugaggaaaucuccuaaaauacagauucccagaccucgccuccacccuccugaaucagcaccuuucagggcuggguccaggacccuguucuuuuagucuuuucaaauuaugaaguauaaucauucgaagaaaagcgaaugaaacacaaauguacaauuuaguagaaaauuauaaagguucucuuuuguaucuggugucucucccucaacauuauguguugaaaacucauccguguguuacagggagcagcaguuuguugggguuugcuguauaccgcaagaaauguuauugucuuaaaugcacgccaagcaaugccgaugcaccugugugcagagcaguguuggaauuagucacuguacacugagggcggcccugugcccaggccauacaacgacacaaagguggacagacgcacaagcuccccguccucccaggcuagcuuuccaguggggagugggaugaggaggccccuccuccaggccaggugggcagaagaggcauuccuaaggagggggccuuuaggucaaggccugagaauaagaaaaaucaguccuaagaagugucucagaaagauccacgcaugugcaaaggcccuguggugggcaggaacuuggugugucugaggaacagaaaggagucccuggugccuggaguacagugaacuaagggggagcggcggguagguguccaaucgugcagggcuuugugagagcguagagaggaguuggacuuuacccuaaggcaccugggagccaucagaggcuuugugggaggagggugguaugauugcauucaucuuuguuaaaagcucccucugggcugcuguuguagaaaacggguugacagagaagggccaggaguagacacugggaggcuagacaguaaugaggaggagagacauugggaggagcagaaguggucagauucgaggucuguuuggaauaccuggugccugccccauuugggcgcugccuuggcuccacgcugagcacuccugcacuggcgcccacccccggaggugguuccaggcuauauccuggugguucucaugaccagguggggccuuaucccugcagcucagcauccugaaggaggcgcaccaggacgagcugggccgcaugucugaggaccuggaagaugagcucggugcacgcuccagcauggaccggaaaauggccgagcugaggggcgaggugaggccauggaugggacccaggaggaccuggguuuagggguccuggggcccugcuccaucagcaggucacugggaacagggcaggggccaggacugugcucugagcggggccagccacauccaaugguguccugaucugcaagaggcaggccucucucccacacagaggccagaagcgcccucacauccuguacaccaugaaaugagcccagcuuaauuacagccaaugcagcuggaucugcuuccuggagccaaaaauggcuccaggagguggcgggggcauccagcucaggcccugcaugcccccuccgcugggaguccucacucugcccugcccugcugcagauggagcggcugcaggccgaaaacgcugcggaguggggccgccgggagcggcuggagacagagaaacugggccuugagcgggagaacaagaagcugcgggcacaggucggagaccuggaggaggcgcuggcccggcggcggcggcaaacagccagcgcacuggacugcgaccugagggccagccaggccgcgcucuucgagaagaacaagguggggcaaggaguggaguggccagugcuggggcugccaccuccccauccagccagagcgcagcuucccuacuaugugucaggccuggugauaauuaugguagcugcauguauucagcaccuugugugcuagaccaguugguaauuauaguagccgcauucauugagcacuuacuaugugccaagcuccacucuaggugccagagacacagcacugaacagacagauguggccuccccucuuccccucauggagcugaagacuuacuugggggauguacacauggcucucucugucacacagauucaugccaaucacacagcuucauggucaccagcaagaagaggggauacuaggagaccuggcuuaggcccacgguccuggaaauaccucccggaggcagugacauuuuaaacugaguucucagccaggcgcaguggcacacaucuguaaucucagcacuuugggaggcuggggugggcagaucaccugaggucagcauuuugggaccagccuggcuaacauggcgaaaccccauaucuacuaaaaauacaaaaauuagccgagcauugugggcaccuguaaucccagcuacucggguggcugaggcaggagaaucacuugaaaccgggaggcagagguugcacugagcugagauugcaccacugcaccccagccugggugacagagaaacuccgucucaaaaaaauaauaauaaauaaauaaacugaguucuccaggaaaagcagccguuaacugguagugugcggauuuaggggaggggauggagagaaguuaggaauaacaugaauaaauguccguggugaaagagacacagagcuuuggaggaacaaguccagugugcuggaggggagugagcggggggaugugguaagugaggcacgaguggugggacucuucgagagaguuuaaagcaggaggggagugugagcaggcugugugggcagaggaugggaagacaggcuggggggaagcuguugacauucccuggacaacaagagagggaggagaccuggaccagguugcagucaguagagauggaacaaaaaggauggacucaagagaccuuuaggcaaugccuauucccauuuuacagaaauggaaacugaggcuuagagaacucacagagcuccagggugggcaucucuuuugcuggcugcccuuccucuucccagccacucugggcucugagacacccacccauuccccagccuagcucauucccaacccagcucuuucaaugccauacgccccugaagacuccagaccucauccuuccccggaaaccccgacccugcuccaacagcuccaggguagauccaguagcaucugaaaguuacacauccaaaccggagccacagguuccacccacccagccuucucaccucccuggaaggcaccuccagccucuggcugcucagccaaaccucuacugcugauacuucagacaacagauggagagauucugggaaggagagacacccagcaucccuagaacugccugaccucgugggacucccuggcauggcgcccaagcugauacugauucccuccucccucccaccccaucccugugcccuguaggagcuggcagaccugaagcaugugcauggcaagcugaagaagcaguuccaggagaagguggcagagcuggcacaugccaaccggcggguggagcagcacgaggcugaggugaagaagcugcggcugcggguggaggagcucaagaaggagcuggcccaggcugaggacgaggugaggaccacagaggggcaggggcagcaacagaccuuggccagggaggagugggggccgcagggccauccuggcuucuccauucucagccccuggugccuggcacaagccugucucucaggagucgcccaggauagaguggguaggugcgugaugaauggauggcaggauggacaugugggugggaagaugggaagaaaaaugaacagaagacaagauggaugugugcauggaugaaccaauggguaaaggaaugaauggauggaugaaugggagagagaggcagggcgggcagauggauggguggauccaauggauguaugaacagaugauggcuggauggguagagaguggacagauggauggacagcugacugggucaguggguggaagaacgaauacagagggagaaagaaggccagguugacgggaagauagguguguccgggagagcaggaaggcauggcuaggcaugcuagaugggcugcugauuagauuaauggauggggaguggugggugacugucuccaugggcagaugaauaucucccuggacgaaugguccgauggacagacugauggggacagaaggauaggagguggauggcugcaucaguagugcagggccugggaggauggguagaugugcaagaggaggcaaaggggauggagaggaaccaaagggaugcuuuucuagaagagguaagccuuagccuaggccucaaggagcaaacacucucggaggagcaccuucccagggaacagcaggagugguuuucccugggcggguggccggccuugcccagcccugggugacccucgugcuuucggcccugcucacccccacagcuggacgaggcccacaaccaggcacguaagcugcagcggucgcuggacgagcagacggagcagagcgagaaccugcaagugcaacuggagcaccugcaguccaggugggccccgggcagggaacagaaacagggcagagacuuccagccagggaacccuccggucagggacggagcccaaaccaaggcuggagggggagacgaaggaagagauccaggugccuggagccagaauccuguccccuccgggcaggaagggccagagccaggaaaccagggcagggggugcaggaagucaggccagcugcaggcccuggaauugucuccucuagcaggagggcugguggguagagugagggcaggaagggcgggcuggagaggucaggcccaaggcuuggggcaguggguggggccagcagggcucaaauaggcagcccucagcguuacugggcccaggugacaccaagacagcagggaucugagagacuggugagcagggacucguggaggggccccaggccuggaucccguccacugccaacaggccccacccagcacacucugccucccucucccaacccugucucugucccagcacucugugaaucacagaaccaggcgauaucagaaaacuucaguccacgucccucccacuucacagcugggaggcccaaggagcaucggagccacagcauugaccugugccgggcccugagaaugcacuuaguugcauucucuucuuucguggaauagagggugcccgguucugcagccagacugccugaauggucugaagccuggcucagcauuagcagcuguguggccuugggacauuuauuuaaccucucugugucaguuucuucaucuguaaaauggggaugaugauaguucuuaccucuugauuguugugaguauuaaaugagcugauccauucuuaagaaaguaccuggaggcaugguagcucacaccuguaaucccaacaguuuggaaggccagggcaagaggauugcuugagaccaggaguuugagacccccugggcaacaaagcaagacccccaugucuacaaaaaauacaaaacuuagccaggcaugguggugugugccuguaguuccagcuacuugggagaccgaggcaggaggaucacuugagcucaggaguucauagcuauaguagugagcugugaucacaccacgguacuccagccugggagacaaagugagaucccgucucuaagaaaaaaagaaagaaaacaccuggcacauaauaaaugcugagugauugucagcagcugcugcuauuacuacuguuacuacuaccgcugcggaggggcuuauauuuggguuacauguugugcaucagcaucacgcugcuucuaugagagaaaggaaagauguuuuuuccuagggggcuggcagaugaggaaacuaaggcccaagaggguaagucuuuccauggccacacaguugguggguggccaggcagaaucaccccuggccaucagccauccaagcccuuauuuauugagcauuuacuauaugcugcuguuugcugagaucuuguggcuuagagaaugggcugcagagaccuaacagcuauugugccaugguaaacugagccucgauuuccccaucugccugggaugacgcccauaaaguguugugcaggggcccaggcgugggcccaagucaggacccaugccuggcuggcucugccugcucugacccugcagcacacacccuucaaaagaccacuuagccuuggggcuuucccgcagucugggucacauuguucaggagccauaaacuccagaagugggcaggcaggcccugcugggccucucaagugcuuccaucggggaggguggggccacccaggaccgcugugucguuuuauuuuccaacuuuuugugcuuuaauguuccggggacagcucacuaaaucacugugcaguaauggaggcccccgccugugccccucccuuacguguuaauaauucaugucuuccaguaagaugcagccggggcggccacuuugcugggggguugggggagggaucggcauuuccuucaccagcucuucuuagacucaaaguuuuccucguaaauuuugacuuuaggaauuuuaaugugaggaagaacuagggcugagcccuuucucacugacacugggaauguagagggcucagcccacccugcacugucacaccaaccaacucugcugccugugcucugagagccaggcuuggguucaaauccugcagcaugaccuugagccagcuccuucaccucucuaaccgcccagcugcucuggcaccacccacuucaguucagagcucugccccacuccccaccaucugugugacuuugagcaaaugacuucaccuuucugugccucgguuuccuugcuuguaaaaugggggugauaauggcacuucuaucauauaaggagauuacaggagaugagacagcagggaaagcaccagggaaggcuuaacugcuccagcaccagcugcagccaccuuaucgggggacuaccagccaggcugcucuaaccuccugucacccccaccccacaggcuccgcaggcagcagcagaacgcuccccucuucgggaagauccgcagugcucgcuuuggcaccgaggaggccgaggauggaaccagugaccuggacgaggacgaggaccugcaaauccagguggccuagagcuuccuguggcugggcaggaugggccgccccauaccugcccaggguccaggcuaaccagccacucaaacugaugcagugccuaggcucacucugggaccagucccugccacagccgacuuucuucucucccagggauggcgucaacagucccaccuaccaacgcccuguggaaaggaagccuauguuuuauauauauauauacacacacgcgcgcgcgcgcgcgcacacccagaagucuuuggacccauuugguuuuauaaauacaggacagcuccaaggcccaguccagaugaccucacccacccaggacuucaugcagggcugggcauguugggggcaguuguuggagccccacccugggcugccucucuaggcuucgcuguucaucauacaaugcagugaacccaguuauuuguaauaaaugaaguucaaguucuuggg

SEQ ID NO: 15743 - RNA, 7731 nt, Homo sapiens
ccugucccaggaauuaggauuucuugugcaggcuggaaugagcaaaauacuuaggguguaacauuuaaggaggugcccaccgucagugccaauggcccugcaccucacuuuaaucuucaugugauucuauuaggcaaucucuauuauuaucccauuucguuguccaaaaaaggaaaaaaaaaaaaaaaagaaaggaagaaaaaaagaaaaagaauaaggcucagagagcugauguuacuugcccugaaaagugacagagccaaaauucaaacccagacccaucagauuccagcaccuaauggcuuaaccauugggccauccuuucuccugaguacaugggcacccaggugauccucaagugaccagugcggcagaaaauacgcugaggcugagugugcaggcggcagcugcagucccagcucuguccaggcucaccgggugaccuugggcaagucucuuuuuuucucugugccucaauuuccuuguuuauagaagcugguggcuaugcugggccaagagucacaaacuacagugcccacagcggccaggcugcaaagcuaaugagagcaggaagggggcagggugggagacaauagggaguggggggaccuggggugaacuggagaguaugggccacgcuggggagcacugcccagcuccagugaacugucacuugaggaaauaugagccccauguggccugauccuucaguuuuuucaaggaagccagaaauuugaaauuaaugugaaaaucuuaauuguuauaaguuggggaugaauucaaauggauuuaaagccugucauaagccaaacaaagccuaucuaaggcuagaucucacccucggggccuccagcaagcaaccucuagauuccaugucagaagcuguaaguguuccucaauauccaccuccccuuucuauaccaauagaaccccauauuuucgcuggguucauggcccccuacaauaaagacauuauuaccuaacauuccuuggaacuggguggccacaugaccaaguucugaacaauaggaugcagccaucaguaaagucugcaaaucuugcaucaugcucuuaaaaaaaaaaaaagaggugcacccuuuuggaggagcaaaaagggaagggguaugagugcccaaaguccaggagccaccacagccaccgugcagccuggucccucgcaugggauggaaguaaacggcuucuuguuuauauggguucuuacucuugaguuuguuacagcagccaaagucauaaccuaccuagcacaggcucuuucagggaucuuccucagggcucauaauuuuaaagccagaaggcucccacaauccucaauucccacccccauuccugaccauauaccuauuuuacagauggggagaccaagguucagaaagguggagagucuguaacuuaaugagugaacagccucucuaaaugcagacacagcauaaauaggacccuucuucuaccccaaauaaagcugccaggagcucaugucugggaaaagggacuacaaggguggggacggugccacccgcauccucucaggggccaccgugugcuaggcaaagccuuucuucacugcuaggggccccuacaagucccaggcuugcaccccaaccccguguuucuuuguugucugcccccagcccgcaagcccaugucucucugggcugaagaggccuucaggacauccuuuuuuuuuuuugagauggagucucgcucugucacccaggcuggagcgcaauggugccaucucagcucacugcaaccuccgcuucccaaguuccagugauucuccugccucagcuucccgaguagcugggauuacaggcaugcgccaccacgccuggcuaauuuuuguauuuucaguagagacaggguuucaccauguugaccaugcuggucucaaacuccugaccugaagugauccgcccgccuauuccucccaaagugcugggauaacaggcaugagccaccaugccuggccagcacugguaauuuuuuaaagcuccuucuaccccuauacacccccacccccacacccgcccgauggccccaggcgacugcaggguuggggcaugugagucuggugguuucgcccuaaggguccuggguaucuggugcucggcacuuugccagucucagccacuggcucagccuuuccccuggagauauagaggcuaugggggcagugaucuggaaggccagcuguguagaagucccugagggucaaagucuaggucuggcaguguuggagaauaaaacccuuggcuggccaaacacugggaggcugcaccugcugcucugcaaauaugccugccccugccugagcaggaggccucagccagcccucagcaggaacccagccagggccacccaccccagccaugcuaagccucugccagagugagagaggcccgcgugggccagggguggcacaagagucacucucagggugggccaaaggguaucacagagacagcccggcccuggagccaugcagaccaggagccgggugccaccuccaacaccaacucacagugacuuugggcaaguccuuuuuuugucuugaaccucagugggccuagucuuggcaacugugcagucgaguguccagcccagggucuagaccagagccaguggcagcaaacagcccuguuaucaagaagcaacauaacaagaagaaaggagaaaaaagguaagcugauuuuuccuuuucugaguguuugcagaagucaacagauaauguccaagguuaauaaaucaggaaauggcaguagaagcauguuauuuauggcucuggagguaacugccacaugagcucgaacuauuagaagugguugccucuggggagggggcuugcaggaaaugggcuuuucacuauaaguccuuuuuaccaguucguguuuuuuaaugucuauuuagaaguauuuauuaaaaagugacucugccccuccacucuugauuuuccaggucaucccuguuaacagaaguauuuuuggccuauaaggccauguauaggguuaagugcucagacuguggaguugggcugccagaguucaaauccuugcucuguaacuuaccagcugugccgccuugggcaaauuacuuaaccacucuguuccuguuuucucauauguagaaugggaguaauaauaauucaaugcuccugguuuacacaguaaacauucaguaauugugagacaugauuauuauauaucccuguaacucauauaugcaauuguuuuacaaaaauagaauuaguaugcuauacacaguguuugcaacucgcuuuucuuucucuugccaaguuauaauggauaucauuucugcuuagaauguauaguuccaucucauucuuuuucauuaguacaagaauuccauugcauagaauguaaaauuauuuagccauaacccucuauugaaggaaauuaagggguccuauuuuuuaguguaauacacuuugcaguaauuaacauauauauuuuggcacauguguggcuauuucuaaaggaaagauaccuaaaagagggauuacuagguuauagaauugugcaauuaaaaauuguacagauacuugagccggggaggucaaggcugcagugagcaugauggcaccacugcauuucagccugggugacagagcaagacccugucaaaaaaaaaaaaaaaaagguauagacacugcuaaauugcccccuuaaaaaguaguaccaauuuagagucccaccauauccauuccaauguggaggugaucucucuagaugggcaaaaaauuguuuuagugugccuauuguaauucugaguggaaccgagcaucuuuucauaacuucaucauccauuuuucuuucuucuccugugaaacaaauguuuauauccuuuauccaacuuaaaaaaaaguaauacuguuuauuuaacuucaaaaacauuucagcauucuaaacauacaaaaaaaauaacagaauguugcaaaucguguuuaaggacagaagguuccugaauuuucauugcagugacucuuugcuuuagugacaaugaagaguucuacaguuuaaaaaccaccacacuuaacuaaaaaacaaaacaaaaacuaaacacuucucaugccagcugacccccccaucuuugccuuuagcuaagaauggcagcagaaagcugucaccacauacagaaacaagacaacuugaagcuaaaugaaugcccacugcacagugaaccgguccagcgucacggugcaugcccucagcuauggccccuccaaaaggcaccuuccccacagccucaaugccagacaagaagcaucaagagcuugccucaguuguuuuauucuuuuuacaaacuauggacauauacaguugauaacucaggauuucuagccaauaaccauauaguuaacaccaucuuacaaauuauaaaaaugccagaaacaugguuucuuuguuuguuuuguuuuguuuuguuuuguuuugagacggagucucacucuguuccccaguccggagugcaguggcgugaucucggcucacugcaagcuccgccuccugggcucaagcgauucuccugccucagcgucucaaguagcugggauuauaggcaugcgccaccauucccggcuaaucuuuguauuuuuaguagagacaggguuucgccauguuggccaggcuggucucgaacuccugaccucaggugauccgcccaccucggccucccaaagugcugggauuacaggcgugagccaccacacccggcccagaaacaucuuuaaaugcccugucacaccaacagcaaagugcacagagugagaauaugagagggcguuuucauuuuaaaauguucggaggcugggcaugguggcucaugccuguaaucccagcacuuggggaggccaaggccagcgaauggcgaauggcuugagcccaggaguucaagaccaaccuaggugacauggugaaaugccaucucuacaaaaaauaaaaaaauuagccauguaugguggcaugcaccuguaaucccagcuacuggggaggcugaagugggagacucgccugagcccaggagguggaggccgcagugagcugagaucauaccacugcacaccagcuugggcgacagagcgagacugugucucaaaaaacaaacaaacaaagguuuggaauuauguacaacuuugauacaguuucagggugcucuggacacccacggccacuuuauguaaaccacugacaauuucuagagcacucugagagacugcaauaugaucgugaucaaauuuuguaauuaaaacuaaugagggcaacagauauuucucaaaugagagaugagucaauuacaacgcgguccccaaccuuuuuggcaccagggaccgguuucauggaagaaaauuuuccacggacgggggucaagggugggggcaagggggggauaguuuugggaugaaacgguuccacuucagaucaucaggcauuauuuagauucuccuaaagagcacucagccuagaucccucucaugugcaguuuacaacaggguucagaaucuaaugccaccgcugauccgacaggaggcucaggugguaauacuugcucgccugccgcucaccuccuccugugacgccuggcuccuaauggaccacagacgaguacugguccauggaccggggguuggggaccccugaauuaugacacuccucugcucuaagauauugacaaggagauggauaaacagguuuuuuaauuccuccuccuccuccuccucuuccuugucuaccuuuuuccaggcaacuuuaacuuuugcaccaucgaacuuuccuucagacuucgagucagcaacacccuucucacacuucuucagcuugcugccguagugaugucaggcagcuuugcacugucacucaaguuauuccauaucucacucagccuuuuugccacaucuccaauagagaugccaggguuuguggauuuguccucggggcagaauucugaacagaacaggaagaauccagaugguagccuuuugggggcuuuaggguccuucuucuugccucccuuagcugguccguaauucuuuauuucccaaucauagaguacuucauccaccucggucauuucgucaggcuuagacuucucuuuuccacacauugucuuccgccucucagagcacuucuuggaaauuucugugaaauugacaagaaccucuggguuuuucuucuugcauucuucucugcaugucugcauaaagaaggcauaagcagacaucucaccuuuugguuucuugggggucaucuuuagccauccugacuauauugucgcuagucugggcaacgcagggcaccugcuuuacacauuuuuaauugggcuuuuugccacuuucuuacugauucauaggaccucuuugcauauuagaaaccuuaauucuuuaauacauaugagccaaauauuuucccaggaucuucugcaugcuuuuagcuaaauucuuggugucauuggucauagaaaaguuuugcauuuuuauauaguuagauguagucuuccuuuaugauuucuggcuuucaugucuugcuuuaaaaggcuuuuucugauuggaauuuauuuuuaaaauacucuccuauauuuucuuuuuaauacuuuuagaguauuuguuuaacauuuaauucaucuggaauuuuugugugcaugaacaugaugugagguaggggucuaauuuuuuguggggugagucuuuuuaaaaauugauacauaauagucauacauacuuaugagguaccugugauauuuugauccaugcacacaauguguaaugauuaaaugaggauaauuaggauaaccaucaccucaagcauuuauuauuucuuugcauugggaaccuuccaaaucuccuauuccagcuauugugaaauaaaguauaaauccuauuaacuauaguugcccuauuagaaucuaguuuuguuugcaucugaauggagaaccaauugucccaacaccauuuaccgauuaagucaccccuuccugccugacuugugaugucccuuugucaaaggcaucucucugucauuuuaugcacucuucuugugguuggcacauggcagaacucauaaauguugacuuugggagcagcugaaaugucagcugaaugacagcgagcauacgccacagugcagcugaccacagagcucaccucgcagcucagaagucagaacgagaaaugaauaugaguggcucccaacaucagugaauauuuguggcuuugguuuugauguuguuuucaaaucaacuuugcuuaucuacaauaaaauuuccacauuuuaaguguacagggugaugacugaugacuuggcaaacauguacacucucggaccaaacacaccaaccaaaauauagaacacguccaucuuucaagaaaguuccuuuggggcucuuugcagucaaccuccccuccacuuccaccccaggcaaccacgauuaccugaaaccacacguguguagcacauugauaacauuuucagagaaauaaauaacccagcugcagcaugagcuuguuggcugaggaggaaggccaacuuccccuaagggacaggacuucucucuugaggccgacaaacuccccccugggcugguuugguuaagaagaaaugggguaauccaaaccaggucuccccagcuucagguaggcaaguucuguuccagugguuuuuaacaagucuagaaaucggccagauauuuacuuaauauuuu

SEQ ID NO: 15744 - RNA, 36656 nt, Homo sapiens
uguuaccauggagauggcuaacagcuagagcaggcuguccucggaggggugaggagggagcaagggacuugggguggcuggacccugucuggcagggaaagggugaggcugguggcccccuucugccugggggccuccagcccugaucuuucuggggaaguuguugguggggugugugugcguguuuauguguguugggaggaggaaguugcugguggagagggggugcagggaagggccgguggguuggggcagaaucuaaggaaccuugagauaagacugccuuccccacacugggcuauagcugaagaggccaccuguguagggaauaaagugcuguggguucuucuccccagcucugccucugaugguguucugggacugacacgucggcuuccucuucagccuacuucuuuccuugcccaccacucccccacccccaccaucccuucuagcacuuccccaucucauaucucuuccagccugagacacacagguuucacaaccagaaauacagggguucaaaucccagaccugcuacuuacuggcuguaccuuaagcagugcacuuaacuucucugggccccaaucuucucaucugcaaaguggguguccucagugucugccucauagagucaguagaggauaagugagaugaucuccguacaacccucagcacaggucugacacacaguaggcauucagcaaacuguaaaugccuuguaauggugaugacugcccuuccugggcucauugucucugggaccaagaggccaacaaauggaucugaucacugagaagugcugcuuggcuagagguucuccccugaggaucugggguccugaaugguguugggcuaccuaggccuuggguggcuuccagccagaugagcauucguccccuccugagucccagagcacagaaugucagaauuggacagaaaauaucugcccucccuuccuacuauaaagagaaacuaaggcacagaaaggcgcagacagugacccaaggguccagcaggagcuacuggcaaagccaggguuuccccaaccaggcucagucguggcugguggccagggacucaccucccuaggaggccgagguggcccauguggguguggaguuggaaauuggggccagccuuuaucugcugcucccuucugcccucuugcuccuggcuucacccagggaagugggggaugauuagaaaaucaaggggauucugcuuuuuuuccuuacuacucgcccccuuuguccuguggguuucguuuguuuuccucaucucuggacccccauuugccguaaggaaaacagauguucgaggacagaaauggaaagaccccagcugggaggcugcagauagugcaucagcugggauggcguugggugguguggaacagggacccccauagaagcugagguuucuuauauaaggaaaggcuagagguggcacuccaggccucuguggcacugcuggggaccccagcucccccaucucucggcccugccguccauagcaggcagcuuuagcccucauguguggccaccucauggucucgccuuggcugccccaccucccacuuuaucuccacauuccaggugggaggaggagaagggcagagggcuccccaaucacuucugcccacaucucauuggccagaaccgggucacaucgcagggccaccucuagcugcaagagaaucugggaagcugagcaauucaaaccaggcacacugcugccccccacacaacugggguucugccguauagaagaggagacuggaucuuuggguaggugacuagcaguccccgcucaguguggcucugcucugugaccacaggacauauggugagcacauguggcgucucugcguggaucacagaaugaagccuguucucugggccaacacaggccuuggccaagagagaguaggcuguguuacccccaccccccacucccuguuuguaugcccuggugcaggcaccuucacucucugugccucgguucccaguuugaucaggugagauaucauucaccugccauccucauuuuuggguggguuguagaucauaucaccuuaccguuaggauuuucuuuaaaccaaucuauuuauuuauuauuuauuugagacagagucucacucugucacccaggcuagagugcaguggugcgaucucaacuuacugcaaccucugccucccagguucaagugauucuccugccucagacuccugaguagcugggauuacaggcgugugccaccacgccuggcuaauuuuuguauuuuuaguagagacgggguuucgccauauuggccaggcuggucucgaacuucugaccucaagugauccaccugccucggccucccaaagugcugggaucacaggcaugagccaccgcacccagccaauucauuuauuuaaauaagaaacuugacaauacuauaguaauccccacagcauucacaguacuugucauugauaacugucagcuggcacaauggcucaugccuguaaucccagcacuuugggaggccaaagcaggaagaucgcuugaggccaggaguuugagccugggcaacauagccagacccugucucuaccaaaaaaaaaaaauagccaggugugguggugugcaccuguggucucagcuacuggggaggcugaggugggaggauugcuugagccugggaguuugaagcugcggugagccaugaucgugcugcugcacuccaagccugagugacagagcaagacccugucucaaaaaaauaaaaaauuuaaaaaaaaagauaacugucaaauauacuaaaagcaaaucgacacgugccuuucccuguccuguccugaggauggcuuccaaccggaggccugcuuugucuuuguuguaaaggaauauuugccaggauuagaaagguguuacagaugggguagcaccaaacagagacuuucuccauguuugaaaggaagucaaagagggaaucacucccuauguguucgacaccuccucaaaaccaucucccaggccucccggggaugcccagaugguguugguggcuccugccugggcugacagucggccauggaguauacuuacccuuccccacagagacauuccaucuccagacacccagagacgcuccagaauggagguccugagggagaagguggaggaggaggaggaggccgagcgggaggaggcggccgagugggcugaaugggcgaggauggagaaaaugaugaggccaguugaggugcggaaggaggaaaucaccuuaaagcaggagacgcucagagaccuggagaagaagcugucagagauccagaucacugucucagcggagcucccgugaguguggcagggugggggcccuggcaaggguagaccggggcugggcacagggagacccaggcagagugcuggugccuggucugguagggugaccaggagauagagggaagcaguuaugagugaaggcuuucugcuuucaaauggccugggccgaguguccaugcucucccaacuagcugugugaccuugggcaagucacucagccucucggugccucagugccuuuaucugucuaaaagugcaggugcuggccaggcgcugugucucacaucuguagucccagcacuuuagaaggaaaaggugggaggaucgcuugaggccaggaguucgagaccagcccgggcaacauagcaagacccccccacccaugucuacaaaaaauacaaaaauuagccaggugugguggugccuauagucccagcuacuugggaggcugaggugggagggucacuuaagcccaggaguucaaggcugcagugagcuaugauugugcuaucacacuccagccugggcaacagagcaagaccugucucuuaaauauauauaugaaaaugugcagauguuaaugauaccugccuucucaguagccgugaggauuaaaugaggaagggguagagccaauggcaacucaguggaaccagggcuccugugugccaggcauggcuucccuaaugccaucccuguuguggcacagggccuuuaccaaggacacuauugacaucuccaagcugcccauuuccuacaaaaccaacacacccaaggaggaacaccugcugcagguggcagacaacuucucccgccaguacagccaucugugcccggaccgcgugccccucuuccugcacccccugaacgagugugaagugcccguaaggcuggcauguugagggcagggcuggggagccuggggcuggagagcagagggcacagggaaguggggcagguucuccaaggucacugggccaaaucacggaccuccugugggccagagcgcuucuagucugggggcaacauaaagucgaacgccagcaggccucagcaggcucagugcagauuacccuggagggcggugguggucuggagaccccaugcccccgccuaaagaggcagcugcugauugcugcggggaaacugcaggccugggguuaccugaucaagaggagacucgggauuugugugggagucucugguuuuuaaaugcuggcagcugacauaaaugcuaaacauugccacgugggccaaauaaagcgggucugugggucccugucagcucgugggcagcuguuucccacccccuggaugaaucccaugucauuccaucuacagauggagaaacugaggcccagaaaggcucagagacaugcucugggucacagggcuggaaggaaaaagccagagcuuagguucuuaugccuguccugguccaauuugucuuauuucucuguccuucccuggacaggcugaccucugaggcuucagacuguacuggucgccagcuggccccagcccagaaccucuguaggccccagggagagcaucgcuccugggaggagagcacagugcucccaggaaccccaggaaacagaccugaucuccucauucagcccugacuugcugggucaccucaggcagcucucaagccugcucugggccucaggugucuccacaaugcccuagggguugaaggcggcaaaacuucaaagcccuucaaaguccagauccagaauaugcuugugcugucuccgggugcuggcaacaugauaagggccucccagucauugccacugcgccacugauggcugccaugugccagaucugggcaucaccuucccagccaagggcugcucugccaccccaggucaugugggccuggccuccugcauuugcucaggccucuagggucccccuguggauucaaggaaggccccaagcuugaucucacaaguucuuauugccuugaccccacuggcaccaucucucuccuugcagaaguucgugagcacaacccuccggcccacacugaugcccuaccccgagcucuacaacugggacagcugugcccaguuugucuccgacuuccucaccauggugccccugccugacccucucaagccgguaagcaccacucacaggcugcaugccugagcccaccaggacuaagauggugugagaaacaaacucacccauccaaacccaaagaauggacuuagaggccgggcgugguagcucaugccuguaaucccagcauuuugggaggccaaggcgggcagaucacaaggucaggaguuugagaccagccugaccaacauggcgaaaccccgucucuacuaaaaauacaaaaauuagcagggcgugguggcacaugccuguaauccuagcuacuggggaggcugaggcaggagaaucgcuugaaccugggaagcggaaguugcagugagccaagauggcaccacugcacucuagccugagugauaagagcaaaacucucaaaaaacucucucaaaaaaaaaaaaaaaaaaaagaauggacuuagagaccuggagaacagcgaaagugagacuuuuaaugauggucuugcaagauugggugucugauaggcagacacacccagcauaguuuuaacaagcaguuuauccccuagugcgcaggucccuccccugguuccucacaggcugaguacuauggggucacaaucuucccagacaucgccuauugauuguuaggcaggggcuuuagguguuuuuucuaggguuguuuugcagcauuuuauugcaacccacaaugcauugcaauccuaguuagcucaggggcucuuuaaguauuugacuuaugaccugaguagcugggcaggcugauaagaacagacaaagcgagcuauuuugcagacuaguaaacuuuuaucuuaggcuaaacuuuuuugguuugagugagggcaacuaaggcgguagguaagggggaggaaggagaaggcugacaaacaggcauuggcuauucaagcaggggccuaguauauccugggguuuuuguaguuugcugaccuaagccuauucaaggcacuuugccuuggaaacggaucacuguguacaugauuuccuucaaugggaugucaggcacggucugggaaaaggaagcucagccaggcucaggguacagccucucagggccccuaagggcaaacaggccuagagagagacagccacuugccugaggacacacagcaagccugggcuucugguucccaccucuuuucuccuuugcauucagagcuucccugccauggcuucaagcgguacaggaaagagagaggggaggcccggcugcccguggcccuaaccccaucuuugggcuucugaccaaauucgucagcuucuccuucagaauagagggagggaggaagaaagggcaaggucaacaguggagaacugauaaagggaggaggaggaaagguggguaucgaaggaagggggagcauuggagcaaaacaguaaacuuaccagucagagggcauuagaucagacacuccuacaguccagaagguuucccccuaucaggaaguccauagccccuucaaaugacaggcaaaugugaauggcauggugucugguugucauuccauucuuagcaggcucccugaccccacaaggguuaggggcccaaagcagguccagccugugcauugguccuggcuccccacccugacagguggugggcugugaccgguggggaggacaggcuggggcagcggggccccagcugugcugaccgucccacugugaccagcccucgcaccuguacuccucgaccacugugcucaaguaccagaaggggaacugcuuugacuucaguacgcugcucugcuccaugcuuaucggcucuggcuaugaugcuuacugcgucaacggcuacggcucgcuggaccugugccacauggaccugacgcgggaggugugcccacucacugugaagcccaaggagguauggucgggcuugagcugcccggguuucccaaaggaugaacauucccggugcugucgugccauccuuagagacguccaucacugccgccucauccccagcccuggccacgcggacacagaucccucaccaccagcccuuccgcugcccuggaguucauauuucaaaccaccagugauuuauguccucggugucuuaacacauccagcccaguuuuccaagcuggcuguucuucucugucuguuguaacucaguuuucagcuacuaugcucccugcuugguaaauuuuaugaaugccacauagcuuauaucuuaagucaaacgauuccaaauuuacccuaugcauuugauaaaaauccagccagccauuuuuauauaagaaaauaggccaggugcgguggcucaugccuguaaucccagcacuuugggaguccaaggcgagcaaaucacuugaggucaggaguucgagaccagccuggccaacauggcgaaacccugucucuaucaaaaauacaaaaaaauuagccacgcaugguggcaugugccuguagucccaguuacucaggaggcugagacaggagaaucacuugaaacccgggaggcaaaggcugcagugaacugagauugcgccauugcacuccagccugggugacagagcaagacuccaucucaaaaaauaaauaaaagaaauaaaaaauaacagacaagugaacagacauuugguucucagucccacacucccgagguaaaaagccugcuuuuuuuuugagacagggucucuuccacucugucacucaagcuggagugcaguggcaugaucucggcccacugcaaccucaaccuccuggacucaagccguccuccugccucagccucccaaguagcugagacuacaggcgaguaccaccacggccagcuaauuuuguuuguuuuuuauagguucucacuauguuguccaggcuggucgugaacuccuggacucaagcaauccucccgccucagccuuccaaagugcugggauuauaggccugagccaccgugccuggcccucaaggccccuuuuuaauagcaaaaaaaaaaaaaaaaaaaaaaaaaaucaccaacuguucaguggcugguggcuguguuuuuagaucugcucauuaagaucuccauaaggaccacaggcugcuacagacacaagaaauacucuggaaugaauaucagaaucacaaaugcaucucuuuacauuuagaaaauagucaugcuacagacagaaaaugcucuucaugagguggauuaauuccaggacucugggaucagggucaggcuccuguggguguccgcagcuuggagauggggauccagggaccugaggcauccagcaggaucacuguguaccuggguuauaccugggugagcacccagggaccccagggugggugcucuggugggagaagggcgagacagaaggggaagcacaagaagagccuugcucucucaggcccaccuccccaagagaagauggagcacgagcuccgccauggcuuuuggcuucaaaagccucuggcugggcacgguggcucauuuugggaggcuguaaucucagcauuuugggaggcugaggcaaguggaccacuugagcgcaggaguuccagaccagccuggccaacauggcaaaaccccgucucuacuaaaaauauaaaaauuagcugggugugguggugcaugccuguaaacccagcuacucgggaggcugagccaggagaaucgcuugaaccugcaagguggagguugcagugagcugagaucgcaccauugcacuccagccugggcaacagagggauacucuggcuccaaaaaaaaaaaaaaaaaaaaaaagccucugagcucccacccgggcaucucagcucucagcucagccaaaagcuuaaugauuaacauuauaucaauaacaaacagaugcagagaacuuucggguuuaaaauccgcuuucauguccauugugcuuguugcuccccacgauggcccagugugguagauauugucacuuuuauguuacagaugaguauguugaugaaaucaaaagguaacauaauguggccaaagucacacagcaggaaaauggagacucagggaacuugaaacgcuggagauucacuauuucuccuucaugacuaucacaggcccaccucugcagccucugcagugcucuuuccugggaauacuucuugccacuuagcacacauuuguagacacgcaagcguacacacacacacacacacacacacacacacgguuucuucuccuuccuggcccagcaaacuguuaaagucaacauaugaggcccuccgaugacaagaucugaaaaauccaacuccugacaauucuccccacuucuggaucagacccaggucauggcuaggauggguggugaggauugaagaggagaaagccacaccuccugagcuccuggcccugacagguaccucccucgggcauuuuuucugucuuuacuucucagaaagaggcuggggagaaaguuccuauuauucucacaccaugaaccugagauucagagaagugagaggaccucccaaggucauggagcuggagcugcauuuagagccagaaaggccacaggcuacaggaguagcugccaucccccggucugagggacuggcugggcgggucucaccucuuggaguugcacauguaaaggggggaugcagggccacugacccuuccucuucuuuugggugacagaccaucaagaaggaggaaaaggugcugccuaagaaguauaccaucaaaccccccagggaccugugcagcagguuugagcaggagcaagaggugaagaagcagcaggagaucagagcccaggagaagaagcggcugagggaggaggaggagcgccucaugguggguccucagcccugaauccccugggcucagcuaucgagaaaggacugcuagggaugggaaaagaggcauaggucauggaggggauguguguauggaccccccaacuagguccaccucacaaucacccccaaccucuaccuggcccugcaggaaucucccacugguggucagccagcuucucaugauggacuccuaacaucagggcacuguacugccuggggcagcccauucuaugcuaggcagcucugguguccucuuugcucuagacucuuacuggggauauaccugcauacacccucccauccauucauccucccaucucuccucccauccauccucccaucuccccucccauccauccucccauucgccaauccauccauccauccauccucccauccauccucugaucucuccucccauucauccucccaucuguccaucucccauccauccauccuccuacccaaccuuccauccauccauccucccauccacccauccucccauccaucuguccucccacccaccucccauccauccauccucccaaccauccauucucccaucucuccucccauccauccuuccauccauccauccucccacccauccucccauccauccaucuucccauccauccauccauccucccauuuauccucccauccaucauccucccauccauccauccucccauccacccucugaucucuccucccauccauccucccauccauccauccucccauccauccauccucccauuucuccucccauccauccucccauccauccauccucccaucuauccacccuccuacccacuuauucucccauccauccaucaucccacucauccucccauccauccauccauucucccauccauccucucauccauccauccucccauccauccuuccauccauccauccucccaccauccucccauccauccauccucccaccauccucccauccauccauccucccauccacccauccucccauccauccauccucccauuuugccucccauccauccauccucccauccauccauccucucauccaugcuuccauccauccauucucccaucuucccauccacccaucuucccauccacccauccucccauccucucauccaucuauccucccauccacccauccucccauccauccauccucccacccacccucccauccguccauccucccaacuauccauccucccauccauucucccauccauccucccaccauccucugauccagccauccuuccuuccauuucuccuccaacccauccucccaucuguccauccucccauccauccacccuccuacccacuguucucccauccauccauugucccacucauccucccauccauccauccucccauuucuccucccauccauccauccucccauccauccguccucucauccaugcuuccauccauccauccucccacccucccauccacccauccacccauccucccauccucccauccauccauccucccauccacccauccucccauccguccauccucccacccacccccccauccguccauccucccauccauucucccauccauccucucaccauccuccgauccauccauccuuccuuccauuucuccuccaacccauccucccauccguccauccucccauccauccacccuccuacccacuguucucccauccauccauugucucacucauccucccauccauccauccucccauccacccauccucccauccauccauccucccauccacccauccucccauccauccauccuccccucucuccucccaugcauccuccuauccauuuuuccugccaucaguccucucauccauccugccagccauccuccuacccaucucccaucucuucuuccaacuccacacuccuauccuuccuccaauccucuuuccccacucccuucuuuccuuuccuuccauagaguauuccuugagcuucuuuucugguccagaccuauuuauacauaacaaugaacaacaagacagucacaguucucucagagggaggcagauaagaaagguacuuggucucccauuuccuuucuguggaugaaaccucacccaaagucauaacauauaaagccgguaacccccagaugcccagugccccaaagaguccgauuuguaaaccacagaucuagucagacucucccauuguuuugauuuuacaaaugggcucagugguugggugaugggaggggagaugggccgucacacuccgguugauggugcagucuacaucagaacucagcucuccugcugguuccccagccccagggagaugucugggccccugacacuccucuuccagccaucugacucguagucacccaccuuuccuuggcaggaagcggagaaggcaaagccggaugcccugcacggccugcgggugcacuccuggguccuugugcuaucggggaagcgcgaggugccugagaacuucuucaucgacccauucacaggacauagcuacagcacccaggaugagcacuuccugggcaucgaaagccuguggaaccacaagaacuacuggaucaacaugcaggauugcuggaacugcugcaaggugccuagggagggggagcuggguggguguggcaggcacagugcaggugauaggaauagagggaagcaauggcagccagaccuuggggagagcgagacaccaggccacgagggcuuugaaccuucuccauagcugcgucuccauggcccacucccuugcccaugaauaaccauucugauacgauuauugucucuccugauuuguguauccuucuaaaguguggauuguuugaaugcauuuuuuaaaaacucuauauugaaguguaaccuacaugcagaaaaguacacucaucccaugcauacauacaguucagugaaaucccacaaauuuaacacaccuugguuuccuacacccagaccaagaaauagaauauugcccaaaccccacaaagucccuuugcacaauuacuaucuuccuccaaauguauuuuuaacucacguauguggcacugguacacacacgcgccuacaagaggguacagaggaggucacaauccuaaguguacauaccauugaauuaucacacacugaacacaccuguguagccaggaccauuagaagcccccucaugucuccuccuggccaccaacccuaccaucguccccagaguuaagcacuaucuugacuucuaacgacauccauuaguuucaucuguuuuuggaguuuacaucaguugaaucacacagugauucaauacucuuacucuuggauuccuucacucauuauguuuaugaaauucauugugguuuuuugugugguuuguucauuuucauuuuuuauuacuuuccauuauuugaauacaccagaacuuauuuguccuuucuacaguugcacauugagacuguguccaguuugggacuauuuugaauaaugccgccaugaauauuuguauacauauauuucagugaacacauacacacauuucuguuggguaacuacugagggguggaaucgcugagucacagggugggcacauacucaguuuuaguagauacugcccgauuucucaagugauugcauccauuuacacucccaccagcaauguaugaggguucucagagcuccauccacauccuugccaauacuggauacuuucuuuuccauuuuagcuauuguaguggacauguaaugguauugcacugugguuuuauuuaaugcaauugauuuuuggcugagugugggggcucacaccuguaaucccagcacuuugggaggcugaggaggguggaucauuugaagucaggaauucaagaccagccuggccaacauggugaaaccccgucucuacuaaaaauacaaaaaauagccaagugugguggugggcaccuguaaucccagcuacuugggaggcugaggcagaagaauugcuugaaucugggaggcggagguuguagugagccuauauugcgucacugcacuccagccugggcgacaaagcaagacucugucucaaaaaaaaaaaaaaaaagcaauugcuuuuugcaaacuguucacauauccaguaaguuuuaaaccugcuuauucauuuuaaaaauuaaucuguaaagacuuugggguuuucugcauauacaaucaguucuauagcugaaugauggccguuuuguuucuucauuuuuaauccuuauacuuuuucauuucuuuuucuuguuuuauuucucugguuaguacauccaguauaaugucaaauugaaguggggauucugaacauccuugucucaguccugauucacaaguaacgccuuaguaucauaacauuucacuauuugugugauguuuaucuugacuguaggguuuuuauagcuagcuacccuuuauuuaacuaagggauuucuuucucaguucacuagcagguuuuuuuuuaaucaaacaaaauuuguuuauaucaaauguuuuuuucaucuauuaaaugaucauaauuuuuucuucuauuaagugguaaauuagacugauuguguuccccccuuuuuaaaauugagguguaauugacauaacauaaauccacuaaagugcacaaguuaguggcuuuuaguauauuuacaagauugugcaacuaucaccacuaucuaauuccagaauuuuuucaucaccccaaaagaagauuuuuauuuuugagacagggucuuccuuuguugaccaggcuggagugcagugaugcaaucacggcucacugcaaccucuggacucaagcaauucuuccaccucagccucccgaguagcugggacuacagacugcaggcaugugccacuaugcccagcuaauuuuuguauuuuuuauagagacaaaaaauggguuuugcaauguugcccagguuggucucaagcaagccacccaccuuggccuccaaaagugcugggauuacaggcuugaaccacugucccgggccccaaaaagaagauugugguugagauuauacuggauccauagaucaauugagagagaaccguuuucuuaacaauauugaauuuuucacccaugaaccaugguaucucucuucaguuauuuaagucuuuuaaaauuucuaucagcaacauuuuguagguuucaguguacaguucuugcacaucuuuugucagauuuauuccuaaauauuucgcuuuuugaugcuaugauuuuuuuaaauuucaccuucugacuauucuuuguuagugaauagaaaugcaguugauuuuuacauauugaucuucuauccugaaaucuucccaaauucacuuauuugcccuaauagccuuugcguggauuccaucaauguuuauacagauaauuauguuaucugugaauaaaaacaguuuuacuucuuuucccaucuggaugcuuuucuucccuuaucacacuggcuggaaucaucaguaaauguuaaacagaagugaugaaagcaaaccuguuuauuccugaucuuacggagagcauuuagucugauaccauuaaguauaguauuagccacagguuucucuuauugguucccauuaucaaauaaaggaaguuuuucuccaguccuaguuugcugagaguuuuuucagaaauagaugcuagauuuuugucaaauacuuuuucugagucuauugagauuauuaugauuuuucuuuuuuaguuuaucuacaugguaaguuacuuggauugauuuugaauguuagacuaaccaugguuuuccugggauaaaccucauuucauugugaugguuaaaucuuuuauauauuauugguguugaacugaaaauuuugcuuagaauuucuguaucuuuguugaagagagauauuguucuguaguuuucuuagaauauauuugccagguuuugguaucacaguaaugcuggccucauggaaugaguugggaaguuucccuuuucuucaguuuucuggaugaguuucuguagaauuggcaugauuuccuuuguacguuugcuggacuucacaagugaagccaucuggggcuggaauuuucuuuguggaaggauuuuaagguacaaauucaauaggaagacucaagcuguuuuugagugagguuugguguuuguaucuuucaagaaauuuguccauuucauuuguuuucaaauuuauuguuaugaaaguguucaaaauagcuccuuauuuuccuucuaauauguuaaagucuuuagugacauuaccccauucauucuuaauauugguaguuuguguguucucucuuuugcuccugaucaaucugguuagagguuuaucaauuuuguugcucuugaugcaggggcaggccccaaaaucagggcuuugccagugaggauucguggcuuuuuccaggaaagaauucaagggcaagcuggugguguuagaggcaacuuuacuugaaguggcagcguacggcagcagcagauggacugcuccuuguggagcagggcuaccccauaggcagugugcccagauuguaaccacccaagggguucaccuugccagcugccuagacagagcugauucaagacuggggaauugcaauagagaaagaguaauucacgcagagcaggcuguguaggagaccagaguuuuguuauuacucaaaucagucucccagagcauucgugcauucagggagcagaguuuuuagggacaacuugguggguugggggaugccagggaaccaggagugcugauuggucagagaugaaaucacagaaagucaaagcugucuucuugcaccaagucgguuccuggguggggcucacaagaucagaugagccaguuuauccaucugguggugccaucugauccaucaaguguagggccugcaaaauaucucaagcacugaucuuaggagcaguuuagggagggucagaaucuuguagccuccagcugcaugacuccuaaaccauaauuucuaaucuuguagcuaaucuagucccuaagcaagaaggaggucugcuuugggaaagggcuguuauugccuuuguuuuaaacuauaauaaacuaaguuucucccaaaguuaguucagccuucaccuaggaaugaacaaggacagcuuggagguuagaagcaagauggagucgauugagaucucuuucagugucuuagucauaauugugcaaaggcgguuucaagaguagcggcucagaggcaguuccacagucacauuuauauccacuuuaaucauaugcaaauuaaggggcagauuaugcagaaauuucuagaaauagagugguaaccucugguucacuuugucauugccauggaaagguguaauuucuggguguugccuuggccccguuuuagcuaguccucaauuugguccagugucugagcccccagcuuggaagucaagucccaccuucuggucaguaagucccaccuuauugucaauaaaccaguuuuugguuuugugguuuuucuccguuguuuuuguuuucuaucucauugauguccacucugaucuuuauuauuuuauacuuuaugcuuacuuugagcuucauuuacuuuuuucuaguuucuuaagguggaagcugagaugauucaucuaagacuguuuuuuguuuuguuuuuuuuuugagacagaguuucgcucuuguugcccaggcuggagugcaauggcgcgaucuucacucacugcaaucuccaccuccuggguucaagcgauucuccuggcucagccuccugaguagcugagauuacaggcaugcaccacgcccagcuaagccuguucuuuucuaacauaagccuucuuucucucggaaguacuacuuuagugacaucccacacauuuuacucuaucauguauucauuuucuuuccauucaauaugcucuccaauuucccuuuuaauuucuccuuuaauucaugggccauuugaaaauguguuuaguuuacagauauuuagaaacucucuagagauauuucuauuguugauuucuaauuuaauucuguagugauuagagaauauaacuugguaugacuucuauuauuuuacacuugcuauaguuuguuuuauggaccauaauauggucugucuaggaaauucaccaaauucuuaauauagugaauuuucuguguguacuugacaagaauguguauuuugcuguuggguggaauguucuauaaaugucaauaaucucaaguugauugguaguguuauucaaaucuuauauaucuuugcugauuuucugccuacauuucuuucaauuauugacaacauuauugaaauguugggcuacaauuuuggauuucucuauuucuucuuucaguucuaucaguauuugcuucauguauuuugaagcccugcuauuagaugaguaaauguuugagauuguuauguccucaugaugaauuaaccucucuaucgguaugaaauaaucagcuuuaucccuaguaauauuuuucauucugaugucuauuuugucugauauuaauauagccacuggagcuuugauuuguauuagcauugguuauccucuuugcagaacugugaguccauuaaaccucuuuuucuuugcaaauuacccagucucggguaugucuaucagugcucuuucguugucucgaaggcacucuguuucugaccaggccaguuucccuugggcccuuuuuaaggugacccugaggaacggcucgcucauuuguuugguggcuuggacugucuguccaucugcauggcggacguagccagucugcugcuccugaacucccgucucaccauccugucccagcugcccucaugguguaugagccucuuccugcaacaacaggucagaauacuuuggggcagcaaguaggucagcuaccuggucccuuuaguuacacucaguacauugccagcauugaugggaggugcagguuguucacaggcuuaacaccaaaacugccugggaguccauggucaaguuuugcaguagucaggaccuggaaauguacagaaagcugucucaucuuccuuugaccgaguuaucauggagauaacucaagugauaaucacucguucuguugcuaccgccaucacacaucccuucugcaugauuacugagauuugugguacaauucacugacagagaguccaaguacugugaacuuugugacuccauaguaaccaucuauugagaagaaggcauccuaggauuucucaugugucuuauuccucaccuccuaggcaacaucauuucuuuauggcucuguaacucacuggccuaccucaucaauaccuaugcacucugguggggcauggcggcuuacgccuguaauccugauacuuugggaggaugaggugagaggaucgcuugagcucaggaguuugagacaagccugggcaacaaagugagaccucgucucuauaaaaaaaaauucaaaaaaauuagccaggcaugauggcaugcaccuguagucccagcuacuagggaggcugaggugggacgauugcuugagcccgggaggucaagggugcaguaagccaugauugugccacugcacuccagccugggcaacagagagagagagucucucucucucugucacacacacacacacauacauaugcacuggacagugagguuucuaucgggaaugaaaugaagaguaugaagaguuauucucaagaugucacagcacuguuugccaguauguugaccuaucccuuugugcuugucucuaaucuuauggcugucaacagccaugggcuugcugguggacccccuucuuccuucccaguauauacuacuugcauacauugcuggugcaugcuacaaaaagagggaaauaugagccgaggaaauagcuuguuuuucccaaagcaucccuuugggaagacuuguugugaccugagaaugcuaauuugaagauguagggcaggacagugacauuucuauagucccagaugcaccaaauuaugggagacaauguugauuucuauauaguuuuccacacuuuuauuuuauuuuauuuuugagacagacucuugcucugucacccaggcuggagugcaguggcgcgaucuuggcacacugcaauccccgccucccggguucaagugaucuucucaccucagccuccugaguagcugggauuacaggcaugcacuaccacaaguggcuaauuuuuuuguauuuuuaguagagacaggguuucaccauuuuggccaggcuggucuugaacuccugaccucaagugaucugcccaccuuggccucccaaaguguugggauuacaggcaugagccacuguaccugaugaccugcuuuuuuaauggucauuuagucuuggggaaugaauaaauaaguaaauaagugucagaggggcgacugccagccccugcgggagacaggcagacuugaugcaugauugcuuugccgguugcucugucuuugugaagaagucagaagcucugagaugagaaacuucugccuucagcaaaggagaugccucucaucacucugccucccuuaggcacugauuccaggguugugggaaguaacacucaguagaugcuuagaauagucucuagcuguucaauaaauguuaacuauuguugcucccaucuuacagguaaggaaacugaggccaaguaaagugagaucauuucucccacgccacacagagggggcagagccgacacugcccucccccagggccugggcucauaagcaccaugguggucgguguccucugaaggauaacagcccuucagaggaugcuacaguccuucagccccucuuccagccugaauguccucaucucauccaucaggcuccgaggugaagguggaagugaggccagaggggcagugcugugccaagugagggcaugaggaagagaugauggcauaggcugucacuuuuaccagcacacgaacauuggagcagcugcuuuguuucuucaaagaaccuugaaauagcgagggguuggaggaggauggcaaggcauccacagagugacugccuggcgcaaacguacccugggcacauggauguggcuguuguccauucaauuaugcuuuuucuaaagaaauagaacuuaaguuaaaguaacaaagcauaauaucuaacuacugcuuacacugguuuacaaaaguaacaaaauuuaggccaagagugcgaauagguuggccgggcacaguggcucacgccuuuaaucccaggacuuugagaggccgagguagguggaucacuugaggccaggaguucaagaccagccuggccaacauggugaaacccuaucucuacuaaaaauacacaaauuagcugggugugguggcgggcaccuguaaucccagcuacucaggaggcugaggcaugagaaucgcuugaacccaggaggcagagguugcagugagccgagaucaugccacugcacuccagccugggcaacagagcaagacuccaucugaaaaaaaaaaaaaaagagugaaaaaaggcaaauaucuauacaauuggguuccuauccacuaagcccauuaagcuuugccacagucgcugugacaucuaccagcaguucucuccccaacucuccucugcugugccccccacuucucuccccuccacccacgagcuagggcagagaaauacucaggagcccucccaggacccacacaugacagugaguacuaggcuuagaguuggcuucaggacagcuuaauauuaacaccccuccaggcagcuguucugcagccucugauuuccucuggaacaugauuuaggguggggagaacaccuugcucuaggaagguugauuagaaugugaggugcuccccaccuucuaggaauuaucugacagaugagccacuuuuauugaggggacugaggacucaggugggcugggugaaaagaggucaggaguuugagaccagccugaccaacauggugaaacccugucucuacuaaaaaugcaaaaauuagcugggcugugguggcgagcacuuguagucccagcuacucaggagacugagguaggagaaucacuugaaccggggagauagagguugcagugagccgagaucauaccacugcacuccagccugggcaacagagggagacccugucucaaaaaaaaaaagaaaagaaaaauaaaagaagguggcagacacacuccauggaggagaaauucccacccaccugcuguuuuuuuuuuuuuuuuggagagacagggucuuacucugucucccaggcuggaguacagugguguguucacagcucgcugcagccucaacuuccuggaaucaagugauccuccugccucagccucccaaguagucagaacuacaggugcauaacaccaugcacuggcuuaaaaaaaaaaaaaaaggccaggcacggugccucaugccuguaaucccaguacuuugggaggccaaggcaggcguaucacuugaggucaggaguucgaaaccagccuggccaaaauggugaaaccccaucucuacuaaaaauauaaaaaugagccaggcaugguggcaugugccuguaaucccagcuacucaggaggcugaggcaggaaaaucgcuugaaccugggaggcagagguugcagugagccgagaucacgccacugcacuccagccugggcgacagagugagacucugucucaaaaaaaaaaaagaaaagaaauuguggagaugggaucucccuuugcuacccaggcuggucuugaacuccugggcucaagugauccuucuguguuggccucccaaagugcuggaacuacaggcaugagccaccaugcccggcucuccaccugcaucuuauguauaacuuccacgugugccugccuauuucccuuguuccuggcauggguaaaauaaacaggaggaagccuuuuuaaaaaaccuuccacuuccugggaguugcuagacccuucugccaucaaaucuugcugguuuguuuucauuggcucuaagcacugcccagccgaugcggaaagaccugcacauccaggucuagcccaggccagagagccuccuugucuuucacagaggucaacacgagauuuccucacagggaggcugaaugaugggcagggaguucugcucccccucggggccucaguuucccuguugggaugaggagugugggcauggacucucagagccaccugggacugacguucugcuuccccaagcccugggcccaggucccuucucugccccggaguagccaucucccaacuccccauggaucagguggggacgugguggcugugggguacacucaguugacugcccucauccccaacaggacuugaucuuugaccugggugacccugugagaugggaguacaugcuccuggggacugauaagucucagcuguccuugacugaagaagacgacagugggauaaacgaugaggaugauguggaaaaucuggugagucucagcagcucgagagcccagggaaugugugugaaggcuucagggagccugacaaguguccccagcagcauauguguggcagugggggauggcccaaguagaccagugauggguuccucaaagcaggaaggcuugagcaauucccuuauuuuacagaugggcacauugaggcccagaaaggccagaaaccuacccaggaccucccaguggguuacggaagggacaggacuugacgucaggucuucugccccccauaucguccaccuuguucaggaguugcccugcuccuuuggaaagcaugucccuugccagccugggcaacauagugggacccugucucuacaagaaaauuuaaaaauuagcuggcugugguggcaugcaccuguugucccagcuacuugggaggcugaggcaggaggaucacuugagacugggaggccgaagcugcagugagccauguucaugccacugcauuccagccugcgcaaccccaccccaccacaaaaaauaaaaauaaaaauaaauuuagaaaaagaaaguugcagagcggggucauaacaccccgcucugcaacccccugggagucccagagcuggcuguucucaguucuaucccaaguagccaucaugagccccacaugcugccaggccuuucuugucuguucugucaguuccucugaaugucguuggccagggccuuacccacaucaccagccucccuucucugaauucaguuucagccuuuaugugaaauggaggcagaaggaucauaguuguauucauaguaauucuaauaagugcauucgucuggcaucacaaagcaccacagaugcgguugcuuaaaugacagaaauuaauuuucuuacaguucuggaggcuggaagucugagaucaagguguggacaggguugguuccuucugagcccccuguccucggcuuguagauggcugucuucucccugucuucacauugucuucccucuguacaaaucuauguccuaaucuguucuuauaaggacaccagucauuuuucuuuuuauuuuuuuuugagacagggucuccucuguugcccaggcuggagugcaguggcacgaucauagcucacugcagccucgaacuccugggcucaaaugauccuuccacuuuggccucuggaguagcugggacuacagacacacaccaccauacccagcuaauuuuuguuuuucagagagacauggucuugcuauguuaccuaggcuggucucgaacuccugggcucaagagauccccuugccuuggccucccaaaguguugguauuacaggcaugagccaccaugcccaaccaacaccagucauauuggguuagggcccacucuaaugaacucauuuuaccuuaaucaccucucuaaagacccugucucuaaaaacaaucauucaaacaguaagugaucaagacaacaacaacaacaaagaaaaaauaagaaaaauaaauaaaacaaauacagucacuuucagggcuuaaaacuucaaccuaugaauuuuagggggaugccauucagcccguagcaaaagguagcacucacaugguccuuacuaagcacugggauccauuguaucuacuuaaccugaaguaacucauuuaaauccccacagccaccuggugaggugggcacugguauuaccaccugugauuaauauuaucccauuuuaccgaugggaagacucacacacagagagguuaagucacuuacccaaagcgauacagcugguaagugacagagcugggauuugaaccuacacagucuggcuccacagucuggguucucaaugguaacucuguucuaccuccuggggcugcuugaugugaugugcuuggcacagcaguguagaccaucucaaaagggugcuaaauguucucagcauccucaucuccagagacuggggacaucuugugugcaguaaauccaggcauaggugcccccugcuggccuuggggcauggaccagccagggccugagagcccagcccugcaggcagccggcugagcacccacauggcuaauaaucaaacaguuccagucacagaguccugguccacccuggcccaagagcccucauuacagcaaagacggacagagggcagcccaaagagucagaacccagucauggacccccaggaaaaaccagaccccgggugacagcccacccaccugaccaucuuagagauuuuugacaauacuaacugcugacugcucacucauuuuuguccccugcaaaaugucacaauuagauaaacaguugucagagguaugagcaauguuuguggaaaaaagguuuuaagucgagaaagucuuauccaaguuucugugauuaucuaguuugaggaccauuuaucuagaucgggccuuauuucacaaauggggaaauuaaggcucagagaggaaauaauaauaggccgggcaugguggcucaugccuguaaucccagcacuaugggaggccaaggugggcauaucauuugaggucaggaguucaagaccagccugggcaacacggugagacaccacccuccucccccggccgucucuacuaaaaauacaaaaaucaacugggugugguaggugcaugccuguaaucccagcuacucaggaggcugaggcaggagaaucacuugaaccugggagacggagguuucagugagccaagauucacugcacuccagccugggcaacagaacaagacuccaucucaaaugauaauaauaauaauaaugucagccaaucagagccccaaggccuuuacagacauuauaucauuuaauccuccuaaaagguccaguuuacaguuaagaaaacuaaggcuuagagcaguuaaaggacuugcccaggaccccuuagcuggucuuggagagaggguggggcuuggguacccugacuccagaaacaccucucuaaucacgaagggccugcagccagggcagggggugcugcuguccuaagccaggcaaguauagggaagggcucccugcccagagucgacuccuccuuuuccacaucaugggucgugcucaugaccuccaguuccccugcggaagccaacggaccaccuuggcuuggcucugcaggcagagacagagcuuugaccauaacuucugcuucaacacccugaccagcaccaccucccccacccccuucucucccaucagggcaaggaggaugaggauaagagcuucgacaugccccacucguggguggagcagauugagaucuccccggaagguauuuucuauuuguguauucacuuauccucuccagauccaguuccugggccuccagagaggucugcaacagcgaggcagggggacacagcagggaaugccaugccccacauuuccacccuucucaccuucagcugcacccucccucccucccuccccccuuccugccacacgcacucagcucugaccccgagggccugacgaccagucuggcacacggggcgaugcaguucagugagcaugugugggaugauggcguguaggugacagcaaggccuggaaacccagcccauuccccucucacacucuucuacccagaggaggccaugggcagugcccagauggugcggggggucucaggaccggagaggggcagguagagaaggcaggagggcagggacugucaugcuccaugucaauaucugcuggugcccaccuagggagcacccagaccuauggggagggcaugggccacuucaacagggugggaagugccagagaggcugucaugggaacccagaggggggcgcacccagcccagcacuggggcuagggccuggggaugggugagcagaaagggguaccagaaguaggcuaggggucaccugggugaaguuuggaaggaucugaaggagucaguccaacaaggggaggaggggaugacgguguuucuggcagagaccuguacaagcaaaggccuggcaaugugagagugugguuggcugcagggcagacccucugauggggcucaaaucccauucuuggguggaucugugcuucugccuggccugagaaccccucuagggcuggagccaccccuggugauuauucuccucggccucccuggaucaggcuuggggcuggaggaguucaguacacagagaacgggcaguggauggaugaauggcugggcggggcuggcccucccuucccccaaacuagcaagaagagaccacagcugacuguguccacagcauuugagacccgcugcccgaacgggaagaaggugauucaguacaagagggcaaagcuggagaagugggccccguaccucaauagcaauggccuugugagccgccucaccaccuaugaggacuugcaguguaagggggauugcucuggacauggguccaggccagcccaggggcgggggcggcuucuacucucucuggggucauugcuggccucugugugccuggaauaagggggguugaaggcuaggggagcuggccuggcugcggcaaguguccaucggccccacagguaccaauauuuuggagauaaaggagugguaccagaaccgggaagacaugcuggagcugaaacacauaaacaagaccacagaccugaagacagacuacuucaagccuggccacccccaggcucugcgcggugcguggcuccccuuuccugggccacccaggagccugggguagaggccucacacacccuguggcaggugguaugugguggcaggaaccagcauacauauuauacauggguucuugggcagcaagcaguagaagcugcccugccucccucagcaaacccgaugugugggaggucagggaaagcucagaaauucuaaggaaauauaacaaaugcuccuccaggaaagcuaaagggggcgccacauacccguucugugguuggaaucaggccggaaccucaccauggggucacacgguggaggccacauuuaaaggaggcagugccggacacaggggcucacaccuguaauccaagcgcuuugggaggccaacaugggcaguugagcccagggguucaagaccagccugggcuauauggugaaaccccaucucuacaaaaaauauaaaaauuagccaggcaugguggcaugugcuuguaaucccagcuacucaggagacuaaggcaggagaaucacuugaacccaggaggucgaggcugcagugagccgagauuaugccacugcacuccagccugggugacagauagagauccugucucaagaaaaaaaaaaaaauccugaccaagaaauuuacaaaagaaaagcauaggaguaauauacauuuuuuuuaaaugaucaaccucauuuggaaguugauaauaaaaaaaaagaaacuaauaaggucccuaaccaauaaaggaccaucuuauaacccccauguuggcaaagaugaaaaaaaugguccuacuggguaugaacaaguaugggagcaacagucacucugugucacuguugaugggacagcagauuggaacuuuucuggaggacaguugggcaaaauauugauaaugaccauaaaacguguacgcuuuuggcugggcacaguggcgcacaccuauaaucacagcacuuuggguggaucaccugaggucaggaguuugagaccagccuggccaacauggugaaaccccguuucuacuaaaaauacaaaaauuagccaggugugguggcaggugccuguagucccaguuacuugggaggcugagacaggagagucacuugaacccagguggcggagacugcggugagcugagaucacaccacugcacuccagccugggugacagagcgaggcugugucucaaaaaaaaaaaaaaaaaaaaaguacacuuuugggcccagcaauuccacugcugagaauuuauucuuagcaaauaauggacaagaacaaaaaaugcacgaugcagauguucaucaugguguugguaauaaucagaaaaaguuguacgcaaccuaaacacccagcaauaggggacugguucauagcuaaccucauccauaaugugggucugucuucucccugggccugggguugggcgaccaagccagcagccauacuuccuagugcuuaugaagcugucuccucccaacucccgcuccccacccagugcacucguacaaguccaugcaaccugagauggaccgugucauugaguuuuaugaaacggcccguguggauggccugaugaagcgggaggagacacccaggacaaugacagaguacuaucaaggacgcccagacuuccucuccuaccgccaugccagcuucggaccccgagucaagaagcucacucugagcagugcagagucaaacccccggcccauugugguaagagcucgcgggggcuggggacaggucgcccuccuucucuggcagcugaugucaccucugaauggugagagcccuggcucugggguggcauuaaggccugagacauauccaagggcaccaaugaugaaccaagcauuuuaccaaauguauuagucuguucucaugcugcuuugaagaaauaccugagacuggguaauuuauaaagaaaagaaguuuccuugacucacaguucugcauggcuggggagcccuuaggaaacuuaaaaucauggcagaaggguccuuuucaccuucugccuagugaaaaggguccuuuccaccuucugccuagugaaaaggguccuuuucacuagaaucagggcagcaggagagagaauaagugcugagcaaaggggaagcugcuuauaaaaccaucagaucgugggagaacucacucacuaucacgagaauagcaugggggaaaccaccuccaugauucaauuaucuccaccuggucccgcccuugaccuauggggauuacaguucaaggugagauuuugguggggggacacgaaacuaaaccauaucaccaaaugcgccauccugggguugucuggugucagacugugcccucagccauggggccaaggauguguuacuuccuuauuguuauacaaaaauacacacucaugacuaaacauuuggaaaauauguaaaaauguagagaaaaguaaacauaucucagaauggcaucucucauauguugccacggauuauagguuugguuuugagaguuuuuucuaauguaauugagaucgggacccagggauuagagucccuguauuacccacuuaacaugaaauugugcauuuuccccuucaugucauuacaaauuaguuggcaacuguguguaauggcagcaugccaaagaagcucuuucuagcaguaagggaugucuagcaauggaguaggcugccuggagagguggugagcuccccaucucuugagguaggcaagcagagucuugaaggagcugaggaggggcccagcaccauaugggaguggaguggccuggcccugagaacccacgaaauccauugucuggcuaggaggggcuauuccacgugaaucgccaaacgaccccagacuccaguguccugaacguucguugcuccugccugcgggcaugcacagaaaucuccucucacacgcucauccuuugcucauccuuugcauguucuggccucccagaaaaucacagagcgguucuuccgcaacccagcgaagcccgcggaggaggacguggcagagcgcguguuucuggucgcggaggagcgcauccagcugcgcuaccacugccgugaggaccacaucacggccuccaagcgcgaguuccugcggcgcaccgagguggacagcaaaggcaacaagaucaucaugacgcccgacaugugcaucagcuucgaggugggccugggggccacggcgggcaggggucggcugcaggaggaaccggggcucucugucuuauuccagccacuugggagaaccaggaugggcgcuggugaaucccggcgaggaaauucaucuuugcucuuugggaaaaccaaaaguucccaucuggggacccuucucuuugagcuccucugaaaaucuuccuuuuccaccaaaaaagcgaacucagcaggcuaagacgacucugcaguccuggucagggcaaaccucagauccuagggaggcucugugggaggggaagagucucacuaccucugaggggcuagcuuuccuagucaaacgcucacucucccggcacaguccccagcuuuucugagucuucaguuccucuuuuauuauuaucuguauuuuuauaagugagaaaauuaaggcucagagagguuuagcaacuugcucgaggucacacagcuggaaaguggcagggguagauuugaacccaggugguccuaugccccgaucauggcagccucucuguguuacuaaggugguuguugucccagguggagcccauggagcacaccaagaagcugcucuaccaguacgaggccaugaugcaccugaagagggaggagaagcuguccagacaucaggucugggagucagagcuggagguaggguccugugggagagugagcaggugggcgguaucuuuguuuuugagauagggucucgcucuauaacccaggcuggaaugcaguggcgcaauuauggcucuacaucccgggcucaggugguccucccaccucauccucccagguaacugggaccacuagcgcacaccaccaugccuggcuaauuucuuguuuuuguuuuuguuuuuuaacagaugggguuuuuccauuuugcccaggcuggucucaaacuccugaauucaugcaaucugcccuccuuggcuucccaaagugcugggguuacaggaguggaggaggggugucuccaucacgcccuccaacacuucucauuucaggugcuggagauucugaagcuucgagaggaagaggaggcggcgcacacacugaccaucuccaucuaugacaccaagcggaaugagaagagcaaggaauaucgggaggccauggucagucccaaucccuucuccaggccccagcuuuuccuagaccccccuggucuccagggugguggggaccaugagggauucugcugagaaacccucugugggggauacgguuauugauaccaugcggucauccuugcugcugaacugaccauuucuaugguucaucccaaagaguacuugggauuugggcaagguuuccccccauccccaggggcuguagccaagccaaggccugugguugggaaaagaauuaaaauuaugugcccaccucuacucagggcucccacugagguugcacccugggccaguggccccagugagcuaccucuggcuccaggccugagcucuccugcucuccagcacagggagggcauucagguuacaccuucagguugcaaggccccgccugguuuucagggccggcuucugaaucccuuucaccaaccaaguugagauuuuaguuugggggucgugaggcaggaugggcaucagaugacuguucucagaucccaggggagggugucagcccccacgucuccaacuucacugcccccugucugcagauggaggacacaggccccaggguggaaaagaaaagugaagggaguuacuggcaguuuuuaacuaacaucguuaauaaccacuaccguugacugaauaagcaucuacuauggauugucaggcaucaggcugcgugcuuuacagacaugauccugucagauccucagauccucagagaaggaaaccaaagcucagguagugagauacaaauucauguaagaaaaaaagaguuggcugucaccaguaaacacagguccagagaccagcaugugggcccuucuaaggcccaucuuggaggcgccaugcacuggaaccuggcugugaggucuggcuuugugcuggcacacugcugaugcagagcugguggagaggucucuguaguuccugcugauccagcuaucugccccucaccuuuacaggagcgcaugaugcacgaagagcaccugcggcagguggagacccagcuggacuaccuggccccauuccuggcccagcucccgccaggagagaaacuaacaugcuggcaggcggugcgccucaaggaugagugccucagcgacuucaagcagcggcucaucaacaaggccaaccucauccaggcccgcuuugagaaggugccaccagggccuuuguuggggagggggggaucucagcaucugcauccaggaaaugggcccacggcuguccgcccacuaccucacaggcuugugagggccugaugacgggaugaauaugucaaugcuugggguuuccaaaugacugaguuguuccuccucacacuuguuuaucggauagaugaaucgauagggggauggauggauguagguauggauagguggguggguggguggguggauggauggauggauagauggguggaugaaugcauggguagauggaugaauagauagauggguggguggauugauggguagauagagggaugggugggugcaugaacagauggguggguggauggguggauaaauggauggauagauggaugggaggaugaauggaugggugaguagauagauagguguauggguauagguauggauagguggguggauggaugggugggugggugagugagugaguggauggaugaguggguagguggauggaugaguggguggauggaugaguggguggguagauggaugaauggauggauggguggauggaugaauggaugaguggguggguagauggaugaauggauggauggguggauggaugaauggaugaguggguggguggguggauagaugaguggguggguagaugggugaauggauggauggguggauggaugaauggaugagugaguggguggauggauggaugaguggguggauggauggauggguggaugagugagugagugagugggcagauggaugaaugggugaguggauggaugagugggcggguggauggaugaauggauggauggguggauagauggauggauggguggguggaugagugaguggguggguggauggaugaguggguggguggauggaugaguggguggguggauggauggauggaugggugagugaguggguggguggauggaugaguggguggguggauggaugaguggguggguggauggauggaugggugagugaguggguggguggauggaugaguggguggaugggguggguggguggauggaugaauggauggguggguggguggauggauggauggauggauggaugauggauggaugggugaguggguggguggaugagugagugagcagguggguggauggaugaguggguggguggguggauggguggauggauggaugagugaguagguggguggauggacgaguggguggguggauggacgaauggauggauggguggauggauggauggaugaauggauggguggaugagugagugaguagguggguggauggaugaguggguggguggauggguggguggguggauggauggauggaugggcgaguggauagauggacgguuggaugggcgaguggauagauggacaguuggauggaugaguggaaggacggauggacggauggauggauggauggaugauggauggaugggugaguggguggguggaugagugagugagcggguggguggauggaugaguggguggguggguggauggauggauggauggaugaguagguggguggauggaagagugggugaguggauggaugaauggauggauggguggauggauggauggaugaauggauggguggaugagugagugaguagguggguggauggaugaguggguggguggauggguggguggguggauggauggauggauggaugggcgaguggauagauggacgguuggaugggcgaguggauagauggacgguuggauggaugaguggaaggacggauggacggauggaugggcagggauggguggagggaugggcagaggaauagaugggcagauggcuggguagacagagagaugguacacuguaacaacuccuaguccuugacccauuuuuguuggucaggcacacaccauguaguucccgugcacuacuaagauuaugucacuuaaucuucacaaggagcucuacaaggggaggggggaguacaaugacccuccuuuuguagacaagaaauugcagguucugaaaaugccaguaacuuguccagagcuacauggcucucucagucuugccccguucugaucucauggacaugacaucccuauaaacaugaccccacuggcucccacccaagauauuuuguggccccugccucuguggcagguauggauagguggcuugugugaguggggacacuggggccaaccgucauggugcugucuagugacccaugggauugcagccugcagccugggugaaggucagccuugucaguccuccuucucugucugcccuaugaccacaggagacccaggagcugcaaaagaagcagcagugguaccaggagaaccaggugacgcugacacccgaggaugaagaccuguaccugaguuacugcucucaggccauguuccgcauccgcauccuggagcagcgccucaaucggugagcaggcagggcagguggagagaacccacugggaggcuggaccaccagcuuuguaaccccucacccucuuuccuugccucucugacuucagacacaaggaacuggccccacugaaguaccuggcucuggaggaaaagcucuacaaggacccacgccugggggagcuccagaaaauauucgcuugaugucccuccuggggccucagccagagcugccagagaaaggaaaccucuucccgcagccuggcuccuguguucccucuauccagccaaugccuguuuacacagacaccuggccucacugccagcccaccuccccuacagcccuguuuguuccugcuucucaugauuuuccuguaaauaaacacacucuuaauuugccauuugu

SEQ ID NO: 15745 - RNA, 15861 nt, Homo sapiens
cgcgcucccggggggcgggcucagaugggcggagggauucauuuuaagcaacgggcggcccuccgccuccauugaaggcggggaaauaccgcggcgcggacgguaguugcugugguuuccguucugagcucgcagcuuaggagcugaagaucgcggacuuagcguugccgcguccgaguccggccaucaguggcugcagauccggaggccaggagcucaaccacccuucuucggaacagggccggccugcugcugugcccucgacgcucggugccuguaucuacuccggggccuaggucggcuccgggggcggcuuaggagaaggccgccggcgagauguucaaaaacacguuccagagcggcuuccucuccauccucuacagcaucggcagcaagccucugcaaaucugggacaaaaaggucgggcuaggggcggcgacggggcgggguggaggggcugcacccccuccucguccgggggcuggggacggggaaugguugugucgaauuggggccugggagaggccgagaggacgcugcugugccuuguccccagccuggcgggacuggggcgcgaggugggggcgucguguaagcagcggaggagguggggggggggcggugcaugugggugggcguggcugagaucuaaguguccugcagcuguggugugguuaggaccgcgacccucgcugcugucuugacuuggucggucaguccauucuuuugagccacuguuuccccaccaauauaaugggguugauggugcccaucucguagcaugaaaugcacgaacuuauuugaaggagcuuuggggauguaaagaugaaaggaccugcuauucacgaauuccaaauauuuacugauauccguuuuugugccaggcacggugcugggcacuagacacagagccuuuguucaggcacccuuacagaggagcagacagaaagacuccggccaagccagugauguuuaaauugcauucauuugcucccuuccucccacugaucccaaauaagucagaauucaguggcccuuggcaccugcuccacacucacugugacuugccuguacuaugcccucggugccugauuucuccaucaggaaaacugcagaaugcugacagucaaagucuuguuuggauuaauaaacucagagccaaguacaggccucaucuuuauucaggcauccacuagaugauauguguuuggccccacgagaugaugaaucuguuuuuugcagaugugaagaaagaucuagcugucuaugaauuggucugcauuuuauuacuuugguauuucguucuucaugcaaauucccaggcaaucagcuguacuauuucuugaauauaaguuacgggaggcacuccaaugugaaauuuaagucauauucuuaguacugcucucugggagaauggcgaguguggguaugccgaaugcugcuuuuuagagagaugcauguggaauaaucucaguaggauuuauugguaaugaagccaagaauuuugaauuuuaucuuggaacacgucucuguauucccuuauccacacaugagagcucuuuaugagggccacauaaaguugggagagaacaugagcagcuuucugccugucaccacuagggaacucugcguucugagggcagcuuuuaggaugguguguccauaguguuacuuucauaagauaguugaaaaaucugaauauaaugaaguugggccuuuguguauguaaaaucugcccaucucuucucuuucagaugauucuauccacaagcuagagcuagugccagaguacaggaaagcaguuccuuaacguugcugcguuacugagguuuuuaguuucauguauuuuuucacaauggaauaaagcauuguaaacuguaaauugcaucuguacaaagagagcccagggugccugggaacuccguaaggagguuggcuucccagcugucacuugacucaguuaugggcugucagaaggcaugaagagaggggggcccucugugccaguggaauuuggaaacugaauuguaacaaagugucaguauaaggcaauugaaaucgagaaugggacuugaccuaggaggagagguuuucagagcagauagagaacuuacuaaagcugaaagaauuccaguaguagggaggccucagaauuucuguuacgaaacuuguaucaguuuuccauuuuaacccuucugggcuugaucuugugugcuguguuuuauuuuucaaaugaggcuuuuugaauagucaacauguuuacccaagaauauaaaagcauaguaaccauggugcacugugucccuuaacaacgccacuagaggucggaugguacccuaaugacauaaacacgugugaaaacauuguuaaaucgauuggcaugguuacuuggaguaaauuaaacagacauuuuggcaaaaccuuuagaacacucauuucaagcaaaaucuucacaacgguaaaagcuaauuuuguguuucuaacucuucuuauuuagacucaauugaaaaauauuuagaauugaggauuuuuccccucuuggggcaagggaaggaaagagaagaaaaaggaaaguuuggggccguaucccucagcuuugucgugugugcuuuuucucagcuaugucugcauaaagugcuggaaauucaauccaguagggggaacacugggaauugauguacuuaucaaagauuuauugagcgacagcuuagugacaggcuuuguguagacuugggaagauagagaaaauauuuuuccugcugccagggacuaaggcaaaguuguaauaaggacagaguuuguggggaggugaggacugucuacauuuagcuagacaugaccuugacuuuugccaguagguauauauugacugugguaccuauuuauaguuauuuuuauuucagaaaacuuuguuguuuucuuucaugaguauauauagagagaauuucuguucgguuucuaugaagaaucuugagaaauuugguuugacuuuuguuuaggcucugucugcauagaagugaacgcuguauucacaguaccagugaauuugcaagcuucccuuuugugaagauggcuuguucguuaguguuugucacaccggcaauuuauuugacucucugaagcucacagccccuccccuccaucucauccuuccaaucucaacuuaaacauucuuuucauugagaacuugaguuaagccucaugggugugccuguggcuggcaguuuucuauuguagaucguccacuggacugcagguuccuuaagcagaagaacaguaccuuaccgaaaaaccucaaugcuagggcguggucagacaccuuggauuugcauccuggcugugcuguguuccaguugugugaucuuagcuauguccuuaaccauucaguuuucucgucuauuucucacgguuaugaagauucaaugaagcuguauauaaaguccuuagcaacagaguuacaguauauguagucaugcaccacaugauggcguuucagucaacgacagaccuuacacaugacaguggugccauaagauuaucauggagcugaaaaauuccugucgcuuagugacauaauaguuguucguuaagucaaaugcauuacucguguuugugaguagguguaaaccaaccuacugcacugccagucauguaaaaguauagcauauacaaugauguucagugccuaacacuugaugauaaaugacuauguuacuggcuuauguauuuacuauacucuuuaucauuauuuuauuguauuuuauuuuucugagacaaggucuugcuguugcccaggcuggaaugcaguagugcaaucagggcucacugcagucuccaucuccugggcucaagcaauccucccaccucaaccucccaaguagcugggacuacaggcccucaccaccacaccucacuaauuuuuguauuuuuguagagacgggguuucuccauguugcccaggcuggucuugaauuccuaugcucaagcaguccuccugccucagccucccaaagugcuagaauuacaagcaugaguucccgugccuggccuuaucauaauuuuagaauguacuccuacuuaacaacaagaacaaaaaguuaacuguaaaauaaccuuaggcagguccuucaggagauauuucagaagaaggcaguguugucauaggagaugacagcgccaugugcguuauugcucuugcagaccuuccagugggacagcauguggagguggagacugugauugauguuaaugauccugacccugugcgggccugggcucauguguguguuugugucuuaguuuuuaacaaaaaaguuuaaaaaguuaaaaaaagaaauaggaaaaaccuuauggaauaaagauauauagaaagaaaauauuuuugugcaguugaacauuguguuuuaagcuaaguguuauuacaaaauagucuaaaaguuuuuaaaauuuuuaaaguuuauaaaguaaaaaaguuccaguaagccaagguuaauuuauuauugaugaaagaaaaauauuuuuaauaaauuuaguguagucuggccaggcacaguggcucaugccuguaaucccagcacuaacuaaauaacuaaagcacaguggcucaugccuguaaucccagcacuaacuaaauaacuaaauaaaauaaauguauuguagcauaaguguauuguguuuacaaaguguucaguaauguccuaggccuucacauucacucaccacucacucacugacucaacccagagcaacuuccaguccugcaugcuccacucauggccagugcccuauccaguugugucacuuuuuaucguuuauacaguacuguaccuuuucuauguuuagacacacaaauacguaccauuauguuacaguugccuacaguauucaguacaguaguaugcuguacagauuguagccuaggggcaauaggcuauaccauauggcccggguguguaggauguuguacugucuaagucuguguaaguacacucugauauucacacagccauggaacugccuaaugaggcauuucucagaacguaaucccauccuuaagcaaugcaugacuguaguuaguacuuuauaaguaaugacauacagaauuaaauauggcagggacugaggaauuugcucaaaacuaaaauaagauguuugaacuuagcccaccauccagauuucuaggaauaggaaguacuguaaaaccagacuccugaaaugagaagaauuuaguuguugcaccguggcucgcccagcccuaagcccuuaauguggcucuaaggccacauaacccaugcucuggcaccugcuucacuuguucuccaggcgggacucacuucacccgguucccccucuuaguaguagccuccuacugaauugaaggaaguccuguucucucaccuucaagcuuuugcacuuccugguccuucugcugggcgcugccccucaccaccccacaagccucacucccaucuuuucauuaggcuccagucacaguucaaaggccuuucucagagugaccuuccuuaacucuucaggguaaguuaauuuacuucuuucuuaucacacuugacauuauuagcuucuuaaggucuguauuccuggcuauacaguuuccugauagaagcuuuuguaaguuucuaaaccaacagcuuagaagaaauuagggguuucuuuaauguuaccuugacaucugggaccagcaaaucuuauauuuauuaaaagacucuuacguuuaauguaaacauuacuucugguuguaaggaaaauaccaggagguucuguucccacuuauacuuguguaaaacaugcuguaauuuucagucuuuuuuuuuuuuuuuuuuuuuuuuuuuuuuuuuugagacagagucuugcucugucccccaggcuggagugcaguggcacgaucucggcucacugcaggcuccaccaccuggguucacgccauucuccugccucagccuccggaguagcugggacuacaggcgcccgccaccacgcccagcuaauuuuuugcauuuuuaguaaagauagguuuucaccguguuagccaggauggucucgaucuccugaccucgugauccgccugccuuggccucccaaaguguugggauuacaggcgugagccacugcgcccagccaauuuucggucuuaaugguaguaauccuggcugggcgcaguggcucacgccuguaauccuagcacuuugggaggccaaggcgagcugaggucaggaguucaagaccagccugaccaacaugaagaaaucccgucucuacuaaaaauacaaaaguuagccgggcaugguggcacaugccuguaaucccagcuacucgggaggcugaggcaggagaaucacuugaacccgggagguggagguugcggugagccgagauggugccauugcacuccagccugggcaacaaaagcaaaacuuugucucaaaaaaaacaagauaguauccuaaaaguacaugagaugagauugcauuaauucaugaaaacgccuuugucugucuuuccugucacccugucuuucucucagcugcugcuguuucuccccuacuccaagacuaaauauuagaccagagucuucugcuguugcuggauaguguuagauucccauguccuguucuaauuuuaaaaauaaagucucucuucagaaaaaauuuccuacauucuaguuuuuaguuagcaugccuuguugauaaaaauuaaauuggugcuguuuucaguaguagaauugaguguauuuggacauaaaggugguaaaacuuuuuuucugacuuggagaauguucuucauuauucugagucagguuuuacuguaauugaacgaagacaugguuuuuugguuuuguuuuucuuuuuuuuugaaacagagucucgcucugucacccaggcuggagugcaauggcacaaucucagcuuacugcaaccuccucuuucuggauucaagcaauucuccugccucagccuccugaguagcugggauuacaggcaugcgcuaccacacccagcuaauuuuuuuguauuuuuaguagagaugggguuucacauguugcccaggcuggucucaaacuccugaucucaggugauccucccaccucagccuccaaaagugcugggauuacaggcgugagccaccgcgcccguccgaagacauggguuuuaauuacacuugccuuuucuuagcugugcacauaauuguccuuacgcugacuuagggguuguugguguaugcccagaguugcuugucugcugucuggauagccccugucaaguacagcgaagggagugaagccuuugacccuuggagccugggagucugagucggagcuaugcucaguucuccccacaggggucucccucugccuaauuucugucugggaacccagcccuuaacccagugcaggaacuuuccugcugaaauggacagcucuaaugguuuaauguaaauuagagcaugugucauuaaagcuaggaugccagauggcugaggguucagcugccugccaggcugaguggguggggccagaaaaaugaaaguugggggagggaauggauacaacucauguuauuuuuaaagcagucauagaaauauacagcauccaccagcucccucccuaucccaguaguaguauuuuuuuuuucccucagcuugacccaccucccugaggcuuacauugcggggagggagagaaaucgguguucuuuauuaguugcccuagcaaccauggaaagccugggagagugauuguaagacuggccugaagcuuuggucaccucuguugucugcagaggcagagaaccauuaugaucuguaauugccaguaacuggauucugaagcucuuugaguaucuccagcucaugggcaggggaggggaaauuaaugaaauaaaacaauauuggcuuuagauuuuuauuuuuauuuuauuuuuuuugaggaauaaagcacucauaggccacacuuugauagugggaaugugucaugaaugaaaaagaauuaacaaaucaaaaacagucggcucuuugugaucuagagaaggacagaacauguuaaaaccugcuuccgccaugagcaauaaaugcugagcaguucauuuuaucuucaucccaaagccacgccugcccagugaccucugaacuggaaggagcuaaggaaaggacguugauacuuucugagacauguaucuuccuguaugcuguuuucagaagcugguuuuaggagacgguugcuuuccuggaagaccuuuauaauauuaggcaaugacagccacauggccagggugguggggagccuuugccccaaauugccugucgccucuccccuuugauccuaguuuuagagccuagagaagaggcuuugggaaauuacccucuaaugcacauaucugauugaucgcccuuaccaccuccacgcuacucuuuuccagugaguuuguauuugcagcccuuuaaacuuaauaaaggagaaaaaucacaauucacuaacaaauccacuuaauuugauuucaaaccucuggagacuuuucacauggggauacuuguguuuuucuucaucggggguuaaacagucucuuggggaaaagcucuguuuaguuugucuuaccaccagccagguucaaaaucuagagagacugaugggcauuccuucaacaaaguugccuugaccccuccaaguucccuuguuuuguggaauacauucauucauuuuguaaaacuuaaauuugugaguguguuuguuaucuaguaacacugggagaaaaagaaaucucuuuaguaauuuauugaaaauccaacuaaaaguuagcuugccucugggcagaagugcaggaauacuacagucuauccagcuuccagccugcauuggcuucugugugcauuguacggcuuuguuuucuucugugaagaccugaauaggucauaucugcuggaguuccagggaagucguaaacuuugagaugggcagaaggcagauucccuaacauuuucucccugugagaucuggcuggucuuucuggaacugagggaggccucuuguugacacuggccagagagagcuugagugaugugaaauuugagggcaugcuuuaaauaaggguggaucaauagcaacauguugcuuuuuagcaauagcaguuuucaggcccaaguuacuucuuaauccugucaauuuaacugucuauuugcucuuugcaguuugucccguuuuaaagaaugguuauguuauugagaauaauuagugguguguuauaaaaguaguguuugcaucuuguuggaauacugccagcucuuaucaguagggcugcucgcauuaguuggaaaugauuucuucauuaauuccuucuucacugaaucugcuugguuuuccacagaaaauacaggaggaauaucgccacuuagguugggaacaugagauggcgagugaggugggcacuuagguugggaacaugagauggcgagugaggugggcacuuagguugggaacaguagauggcgagugaggugggcacuuagguugggaacaugagauggcgagugaggugggcacuuagguugggaacaguagauggcgagugaggugggcacuuagguugggaacaugagauggcgagugaggugggcacuuagguugggaacaguagauggcgagugaggugggcacuuagguugggaacaguagauggcgagugaggcgggcaguaguggcguauucugcacagacccaggccuuugugcucuuaaucuccuuggaaaggggcccagaauucaaagcaggagggcauugaacauugccagcuuuguuugagaaucguuucaaugugacguuuugugucuugagagccuaagaaaugcuccauuggcagggauuggggucccgucuagcccaguauucugucucugacaaugggcacccauuuguggaagcauucuucaugcuggcggcccugugggcuuugugauaugccccagaucucuggcuuccuauaauaguccacgggggauguguuauccaggaauuuuuaaaacccuccuugaaccuauucauaugugccagcucuuagggugacagauuccagaagucagcaaauauuugaacgcuuaguuuauggcuagcacugugcuaagcauugucgaagauagaaaugaugcuucauaacuggucuuggcucuugcuugagcuuauucuuuuuuaaggagacaagacuugguugcaguuguggaaaaggugggcagugacaucagaugucaccuuuagaacaccaggcagaccaugaguggaucagacucacagugacagagcucacagagacuaaugucuaaaaacagaaacauauuauuaauaauuuauguugaaaaauaaaacuaccagacccaacacugauuuauccccauaugcaagucuaauagccaaaucguaaucagcaggcugaugagugaacaagaggagcuuuagucagugugauugagucauugauuauggcagccuaacacagcccuuuccacaaagaaagaccguauguuugucuuucugaugucuccuguucuaaaccuaguugaucuuuuucauauguuauuccauucagcccuaauaguccagccuuguuuuuuuguuuguuuguucauuuuugagacaggaucucacucugucgcccaggcuugaguacaguggcacaaucacggcucacugcagccucgaccucccaggcucagguuauccucccaccucagccuccugaggaacugagacgauaggcacgugccacuacaccuggcuaauuuuuuguagagaugggguuucaucauguuguccagacuggucuugaacuccugagcucaagcaguucucucgccucggccucccaaagugcugggauuacaagcgugaaccaccaugccugaccccagccauguuuuuuugguuuuguuuuuuuuuuuucguuuuuuguuuuguuuuuuuugagauagggucuugcucugucaccuacuccucuaggcuggagugcaguggcacaaacacagcucacugcagccuggaccuccugagcucaagugauccucccaccuuagccucccaaguaguugggacuauaggcacacuacaggugcacgccaccacaccuggcuaauuuuuuguagaaacaaugucuuacuauguugcccaagcugaucuugaacuccugagcucaagcuauccuccugccuuggccucccaaagugcugggauuacaggcaugagccacugugccuggccccagcccuguuuugaaagugccuuugcauaucucuguucuguccauauuaguugcuuaaaaguuuaaugcuugaagauaauuguucuuuccuaaauauuuugagaggaggaaucuguauugaauauugauuccuccccaucaucuaccuccuacauaugcagcaaacaauacaaaacaauguaggaugaggugcuaaauuaugucgucuagacaacaugagccagaaaaacaaaucagagaaaagagaggucagugugggcugaaaaugcuaaagaaggcaucuguguguggcacagaugggaauugaauuccugcuuuaaaaaguagaaaauuaggcaaaagcagauagggaagcaugaagcaggauaacuccaggggaggaaugcuuucacuuuuuguugcugcccuccucaguaacacucagcuuuucuuuggcuuuucuggccaaagaaauauacaaggcaggacgggcgcaguggcccaugccuguaauuccagcacuuugggaggccaaggcagguggaucacaaggucaggaguucgagaccagccuggccaacauggugaaaccccgucucuacuaaagauacaaaaaaaaaaaucggcugggcauggugcugcacgcuuauaaucccagcuacucaggaggcugaggcaagagaaucgcuugaaccuggaaggcagagguugcggugagccaagaucgcgccauugcacuccagccugggcgacagggcgagacuccgucucagaaaaaagaaaaaagaaagagaaagaaagaaaucuacgaggcaguaugaggcaguggaaaggcugcugaauccuuagucuccuacuuaggguuuggcauuugcaguuccggggugccaauguccacauuuguaaaaugaaaacaguaucaccugccuuguuguuuuuauugugugaggcuuaagugagaaggggaugugugugauauuccuggugcauaguaggcauucaguagauauuagcugaaucuaaauugaguugauguauuuggggagaaguuuccccagauuuagggauugccaaguuaccugggauucccuuggugguuggugugacccugucuagagguaauagcuuggcuuacuuacauauaagcuucagugugcugugucacaaauuucuuuguacgccucuugggcuaccgugguuuucuuuaaauaguccuauucagccuugucagauauuucaguacuaaucgaauuuucuuucuuguagguacggaauggccacaucaaaagaaucacugauaaugacauccagucccuggugcuagagauugaagggacaaauguaagguagguugccaccucuguucucccagagacaucauauacuagggaggcaguacgucauagagguuaauagcacagacugcggagucagagugccggaugugagucuaucucugccacuuagagcuuaccaugggcaaguuacugaaucccccagaccuuagcauacucaucuguacaaugggcagaauaauaguacauuuuccuuauaggguuauugcgaggaguaaauaaaugaauauauauaaaacacguaaagccuugcuuagcacauaguaagcacgaugucaguauuagcuauauuauuaaccaaaguguguguugggguggggagugggcaguguuguacagcucauccaguggguggacagugugguuuucagugccauagaggucucaguuuugguuuucugucauucgauggcuccccuggaccagaauugaggucuucucucacuggaggagcuucuaagauccacugucuggcuuuguuuuucagauauuuuauugcugcugucuaguccuguguuaagcuuuuguuucuggguccagcguuuguuaaagcagccgcugacuuagggcugagggauucacuggguggcgugucugaaucuuuuagaucugcuuuccaguguauccucuuggaccguguguuauuguugugcauaccacaaaggaagagaguccaggaguguguuuauuaguauuuccucucucuacagcaccacauauaucacaugcccugcagaccccaagaagacgcugggaauuaaacuuccuuuccuugucaugauuaucaaaaaccugaagaaguauuuuaccuucgaagugcagguaaguauguguacaugaauguguccacucuuggcuauaccaaagugauagccuuugaacugaugggaaaaagugacccuacaaaguaucuuuauccuuuugcauguauucuuuucugcuucuaguauaagcccagugcaguccuuguuauguaaauuugauauuaguaauaaaauuuaaucagguuuuuaaagaaacagcaccuagaaaaccuaguaauuucaaagugucagaguuagcgugguauccauuuggggagugauuauuuaauaguggguggcuguucuguuuuaguauuucugauuuuucaaaaggaagaacauuuauauacucuauggucugagagccugcugacuguguuauaugucauaagcagcugguguugucuuggcaacaaacaagauaaacuugcuacuuccgggccaucugcaugcaguguaugaccugugucuggucuguuuauuuuccucuaagucucagccuugggaaagcaagcugugggaauucagguccuugucuggacaagguugugugcuucuuccaagacagagcuagugugaugcuucuucucuguauuucacagguacuagaugacaagaaugugcgucgucgcuuucgggcaaguaacuaccagagcaccacccgggucaaacccuucaucugcaccaugcccaugcggcuggaugacggcuggaaccagauucaguucaacuugcuagacuucacacggcgagcauacggcaccaauuacaucgagacccucagagugcagguacugcuccuuucccagauagagcccuggguuggggauagggcacacugcgucuaauauuggcuuguggcccacauagcagaacaguguggguuucuggcuucaguugccacacuguccagggagcuuuggccucacaaagguccaggaaauauucagaagucgggucagguauagaggugaauacagcaaguaagaccucccucuugccagaauccaucccuaagacaagccaaggagaugccggagaugacgcguuuccaguccuggaagagggccucuagaagauucaggaaaagggggagaacagucacauuucgccucucaaaagaagcauugccuugacagauccaugcaaauugucgcauccgacggguuuacuucucagacagacucuacucagaagaugagcugccggcagaguucaaacuguaucucccaguucagaacaaggcaaagguaagccagucuuccccagaggaagguccaccagugaguggggggagcuguguuccuggaaggugcucuggucuaagaauucagcugcagagccucucuguguugacacuuuggggugccuuuauaucgcaagaucuuaggucuccuuccagcacugaaucaggaaugcuccugugaaauacucuguuacugcuguuuccccucuccacggugagaggggaugaggcacuuccuacuacuggcucacagaacuucagaaaauaucuuaacuuuuuuuuuuuuuugagauggagucuugcccuguugcccaggcuagagugcaguggcacgaucucagcucacugcaaccucugccuuccagguucaagggauucuugugccucaggcuccugaguagcugggauuacaggcgccugccaccaugcccaacuaauuuuuaauuuuuauagagacgggguuucaccaugcuggccaggcuggucucaaacuccugaccucaagugauccgccugccucggccucccaaacugcugggauuacaggcgugagccaccgugcccagccccaucuuaacucuuaaucagcccaaaaguauuaucagcugauaggucccugcuaacacaagggugggugcuucccugccugugugcugcagauguguguccauucuccacagucacuguccacucaagugucaccagaggcagggggccugugacacugaccaucuauuuucuaguaacuuaaacugaugccacuucucuguuuuuucccuucagcaauaacuggaauugugacucgagggauagaccccuggaugugacucuucuuuuuaaaaggaaacuauguggaggacgaugcaaaaacauauuuaucuuaguuugcucugcuguaguucuguuauuuauacuugguguugcuugucauggacaccggugaacaugccguaacucugugacugcauuguaagugcaguggggguaagcaguccugugaguggcgcaugaacgcuggagcuuauuccgccgccugccccaguguggggggagauaccuuuaccaugaacuuacagaauuaaagauggcccauaaggaauuccagaccaauauuucuuccugcgguuuauucuauguuuuauauauuaucuaaauauauguauaugcugugucauacucauaaucuggaaaugaauaaagugauauauuccugguuuguaaau

SEQ ID NO: 15746 - RNA, 45729 nt, Homo sapiens
gaugggugugggcuauguggugagggaugagaggaaggugcacggaggguggguggggucagaggugggcgaggguggaggugaggaaugaggccccagcugagguuggacauaguaguuaaaccagugguuuggaaucauuuuugggucauggccuccuuugagaaucugauguaugcuaaggaaagaauggacacacacacacacgcacaugcacacacacacacacacacacaaacccacaaauucugcauauugugucagggguucccagaacuggggaaauucauccaaggacuggcauuaagaaucucuggucuggucuaguucacagggacuugucagaaacaaauccuaaagcugcauuaagagcuugaggauauuuaugucuucuagagugaaagagauuuagaaagguuugcagguucaggaauuaaauuccaaaguccacuuuuuccauuaauuuuuuuuucuaguuuuuauuuugaaaauuuucaaauucuaccaaaaaauugcaagcucauguacuguucaacuacauucacuaauuaucaaaauuuucccccaauuccuccccacucuaugcaugcuuaugcucucagaaacccacauuuuccuggagaacaauuugagacuaaguugcaaauauugauucuucaucucuacacacuuggcauguaacuccuaaaauuaugggauucuccugcauaacuaaauacaaugaucauacucacaaacuuuaacauugauacaauauaacguuguguaauauacauuaacauuguguaauauacauccuauauucaaauuuccccugcaguaaccuucuauuagguuggugcaaaaguaacugcgguuuucgccauuacuuucaauugaauuucaauaacuuuugcaccagcccaauaugagcuguauucuuucucuuucccuccuuuccuuucuacuuuaaaaaaaaauccagacucuaauucagaaucauacacuucaucuaauuaugucucuaagucuucaguaacaagaauacgaaucuaggguuucguuugguuuucuuucuccuagugacauugacuuuuugaagaacucaggcuagcuguuuggcagaaugucgcccagcuuggauuugucugaugguguccuuaucauuagauucagguuaaauguuuuggcaggaggaccacaugggggaggugucccuucucagugcaucacaucagaggaucaguugguucccuacugaugagaaguuuggaccauggguaagguggugaccucguuuccccuugguaauuccuaagucaucugugggguagcacuguauuuacugaaggucucugacuguggcaaaugcugggagagucaguggugagcgcccacacucuguccuugcucuugugcuguuuuuacaaaggaggggacagacaauaacccaggaaacaaauaaugacaagauaugcaguuugaugaaggacguggauagggugcugagauagagaaguaucaacucuagagaaagugaucuuuaagcugagacuugagcuggaggcaugccuguagucccaacuccucaggaggcuggggugggaagaucguuugagcccaggaguucugggcuguagugugcaaugccaaucagguguccacacuaaguuuggcaucaacuaugaugaccuccuggggcuggaggaccaccagguugccagguggcaaacagcaggucaaaacuccuguucggaucaguagugggaucaugccugugaauagccacugcacuccagccugggcaauauagagacacccuauuucuaaaaaaauacuacuaauaaagaaaaaggugaaauuugaauaggaaaaaggagacacccuugggaaggugggguggagggguuggggguggcuccuaguuaagcuuggaggauagaaggaaccaaaagacggaugcacgguggucucagggagggaggaaugagcagagaaaggcccuaggccuggaaauaaucauauugaacacaugcuauccuaauagugaacaccauccuaaguguuucacaugguuuaccuuguuuaauucuccuugcagcccugugaagugagcguuauuacugguuuuaugcuguagaaucugugacacagagagguugaguaauugcccuaaggucacacagcuucuaaguagcagugcuggauagaucugacuccacagacugugcucuuagcugugucaagcaggaaggcccaggguuucauccagaaaacagaaugugaaaagggacuggaaugaaagcaaccuguacugggugcagaggugcugucgauaaaggaugagggaugggaaaggaagacagaagaaaggccuagaagaucaaaggagaaggguguucaaggcugcaggcagcacuggaagccaggccagcucaguugaccaccuacucugggcacauccccaacccagccugucccuucaggucggauuugcaauucuccugcucucccuccuccuaaacacaaacaggagauuuacacucucaaagucucuccccacaaaugacuuauuaaucacaaagggaaaaauuguaacuuugcaguggcacaaccuggucaaugccagcuuaaccaagugaccaaaguggauauucagggaaggcucuggaagggcauuugggggaaguguagaaagguuuugugaggagcacucugaaugacggggguaggaagccuuggggacugaggagucuacccuaacagggcaggguccagagggggaaggagggguaugucucgggggaagggagaaguauugaggugggggagguucugagguuugagugaggcccuggggagggacuugacaguuugggugacaggagggucagaauagggucaguaugggauguguuggguggguaaaagcugggugagugcagggcuggggauagggucuccaaggacagugaaagggucgggagucgcgggcgagggcucuagggcaacggccaguggaagggggggcuccuguggcgugaagucaagccagcccgagggugaggcgauuuggacaguccgaccuguggcggcgggagggcgaggguggcggagggcgcgagguaggcggcggggcgugccggggcggggccggggcggggccggcaccgcccggcggguccccccgcgcuccagggggcgcugugagccugggcggccccaggccgggcggcggccgcucccagugagcgcggccccuuuuccggguuuccuccgccuccuccuccucuccuccuucuucuccgcugccgccgccgcugccccuuucccggccgguggcugccgcugccggugccgccgccgccgccuccugggggccgcgagccgagcggagaccgccgcggagcgcgagcgccgcccgccccgccgccccgccggccgcuccagggccgggccggcucggccggcgccccccgcgcccccagcccgcccgcccccgcgggcccggccuggcgcggccgcccgccgccgcgcuccuccuccuccuccuccagcgcccggcggcccgcugccuccuccgcccgacgccccgcgucccccgccgcgccgccgccgccacccucugcgccccgcgccgccccccggucccgcccgccaugcccggcccggccgcgggcagcagggcccgggucuacgccgaggugaacagucugaggagccgcgaguacugggacuacgaggcucacgucccgagcuggggguaaagccgucgccgccccccgccgggcccgcugaucccugcccccgcccggccacccccugcgaaccgcacucgggcccgguggugucucccgccgaccccuccgcgggcccgcagggaggcagaggucccgcucucgcacauguccucgucuuccucuucccuccccuuuacccccguuucgucccuuucuccccgcuuugcgcaccccuuucccccaaggaaugcuuuuuuacucggggagaagugugggguccagggaucgacgccggguggaagugagggagcugcccuuccucacacuucuggguuuccacuggggugggaagucaacagcuguccuuuggagcuauuaaaaugcccugccuuuuagguuuucugagaugagguggugggaggaaauuucuuaaagacguccagauuuuuaaaacaggcauugucuaccuugaagaugugaaacgagaagcaggugcuggggagccgcggggcacagggggcacccucuaggccuucaggacgggugcuuugcucgccccucuggauuggcucagagcguugccuuccugccccaucuucccaaguuaggagagaccaauuagguuaggagcucugcagagugaagggagccaagauuaugucguggcuuucauuuagggaaugaguugugacgugauguauagacacuuccaaguguuugccugguggaagcggcugaaugacguguacagugggcauaggcuugguuaacccccaguccuggcauuuaugugugugucuuccuuuuacaguaaucaagaugauuaccaacugguucgaaaacuuggucggggaaaauauagugaaguauuugaggccauuaauaucaccaacaaugagagagugguuguaaaaauccugaaggugaguguccuaugagugguauguaacauuuuccuccccacagggcaaaaguuuguaagguaccccagucacauucuauaaugggcaaugcaagcuugaauuuaauuuaauuuauuuguuuagagucagagucucacucugucacccaggcuggagugcagaucauaguucacugcagccuucaacuccugggcuccagugauccaucucagccucccaaguagcugggacuacaggugcaugccaccacgcccagcuauuuuuaaaauuuuuuuguagagucagggucuggucauguugcccaggcuggucuuaagcuccugagcucaagcaguccuccaaaaggacuccuugcaggccuccuauaguugcugggauuagaggcgugagccacugugcccagccgacgcucaaauuuuauuuaucugaugucccuucauuacuucuuuuuccaccccauuuucccaugaacuuucaagaaaaugugcagacaucacaaaucuaaguucaguaaaguguuuguucuaaaauguaaauucccuaaagcaaaaauuccaaaagggcuccguuuguuagaaaauaaauagguaaucaaaagacagaaaagccacucucaauuuaagggcucccugagcacuguguuuguuacucuuggugcaugcuguauguuauuccagaaagaaaguuggaaaaaauuggagcgacuucagaaauguauuucaagcccaaguggaaggaaauuccuuagcggauaaucacuuguuuuuuuccuuuggcaguaaaguuucaggugguauggauacagugcaccaguagugcugagaagccuuguugggaagccagagagccauuguugcuuauaagcuaguaaaaauauagaagaguucauguauaauuacuaaaguaauaauuggaacaaaacuaucuuaauauaugguuuagcaaugaauuugauaaugauaugacguuaucucuuugaugaagaugauuuuaauuagcaugaagggucggcuaaauuuuccuucugguaacugauuguguagcuuuaauaauguuuuauaggguauaguaaaaaguaguucuuagaaucugugauggguccucguuauugccggaucauuucauguggauacaagucauuuagugagagauugagaagaccgaagagugauguaagcacuuugcauacaugugauuuccauuguggcccuuuugcagagguucuguggacuagaaaagcugugguauagaaaagcuguuucugugugcuagggcagcugguauagguaaucccuguuuaaugugaggggucaggcuuaugcuuucugguaaucaucuuucagaaaaaaugauuaacuccaucacucaaaacauccuagccuagugauaaaggagcagaauugcaguaaagagaaaaagcaaaguuauuuguguucucagacacacuggggcugagaagugaggaacugauguugaagauacugagugugacuccucucuucccuaaauaugaauugcauuuaugaagucacaaggugguuuuuuuuuuuuuuaagucacaggaaaauuaccuuagaaagccauacauuagcuuuauguacauaagcauaaguuuucaauaagcugcuucaaaucuaagaaauaagcaaaacguaaauugaaauuaggaauauccauauuccacugcuguauauucagaagaaugaauugcugacucuaaagcaauuccagaaaaaugucugaacuuuugugcuauggcagcauuuuuagaauaaguguaugauuuucuguggugcuuuuuuuuuuuuaaaggaacagcauucagguguguguauaaauaccagcauguucauuuaggagagcaucgcauugcugcuucaucauccaaagagcuuuauaggcucuagcuuucccccuacuuuaaagauucuuggcguauguuaggaaacccaguauguaagcugcugcagguuaucuuuacaaaugggagaccuaggcacaaagaaacuuaccuaaugucauuauguugaaugaccauuagccagaacuccuguuuccuauuucuucauaucucuuacuguucauuuuagcacuggauuguaggaucugaacguugagcacagaaacagguaccaguguccuggaaucagacuugggaggccccuaguuaaugaaauguuucuuguuucuucuugauguuguuuguuuucacagugcagccuaaaccacuagugaaaauuagacucacuucuuuauguuuuuuaaagcccgguggcauuucuauccagauuuuguuccugucugaaggaugggguaauauaucacuaauggcauuauugugguuuuguuguuuugugaauuaaaaguauuacuuuuuaaaaagaacaggguaacaaggucuuuagccaaaguuguguuucuuuauucaaauaaguugaaguuaugacuaauagcuacuauuguggugcuuggucauaggaaauuagguccuuaacagacuaccagcuccucauaacuuggaagaaucuagaacagccuuccuuuuuguaaaagccugcuguauuuuagcugcaggauuguauuaugcacauagugaccaagauagaggguggcuuucuugaggacaaguggucuuacuuuuguagucaguaacguuucguaucaguucuuugcaauauaugugagaauggguggaugaugagugacuacagaggaauuuuauaucauuuaauuugcauuaguggauuuccagguauugaucaaaaaugagcugcuaaaaaguuuuaggaauuuagaaacuggugagcaaaauuuuacugucuauccccaagugguauucuguggcuaaaaucuuaaaacuuuccaaucaauagagagguuguaucuuuuuuugacaaauuguuuugaggagaaaagagaaaaaggaggaggaaaaugguaagcguuuauauggcagggcagaaagcuacauuagugccaaaaguuucaucuuuugauuuugaaaaaucaguucuucauuuccuuuguaguaccucuuagaaaaguguacacagaaguaaaaguggccaccuuugacaacuuuuagcauuuuaugaauacugccuguguguguagauuucaguacuucuugggguccuugggaucuuucaaauuaaacugcuauuucuugaauaaaaguuaagagcaacacuauuuuuaaaaaacagcauuuugaaccagugcaaaaugacuuggaaauucccauauaaggcuuccucuuagaggucuuauuuuauaaacagauugacuauccauuuuccccuagauauuaauuauuuagcuuuaaacaaaggguggugguauuaaaauuuugcucuuuaagcauguuuagcauacuugcagauauuuuuuaaguucuguguugucaguagguaguguuaaaaggaugggcauugguuauacaucuuuguuaguagcuucaucgugagcuggugaucuuuauauuauaucagaauggugcuuuccucuuuauuuccucuuuauuucuccugugguagguuuuuuacccuccuaaauuuaggcauguguaugaagacaucuuccugaaacaacacauuagugguauuuaucuaaguuuuugguacauucugauuuucacuaaugucucaugguauaaaaguagugcaaacaguaucacuaaaguauugcuaacauuaaaaauaauguuaaaaauuauaugugaacuaggccguuuccagcauuguacuggggagucacagauuaagaguguaguuaaccugugucaaacagaaucgcagaaugcgggcacuuagaaaccuagaaaccauuagaacccaggcccuuuuuacaaaucaaccaagacccagagaaaggauguauaugcucagcgucauguagucaggggguggaagcacucgguguaggaccuuguguaccugucaugaagucuugguagaugcgaggagcauaauuaggacauuagcuggauguuugacuuugugauguccugaucuguacuggaagaauugaggaacacucaccaggagucaaaugaaguuaauucguuucuaaugauuuuuggaguuauuuuucucaaaggaaguguuugacuuugguaaguugcuaguugaaguguggaauccaagaguccucgagggcuauagggacccaggcaggcguucucuaugauuaguauccacagcagcauguuuaaugcuucaaugaaaugcugcuuuauucucuugaagccucaguaaauaguguuuuuaugguuuuuuuuuuuuuuaacccauagaguuccuccaagucucagcaugaucacuuggcagauuucgggauuaauaguuuaauaguuuuaucccuuuaauauaugaguuuauuugagagcaaaccacaugugaaaagaauaucuugauauagugugcccauuuucauguauaaagcagggcuccagauaguuucuagaguuuaauuucaggaucuaccaucucaucaucagggugguguaguguaggaagugcuguaaaugagagggcagaaggcuugaguuccagaacuaguuucuucauugauacccacuugacuguuuucucaucuaugaaauaagcauacauuuccugcuuaagucacaggauuguuaggaaagucagauaaacuauagauagauggguagagagauugauugucauguuuuaguaaucuacaaaaugcuuuucuuuccugagagaguauggccuaggaaguggucugccugguuucagguguuagcuccaacuguagacgcucugugacgucaaacaguuacuuaaguucucugugccuugguguccuuccucaaguaaaacuguuaauagugcucaucuaagacgguuaaaugugcuuaaaacagugccuggccugagagaucaauaaaguauaguaguaauaacaauauuacauuugggucaugcgagugauguuagaggcagaaccaauaguagaaaggguuguaguguucuccuaaugagauucaaagggucugcucuaugccuugccuuuaaaaaaaaauuguguuaaaauacauguaacauaggcuaggcgcggugccucacgccuguaaucccagcccuuugguaggccgaggugggcagaucaccugacgucaggaguucgagaccagccuggccaaccuggugaaacuccgucucuacuaaaaauacaaaaaauuaguuggccaugguggcgggugccuguaaucccagcuacucaggaagcuaaggcaggagaauugcuugaacccgggaggcagagguugcaguuggccgagauugcaccauugcacuccagccugggcaacaaaagugaaacucgucuaaaaaaaaauaaaauaaaauaacauaaaauuuaccaucuuaaccauucuuaaguguacaguucaguggguaauguugugcaaccaucacugccguccaucuccauaacucuucaucuuguaaaauggaaacucuauccauuaaacaguaacuaccuauuucucccucccccauuuccuggcaacaaccgucuuacuguuucuaugaauuugacuacuccagguaucucauauaaguggaauuguacaguauuuauccuuuuguggcuggauuauuuugcacagcauaauguccuccaaguuuaucacuguugcaugcaucagaauuuccuuccauuuuaaggcuacauaauuuuccauuguauguauauaccacauuuuguuagccauucauccaucaguggauggguugcuuccauguuuuagcuauugugaauaaugcugcuuugaauaugaguguacaaauaucuccugaagacccugcuucacuucuuuuggguauagacccagaaguggaauugcuggaucauaagguaauucuaugauuaauguuuugaggaacuuuccauaguggcuauaccauuuuacauucugacugcaguguacaaguguggcuguuucuccacauccuugccaacacuucuuuucugguuuuuuugauagcagcuauccugacuugugugagauaguaucugauuaucauuuugaauuuaugccuugccuuuuuaaauaauuuuuuuuaacuccugagaguaaacaguuacccucaaggaguagaucauguaauuggggugaugaaacuugaaagauuagaggaaaaguuuucugugaugaaauaacauugcucagauaauauuuuuauauaggucaagugcagugaguuuuagggaugccaccaggguagugaauuacgugccaucauccaggcugaacuuucuuuuuacucuguccuucuacauucuuggcaaccauuguucauugcaggugaugaaauuaauaucuugguggagcacuuguuaguuugguaguagaguaaaaguaaccccaaauuugagagcuaggagcuguagauauguuccugccugucuugaauuugucaguucaguuguucuuuuuuucaccacuuugucuacuagauuucaaguuaaaaaaaaauuuuuuuauugguuuggacaauagcuaaacugauugaguuugaaucuuuuaaacagauagucucugaauuggaauaaaugaaccccagacggagacuucuucuagcaugcagagugaaacugugagaucguuguggaaauauauguauuuucuccauuuuguguaacugguggugaauggcuacaggcucuggacaggagagucaaggcauccuuauuucuguaaaacuagguuuauuuuccuuaggauaccaacaauccucccucauaaauccuaacuuuuuaucucugauucacauuaaaaggaucacuuucagcuccucagagcucauugguuuaguuucucgagcaucucuccaguucagaggaauaaacugaggcugaagggaucuaccuguagcuuaguuuuugaugguuuggagggaaguguccuggacugugggucugucaccuuccuuuuuuaucauuucuugguauuuuguuugcaugugaggacucuagcugccuuugugacuugggacuccuuugugccaccuucagaguugcccugcuauucccagucucuaguuugggaaguuuaaguuagacaccuggugggcagcaaaauaugcuucaguugcuaugccagauaccuuuagauguauugagagggagguucaucuuaacuggguuguccaggccugaccuguugcugaauaaccggagaccaaugcaagacuuuacauggggcagcgucauaaaggcaacuaauggguugugccuguaaggaguuaggaguacuguuagaauuagaagaggguuuuugguggauauaggccucuggcuguggguuuuuuuccucucuguuaccacucuuauagaucuauagcugcuuuccaguauuggaugacaaaucuagaauuuucuuauaucgaaaggcauugacuaaacugguagcauuggcugaauuuauaaguauaagauagccagcuuuggccgggcgcaguugcucaugccuguaaucccagcacuuugggaggcugaggcaggcggaucaccugaggucaggacgagaucacccuggccaacauggugagaccccgucucuacuaaaaauacaaaaaaauuagcugggcgugguggcacacaccuguagucccaguuacuugggaggcugaggcaggagaauuguuugaaccugggaggcggagcuugcagugagcugagauugcgccacugugcuccagccugggccacggagugagacuccgucucaaaaaaaaaaaaaaaaaaagccaguuuuuauuuuucuuuuaacuucuuaacauaauuuuggacuuaaaaaaaguugcaggaauucccauaucuguuucacccagacuccucaaauguuaacauuuguuuuauccuucucuuucucucucauauacacacacauuuguguacauauacacacaccuauauaaugacauuuauguuauguauuucuuccugacgugcuugagaguaaaucguagucaucccuaaauacuuugguaugcauuuccuaaaaauaguuucuuacauaacccuacaaugccauauuaaaaaauuagaagguaaccauugaugcauugcuguuaccuaaucuacagcucucauucacauuugccagcuauccuuauaauguucuuuauagcaaaggaaaaucccagauuacaugaugauauucagcuguagucauguguuacauucaguugucacauuuuaaaagucuggaucaguuuguuucaugaaugacauugacguguuugaucuuacaggccgguuauuuuguaguguguccuucccuggcuauuuuuuaaucagauuguacagugcuuuuuucccccaaaguuucgagcucccucguuaaugaaaaagggacuaaggaguaagguuucuaaguggagucggggaacaugcacagcagccacaucugcucuccugggaacccuggcacagcgggcggagagcgggugucaucauggcagcuggcucacaaggacgcagcgagagcccagccugucaguugagcccccuguuauaggugaugcaagugcucuuguuucauaguccucuccuucucuguuuuguuauguguucaaagcuguaucuuagugaccaacaaaagaugaagguuucucuggcauguguguauguuauauuuucccccuccccuccccuuccccaccccacacacaggcaaaaaaagucuugcuuuauuauuuauuggcaaauccauuggccucucuuugccucugcuauuauaacagugucucagugauaaaauacucuuuuuuccuuaguuacguuucucccguuagccacacuugggaaacaaaagcacuguggcaagaguauagcaugcagucagacugcccagcuuccagcuuugauuccugccccucucugccaugggcucugugaucuugggcagauagcucaacucugcuacauaaggacuuugugaggaaucacaaugacuuauuaaauaauaaauuacuaaaaauaugaaaauaacacuaucauuuauuaggugcuuacuguguucuggucaccauucugagugccuuauaaagcauacuugauuaugauagacuuacuuuuucagaacuguuucuauucuucuucaaacucuuuaacucauuuaagacaaggaguaauauguauaaugagaguaauuauuuuuaaagccuuuaaucuuuccagcagacugaaaaguuagauagaaguguucagucacuguuguaucagauugauuucuccuuuccugauucaacauuucuuucuucaggaaugggaucuguuggaaaacauuaacuggcucugugcugauuucagauucuagauauuaaggaaaugggaguggugacaggaaaugagagccagcagcugggaagcaaguuuguaaccugaugucagugaacuggucuuucacuccugaaagacaaaauuacauguaacucauuggaagagcaggugucucaccauuuuguuucaguuuuuccauuugugagugcaugauauacagcuguucagagcuauauuuuccacuuggcaguuaucuaguaagcccaaguuuuauuuuuaaagugugauauggguauucaaaauuuuuaagugcccucaauguaacuacuuagaagaucuugacacauaagcuguaugagucuguaaauuauuuaacuuaauguuaaagguucuuaugggcaagcccauucuauuucaguuuuuucaaauuuaggcacacucuugaacacaacagaguguacaagauagcguacuauccaucugauuggcuaacauuguuuuaaaguuuuauuuauuaacuucaaaaggagucucacuucugauuacucuuguguauuuaagccagugaagaaaaagaagauaaaacgagagguuaagauucuggagaaccuucgugguggaacaaauaucauuaagcugauugacacuguaaaggaccccgugguaggugccaaaugguugggggaguauacuaguagaccgggguguggauaugggaguuguuuaacacacagaaccucacguaaugauacaguggggauggugguguuugucuuuaacuacugacugguuugaaaaccagaaaaaaaucauggugacccagugauaaaacagcuaccaccacugugauggaaccuaaaaguguacagagaaaaaucccuuuucuggguuuguacuucacuauuuugauucagcccacaaauguuugcugaaugucuccuuuaagccccagccucuuuccaguuuugaaaguucauuacugccaauuuguguuacucuaccucacuuaaguaagcaugacauuugaaaaucuggguuuacacaaggaaagaaugaauaucuccacguggacaccuggcauaaaggccugagcaggucccagcuccacugacccugugaagaagucuucuucuuucccuuaaaucagcauaugccauuagggcucaugucacauguguagauagacuaaaauauuuuugucagugcucaguuuguagccauuuuaaaugugcuguuuaauuuuguuuucucucccuagggaguaacuuaaccuuagguguuuuugauuagcuaagguuggagacaccucaccuccccacuuuuguaccccuucuugucccauugcuguucuccaccugcuguaccucagauauuucccuguuauccucccaugauaguuuuguuuauuaaagaaauagguuuuugcuucuggcugcuaaagacauccucauaauaauauaguagcuaacaugcacugagugcuuacuaugugcugggcacauuccaagugcccaacugugccaugucacucagucuucacaacaguccauugggguggguaccauuuauuguuuacauuguacagaugagaaaaccguaguuugcagagguuaaaaaauucacucaagauuacacaguauuguugaagcauaaggaaaguuuuuccuucuggacccugagaagacugagaagggaagggaugguuguaugccagauuguaacuaauuggccuuuaagauauccuguccuuuuagcacaaauugauuuuauaaugacuaguucuggacugccucauguuugaaaaugggcugcauuagaaaugaguacccauggaaaaaugagcaccguguaaaaauaugaauuucagaauaauuuuuaaaaugugagucaguaugugguauaccaggagcauuuuuguuuugcuuuuucuuuuuuuaaguuagcagaacuuaauuuguuaaaguauguguauguuuuacaugauauguaagacaaguaaguugaagaugacaaaaaucaacagggaccccuugucuauuagaaggucaggcuuacuccacuauucucccguugagagaagugguaauacugaugaaacccuuacagcuucgggcuggugaagaauuuuuaaucauggcugcuacuggggcugcuguuuggacucugaguuguccucgcagagaucugcaugcugcccuguggccuguuuccuagguaacuuucacaugguucuugagcaaagauuucuagauguuuuuuuuuuucuauaaccccuuaagucccuacuuucucccaauuuugaaagcuuauuacugccaauuagcguuauuuuacuucaauuaaggaauccuguuauuugaaaaucuagauuuacacaagaugauauugagcacuuuuguacucauuggauuaaagauuauagugcuuuaaaaauauuugauuauauaugaguuuuuaggaacaggucugcuugauaagaugagacaaucuuuaauggucucuagccaaggcaauaauauuauaguauagcuuauugauaauaucacggaugguuauauuuuccuuuuggacccccaaaagaccuaugauacauucccacaaccuaugauaauucugucaagugcaauucuggcuugcuaaacuaagaugaaaaugugucacuuuuuuuguauauggcagacuggaacacugcaggguguaaauccucacauaaccuuugaagauugguuaaggccauugguagguuauucggagaauacauuccucuuaaaacuuuuuauuaugaaauuuucaaccauuuucaaaaguaaaugaaaaauguaaugaacuucccucacacaugacccaacuuuagcaguuaaucagcuguggccaaccuuguuucaucuauacucccaccacuucccaccucccacuauccccaguuauuuugaagcaaauuccagacaucauaaaauuucaagagaauacuuuucuugacaggcugucccugaugagugaaucccuguguuaccuaaguaggauuuggggaugggccauuuuggcagaagcagauuacauugauuauuguuuggguacuuaaaaagcauuaauauucucuuuuacagucaaagacaccagcuuugguauuugaauauaucaauaauacagauuuuaaggugcguaugcuuuucuuucuggcaugggguuaacggggugagggggagcuggugauaaauacuguguacuccagaacccaaggggccagggcugucauuggugagaggaggaaauaacaaauuggguuccuuaaggcaugagugcaggaugcagaaaguggcuaggguucuugcauuaggugaaauuacuuaaucacccuuugccuugccuacuccaggaguagcugcucggcugggucuaagcuaaugccucaucuguaacacuccuguuuuagacagcauagcuuuaguuguauguuaacuuugccuuuuguacgaaaucuuacuuugccgagaggaagggauagaccgauacaaggcccuugugaaaagaagcaaugcauuggauucagugcugucaaauaacaaaguguguguuugcgcacgugacguacaaagaaaugauucagaaaaaccagagucagugcuuuagaagagcccuaucggguuuuuuacauuuucuuauaauguaaauuauuuuagacauugaaguguucuuuuuaaaucaugguuuuaagcucguguuucacaaaauuuauuguucaaacauuaaaaccuuaauaucaagguuuuugggguuaggcauacuagacaugguggaaacccuuuuuuagaacguaauuuaaaaaccaauauacaaacaaaauaguaguguugauuuucaggggcacuuggaggacuuguaguugauuguaacucugucagugaauaagagacuugugauuuuguugugacaggagcuagagacaaaacuaaaucagcaguuaaaagauguugguaucaggacggaugguucuggguaaaaguaagagaaccuuauucucacacuuuuuuuuuuuuuuugagaucgaguuucgcuuuugucacccaggcaggagugcaauggugugaucuuggcucacugcaaccucugucucccggguucaagcgauucuccugccucagccucccaaguagcugagauuacaggcaugcacuacuacccccagcuaauuuuuuuuuuuuaauuuuuaaauuuuuuuuagcagagacgggguuucaccauguuggccaggcuagucucaaacuccugaccucaggugauccacccaccucggccucccagagggcugggauuauaggugugagccacugucgcgccuggccuaauuuuucuuaaucacucuaaaaugacuaaaacaagguuaauuagugaaaaguaagcaaaagaagauauuuugacuuauaaaacaauaaggaaguuuuauguguaguauagcacuuucccacaugugacagauuuucuuguuaaugugacuccuuacaggugaaauuagcagugaacucuaaaaagcaggguguaaauuuuuucauucaguagcauaacagcgcuuagcugguaggguacuaugcugauauguguagcugauccuaugaaucacccagguuuauccugguauaugugagugggaaugugugugcaugucuuagaaaaccagauaggcuuuaaugaaaccaaauauuuuccuaaugcaaaaguugaaaccuuaucugaauggaaguucguaguguaauuccccaaguuuuaaaugccugggcuucguuaaugaguuuuuaccaauugucugcuacauguguaaaauuucaccucagcauuuugugguuuuguuuuuuuuuuuuuuuuuuugagacggagccucgcucugucgccuaggcuggagugcaauagcgcaaucucggcucacugcaaccucccccucccagguucaaucaauucuccugcuucagccucccaaguagcugggacuacaggcgugcaccaccacgccuggcuaguuuuuuuuuuuuuuuuuuuuuuuuuuuuuuugguauauuuaguagaaaugggguuuuaccauguuaaccaggauggucucgauggcuuaccucgugauccaccugccuuggccucccaaagugcugggauuacaagcgugagccaccgcaccuagcccauuuucuguuucuuaaagugacaucugcucuguugauuuaacaacugcugaagaucaguuagugggaauucuaauucuuagagaaauucucucuggggucuuaacccucaaaggggauguuucauacauucucuuguagcuuucuuuaaagggauuaugggaaauuaauguuuuuuugaagcuugcauaucugaagucauuuuuauuuuguccugccaauuaauguauuugcuaggguauagaguucuagguuauaauucauaauuuccuugauuuugaagagauuguuccaguauuaccacugaagccauucuaguuucaucuuaugugacgguuuuguuuuuguuuuuuaccucuggaagcuuuuaggauuuucucauuugcacucuucugaaauuucacaaugacgugccuucguaugggucccuuuuaucuuuuguucugcauacuugcugggcuuuuuccccuguguuuuggaaaaauauuuuuaauguucuuugauuuuucuccccuuucuucuuuguucucacuuuccagaacucauucaaauguuagacuucacaucuuacagcuccauuuuggucuuggaacuuuuuaaaauaguauccuguucuuuuauguuuuauguaauaccuucuauuuucucacuaagaauauuguauuuuuucccuucauacuuuuucucuauuuuucuuugugugugaguuuuuguuauuuuguuauucagucucugaaauaucaugguuuuugaaugucugcucauugcucuaaagaaccaucagccccugucucaaggaugcaggcuuggcugcugguaucuuagccucaaguugaggagaaccauggggaauguugugcagacuucaccuaagucuccccuuuucaguguggcaucuuaaacucauuuucccguuuccggugcacucuguuuccucucuuaaaccaacauuggaggucccccguccugaacauuucugagguuguucaguuugaagcuguuugcuuuuggccuuucgcuguuggcagagacauguuuucuagcuucacaauguuguuucuccuaucuucuuaguucuuacgauuuaaucucccugcuccuuuuacgguuauuuuagaggaguuucagguagagcagagguguuugaucugccuuguuuaacuggagguccccuuugaauguucaagccaugacauuuuaaucaagagaucauuaaauaucagauggcagauguguauuuuugaagagcaaaucauggcaggaaaauuaaauucuuuuccagauaguauggcaggccacaaacaaaaucauuuaguucaccgucgugauguccuuuagucuuuuuauuuuguccuguguccaucuuauuaggaaaguuuguuuuuuugucuuuuuaauuuuaguguaaaguauauuaauaacugguuuuaagauuaucacccagagaguguucauuccucguuaauaccagggugaauuaacagugaugcagcccgcagcccauucuuuucaguauuuuauauuugugcaauggauuauaaauuuugaucuauaauuuuauuuugucauaggguccuucucuaaguuugcuaucaagguuauacuauauaagauagauuggguagcuuuuccucuuccuauucucugaaaguuuauguaagauagguauuauauggauagaugucuuucaaggaugggaggaagacuuugaacuauacuuuccuuuuuaaaacauaacuuaaaguuuauccagguuuucugucucuucuugagucuauuuggauaauauauauuuuauucacuuucaauuugauugacaaagaauucucuuaggacuuaaaaacuauauuguugacuggucacaaaaaaaaaaaaaaacucuggaguaucuguaguuauccuuuccuucacauuuuuaaguaguauuugugccuuuacuccuuuuuaaaucagucgugcuagagaucugucguuaaucuuuuaaaagaaccagcuuuuugguuuuauugcucaguuauuguuuuuguuuguuuuucucuuucugcuccuaucuuauuuuucuucuuucuuccuucaacuuuguugggcuuucagugguuuucuucuucauuucuugaguugaauuaaacucauuggauucuguuucucuuuuucuuuuuuuuuuuuuuuuugagaaggagucucgcucuguugcccaggcuggagugcaguggcacagucuuggcucaaugcaaccuccgccuccuggguucaagugauucuccugccucagccuccugaguagcugggauuacaggcgugugccaccaugccuggcuaauuuuuguauuuuuuaguacagacgggguuucaccauguuggucaggcuagucuugaacugcugaacucaugacccacccgccuuggccucccaaagugcugggauuacaggugugggccaccacgccuggccuugauuuuguuuuucuugacaauacaugugcuuaaguuuguacaacccuaagcgucauuuuacguguaucccaugguuauggaacucacuucuggauaguuuucaaacuagaagugcaaacugcaacauugugaauuugcauuuuucuccgaagacuuuuuacuuggaaaauuggaaggaguagcacaaucaguauauauucuucaccuagauuuaccaguuguuacuguuuugccacauuugcaguuauuuuucucccuguccccucacccucucuuuucuuucuuuuuuuuuuuugagacagagccucuaucucucacccaggcuggagugcagugaccugaucuuggcucacuguaaccuccgccuccuggguucaagcgauucuccugccucaggcuccugaguagcugggacuacaggcgugcaccaccacacccagcuaauuuuuuguauuuuuaguagaaacaggguuccaccauguugaccaggcuggucuugaaccccuuaccucaggugaucugcccaccuuggccucccaaagugcugggauuacaggcuugagccaccaugcucagccucuccuuucuauuucuauuuuaucuuuuugcugagucauuuuaaauuaaguugcagacaucauuaugauacgucacuuguaaauacgcuagcacugaaacuaggcuguuuuccuaugcaaaccacaauacuuuuaguauaccaaagaaauuuaauauuuauacaauaaugccaucuaagauaaguucauacucaaaaguuucucuauaauuauuguuucaguaauguucuuuauagcuguguguuugugaaugugugauccagaauccaggugaauuuuuuaaaaauuugauugcacuauguucagagaacgugaccuauauaauguuaauuauuuggaauuuguugaugguugcuuuguaacuuuaguacaugaucauuuguuauaccaaguguguuaauuuaguucagaauuauggccuacuaauuuuuuuccuuguauuucacuuuaugguagagguauugguuuggucaguuucuccuuaaaaucagcaguuuuuaugcuucauauaugccaaaacuguaauaaagauacuuuagaacaagacaaaacuucgaaacgaaugaaugagaaaagucagucucuaagaguuggacugaauaauuguagcaaccucccauacuuaaaagugucucaggccgggugcgguggcucaugccuguaaucccagcauuuugggaggccgaagcaggcagaucaccugaggucgggaguuagagaccagccugaccaacauggcaaaaccccgucacuaaaaauacaaaaaaauucggcgggcuauggugcacgccuguagucccagcuacucaggaggcagagguaggagaaucacgugaacccgagggggcagagguugcagugagcagagaucuugccauugcacuccagccugggcaacagagugagacuccaucucaauugaaagaaaaaaaaagcgccucaagagaagcuaagguacuauuuugaaauacaaaaaaaaaaaaaagauuucgauaagacacuccaaaugggcuccauccuaagaagcugguagaaucauauugauauuuggaggauuucuaaaucacucacauagagguaaaucaccacuuaguaaauaaugugaggccuuguuaauucuguuagagguugaguuuacagacuaaauaguuuccuuaauuggagaaacaaauuguacuuuuauauuaugucguguauguuauuauaggucguuaacauuauuuugucauuuccuuguaggaaaauaagugacauuuucaggggauucguaauaacuuugaucugcuugauuaaagauuuauucuacuuccuuaaauuucuaaaaacguugaccucgguuuuauucuggaacuuagagguuacauguaaacaauucuuaaacuggugacugcuacaguaaauaccucuuuugcuuggacuuuauguaucccaccacuuuuucuucucucuacacaugacagggauuuaugggcauagacugagcuguguauaucagggaaugugcacacacuguguggcuugagaguuugguguguuggugauucccacaucuggcaggugaccagagcugccugggaagcugucuuauaaaagugugaaucuuccugaaggucaugguugggaauggggucuucagaucuguggcucauggugaugcagcugaauugcacuuggagucugaacagcuguguguaugccuacgguagcagugaggcccaccuguggccaugccuuugugggugucugugguuuuacaccauggaggcccuccucagacuuuuuggagcuaauuaaaaggcccaggaaauuuccaccuuuuaagucauuuauuuuuugaaaauguaaccaaagcugacuuccugccagcauuuugcaguggauuguuuaauaauguucucccuguagcuggcuaagaagaagggagagaaaguguaguucuugugacguuucucuuucuaaugugucauggacucuugguacuucuguuucuuggaagagugcuucuguuuuguuccauugacugugaacauuguaaaaacauguaugcaagacagagcugccauacaugguguuugguguaugaagcacuugcuuuucggcugugugaggacuucauaugugguuggaguucaguguaggaaaugggugugguacugagugaguuguucagugggcccuuggcauacuugggugguggggagaguucagagaucuuuuaucaccaaauuugaugacucugccaccagccacuguacccauuucucccuguuguguaugccacgaagcacagggaauguuggcaugagacucuuggggucuggacaaagcacgcagcagagugaggagucaccuugagaaccugagguuaccaccagucccugugugaggaauguuaacucuggggacauuguguucuuaaugguguccugugcacagccacauuggagagucaguggcauggagauagagaagggagguaucauugucagcucuguagaaagcagacagguugguuuuggcuuuacaggcuaagguggaguagggcuagagagggaagaguggaggcagcaaacacgggcuuguuuugucagagcuguggacuccuggggguacagugaagaacagagcuacaaaagucggaggaagccagacuguggacccugcauagucuugaauuuugggcccaggcgguuaaauguuacagauguaguuuggucuccuccuacccggagauccugagaagugagggugaauggcaaccagucacuugggacuuuguaauaucuuaguccuaaacacuaguguacaacuggugucuuugaauuaaauuguuaaugguuuuuguagcuagaaauacuguguuggcaguccagagacauuuauuuuuauggcuuacaccauuuauacagaugcaugguguagguaccacaugaugagggaggccuuccacagauaaaaguccuaaugagauagcccauguuaguuuucuggaaauaaaauauuccagcccucuaaggguuagaaaauuagaucuuuucucuuucauagcguauuuauugacuugaaguucaauuuagccuagucucugugagugauuuccuuaacucacagaggaggagcugcuuugacacccaagagauggcaucuuaagccugucuuuacauucaagcugucagugugcagccaaguccuggcuaagaagccuucuugcagcagagcugggagaagaacaaaaagcuuggguguguguuauguagcugaagcucuccugagcagaagugguggcuuguugguguuguucugccugaaugggggucagcuguagccagggccagccacccaaccccacaacaccauguacuggccugugcauuucguucccugcgcugcccugagguugaugaaaucaaauauuuuuccuaagcuggcagggggaauuacucuuaccuaaagggggaaacuugagaaagcaaagaccugguauucuuagaaaauguuaaauuugguucuuggcaaauuugauuuuuuuauuaaauuuuuuugaacauuauauguggaucaaaaauauaaaaugguagacagugaaaagucucuuuuauuccccuguauuccagcugccuauuccuuuacacauauauacgugaaaccaguuuuuauuacuucuguaucauuuuugcagauacagaaaauauggauguauaguuuuuauuuucccccuuauuacagagacacauuauauacacuguucuguguucccuggagagauucccuacauugcuugagucucucuuucaauagaagaacaagagaaguuuaauaaagguguguuucuuaauuuuauagaaagcauggcuuggauugaugggaaaacagauuuacauggauuugauuggauaucaaagauaaugagaguuccugacaaggguuuaugaugccuuuaaugaagcuuguagcauuaauguauucugacucuuagaaauuuuuuaaaaacucccagcgagugggucucuggauuaccaauaaugaaaacuuccauuuaccuaucaguuuggccagugaucauuuuugauaccccugucuuuuuucacuccuaagacgucagguguugccugugaaauguucuuuuuuuccagucuggaauugguuuccggggagcagaggguauagauuuuuuuguaagcucuugccaucugcaaaugcuauagcaccuccuuuuuccuuauuuuucuuuuuugagaacagccugugucgccacuguuuuaccacaguagcccaugaaguucuucagagcucugccauccacucagaacucacuucucuagaguauacugugguguuacagugggguuaguuuucuugauguucgguaagaaugugaagacagacaacuuagacuucacaaugguguaauugugguuaauaauuguaauuggcaaaaucacagagcauuaaauaggaaagaucugaguuggcuuaaauguuuuucucccuuggaauuccuuccauuuuuuuuuuucuucucuucugaugauuaaaauauaaaaccuucaucuuuagucuucccauuuauuucagaucagguaguaaaaaagucaugggauuccuuagucacuuaaguaucaaauaagcuuagagaauggccugcacuuaggaugacaagaugcagugagacuaaauuaacuuucuguuuucuggaaucuguuucagcaacucuaccagauccugacagacuuugauauccgguuuuauauguaugaacuacuuaaaguaagugguguucauaaaccauuaauuuuuuucaggccuguucauuaaaagauaaguuuuugagagaacaaagagaacuuaagcagaauguuucuugauacccagaggauuuagugaaguuuuuaaacuuauauugaggccuccaucgaggaaucuucacauagaaacuuuccaguggaacugggaaaaaaguggccaagucaagggguaccagggacauuauaccuuagaaccucccauagcucuuguugguccauauguuuucucuuugcugcuuuauuaauaccuacugugaauguaacaaaucaucccaaacuuaaugacuuuuaaaaaaugauuauuguuucuuauaauugaguuagccaggugauucuuuaggucucaguugauuugacuggggcaggaugguccaggaugaccucauucacaaucuaggaccacagcuggggcagcagggauagcugaggucucauccuccagccugugaaguucaugcugcuucccauggugguccuccugggguuccuagcagcagagagagggaaaccucaauguauaggcacuuuucaacccucuaccugugucauauuugcuaauaacccuauuggccaaagcaaaucacauggccaagccuagcuucaaagcauggaaaaaccgacuccacucuugaugggaaaagcauugaauauguaggcauauuauagagagacaugccuacagggguggcaggcauuugcagccaucuuuccuugccaugugucgucauccccuucuugcaugagucuuccuaaccuaccccuguagccguggcucguuaaugcagggaaaagugauggguagaaugucuaagagacuuacuaaucccaagcacaaugaaauuugaagaauuacugguugguggaggaaugaucauuuuguuugucuagauaagcacuuaaaggaaugcucaguuuguaaaauggaauacacccauggguccuagauuuuuguguccuggaucacuaagaaccuaaugaaaacuaugaacugccuccaaaaaugcauguauuaauaugcagucuugugaaaaguuuuaggguaguuguagaucuuaagaacaguucuaugaaaugaauguguuuuuauaagaacuuguacgcaccacuuuuuauuagagaaagcugaggugguggauuuaagguucacucuuauggcuaaugggucuuccuuuuugucaguaagaucagaaacacgaaaaaggucgagcuugauuuaucccacguuucuccaugucuucucuagacuaaaauugaagcauugguguggauaaaauuugcagugccaugauccugugaacugucaggcuagcuccuuuccuggaagugcuuccugaguaaucccaugcacucucaccccaugagagcuacaauucagaucucacaguugguuauuuuuaaguaagaugguuugagauuuuguguuauuuaaccaucagccaaagcuaaaguuguauaagcuagccugcccuuaggucccauaaagacauccaacuaaugcaggucuucccagguggacaugugggugucacucaaugucugauguccuuucugcuuucuggagguagcagcuaggcagugaggacauauacuuauuuuugcuaaugagacguagaaucccagaugaaacuugaaaaacgucauucaugcuuaauggucagaaacuguacgagauuuuaaaacugaaauaauuccccaaagaauuucaaagcaugucaguaacuccauagggaguccgacuaggaaacuuggcaaaagaauuaauuaccuuacuguauuuguucagccuuugcuuucauugaguauuuuucacaugccagguauuguggucuuaauuaguuuauuccuuuggacaaagaguaggcaauauagcagaaucaacacuugguaaauuuucucuuugaaaagaaaaaacaggaguggggaagacuaaauauuuaacuccuuugaaaauguagaagcaacugaggcugagggcugcagugugaugacucggugacuuaaccugaucuccugauucagauucaaggaggucugcccucacaaccccugguuucauaaagcacugccacaaaggcacuuuggaaucuugcuacaguuauuauaaaacagagggaaaaaauugaaguagaauguaagugaaguaaauaaaucuuaaacguacagucuuuuggauguuuguguauguaaaacucucacccagauuuacacaggacgaugauauccaguauaguuaguaaccacugcccauagguagcuauuuaaauuaaguaaaauucaaaauuuaguugcuggccagacucgguggcucacgccuauaaaucccaaugcuucgggaggccaaggcagguugauugcuugagcucaggaguucaagaccagccugggcaacauggcaaagccccauagcuaccaaaaaaaaaaaaaaaaaaaaaauauauauauauauauauauaugcaugcuccagguguagugguacaugccuaugguuccagcuacucaggagguggaggugggaggauccacuugagccugugaggcagagguugcagugagcugagaucaugccacugcacucuagccugggcaacagagcaaggcccuguacaaaaaaauaaaauaauaaaauaaaauuuaguucccuaaucacacuaggcacauuucaggugcucaguggccucauguggcuaguggcuaccguauuauagagugcaggaauagaauauuuccaucauugcagaagguccuauuggacagggcugguagaggauauugugaacauccugcagggcucucuuguguucuucuguucagugucuccucugaagauuauaucuuuauauguauccccauaguuaguagugccuguucuugaucuucaaauaacaagcauucuuucuuuuuuuaucugucgcccaggcuggagugcgguggcaugaucucggcucacugcaaccuccaccucccggguucaagcaguucucccgccucggccuccugaguaguugggauuacaggcacgcaccaccacaccuggcuaauuuuuguauuuuuaguagaaacgggguuucacccuguuggucaggcuggucucaaaacuccugaccucgugaucugcccgccuuggcccccaaacugcugggauuacaggcgugagccaccacgccuggccauaacaagcauucuauauuguauacucuugguucagggaaaagcacagaucgagggagcuuauuccuggaaugcuaauccuagggcucauucucugccuuguguacuccuccagcaugaagaaguccauucaaguguccucaagagucuaguuuauugcuucuuauccaggucaagcuugucccccaggggacauugggcaaaaucuggaaccauuuuugguuguuaaaacuggaggggggcucuagugguagguagaggacagggauucuacuugaagaguauuucauugaccuuguguaggauucaggugcuuguuaagauuagccaaagguccugaauuugaaguuuaugaagauaguuauuauguuaggcaagggagauuuagaagcaaauuuuuacauuaaaaaaauggagcuuaacaaucuaauaaaugauugaaagauuugaaucagcauuucuccaaagaagauuuagaauggccgguagacacauaaaaagaaguuccacuucaucacucauuauggaaauaaaaaucaaaaccacauggagauaccacuuuacacccaccagcaaagcuauaaucaaaaaguugaacaaugacagguguugaugagaauguggagaaacuugaacccucagguugcuggugggaguaaaagugacgcagccacuuuggaagauaauuaggcaguuucuuaaaaguuuaaacacaaauuuagcauacaacccagcacuuccaccccuaggaaucuacccaagggaaaugaaagcaugaguggaaacaacccaaauguccaucagcuaguaguggaauacuacucagcaaggaaaaacaacuuggaugaaucucagaaacaguauacugaaggaaagaagguagacaaagcacuauacauguaugauuucauauuaugaauguacagaaaaggcaaaucuauaccagcaaauagcaggucagugguugugggcagggcacggagggguugggagaaguuaggaaaggggauugacuacagacaagcucaagaaaaauuuuaggagugauggagauguucuaaaacuggauugugguaaugguugcacagcuuuuuaaauuugugaaaaaccauuauauacauaaaaucuuaucugcauaucaaucaucuuaaacaaagcaauuuucucccuuggaauaauauguaaugauaauuguuuuuuuuuugagacccgcuuuguugcccaggcugaagugcaauggugccaucucggcucacugcaaccuccgccucucagguucaggcaauucucgugccuuagccccacaaguagcugggacuagaggugcccaccaccuugccuggcuaauuuuuuguauuuuuaguagagguggaguuucgccauguuggccaggcuggucuugaacuccugaccugaagugaucugccugccuccgaaaguucugggauuacaggcaugagcaccaugccuggccuuauaaugauaagucuuaaaggcuagcuggcucagggauuauauuaaggaaaauacuaauacuuggucaucuagaaaacccacgugggacccuuauguacaaaauaagccauacugaaagauguauuugaaugucauucuucauguccacauagaugcuggucuguccuuugaaccauuaugagaggugacuccagugagguuccaaagucugguuuaucaucccacacacacaccccccuccccacugcccgccuuucuugcccaggcuggagugcaguggcaccaucucagcucacugcagccuccaccucccagguucaagcaguucuccagccucagcccagucgaguggcugggauuacaggcacgcaccaccacgcccagcuaacuuuuguauuuuuaguauagccguguugcccaggcuagucucgaacuccugaccucaagugauccaccugccucggccucccaaagugcuaggauuacaggcaugagucacugugccuggccucaucacccccucuuuuaaagaaaucuuccucggcugggcacaguggcucacaccuguaaucccaguaccuugggaggccgaggcuggcggaucacgaggucaggagauugaaaccauccuggcuaacacggugaaacccugucucuacuaaaaauacagaaaauuagcugggcguaguggcaggcacuuguaguccuagcuacucgggaggcugaggcaggagaagggcgugaacccgggaggcagagcuugcagugagccgagauugcaccacugcacuccagccugggcgacagagcaagacuccaucucaaaaaaaaaaaaaagaaaucuuccucauagcccuugccauucccuucauacccccuuucuaccagcuguagugugcagagagagcaaggggugccuucugaagcacgcuuuuuuucucuuucauuacaggcagcaagcugcccguugggggacuguauucaagucaaggugucacaaacaauaagacuaugcuugcguugggggaugguagagggguugcuuacuauuaucugugcuuucuuaccuaauaggcucuggauuacugccacagcaagggaaucaugcacagggaugugaaaccucacaaugucaugauagaucaccaacagaaaaagguaccauuacagccaggcagcaacaagcuugauuaaaaggcuuagagcagaccaaaaagcuguccagugccaugaugguuucuguagacccgugguggguuuuuuggcaaacuuucguuacugugauuucucccaucuccauuguugauuucuacuuuguauaguguaguacacaaggaaaguagacgguuuaacuauaguaacuaacuauagucacuuguuuauuuuggucauaguuuucuggagggccucagaaagaaauuacagcuggugguuucugcuucauuucuugaugacccgcagaccaaucugccuggccuuaaaagaacacuugggucccuccuauuuuugauauccaacucuguuggcccuaaucagugaguaaauggaucaucuaguauuagacgaauaaaucauuagagcaaugcuucaguccuggagugggauguguguccccagcccuuucacugacgccuggagcuuauaacgaaaagcuaugaaugaugggagaauguguuaccaaguguaacugccuacaguuucugaaugugggcagaaaaaaagguugagcucuguugaucuagagagagggaugaaccaggauaauuuaaaauuuuuucaaaaagcauuucaaguguucugcucuaaaaaugaccucuugcacgauugcugaaaauguaauuuuuaagccagugcaccugcucacauuuuuuguguggccaaaugauuguuaccuaaugugauguggccuuguucuaaggcauaggcgucuagaaacacuccuuucacauguuuuuuucuguccuauuuguagcugcgacugauagauuggggucuggcagaauucuaucauccugcucaggaguacaauguucguguagccucaagguacuucaagggaccagagcuccucguggacuaucagguaaacuuguuagcagagcuauucuggguuauuuauacuugcuuagggcuuuucugguuugcuguugaucuagucaguuugaauacacucaaaacccagccauuauuucacccuaaaaugcugauuuuaguuuuuucucagcuaguuuuuuggggggacagagaaguuuuuaaaucuaaaauaucugcaaagguuaaaugaagacuagaaauucagaucauuucuaggagccaggaaguuaaaaaaaauuuuuuuuaaauaaauuaucuauggccauaccacccugaacacgcccaaucucgucuaaaaaagaaauuuauaucagaaaaauggauuucuaauacccuuggcuaaugcguuguccuuauugccucagauguaugauuauagcuuggacauguggaguuugggcuguauguuagcaagcaugaucuuucgaagggaaccauucuuccauggacaggacaacuaugaccaggugagcaaaugcuuucugguucuuauuuauuugggggugaaugccaaaaaaauagcauccuuagauaagaauacuauccuugagccacuaaguaucacucagugucugcauaugagcuuuucuucaagauaaagaucgcacagaauuuuguguuuaccagguccgcagaaguagaggcagauaaugccaucuaugccaaacuuccaaagugaaucugugaagaagucaggcaccuccuugucuaauaaaacuagauuuuagucauuagauugugaugcccuguacugguccaccucuagaagauuauuaucguaaguuguauuauuuuaaaggccguuuggaaauuugcauucaugugaacuucuuguccuugggucugucugccugcccuggaccuggguuuguaucucguuccuagagguuuagugguguggaagucuucugauuccuuggugcaguguccucacgggcucaugguguguucugugcucagugauuuggucaguuuguuuuguguuucagcuuguucgcauugccaagguucuggguacagaagaacuguauggguaucugaagaaguaucacauagaccuagauccacacuucaacgauauccugggacaguaaguaagagagagagagagagugcuuuaccuuaccccguuucagaaguggaaagguuagccaaaaucacuuucuuuucccauucugauuauaguaaaauggaaguagcccucuuuuuuccuaugcauauuuucuuuuaacuuauugagauauuuggacuuuaugucuuuuaaucauuuuacuucucugagagauaaccuauuaauagaaaagguaaaacaaaaaucauaauguuauagaaaaaaguuuucugguacagcaaaagcuuauuuuuaauggccaaacuuggagagcaaugauucuuugaauaagagacuuaguuuguuuuuuauuauauuuuauuuuauuuacuucauaucucuucaagguggacuuacaauuucuucuuguucucuguaauggauuuucuauacaauagcaaauuuuaaagcacauugaguuuucagguacauugcaauaauguugagaaguaaacauuuuguuaacaguuuucaaacaguauuuuauggaaccucccuguuucugaggcuagcccugggaaauauaucugcugaccaauaaaaauugcccacucuucugcaugccacccagaauugacuaaaagucuacagcauaaaaaauaaucuagaaagguuccacauauucuaaaugagauauagaaguuuuaccuaguuguauuuuucuaaucacagagcaccauuguguuucaggaugcuaugcuguaacuauggggccguagggcaggcaccaguuagagauuuaacaagcuuguaaucaguacauuauucugagauuuuguuggcuuuagcccuaguagauaaggauucuuguugaauuuagucucugguuacuaaugcuucauuuuucuucucagacauucacggaaacgcugggaaaacuuuauccauagugagaacagacaccuugucagcccugaggcccuagaucuucuggacaaacuucugcgauacgaccaucaacagagacugacugccaaagaggccauggagcacccauacuucugugagucuccagggacuguguucagggaguaauucagucaagagaacaaaucuuccacucuuugucuuugagaccagucaggagaauucuaggguauuuggauuggauuauuccuagaauuuggccucauuuaucguagaugauugagacaacuuugcagauccguuucuugaucaccaaagguguuugcuuauucacugaauguaucuccccggaguucaagcuguuugacuacucccuguuacccugaguuaauagaucgcaaguuucuaaaauuucuuuuuaaacauacauauauuuguguggaaaccuaauugaagauuauuucuccccucagaaaacuaguaauuaguuaaaaguaguaagauaacuauuguauguuuugaaagaaggagaugaacagauggauggacgaaaggaauuugaggaaagggaaguaaguguggagaggccucacugaaaucuugacugaacugcucacuuagaaguguguguggauucacuuugcguguuugcuuauucuucugcauguguaugguucuuuccucugauaacguguguuucaaauaaacuuccuccuauuaucagucuccuuccuggggagcagggagguugagagacuuaccucagucgcuuucugaaucaagagggaaacguucaccccuuaaagucguugucucuggcuuaacaaacaugcugucuuucccucuccuuugauuuccucuggagaugaacuaaauucuugccugaagaaugugucgcuguagucuugagccuguggcccauaugcauaagggagaccgcaaauggaaaagccuucagccuucuagaccucagccccaggaaacucagauguccccgccccagugucuggcacagaaagcuguuuuuacccgaguuagaucaaauuaggaauacugauguuuaugacaugucauuaaugaucuuucugcuuuucugaauauaugucauacuucaauuuaaaaaauuucaaacuacgguugcuuaaaauggauaggucuucugauggcucuuuuuacucaccuuuccuuugaagugcuuguuauucuacaugcuuugaagaaauuagggguuagagaugauauuaauauugaaagaaaauaaauguagaaauuugaacagugggaaauuagaguuucuaugccucuuagcauugagucuguacuccgaggaaggguaagaguugacugcaauaacaauuucccugaucauuuuucaguguuugguuuuuauauggcuggaauuccgugauuuccgucucuccuguugccccccugacccuggcuugcccaucagucugucucucuuuccguugaaaggguggguuugccaugggcuucucucagcacucaccacccugauugccugacuuuccuccugcuuucuugcagacccuguggugaaggagcagucccagccuugugcagacaaugcugugcuuuccaguggucucacggcagcacgaugaagacuggaaagcgacggguaaugcggcauugaugcuugccaauaaaaccaaccaaccaaacacaaaccuugaaggaaaacuacagugugauaaaaagaaauucuuaucauuccuucuaaaugcacagaagaguaaagaccuaaaagucugucaaaaagcaagaaagaaacuccccagugcuagucuccagggagcugucacuguggcagcauggggaugcaccuaguucaggaucugaaggagcucugccuuuggaaugcaugggagauagagacucggaguuguuguacauuuaccuuuguuuaacagggcaccacuguugaauuaacccauucagucaacaagcucugaaugucugacuuccuaucuauuccauuguggucuggguuuccuuuggugaaauucaggcucaagucuuagcgaaaugucagcagucuauacugacacaccagccucauuuacaaaaaggagauauuaaaacagugacaguauuuuuuuuuuaagcucuuuacaaauccacguuuuauguauuuuuuaaugacaugagcucuccaggaaauguaccucauccccgcaguuuuccuccaaguggauucauuugggagcaaacugcagucacuuucacaagaguccucuuugaugucaggagggaucacgaaaccuugcaaugccaugaacugguccaugguuaucaucaaaaguuccaugcuaagugcauaacuuggagcucacuauaaccuuuguugauuucccuaaccauaaaaucuuguugcuauuuuuuuguugcuuuuucuuuuuuuuuuuuuuuuuuuuuuuuggcagccuuguaaggagaacuucaccauuucccagcacaucccuaugugugcgccuauuuuaaugcaccucucugaaacagagaccuuuuuguucacaaccauaacuaaagcuggaaagucagucuucaggcaaggcgagggaggaaaacaucccauuagaauuuuuucaggaaagacuuauggaaaaaaauaucucucucccaccuccuuuuauccccaugagacacaguuucccacuguaaucaggguaauaugcauuuguaaguucugauaugugauacauuuaugugauggcaaagauaagucugucuugcaugcagguacuagaguugugugggcagggucaucugaaacucaagcaacucagaggaauauacaaggggcuuggggaagaaaauggugcucccggagcaaguguuggauccauuuugcaaaccuucauguuagcagagaaagcuagaguuuguuuaaacaaaaauagggcugauuucauuuuggggacucaggagcaacaugguuuguaggcaguccccucaccccagcugcagggccaugccacagcuguggggacuucacacaccuaggcuagaacuagaggugucuaccacaucacccuuuaagauuucuuuauuaacuauuuaauaaugccauacauuuuuauaagguuagauguuuguuugaaacauuuguuuacauuccauauuccaauaaaaucuuauugguauugguagcagauccuacucuaaauguagauucuauuuuugucguuuggucugugggaacuuaaaauacaaaugaaacucuucucuuauuauagaguugaguuuauagaguaaaaaauaaauaagaucccaaagccaaggaaugcauucaguuaagguucucauaccaaugcugccugcuugcauugcacauucuguauacuaauguaaacauuuguucuaccugaaaaucaaaagcaagaugugagcucuuuggcuaaaccuguauugauaugucaggcagcaaaacucaguguuugagauuaucaaaagccuucuaauaugcccuuauaggcaauccugaagcauugguuaucaucagggagaugugccacugcgugucuuuccugcucccccuccaaucuccuuuaucaccccaccccacuccucagcccucccuuuuuuuuuuuaaguugccugucuggaccaggcaagaggugccuacuggagggucuuggugaagcgguaacuccauuccuuucccuugggucccccaaagguaauaaaaguaccuggaggagaauagucaggugauugaccucugccugucucucugacggugauguaggugcagacaccgccugccugccuuguccugggguuuuguaacugcagcuuugacacaggcauucuuccuuugaagcacacagcuugcuuuuccagcaccuagacuuuuaccucucuucaugccuuagacuuagaccauaacugggcuugaaaugcucaccccuuccugggucuggucuuggcaccuaggcuauuccuuuccaaacugaagugaguccaguuucagaccaucucuuuuccugucuccaaaaaccauuuuuguuuccaaaccuagcucccccgaaauuuuaagacuauuuaccuagauucggagauggucuuggagaguuccaaaaggggugugugugugucugugugugugucugugugugugucugugugugugucugugugugugucugugugucuaauauuuagacuaaaccaugguaaauguacgcacccaguauccuuuucaguuagcauauucuuucuuaaacucaucucaguacuuuucauuuguuugcuucauuaucuuaaacagguuaaaagugccuaugauaaggacuuaauuauuuccuaaagaaaagcaaaaaauguggggaacaggguaguguuauacuaucaucucagguacugccuauguucaagaacauagaccugguauggugagaacaaaagguuccuaugccaaauccagauggcuauaucauuuguuggcuacaagugagccugacugcaagguuugcuucugcugagaaaucccauggugagaguagaacucaugaagugcugagucacauuugcaccucuggugugguggcaguucacucuccccuggaugcugucagcuggccuugcuuucauccuaucccuguaggcaggguagguggcuggguaggagaagcuauugaguguaugacgcagaccaagcuuuccugggccuucucaccaacuagagaagcgcugaugucguucauugaggcacuuaaacaccagucacucagccaggccuccucccagacauucuguaacaugucagcacucacaagguuuaaagcaaauguguucccuugcagagaggaaggugcucucagacugauagauuagaggagacagacaaacucguaauccuuggggacuugaagagaguggcuaggggaagggcuguuaaaagaaaagggaccaauaagaaaauccaucuaaagguagcucuugaggaggaaauuaacuucuugaggggauaaauuagaggguaccaaguuuauguucuggaauguacccuggggagggcgcugcccacuggauuggucccaguggacugaaagguggugcucucgagucaggcgcuuagucccagagagagcugggugccgcggggcucguggucugugccuacucagggaaaugacuuagguucucccaggugcucuguugauaaggauggaagcagaacuacuuugagacacaagcaacaauuggaagaguuuuuuuauaugaacugaaauagaucuaagagagccugguuaacaguuuccuuuaauaccaguucagauuaaaugguuacuuuaggaaccuguguuacugugugagcacccacagaaacaagcaaacuuauuuccuacaaaaaaugaggggauaauaaccgaucagagucacagucguuucaauauaaacccuuccgaaagcaaaagcagggaccacaugagcacacaagaagccaaaguuugucagugaucuuaauaaauuaagacugaguaacauccugccuuuagaaaaaaauaaccccgagguggagaccagggcaggggagguggcggagaagcaucgggccagaucaaccguuaauaacaugcuucugagcuauguggauguauaaaugaaaacacccccaacuagguauuguagaggcuggaaaaagaugugaugggauuauacaggugaugcauauuuuuguuuugagacucaacaaugugcuacaaaugugauacuuaacccugaacugcauguauuggggauuguuuuuuaaaaagaaaaaaaacaacuuugaaucaauaaauuaacaguuuuucacuugcuggcucuucuugcuguaaauggugacuaagagguugggacagaaaucuugacaacuaguggaaaacuuggauaaucuucaaggaccauggagccuucuguuuccuucuguuugcagaaaagcaacacugccuggguugugauccuuuacaagugacuacuucagacacaauuggccaccucuuuguaucacuggaugacugauguaugauuuaugugcugcugcccuuagagggaagaaaaaugccauguuaaauccuguuuucuuaaauaaaaauguugacaauaaccagccuucccaagugggagacaaaccauugcuaugaggaccuuaacuuguauuuccugucucuuugggggagaggggagggauaaaccuugaauugcaaagauguguguuacaccuugaugugaaaacuuuccuuuggcagaaguggggcuagagugguguccuguugggaguguuccguuuuuauguacuugcuucugagucgcgccacucagacaccugccucuugggauugacuguuuuagugcaugacuuuaaccuuguggccuggugcucugcauuugugaaacacucucccuagccccauuccuugcagcacaugcuauuauuuggcagguggugguaucuuuaauuaaugugcuuucuuuaauuagugugcuuucuucucacugagccucugaaguugggugcuuggaaucagcugaaguguuuaaaggcaaauauagucauuucuuucuuaaccucaugcaccaugcagcccuucucaaaucaaauacuacgcaguggaacccuuccuuuacccaaagaaaguuuucaugaaaugauuuugugugugugacagcuucccaggugcauaguccuuccucaguacuguagugcuguucugggaggcacugcuucuagaauuccacugccggcaucucaccacccacuugcuaugcuggaccuggaaggagaaaugagguuuucaggccaugccaggcagcuagcuguuuccaggggagaguuaaaaauauuugagcucacuuacugcucuuuguuuauuaguggacucagcccuuuuucugaguaaauacagaccccgucuuaguccuaagacaccucagauaaucaggucaggucugagggggaccuagagcugacugcugaauuuguagcuugacuggcacagaauggucaagaggcucugaggcuucuccaucagcacccuggacccgagggaugggguagaguggaagaccuggucacaacacacguggugcccagagcacccguccugugacagaaggccgugcuagagaccaucucugucaugauaaucagaagaggaaggcagaggguacuguuggaaaccugaacucagcgaguucucacaggguucuccaccaaguggcaugggagggccgagcuugcauucuagcacaggcccuccuacacguggaggccuccccucgcccgcucagguugauuaaugacgucuuucccuccucccgucucuuuccccaggucuguugcgguucucccacuuuuccauaagcagaacaagaaccaaaucaaacgucuuaacgcguauagagagaucacguuccgugagcagacacaaaacgguggcagguuuggcgagcacgaacuagaccaagcgaagggcagcccaccaccguauaucaaaccucacuuccgaauguaaaaggcucacuugccuuuggcuuccuguugacuucuucccgacccagaaagcauggggaaugugaaggguaugcagaauguuguugguuacuguugcuccccgagccccucgacucgucccguggccgccuguuuuuccagcaaaccacgcuaacuagcugaccacagacuccacaguggggggacgggcgcaguauguggcauggcggcaguuacauauuauuauuuuaaaaguauauauuauugaauaaaagguuuuaaaagaaacguauggagaguuuucaguauggaaagggccgugaacugaggccugugacucaggaugagacaaaagcgcauucgugccagguucuaaccagacgaagcaggggaggucccugggacaaggugggccaguuuucauuuuuguuuuuaaacagucuugcucugucauggaggcuggagugcaguggcgcaaccauagcucacuacagccucggccuccuggccucaagugauccuccugcuucagccuccugaguagcugggauuacaggugcaugccaccacaccugacaaguuuucuuaaguuuuuuuuuuguagaaauggucuugccacguggcccaggcuggucucaaacuccugacucaagugauccucuuuccuagucccccuaaagugcugggucuacauagaggugugagccaccacacucagccaaggagggcccguuuguaaggacucucuuccagagcugagugguguuaagagguacacagugaaccaguccuaggaauggggacaauauggauggcugaaguagacucagccaggaaaguggggcuuugccuugaacacauuccaacuggccagcauccucccuggccucuccuucaaaugagagucaccuccugugaaugcaggaagaugccuuggcccuuucuugguugccccuuugcucccaucuccacauuucaucccaucucaauccuguccccucagcaccugcuacugaagaaaggccccgucuuggaggcugguugaguuugcuguccugaggcaggagaggggucgaggucucugaucugagggcugcuuuugaccacacauucugaagcacccaugaacuggaaggaaaagcagacacucagggagcuagaacagaagcacugguuguauuuguuaaaugggagaaacccaaugcuacaaaugagacuucgcuggcucccaugguccucagcucaagacaguggugccagggcaggugaaagcaauggccaugaccuuguacuggcugcugguuuguguccucccacugccuguaggacagcaggagcuaugggcagaucuagacacccaagccacuggauggcacgccagcuaggucuccacaaaagcaacuugguccacacaacauucucuguccucugcagcuaguucuggcccauggugggaacccaaguguggauguucacaguuuuugaagugacuauggaggaaagcaggccccuuucagggccaccacagcaucgugguguccuuuggaccagcuucuguggcaucuaagcuguugcucaggugugggagcuugagacugugcauccccccuggacaccagcaggugaggacccauaggccaccaccugugggacacugagcagauagacuuggugcuuucuagccccaucacuggccuaauuuucucaagcuggcugucucggggcucuuugugacucaaggcugugcaaauuucugugagucucccagaucucugggacugcaucaaaacaccuuguuguuuuguuguacccuguaguaccuaggaacaugcuucgugcgugcauguuuaucuccacagcauguaucugugcuacuuagcgugacuuacugccaucucaggucuucuccagacauagagggucuuauucgaauagaaucauuugauuggcuugcaucuuuagaugucauguagaacuuggaaccauaacucccuccuccaauuuccccccucaaccaaggcucucuuuaacugcuccguguggaaaucauguuucacaaauaauuuucaguuuugugggugauuaugguuggguugagaaagugugugguuguagaaagaagagaaaggaggugauuuuugaguagguuguuuugacuuuugaaagcaggggacguccuaacaccugcuaccacaaaaacugucuucagcuccuccucagugugcuuggagauucagaacaucagcucucaucucccagugguccugguuguguucuaaacaauauugauugcauuuuccugauuaccaaaauaauauauguuugugguaaaaacaaaaaaaaauucaaaugcuuacagagaaguaaauaacgaaagccccagcccccagccacacacacacacacacacacacacacacacacacacacacacacacacacacaccccaugcucacaggaaagccucuuccucucuuagagauaaucaccauuaaauuuuguguauaucuucccgguuuuuuccuaugcacuuacuauuuuaaaauua

SEQ ID NO: 15747 - RNA, 3892 nt, Homo sapiens
cgcggugcgccggcccgcgaggaaacgcgcucuuagaccauggcgacccaggcgaagcguccacgggugaguggcgggcgcgggguccagccuuuuccuccgcgccucaccccuucuccguucgcagaaccguccgccugcgcccccuccgcucccucccgcgggucccgcgccccucuccgcucguccccuccuccacccaaagcccguucugcgcucgcgccgcggucuccugcaguucccagcggccucucugggggucggaccuggucacugcgcgcacuuaucucagguggcggggcccguggacggcggcgaccuggauccuguggccugcuuccugagcuggugccggcggguggggcuggagcugagucccaaggugagcgagcgagccggcgggcggaggacccgcggcggggcgcgggcugcccugaccagcccuccugcucagguggcggucagccggcagggcacgguggccggcuacggcaugguggcccgggagagcgugcaggccggagagcuguuguucguggugccgcgggccgcgcuccugucgcagcacaccugcuccaucggcggccugcuggagcgaggugggcacggcggcgggcuagggcccuggggcggggcggggcggggcggggcgggcccggcccgcgaggccgcgccggggcgcucacaccugugucuuccucagagcgaguugcgcugcagagccagucgggcugggugccacugcugcuggcgcugcuccacgagcugcaggccccggccucacgcuggaggcccuacuuugcgcucuggcccgagcugggccgcuuggagcacccgauguucuggugagagccuugggagggguuggggagcgccugcaccguagccugcugcaagaaguuuccccgccccugcaccaguccuacccaguaaagugugugaaggaaugaagggaaccugggugugggugucccugcaggccagaggaggagcgccggugccugcuccagggcacaggcguaccugaggccguggagaaggauuuggccaacauccgcagcgaguaccaguccaucgugcugcccuucauggaagcccaccccgaucucuucagccucaggguucgcucccuagaacucuaccaccagcugguggcccuugugauggccuauaggucaguggguggggccucugaggacggaacccuuuucuuuacaacucuauagagggacaaaaguggaaaaacagugaaauccacccccagucccucacccaagacagggccuuagccagguucugucaauggcagcuuucaggaaccacuggaggaagaagaggaugaaaaggagcccaacucccccgugauggugccugcugcagacauacuaaaccacuuagccaaucacaacgccaaucuagaauacucugcggugaguggaguuucucuuggugcacugauugagcaugauucaagccauugugucuuaggcuccauucucuuacuagugcuacaaaaugaguaggugaaaucagcuccuccuguauguccuuuuaguaugcauauuacuguagaaucauuugaaugcgaaacauuuuaaaguccucaaaguaaguugugguuaauccucugauaaacuauacuaccaucauuuauuuagugcuagacauugaguggucugcauagccauguuucauuccuuucuggcugaucacaucagugagcccagacuguguguggcucuguggauagcagccuggaacagugauagucuccguguuuuggagggaugaggacauucacaggccaaaggucuaagacgauccuagaacugauauaaagcuguguuuauaccagcucuauucuauauaaaaaguagccugaaaagauggcacauuuauaggaucagaaauuaguaaguaugguuauuucuuaauccuugccuccauuuuccuuucccacuuugaucugcgaaaguuccauuuuuucccccccgaggcggagucucacugugucgcccaggcuggagugcaguggcgugaucucggcucacugcaacugccgccuccuggguucaagcaauucucccugccucagccucccgaguaguuggaauuacaggcuccugccaccaugcccggcuaauuuuuguauuuuuuaguagggaugggguuucuccguguuggccaggcuggucuugaacuccugaucucaggugaucugcccacuuugaccucccuaagugcugggauuacaggugugagccacugcgccuggccgaaaauuucguuuuuaaagcuagcaacuuuuuaagugcugaagaggacugugcagaaauccacccaguuaaacaugaagcuggccuuuuaaaguuagcccaacccuuuuuuguuucacaguuuagggucuaacaggaacuaaagguagaacuuugguaguuaacagcaucagucauggcugaacuacaccugcugaaggcucuucuuaaguggaaauaaucuucauggggcuggcccgugaaaggcauggccccagcuucucccuuucaccucagaauugucuucggaugguagccacucagcccauuccuaaaggccaugagauuuucaacacuuaugggcaaauggcuaacuggcaacugauucauauguacgguuuuguugaaccauauccugacaacacagaugacacagcugacauucagauggugacaguucgugaggcagcauuacagggugaguguaucauuaacucaauauuugacacugauggugugucuauacccaugccucagguuaaauagcuuugcuaaauagcaguugacuuuguagacuggguggcagacuaaagaagaaaugaacccuuggguguacugagacuuucacauugcuguuucaucuacaggaacaaaaacugaagcugaaaggcaccuaguguacgagcgcugggauuuccuaugcaaacuggagaugguaggggaagagggagccuuugugauagggagggaggaggugcugacugaagaggagcugaccaccacacuaaagguaaacggcugaaaauggccauuuaaugcugauaaucuaaguauuuaaagcaaaauagcuagaagaugagagaggaaaugugggauuuuuaauaaaugcuaagaugaguuuagucuccugagucauuucagaaguacaaaagcaguacaucuaauuaaagagcucugugguugcuucuagguacugugcaugccugcugaggaguucagagagcuuaaagaccaggauggagggggagaugauaaaagggaagagggcagccugacgaucacaaauauucccaagcucaaagcaucguggagacagcugcuucaaaacaguguucuacugacuuugcagaccuaugccacagacuuaaaaacugaccaagguuuacucaguaauaaggaagucuaugcgaaacucagcuggagggaacagcaagccuuacagguucgcuauggucagaagaugaucuuacaucaguuguuggagcugacaaguuagcaguuucccuguucccugaaggaacagcaauaagaacuuuauucuaagcuaauacucauugauguuugaaaaagaggaaaauuuggaucuuucuuuugcuuacuaaacaccaagaggaaaaguagcaaaguuggugugcuaggauuaacucagguaagggugauguguuuuaggauugagaacagcagacuugggaaucacugcuaauuguuacuuaaagcauguuacagauguuuuguucucaguuuuaaccaaagccaguggacauacgguaguaauaaguaagucuuguuguguuucagcauuuaauaauagacuuuggagguagaccccugguuuaaaucuaagucuaguuugagga

SEQ ID NO: 15748 - RNA, 794 nt, Homo sapiens
cgggccguaggaggaagauggcgguggggucgcgcguuacccgggaggagauuaagacggagccagagaacccgaucaaccgugagaaaacaugccugcugcugcugcgcaucuucaccaccaauaauggccaccaccaccgaacggacgaguuuucccggggaaacguacaguccagagaguugcagaucuacgcuuggauggaugcaaccuugaaagaacugacaagcuugguaaaagaagucuacccagaagcuagaaagaagggcacucucuucaauuuugcagucguuuuuacagauguuaaaagaccuggcuaucgaguuaaggaaguugguagcaccaagucuggcagaaaggggacugaugauuccaugacccugccgucgcagaaguuccagguagauuacuuggacauagcaauuaccccuccgcaucgggcaccaccuccuucagggcacaugagaccacauuaaauucuauuuacuauuucuuguguuuauuuuuuggucaguuauguaaaauaaacuuacucuuuuuccuccccagauuauugucauuaagccuuugaauucuaagcaaauuauaauccaucaucuauuuaggaauuagauuuggaugugcuauuguauaauuacuaauacaaaguccauauguuuccagccuuuuuguaaaauaugaagaaaugcucuuagcauucuauguaaaacuguacuguuaaauauauguguguaauaaaaaaagcaacagaaaaacagacaaaaacccuucaaauuaaaggaaaucucagagau

SEQ ID NO: 15749 - RNA, 19665 nt, Homo sapiens
caugugaugcaugcucacgugucuccgcagccggcucgggaaagaaucccccaagguagguggccggagacaggcucuggaggguggaaguguuagauccccgaggucuguggagccccucaguccccgccaccgcggaaaagcucagacccuuucccugcagggguccagauccuggcguccucgccccacgcccgucccucuguugcgccagcucugccgcgccuuuacccagccagagggucuccacccaguccuaggccgggaucgggucccggagcuccuccccagguuaccccacaguagcccacccuucucgcuccaggccugggaaucgccccgccccggccuccuggcccgggugcgcccuggcucaccucacaaagccucaccucacaaagcagcccacccuuucuaucucagggcuccaaccccaggcuggacugggagcacacuccaguugggaucugaggggccuacaucgcuggccugagcaugugggcaucaggcuucuauucuggcucugccagcuacccacugugaccuuagucuaaccucucccuccugggccuguuuuccuaucuguccugaagcuccauuucaugaguaagcgugagagccgcucaguuuccuccagcucugcugaagccagcacagaaguagcccaaacucuucccucugcugacagcaaauuuuaggcaaagucuugagaaagaagaaauuggguccagaaagggaagugaggagaaucagaucccagaccuuuggggagaaggagcaaccgccucuggcacagcccaucagggagaaagagcagguaaggugcaacaaugagcugaguaauuugccagugagcagugggggugccgagaggucuuaaccaaggcagagaaucugcaagaggugggacccccagcuucugaguuccacgaggaccccagccugcacucucauguggguggcaggagaggcuggaggauggugcaggacucgggcaggggugcccaagggaaacauuuugguuggagagucaggaagccgcaccaagccuugugaccuuggacgaaucacucuguagaccucugucucugugacgugagcagcggggaggagauggucacagcucuggcaguggucacuuugcaggguucuuucucuagcuacacuggaagccugggagucccaagacucugccuucgcugcucacugcuuugauuuugcugaguugcugguugggugacaggauguguaagaggauguguaagcccugugacaucugacagaucuuucuggguuucgagccagcagaggaauguuuccucuggugccaugucccuugguuccaugcuugauaacagauggcugagagcacaugaacuuucacccuuucccucucaugaguggaugguccccagcuuuguuuguccaucaucaggaggagcaaugggaaguaguccaaggggucuuguuagucauuuuaaacccccagugggcugaaggcaucagagaggguggcccaaugguuagggcagucauuauggcugaauaugcucaguucccuuuuuuucccucugggcuauaaagacuaaaccaggcugggggcuguggcucacgccuguaaucccagcacuuugggaggccgaggcagcaggauugcuugagcccaggaguucaagaccagccugggcaacauagugagaccuccucaucucuacagaaaauuuaaacaugacaggcguggggggcuugucacgugggagaagucacaugggagaagaguugagaauuggccugaauuuugaaaggccaauuuuguuccccacaggaacaaaaaauuuaaaaaguuggccaggcgugguggcucacgccuguaauccuagcacuuugggaggccaagggggaucacaaggucaggaguucaagaccagccuggccaacauggcaaaaccccaucucuacuaaaaauacaaaaauuagccaggcaugguggcgggcaccuguaaucccagcuacucaggaggcugaggcaggaaagucucuugaacccgggaggcagagguugcagugagcugagauugugccauugcacuccagccugggugacaaagcaagacuccgucucaaaaaaaaaaaaaauuuuaaaaguuagcuggcugugguggcacacaccuguagucccagguacucgggaaguugaggugggaggauugcuugagccugguagauugaggcugcagugagcucugauugcgccacugcacuccagccugggcaacagagugauacccugucucuaaauaaauaaagacuaaaccagggagggaguagagauuaaaauggaguuuuguaugaguaccgugaaaucgggacucaggaaugaggagacucuaggagaaggagucuuuggcagauuucgccagccugggugguaaccagcuaauagcagccucuggggaagacugcccuggcuccucccugcccccuuaguuccugcccuugaaaucuggccuucuuccugcucuuucucccauuagcuaucccagggccucugugcccauuguuaccuggccaauagcaccaggcugugguuugaguuuuguuuguuuguuuguuuugagauagagucucacucugucgcccagacuggagugcaguggcgugaucugggcucacugcaaacucugucuccuaauuucgggcgauucuccugccucagccuccugcacagcugggauuacaggggugcaccaccacaccuggcuaauuuuuguauuuuuaguagagaugggguuucaccauguuggccaggcuggucucaaacuccugaccccaggugaucugcccaccucgaccucucaaagugcuggaauuacagaugugagccaccacacccggcccaggcucugguuuugaucaguguucugcucccugcuugcuuagggcuggagagucucaggcauggugguggugggcaacaugggaaggggcaucugcagaaauaacagcagcagugaccauuuauugagucuuaaacccuuacugauauuaacacacgacccacaggaacauaugauguaaaggccuaaaggggcgaagugacuugcccagggucacacagauaggcagcggaggagucagcauucugacggcagaaccuacucggagacccagaucacagcccugcccagggcugcucuugaucuggggguggacuugaugcuuuaggaccaucauuucucugcgggucucaggcuaugagcugaaccuugagaacacugaagauccuuuuucagggcugggcuccucagagccucucgagauucuuggaagaaaaaaaacugcaucucaauuguguuuauccagagagcaaagagaaucagucaggugauaagccuguuaucugaguucugccauacccaagguaccaucuuggacccaggaguggggcagauacaaacagauggaugcccuauggucagacaggccuggguuugaaucccagcuccaccacugaccgccauaugacugaggggagagugguuauccccucugggauucagcuuccucuuugguaaaauggugacugucaugucuaccuuuuagggcugcauugaggauugaaugagaaagcauuccauagcugcagcaauagugguuuauagugacaaacagcacugcauguuuggcacugaucauuguaaucuagcccaggaaagcaagccuaguggccagugagaugcuagcacaugagagaguacugagaagaaaccagcuagagugguucugggccccuacauggcuccaagaagagcucagugagugacccaggaaauggggaagaaauaggaccuaaaaggguggcggcaaaggaguugggagcauuagaagcaugggaugaaucacuguuuuccugaagacgcaaacaugacaggcaugggggcuugucacaugagagaagagucgagaauuggccugaauuucgaagggccucgaaagccacagaauucagacuccaggccaccgggaggcgugcuggacuguaauauguugaaucucaguucuugguaagggguccuuuugggacccugugggguggaaacaggcugggaagccagacagaucuggauccaaauccugcuaugcaacuugcuaauauaugacccugggucagugaugggaucucuccgaaccuuuugaccacaagaccauccuaaggauugaaugagauaaaguauauccaugacacaccugcccgaugcggggccucuaucgagugcugauguguuaguacccauuuuauguugacaucuaacugguccauugagucuguaugccugaagcaagcaugauuugcaccugaucuguuucugugucugucuccccauacucuggcacccagugcacugucugcacagaggcauaccuggguuuggacccuacccaugugaucuugggaaaguuauuacaccuuuuuguccccuaguucccccaucuuaggauaacaguagugccugccuuugucccaucuagguugagaagaguccuaagcuaacagccccaaacagguggguguugcucagcucccugaggcaugugguuguaaggcagaacccacagaccuugcaggaagaaggcucucggggccauggcccaggucagcaucaacaaugacuacagcgagugggacuugagcacggaugccggggagcgggcucggcugcugcagagucccuguguggacacagcccccaagagugagugggaagccucuccugggggucuggacagaggcaccacuuccacacuuggggccaucuucaucgucgucaacgcgugccugggugcaggguuacucaacuucccagcagccuucagcacugcggggggcguggcagcaggcaucgcacugcagauggugagugcacuggccgggagggcagaggugcaguucaguugggcgcuuugccucaaaagggaggcuucgggucagggauggccaguaagugauacacgcacugcucuccccucccucacacauggcagacaugacuaaucuauucuaguauucuuuccugugacccaaaugaggcuucagaagccuuccaacaaucagagaaauuugaacaucaauuacaucucuaauuuuuuagguguaacauugauuuugugguauguuuaaaaagagggcccuuaucuuuuagaacuacauacugaaauauuuauugaugaaaugauaugauagcuuauauuggcuucacaauaaaugcagagugggagggaaggggaaugaugaaacaaguuggccaugcauugaucauuuuugaagcugagugauggauacaugccaguucuuuuuacuauucucuuuacuuuuuucuuugagauggagucuugcuuugucacccaggcuggagugcaguggcccgaucucggcuuacugcagccucugccucccaguuucaagugauucuccugccucagccucccaagucgcuggcauuacaggcacccaccaccaugcccagcuaauuuuuguauuuuuaguagagacgggguuuuaccauguuggccaggcuggucucaaacuccugacuucaagugauccuccugccucagccucccaaagugcugggauuacaggcaugagccaucgcauccagccuauucucuuuacuuuuguauguuggcaauuuuucaaaaaacuuuuuguuuuuaaagaaaaucucaacucggcauccucuagcagucucuuaaaauugccuuugugagauuugccaagcuugcuuugggcacuggcccaguaaaugcuaggcgagcccagggugcccucugcugccaggccuuugccacaagcucuuguucugccucugccugcaggguaugcugguuuucaucaucaguggccuugucauccuggccuacugcucccaggccagcaaugagaggaccuaccaggaggugguaugggcuguguguggcaagcugacaggugugcuaugugagguggccaucgcugucuacaccuuuggcaccugcauugccuuccuaaucaucauuggcgaccagcaggacaagagugagcuucucccucagucccuaccccaucucuucuuaucagccccagggauccugggguggagggaaaaggcacugaacaccucuccaggacuuaccugggcccagcauucaucugggaauccucccuccaggcagagggagguccuggggcccagcagagcaggagggccacaccccaugguggccuggcuugacauucccuccuuccucccugugcaguuauagcugugauggcgaaagagccggagggggccagcggcccuugguacacagaccgcaaguucaccaucagccucacugccuuccucuucauccugccccucuccauccccagggagauugguuuccagaaauaugccagguuuggaggccccagccugggucagacagaagcuaugauccugggcagcuguagacccaagggcuccuggggaacccugcuccuccaugccaccucaccuuggggagcaagaguaggcaaggcagggcagaccggggcuugcaggguuucagauaagaccauccuuuucugucuccaucauagaaaaaggaugcauccaugagagauucaguucuaaauguccuuuugcauccaugaguaguucaguucuaagugcccuugucaaagaaggaacaggugguaucugggcggugaaggcagccuccuggcauucccugggaggaauuugggucuuugagacugucagccuaccagcaucuuaccugcagcuuggcaugaaggaaggagacugguuuccugucucggugucugaaaggcugugggauucuaggcuuccccgucuguaagugcaggggccaugcuccgcucucuccaaggcucccauaaauguugacacaaaagugucuguacucucaacccucuuaccucuggcaucucuuaguucucaaaggccaggcucagaggauggucucccacagccccugcccgggcugggcugcucugauucaagucccaggugugcuuuggagcucugcucucugcaucgucucugagccauggagcugaaccagcacuuccugauggccaggaaugcugaucagguccccuguuggcuguccagcuccuuccuagcuguggcagguuucucugaaacuacuucucaggcguuuccugagucugcuuggcauagucuccgguucauucaguggacacuuguggucgcuagagcugaagguggaugucccuagggguggaaucagauaagaggcagcuggggaugaggacacuuagucucuccuucccggcagcuuccugagcgucguggguaccugguacgucacagccaucguuaucaucaaguacaucuggccagauaaagagaugaccccagggaacauccugaccaggugagggugagggcccuaggagacauggggaagaagccaccacuugggccccagcaggugcugggucaggaaccagaaggccacacaggugcucuucucaaggcucaugagcucaucagggcugacuuggucauuguaggaaggaggaaagagccccugcucugauguuacuggaaggaagagcaagaaucagagacaggaggcacuuugccaccuacauccaacagaugagccagugugaggcuaggccuuggguuguggaggaaccugaggguggaaucccagggucgaauugccuguguuuccagcaucugcuuaucuguaauuucuguaucuuugagggugaauuuauuauuaaaaaaaaagggggggggccaggcacaauggcucacgccuguaaucccagcacauugggaggccgaggcgggcggaucaugaggucaggagauugagaccauccuggcuaacacggugaaaccccgucucuacuuaaaaaauacaaaaaaauuagccgggugugguggcaggcgccuguaguagcagcuacucgggaggcugaggcaggagaauggcgugaaccugggaggcagaaguugcagugagccgagaucgcgccacugcacuccagccugggugacagagcaagacuccaucucaaaaaaauacaaaacaaaacaaaacaaaaaaaacaauuuccuucuuuugaaaggaacaaaccaguaaagcaaaagccccaguccaggagccaggaauucuggauuuuggccccaggggggcuuuucugaaccuccaggccccaucccagagggcccugggacauaaggaugccucuucucccuguucccagacuucuguggguugaagcuauggaaucccaguugcuggagaccauggugggcugaccgaagagugagggcgugggguggguuguggcucugagggguucccagguggcagcaccauguguguuuguucacaggccggcuuccuggauggcuguguucaaugccaugcccaccaucugcuucggauuucaggugccagugccaguugcaaggucccugcuguccccuuagaucaccccacccugggauggaacccagcaaggaggaggaacccaggcagaauggaggaaauccuggggggaaggauggaacaggggccucaggacuugccccuuguuccuggggucuuuguucccaagguaccuuccucuggaaacugggguugaggucauuuccccaccaugacggugcccuucaccuggacagugccacgucagcagugugcccgucuucaacagcaugcagcagccugaagugaagaccugggguggaguggugacagcugccauggucauagcccucgcugucuacauggggacaggugagugcuccccccccccaagaccugggacuagagugcucucacuuccacaggagucccuagguccuggggccuagcuuuccuggggacagcccugcauucccagcaugacuuguauaggcauuggcuugaacuuggccugccuggagccuccuccugccaagaugagagugguguauucauccauucauucaccaguucuaacuuggugccuaggaagugccaggaacgguucucagcaugggggaugccauggagagagacagaacuggucuugcccucauggaguugacauucuuguuggagagacagucaugcaggaguaacuggggaaucaguaaggaauuccagaugguggcaagcauccugaugacagugaaauagggaagguguguuuuguuuuauucuauuuuauuuuguuuugagaaagggucucagaaacugucgcccaggcuggagugcaguggcaugaugauagcucacugcaaccucaaccugcugaggucgagugauccuccugccucagccuccagaguagcugggacuacagccaugugccauugugcccagcuaauuuuuuuuuuuuuuuuuuucuagcagagacaaggucucacuauguugccuagccuggucuugaauuccugggcucaagcaauucuccugccucggccucccaaagugcugggguuacaggcaugagccaccaacccagccuaaaauggggaagguaugaaugggacuggauggguggcuuugggagugguucacagaagguucuucucagagaaggcccaaaugaugagaaagagccagaagaggaggagcuggggaagaaggguuccaggcagaggaaccacaaaacaccaaaucacugaggcagggccaggaagaaagucuauguggcuggaguggugugugaugggggcaggugaaggcagugaggccagacaggcacuggcagccagauccuguugggccucgagggcugcugggagucaucgaggaaguguuuuaagcaggggggugguucggggaaagguggcucuggcugccguguggagagugguuggggugagggagcaagucuaggagacccuggaagaaggauccccugaguucuuuccacggauagaccguaggagcugccugggccaauacuguucuagccucugaauacacagccaggaacaagagaggcaaacagccaaaucccuauucuccuggggcucauguccuggcuggggagacagaaaauaagccuguaaaaauuaauuacuauuauuauuguuauuauuuuuauuuguauuauuguuuacuuaaagaccagugugauaguacaguuaaaaaaaaauuagaaagcgaugaggccagucacaguggcucacaccuauaaucucagcuaugggaggccaaggugggagguucucuggagcccaggaguucaagacaggcugggcaacauggugaaacuccaucucuacaaaaaauuuaaaaauuagccagguuaugguaacaugcaccuguggacccagcuacuugggaggcugaggugggaggaucgcuugagccuaugagaucaaggcuguagagacccaugaucaugccauuacacuccaaacugggcaacagagugagacccugucucuaaaaaagagagaaaugaguguuaggggacaggcccaguggaucaugccuguaaucccaacacuuugaaaagcugagaugggagaaccgcuugaggccaggaguucaagaccagccucggcaacauagugagacucaucucuacaaaaauuaaagaauuagcugggcguccgccaggcaugguggcucacgccuguaaucccaggacuuugagaggccaaggugggugaaucacuugaggccaggaguucgagaccagccuggccaacauggcaaaacccugucucuaucaaaauuacaaaaauuagccgggcguggugguggugccuguaaucccagcuacucgggaggcuaaggcaugagaaucacuugaaccugggaggccgagguugcagugagccaagaucgcgccgcugcacuccagccugggggagaaagugagacucugucuucaaaaaaaaaaaauuagccaggcaugguggcaugugccuguagucccagugacuugggaggccaagucaggaggaacuugagucuaagaauucaagacuacaguggaacuaugauuguaccacuucacuccagccugagugacagagcaagauccugucuuuaaaaaaaaaaaaaaaaacggccaggcacuggggcucacgccugugaucccagcacuuugggaggcccaggcaggcagaucacaugaggucaggaguucgagaccagcccaaccaacauggcgaaaccccaucuuacuaaaaauaaaaaaauuagggcugggcgugguggcucacgccuguaaucccagcacuucccgaggcaggcggaugacgaggucaggaguucgagaccagccuggccaacauagugaaaccucauuucuacuaaaaauacaaaaauuagucaggcuugguggcgggcgccuguaaucccagcuacucgggagucuguggcaggagaaucacuuaaaaccagaaggcagagguggcaguaagcugaaaucgcaccacugcauuccagccugggugaaagagcaaaacuccaucucaaaaaaaaaaaaaaauuagccagguguggcggcaggugacuguaaucccagcugcuuaggaggcugaggcaugagaacccaggagaccaagaucaugccauuguacuccagccugggcaugacagagcgcgacuccaucucaaaaaaaaaaaaaaaaaaaaaaaaaaaaauuagccgggcaugguguaaucccagcuacucaggaggcugaggcaggagaaucacuugaaccugggaaguggaggcugcacugagccgagaucgugccaccgcgugccagccugggcaacaagagugaaacuccaucucaaaaaaauaaaaaagaagaaggcuggguguaguggcucacacucugggagggugagguaggaggauuacuugagcccaggaguucaagaccagacugggaaacguagcaagaccccaucucuacaagaaaauuagcugggugugguggcaucugccuguaguccuagcuaccugggaggcucaggugggagaaucgcuugagccgaggaggucaaggcugcagugagccaugaucacacuacugcgcucuagucuggguaacagggcaagacucugucucaaaaaagaaaagaaaaauaagacagcgugaugugagagagugccuggggugggggucauuguagauggacuggcaggaagcauucucugaggaaggacaucuaaacugagacccaaaugauaaggagauggcaucugaaggucugccagacagaacagucagugccaaggcacugaggugggaaugugcugggcaaguucaggcucagaaagcugggggcuggagggcuuccagcgaugggggaucugagaagucagggagggaggcaucugaucggagccccaucucccacucugagccuccgucuaaguguccagagcugcugcugcagccuccaggcugauguugcuccuaggaggaguggacaguccaccccacuacccucccaggguugcccugacccaguugucccugcccacaggcaucuguggcuuccugaccuuuggagcugcuguggauccugacgugcuccuguccuaucccucggaggacauggccguggccguugcccgagccuucaucauccugagcgugcucaccuccuacccuauccugcacuucugugggcggugagcccccuuccacuccccagggccccuccuagccccugugagcgcuuccaacaugguccuuuggccuuguguggaccccauccuguagaaggagaaacugaagccuguagaaaagagucggugccuaggaugggucccuacauaucccaggccaggugucagaagcgcccuuuguccuggggucaccagaacauuccgugaguccuguaagaaucucuauccauggcauggcacgguggcucacgucucuaaacccagcacuuugggaggcugaggcagaaggaucgcuugagccugggaguucaagaccaccugggcaaccuagugagaccccaucucuacacaaaauaaaauaaauagccagguguggugggaugcaccuguggucccagcuacucagccacuugggaggcugaggcagaaggauggcuggagcccaggaguucaaggcugcagugagccaagauugcaccacugcacuccagccugggugagagagccagacccugucucaaaaaaacaaaaaacaaaagaaucucuauccagauccuuuccugagcuuucacauggacacccuccccuuuggaugccccagacaguuccuuuuaaggaaaaaacaauaucaguuuccaugugauguaaagcaaagugcuaagcucucgacauucaccgucucuagucccugugguaaacagagugcugguggcccauuuuacagaagaggaaacugagggucaggaauggggcuuuccccgcagucuacccaguuaggggucuggcuccugugagcuagagguggggagcugcuagcagcaggggcaccucuaagcccuucuccaugugggcagggcggugguggaaggccuguggcugcgcuaccagggggugccaguggaggaggacguggggcgggagcggcggcggcgagugcugcagacgcuggucugguuccugcucacccugcugcuggcgcucuucaucccugacaucggcaaggugaucucagucauuggaggccuggccgccugcuucaucuucgucuucccaggugcggaccccuggcgccccaucucacagccccacagcacagacucccagggccugccuagccucagcucccuacuugcucaaaacaugcaggagagaguaaccaccagcacuaauugaucaccugucucgccucuguacuagccccuauccaagcauuaucuccuggaaagaagguauaguugugaucuccaguuuacugauggcacguggggcucagaaagggucacagacuugccuagagcuuaacaaacucaacuaguaaccuuuuccaucccacgcugucuggguccagagucuauucuuuuaaccauucauucaggugucugcugcuccuugacuaugagggaucuaucuggcugguucagcccauuacagcccagagggcaguggggucugggguggcacccugacacagacaucagggaaccuggguuccagacacagaucuaccgccagaucccuggagaacuguccugucugcccagccaugaguuccacccuuuuccagcuugucucuauccaggaagccacccugaaagccccagcugcuuugcuuggagcaggggagccagaucugcugggaaguguacuaggaagaccccugggguugggccaccacugagucaccauugagugcugucccuuuagcugagucuagcaugcugcccaaggggucuugucagaugccagccugucaugggagagcagaugccagaugaccccagcaggauguggugugggggcagagauggaauuucuagaagaguaaacaugggccuuucuccauccagcacugcuucuugggaaaggagguggcuaggagggagggagcccucuccccucacaaaugcucagggccacuucuucucuuucagggcugugccucauucaagccaaacucucugagauggaagaggucaaaccagccagguaaagcaggacccagcccuugauccucucagggaggugcuggauuggaauguggcuuugugggggccuuaaaacagauaggagucagaggcuuguguacuuagaaaucauggguuuuuguuuuguuuuuuuuuuuuugagccggagucucgcugugucgcccagccuggagugcaguggcacgaucucagcucacugcaagcuccgccuccuggguucacaccauucucgugccucagccucccgaguagcuaggacuacagaugccugccaccacacccagcuaauuuuuguauuuuuaguagagacgagguuucaccauguuggccaggccggucucgaacuccugaccuuaggugauccuccuuccucggccucccaaagugcuggcauuacaggcgugagccaccacacccagccagguuguuguuguuuuuuuuuuaauacuuuuaaaaauucgguagugugcuaguuguuaacaauuuaaacauuaauaaagggcuuaauacaaaaagauggaagucccucuucccccacaacccacucgcccccacauccuuucugagauagcuccauguuaccaguauggucuguguccucaaccacuucuguacaugugugcgugucuguguacacauagcuauggagauguauacauagaugcagggcucuuguuuuguuuuaugaaaagugguuucagccaggugcauuggcucaugccuguaaucccagcacuuugggaggccaacaugggcagaucacccgaggucaggaguucgagaccagccugaccaacauggugaaaccccaucucuacuaaaaauacaaaauuagcugggcaugguggcaccugccuguaaucccagcuacuugggagacugaggcaggagaauugcuugaacccaggaggcggagguugcagugagccgagaucacaccauuacacuccagccugggcaacaagagggaaacucugucucaaaaaaaaaaaaaaaaaaaaaaaaaaaaagccauacaaacaugucuaaaaaagaaaaaaaauuggccaggcacagugacucacgccuguaaucccagcacuuugggaggccaagacaggcagaucaccugaggucaggaguucgagaccagccuggccaacauggcaaaaccccgucuuuacuaaaaauacaaaaauuaccugguugugguggcgcaugccuguaguccuagcucgggaggcugagguaggagaauugcuugaaccccggaggcggagguugcaguaaguggagaucgcaccacugcacuccagccugggugauagcaaaacucugucucaaaaaaagaaaaagaagaagaagaaaaaaaaucacccuuuauuucuuuuuuuuuugucuuuuuuuuuuuuuuuuuuuuugagauggaguuucacucguugcccaggcuggagugcaauggcgcgaucucugcucacuacaacaaccuccaccucccggguucaagcgauucuccugccucagccuccugaguagcuuggauuacaggcgcccaccaccacacccagcuaauuuuuuggguuuguuguuguuguuuugagauggaaucucgcucugucacccaggcuggagugcaguggcaugaucucggcucacugcaaccuccaggguaucugggauuacaggugcgcagcaccaugccuggcuaauuuuuguauuuuugguagagacgggguuucaccauguuggcuaggcugaucucgaacuccugaccucaggugauccgcccaccuuggccucccaaaguucugggauuacaggcgugagccaccauacccagccauuuuuuguauuuuuuuaguagagacgggguuucaccacgcuggccaggcuggucucaaacuccugaccucaggugauccaccugccuuggccucccaaagugcugggauuauagacaugagccaccacacccagccuaauuuuucuauuuuuaguagagaugggguuucgccaucuugcccaggcuggucuugaacuccugaccucaggugauccaucugccucggccucccaaagugcuggaauuacagacaugagccacugcacccagccuaauuuuucuguuuuuaguagagaugggguuuugccaucuugcccaggcuggucucgaacuccugaccucagguugcccgccuuggccucccaaagugcugggauuacaggugugagccaccacacccggccggaaaucacccuuuauuucaauuccguuuuaucccuguugcuguuaauugguacauacauuugcagaugucugcuuuuuguuuccuuuuuuuaaugaaauagaccacauuccaugugacgugcuuuuuucugaacaucuuuccaucaggaugccuacauucgaaucguggcaugaugugaacaaucaguuacucccauuagaucuuggucuucuuaccuauggacuagggacaauacaccuggccccacacuaccuuuguauugaagucuuugggaaguaggaagugcucuaccaacaggagaagugcgauaauuacaguaauuaacaguuauauauauugaagucugcagucaugggaugggaugacugaucagaccucucucacccucuguucuacagcuggugggugcuggucagcuacggaguccucuuggucacccugggagccuucaucuucggccagaccacagccaacgccaucuuuguggaucucuuggcauaaccacugccucccagggaacacaaggccuuugccauuggucgcaggaacccaucucuuagagcuauggggccauucuuaguccacgaucauuccaacuggugggaugacauccggacauccucuuccagggacuggggcaaacucaggccccacaccucuggacagcucaaauccaguccccuuccugcuccccaguccuggcagugccguggauggcggcaggaagucucacaucauagaggaccccuccuccucucccaguucucaacuucuccaugccuggaauccacgggugaagagagucgguagaucucauaagaaagaauccagucugacuucccucuggagaaugacuauggacagaaggccaccauccuccacagagcacccuguccugaguagggguugugcucauuaccccaggccagugguagcuuccucaggagccuggccacuuccaacgguagcacugaagucaugcaaaugcauagucagguagauucagaccuuguccacaccuuccugggcaacccccaccaugaaccugucagccucuuucccauagcuaauagacauuucccaggccuugaggggccccacccugucucuuucaucaaaccugaugguccaggcugggcaucccucuccuccuccauccccagacaucaccaggucuaauguuuacaaacggugccagcccggcucugaagccaagggccgucccgugccacggugcugugaguauuccuccguuagcuuuccccauaagguugggaguaucugcuuuugugucugagaugggccccucuuuucagaggccgcagggugggugauggagaaggcugagaaccuuucagacccucugugugggcugggcuggucagaaucaggguguaccuccccgacaccuucuuuuucagugauguuuucucuucuuccugccuuuccucugccuccuccccugccagcccuagcgugacuacccagagacaaaaaaaaaaaaaaaaaaaaaaggcagggcugggcgcaguggcucacgccuguaaucccagcacuuugggaggccaaggcgggcagaugacuugaggucaggaguucgagaccagccuggccaacacggcaaaaccccaucucuacuaaaaauacaaaaaauuaaccgggcaugguggcgggcaccuguaaucccagcuacuugggaggcugaggcagcagagccgcuuaaacccaggaggcagagacugcaaugagcugagaucgugccauugcacuccagcuugggcaacaagagugaaacuucaucucaaaaaaacagaaacaaacaaaaaggcagcuggguugucacugaugggcagcauuugagccugccacacuggccuggaaguuucccuuccagucuggauuuugucugcuccuuccuucccccucaccccguuaccucuucaccucccaucucacuucacuguguagcucagucucucccacgcacauaauuggggacagugggggcucucuuaccagccuccucagcaacgcacguccaucaggccuggccucaguggccagccacauugaugucacacuggaauuguuaccccagagagggcgaagagauaggcuaucuccccaccucccacccuacuccccacuauauucccguuuugaccaccucagccccucagcugcccccucucacuuuggccaaucccaggcaccaaucagacuuccuccuccaccuggagccccuagcauuuccuuguccccucuuccccaaaaccucuguaaaggguacgagagggacccccugccgagccgcccgccacucagggcaguccgaucuaagaagcagaagcugguuggaggcuggcugggccucuguccaguccccagauggauaaacugccuuuucucacauccccucuuggugccugaucuucucugcccccggggccagacccacugugcuguuuucugucagucuguggcacagcaccaagcucugccagcaccagucccugacagggcuaggaggacagccuggucagcagggcugcagucccccagugccguguuucgggggucaagggauguaaguggagucauugcacagagacagaccagucaggagaaggagcuggaaucuggccucuuguccuaaccucaggagcccccucccauccucuccccacccucccuaucgggguacuucacuguuucuuuucuacuuguguauacucgagaaagggaagaugguuaauaaaagggauuugugcugcugagc

SEQ ID NO: 15750 - RNA, 2467 nt, Homo sapiens
ggaaaaacuuaaggacaccgaagaauauauggcuaagaaaaucaguaaaaucuacgauacuggucuuucaucuuaggguagggagggacauggacauggauggacacacacacacacacacacacacacacacccacaagcucuaugcccucguggcauucucucccagcaugagagcaugugucaugcuggaugcuguagcuuaccauauaagcccauguucuuggcauaugauuggcagaggcaaacauuaaugcccuguucgaugaaguggcgcacagcccaggcauccuuaucaccaucaccacuggcaaagccuugguaggccaugucaaagaacgcaaagagauuccuuuucugagaaggaacgaaagaucgaagcuuuagcagucuuucugaagaggccccagauguuuauaaaagucugaaagauguuuaugugaggugggcauggucccaauaagcacaauaagccuuuucuggggcuaacguaauccuggaagacucaacuuauacccaggacucacgagacaacaucauuagaaccauuuuaucuugaaagugcucuccaaaugcuguuucugucucauucuguuugcagcuuagauuugacagaaguuaaagaaagggaaacuggccaggcaugguggcccaugucuauaaucccagcacuuugggaggccaaggugggaggaucacuugagcccaggaguuugagaucagccugggcaacaaagugagaugcugucucugugaaaaauaggaagaauuagccaggcagguguggcacacaugucuguagucccagcuacucaggggcugagguaggaggauuguuugagcccuggagguagaggcugcugugagcugugacugugccacugcguucuggcuuaaggcgacagagugagacucugucucaaaagaaaaaaaaagagagagagagaaaagaaagggaaaugaaaaggagugaaaagggaaaacagggacaugagacaacaggaauaacauuuuccucccuaggaauuuugacuagugucuucucugacagcuggcuacacuuugagagugaucauggcaaugcugcaaaggagaggacaugaaaaaguguuuaaaaagaucaauaagcaaccacugaccagggcgaauauaggcaucaacagcagacauccuggggccaguggacagguuuuaucagaguucccuacauccaggaugaggaaaaaaauuauuuucuuuuuuucuuuuuuagagacagaguuuugcucuuguugcccaggcuggagugcaguggcacaaucucggcucaccacaaucuccaccuccuggguucaagugauucuccugccucagccucccaaguagcuaggauuacaggcaugggccacuacgcccagcuaauuuuguaguuuuaguagagacgggguuucaccauguuggccaggcuggucucgaacugaccucaggugauccaccugccucgaccucccaaagugcugggauuacaggcgugagccaccgcgcccagccaaaaaaaauuacuuucaaauacucaugcgucaucaaucccagaacugcuaaucacgcaaauggggagcccuuuucuggcagcuuauccaccuguguggacauuucacgcagguucgagguuaagacucucuguugagacauugccaaauuaagccuccaaagcugguuacuaaacacagaacugucgccagugaguucaucguccucaccuucaccacuguugcuauuuccuuccacuguuccggacgcggguccacucccgugggauugugggcgcaggcaugcagaagaagaacacucugcucugguauuuucuaaagagaaaaacagccaagagacgacuuugcagcuuuaaaggaaaugguuuaucugaaaugccacaggaucgucaucauuugauaaguaacaaagguaaccagaacccugggaaucagcucuuccccaguauuuuaacucagauauugggacauggugggagacaucaaauguccgcaagcaaggaguuuuauucaccucucucacccugaaagccacacuuacugaaauauccuccacagcgccugugaagucaaaaccgcaagucuuggggucauaauaccgauaaccuuguagcugcaugccagcaucccugaagaugggugugugguuuccccagguugguuugggcagaaagacaucucggcugaacuuaaaaaaucuuugcuaaaagaugggacgaaaggaaacagaaaaaugaacaaaggagaggcaaaaaaauguugauguguuuuauugagagaacauuuuucucugcugaaacccaguuucucucuaugguugagaagcaguauugacucagcaguaagacugccuggguuggaauagucucugacaguuauacuggccauguagccaaggaccuuucugggucuugcuuucuucacuuguaaaggggguu

SEQ ID NO: 15751 - RNA, 986 nt, Homo sapiens
agacauaaucugcuaaucuuauuaauccucacaacugccccacaaaauacacaugcgacccucuccauaaaagggauaaggaagccaggugcgguggcucaugccuguaauccuagcagucuugggagacugagacgggcagaucacuugagaucaggaguuugagaccagacuggucaacauggugaaacccccgucucuacuaaaaauacaaaaauuagccgggcguggugguggcaccuguaacccagcuacucggggagcugaggcaggagaaucgcuugaaccugggaggcagagguuguagugagccgaaaucacgccacugcacuccagccugggugacagagugaaacuccaucucaaaaaaaaaaaaaaaaaaaaaagggugggggauaaggaaacauucaggaacgacgugacaugacuugugcuuagggaaacuauuaggguugaaaguaaggccaccuuggguccuaauggcuguaaggcaucagacaaaauacgucaacuaugucagccuacauuuucucaucuuucaaacugccauaacagcagccaccucuucggccggccaggccuggcccagcuggauuaaaugaaugaagcgcagcaagggcugggcguagguaaacugugcagucauccucuuccacgaccuccgcugagcccacgccgcuccgcccgccggccgccagggaucgcugugacguggcucgggcccagcacgcggccgcucuggcccagggaagucccuguccuuaccuucagcaggagccgguucccuguguguguguccgcucgcccucugcuccguccugcggcugcccacugcccuccuacgguccaccauggcccugcugcacuccggccgcguccuccccgggaucgccgccgccuuccacccgggccucgccgccgcggccucugccagagccagguaagccaagggaaacggagauggagccagggcgauggcccugccc

SEQ ID NO: 15752 - RNA, 1558 nt, Homo sapiens
gucuuuagggacaccuuuacuuggaaaguuacaacacuaguacuacaaggcuuaacacauuuaacauuugcuuguugaaaagcaaugucauaaagucaaauaaaauuaaacauguuuuacuuuuuuccucacaagaacauaaaaauuacggaagggacuuaacagggaauuuaaaaaagguaacacaauuuuuccuuuuaguaguccuuggguaguuaugauagaauaguuuccacucuuuuuuuuguuucuuugaacugggauuuugguccaaaguuuuguuuguuucuaguaucugcuucugccucccccucuaucagaucggcuuccuccagggccagcaccucuuggugcuccgcggcuugaacugcuguaggaaucacgugaagaaggguacccccuuucuacagaagggggaagcccucuuucuugucugccaacccugucacaacuugaguagagaucacuucggcugcuugaguaacugucucgacuuccaccauauccaucacgugagcugcuauaaucaucauagcgacugcuuccaccauaagauggcgggggcccucguguaaguggagcacuacgugaguuaccauaacucucauaugaaucucuguaggaaccuccacuuggaugaucugaauagucacgaucacgaccauauccaucucuaucgccauagccucuugauggauagucaucacgugaacuggaaugaccauaaucacgguaaguauaaucucguggugguggugcauaaucucuuguaucacgagaacuuggguaaucucugcuugaauagcugucuuuaguagaauacccaucaucucuuggggacaaauaaacaucucuacgagaggggagcgguucccuucgagguggaccuccauaacuaucucuuccacgugauagaggagcucuuccucccauuccacugcugcugcgaacuaguccugaaggugcagaucucuuaggagaaggacccccacuucuugguggugguccucuuuuuacugggagugguccccuggaagaacucauguuaaaauucauggaauauccaccaucauccauguguccuccucgugaaggagguccccugguuccuccacuuccuccucuuccagcuccaaaaccucuuggaggaccucuacuucuuggaggugggggcgguccaugucuaccucuuucaaaugaugguuugguggcuuguuccaccuugauggcuuuuccaucuaaugacuuuccauucaugucucuggcugcauccuuagcgucugcugggcuuucaaaggugacaaaagcaaauccucuugauuuguugguuucacggucuuuuaucaagaguacuuccacuauucguccauauuugccaaauacuguuucaagagcuuucucauuuguuuccguauuaagcccaccaaugaagagcuuuccugggcgaucugcuucaaccauuuuuuuuuuugccggugagucggaggggugacaguggguucaagcuccaacaagcucgccgacaggggcuuccuagcagcucagcaccaguggcggc

SEQ ID NO: 15753 - RNA, 1558 nt, Homo sapiens
gccgccacuggugcugagcugcuaggaagccccugucggcgagcuuguuggagcuugaacccacugucaccccuccgacucaccggcaaaaaaaaaaaugguugaagcagaucgcccaggaaagcucuucauuggugggcuuaauacggaaacaaaugagaaagcucuugaaacaguauuuggcaaauauggacgaauaguggaaguacucuugauaaaagaccgugaaaccaacaaaucaagaggauuugcuuuugucaccuuugaaagcccagcagacgcuaaggaugcagccagagacaugaauggaaagucauuagauggaaaagccaucaagguggaacaagccaccaaaccaucauuugaaagagguagacauggaccgcccccaccuccaagaaguagagguccuccaagagguuuuggagcuggaagaggaggaaguggaggaaccaggggaccuccuucacgaggaggacacauggaugaugguggauauuccaugaauuuuaacaugaguucuuccaggggaccacucccaguaaaaagaggaccaccaccaagaaguggggguccuucuccuaagagaucugcaccuucaggacuaguucgcagcagcaguggaaugggaggaagagcuccucuaucacguggaagagauaguuauggagguccaccucgaagggaaccgcuccccucucguagagauguuuauuuguccccaagagaugauggguauucuacuaaagacagcuauucaagcagagauuacccaaguucucgugauacaagagauuaugcaccaccaccacgagauuauacuuaccgugauuauggucauuccaguucacgugaugacuauccaucaagaggcuauggcgauagagauggauauggucgugaucgugacuauucagaucauccaaguggagguuccuacagagauucauaugagaguuaugguaacucacguagugcuccacuuacacgagggcccccgccaucuuaugguggaagcagucgcuaugaugauuauagcagcucacgugauggauaugguggaagucgagacaguuacucaagcagccgaagugaucucuacucaaguugugacaggguuggcagacaagaaagagggcuucccccuucuguagaaaggggguacccuucuucacgugauuccuacagcaguucaagccgcggagcaccaagaggugcuggcccuggaggaagccgaucugauagagggggaggcagaagcagauacuagaaacaaacaaaacuuuggaccaaaaucccaguucaaagaaacaaaaaaaagaguggaaacuauucuaucauaacuacccaaggacuacuaaaaggaaaaauuguguuaccuuuuuuaaauucccuguuaagucccuuccguaauuuuuauguucuugugaggaaaaaaguaaaacauguuuaauuuuauuugacuuuaugacauugcuuuucaacaagcaaauguuaaauguguuaagccuuguaguacuaguguuguaacuuuccaaguaaaggugucccuaaagac

SEQ ID NO: 15754 - RNA, 5080 nt, Homo sapiens
uuuuuucuuucuaaacuuuuauugaaaaaaaaaccgaggaggugugcuggaucccuuuucagaaaagccgcuucucauaccugcaggcagaaggaccaccugugaggugagggcaggagaaaggaggcaugagguauggcagaggccccaccaaggacagggugacuuacgaauggaggcuauggacgccaccuuccaccugggcugaggacguucucuucucaaacuuaagcuccccagaguacaucauggcucugaagaagggcagaggucaaauguggguagcuggcccuggaccagccccucuacccaugucccagcuccccaagcucaccggacuugggucaagcucuuggcaccaauguccuggcaugaguguuggaugccagcaaucagguaagggacaaauuuguggauugacccuuuguccugcacagcaccagacacucccugggccacuuugauuuugucagcuucacugcagggagaggcagagacacgggcaaggucacagcagagaugagacugucagugcaggauuagggugggguaacuggcuugccugucccaccugaaauaucuguucuggcugcugaggugcuuguccauggcaucgagagaacccauaccgcgauauuucuuuagccggaucccaucggaaaagaaguauucaccaggggccucagugguggcagccaggagagagcccaucaugacugcggacagauggagugcuuggguuagagccuaagcagcacuagggagggggucccacuggccuucacggguacugggccucaccuguggaggccccaagggccaaggcuuucgcaauaugacccacauuuuggauuccuccaucagcaaugaccggaacaccaaagcgccgugcauacucugacaccuuguacacugcuguugcuuggggccgcccacaggccagcacuguugagauggaggaacacauggguggauaggguuaauggggacgggcaguggacccuguggccauauuuaggacccaggagcuuuuggcuacaucugcaucaggacugcagcuuggcugaggaacagacgugucugggauggcugcugccacaucugccuuaaauaguacaaacagcugugcugaccucuacucacccccacaugugcacgugcaugugugcagugcccagggcagccucaggcacaugcagucuuagcagccgggaaagcccccguccagcugguaucagauggggcaggagucaccgugcaguuaguccccagaggcacugaggucaggcccagcccuuccucccugaauggugggcagcucaggcaagauaagggcagugguuguguaggagagcaggcugugguuguguggagcaggcagugguugugugggagagcaaggaccacacaaaggaguuggucccugaacuaugccuacugcagaagaugugggcagaaaagguccugccuagggaagaagguccugcccuaucagcaccccagaaggaagagggagcuauguucuugagcaccacccccaaaccauggucuguguaucaguuggccuugcccacccaucagcaccacaaaccccgggagcuacagcuacgucaaccaagcagccgggcagugggcagcugggccgggccagugggccgggcuggacuuacuauagcaacccgugacaguagaagggcauuuggggcugugggacuuuaugucuggagggaucuugggagccacuaaauaaaacaaacagaccagaguuuagagaaggugcagagcaggagcaagaaggccaggcuaggcaagggaguggcaggugauggaugacaagaccuugucuugcuuccagccaugucacccauccaagaggccaauuuggccccaggguugccccuauuggagggcucuauuguccccauaagagugcuugguuccaagguauguggggccugaaacuggggucucugugggcccuaucaaaguauauucuuaccuuccugcguaaugcagauggagccacuucccaugcccacccgcagggcauccacaccugcaucaaugagguucuuggccugggcagcagugaccacuauggugaaggaaaggaaaaugcucaugugaagguuaaggugggagcccagcuuacccacucccaccacacauccuucagggcacaaucuugccuuaccauugccuccaaugacuuggagauuaggguauuugucuuugauguacuugaucauauugaucuggaagauggaauuucccugggaagaguccuaggacaagaaguaagucucagacugugauguggcagcugccccuauugccccaacccaccuguguagcagcucaccaaaaccacuacauccacaccagccugggcgagcaaguccagccuauacuugucauccucaugagugccaauggcugccccacacagcagcuguuucuuggcaucuuuggaggcuaguggguagucccgauucuucuucaggucuguccgggcaaugauggccacaagcucaucaucuucauuuacaaugggcaacuuuccuguggucagggcaggacaugaaucaggacccuaggcauuaguuccaggcccuuucccagcucuaggacuuacccuucuugcugcgcugcagaauuucauuugccuccuucagugugaugccugcaggggcuaccaccaagucuucccucuuugucauuaucuacgugggaggugagaugugaagaagggccagucaucgacuaugaccaguuaacucuuuucuuuccuucccaaguagcugagcucagaggcacgcgccaccacacccaacuaauuuuuuguauuuuuaguagagacgggguuucaccauguuggccaggcuggucucaaacuccuaaccucaugauuugccugccucagucucccaaaguacugagauuacaggggugaaguucuauggaccaccacguucauacauucacacccaaaacacccuuccucaagggaucccaauaauucuuagcaguaugguauugagugagggaugaguagaaaggacaacauggcacagggagcacccucuuacacuauggaauaaggaggacaacacaggaacaauggcaagaaaaucagggcagaccucaagcacugccccuaccuuagggguuuaaaagaacaaagcaugaauacuagcaagcauuugggcaguuugaaagccucugguggggaaaggaugcaggaacccaauaaaggagucagaaacuugguuugacacuccuuucccagagagaagaggcuaucagagaugucuuagacaacagaagccccuugucuucaaccugggcugcuagagcuuggaucuacucugccaguggcacccaccucuuccaagaaacagucauguuccuccucuuugagaaaaucaaugucccuggaggagaugaugcccaccaagcggcuccccauccggccugugucugugauugggauaccgcagaaaccaugccgggccuuggccucaaaaacaucccgcacgcgauccuuggggcugaggaccacagggucugugaugaaucccuguucauauuucuggaaagggauggugagaaagggcaucgcaucuuugaacuacuuucaucaggcucuugaucugaagcauggggucucugcuuaucgaucccuuuggcagugccacaagaccaaaucacaccaacacaucuuagagacauggguaggcuggaggcacuguacaccuggucuauugcugcugcuuuaagaaacagaaucucagggucuucucaguaacugaaccccauggugggaagaaagaauacuaaauuagaauaaaccccuacucccaccccaccccaccucagugcaauucccaggagcgcuugcuaaugaucguugcccuucugaccuucacuuuccgaacuucauuggccuggaauucagguguacaguugugguggaugaagccaauaccgccuguaagcuacaggauaaaaagagacuacuacuaagugacaagaagcaggacugaaugccuuuggggaaaggcgauggaguccuugcuccuucccccacaccccauggggcucaccgccauugcuauggccaucccagccucugugacuguguccaugggagaggaaaccaguggggucuuaagagugauuuucuuggucagagcagaagucagguccugaggagacaaacgucaaccagugugggaaagcaucccuuacaccucaagguguuacugagucccccacaaaaaggcacuuuuguaugaccugcaugcuaacaagcaacaugauccuauaaaauccacccccaagcccaaucuggugaguuagcccagagaccaggugauaguagcaccuuagcucaccuugauguucaggacccaauuccugaucauacucaccaccuggucugcagugaagucgauguacccagggagaaugagaaagucacugcgagggaagggagugaauugggaguaaagcucucagcuuagggcagcaugagacuccauccccauguaccaaucaacccguaacgcaugugagcagagaguggcacugacagagucugugugucacaggcacagcacaagguggaaauggguacaggggaccuuuucugccaccgagcugucaucagugcuccuggcacccugacaauuccaugugucuggagcauggaaucuccggccugagauuccaagcacuacugagaugcuucuccguaccccaagcaccgcuccagaugucucaaagugagccccggagguggguggccaauucccgaaaccugucccccacgcccacgcccaaggcggcucucggaagcccccaucuggccuuuuccccagggugccgccccucucuucgcccaggugagccccauaggcccgcacuuguaggugaggccgucuccgcaguugaagagcugcugugcugugaguccgucgucuggcacguaggacgugcccccacuaaucagguagucggccauggccaacacaggacaccgccgcgugucuccgaggaccgcgccgcagagaccucu

SEQ ID NO: 15755 - RNA, 1130 nt, Homo sapiens
uuuauuauuuauuuauuuauuuauuuauuuauuuuuuaaagaaguaagccuuuauuuccuuguuuugcaaauaaagcuggcuaaguugguugcuuuuuggugauuagucaaagagaccaaaucccauauccucguccgacuccuccgacucuuccuuggcuucaaccuuagcuggggcugcagcagcagcaggagcagcuguggugucagcagccacaggggcagcagccacaaaggcagauggaucagccaagaaggccuugacauuuucagcaagugggaagguguaauccgucuccacagacaaggccaggacucguuuguacccguugaugauagaaugggguacugaugcaacaguuggguagccagucugcagacagacacuggcaacauugcggacacccuccaggaagcgagaaugcagaguuuccucuguuuuaucaagcacuucaggguuguagaugcugccauugucgaauaccugcuggaugaccagcccaaaggagaagggggagauguugagcauguucagcagcguggcuucgcuggcucccacuuugucuccagucuugaucagcugcacaucacucaggauuucaauggugccccuggagauuuuaguggugauaccuaaagccuggaaaaaggaggucuucucgggcccgagaccaguguucugggcuggcacagugacuucacauggggcaauggcaccagcacgggcagcagcuggcaccuuauuggccagcaacaugucccugaucucagugagguccuccuuggugaacacaaagcccacauucccccagauaugaggcagcaguuucuccagagcuggguuguuuuccaggugcccucggauggccuugcgcaucaugguguucuugcccaucagcaccacgaccuucccgcgaagggacaugcggaucugcugcaucugcuuggagcccacauugucugcucccacgaugaaacauuuuggauaaucauccaauaguuggaugaucuuaaggaaguaguuggacuuccaggucgcccugucuucccugggcaucacggcggugcgucagggauugccacgcaggguuuaaagacgaugucacuuccacgaggaugccuggcgagag

SEQ ID NO: 15756 - RNA, 1112 nt, Homo sapiens
auuauuuauuuauuuauuuauuuauuuauuuuuuaaagaaguaagccuuuauuuccuuguuuugcaaauaaagcuggcuaaguugguugcuuuuuggugauuagucaaagagaccaaaucccauauccucguccgacuccuccgacucuuccuuggcuucaaccuuagcuggggcugcagcagcagcaggagcagcuguggugucagcagccacaggggcagcagccacaaaggcagauggaucagccaagaaggccuugacauuuucagcaagugggaagguguaauccgucuccacagacaaggccaggacucguuuguacccguugaugauagaaugggguacugaugcaacaguuggguagccagucugcagacagacacuggcaacauugcggacacccuccaggaagcgagaaugcagaguuuccucuguuuuaucaagcacuucaggguuguagaugcugccauugucgaauaccugcuggaugaccagcccaaaggagaagggggagauguugagcauguucagcagcguggcuucgcuggcucccacuuugucuccagucuugaucagcugcacaucacucaggauuucaauggugccccuggagauuuuaguggugauaccuaaagccuggaaaaaggaggucuucucgggcccgagaccaguguucugggcuggcacagugacuucacauggggcaauggcaccagcacgggcagcagcuggcaccuuauuggccagcaacaugucccugaucucagugagguccuccuuggugaacacaaagcccacauucccccagauaugaggcagcaguuucuccagagcuggguuguuuuccaggugcccucggauggccuugcgcaucaugguguucuugcccaucagcaccacgaccuucccgcgaagggacaugcggaucugcugcaucugcuuggagcccacauugucugcucccacgaugaaacauuuuggauaaucauccaauaguuggaugaucuuaaggaaguaguuggacuuccaggucgcccugucuucccugggcaucacggcggugcgucagggauugccacgcaggguuuaaagacgaugucacuuccacgag

SEQ ID NO: 15757 - RNA, 16934 nt, Homo sapiens
cguguguggcccugggcagcucuccccaccgcuuucccauuccacagcucaaaucucaguccagguuggggcugggacccagugacccccaaacucuguggggacucucaaauggucuacuugagcucaggcauuuaaaguugcguauuggcggccacagacuuugggaggaugaagggugaggcccugggagcucgggaaugggguuuggccaggcagcuaugaccuggccccuucugcuuccuccugguuuguggcucaguuuggcccugggauaggcuucuguggguuccagaccuguuccucucccugcagguucugccaacagccuccccacucccugcuggaggaagucuagcuccucagccagcccuuaaggccuagcaugguuguccccugcccacccugccagcucuccucuccuccacuucccugccccuuccagccucgaggagagcuaggaguuccugaaaugcacaaugcccuuccucucagcagcaggcuuuuugcccaggcuguuccuucugacuggaaugcucuucuuugcuguguuuccuggguuaacgcuuuacuucuucucaaggcccacacugccuacuccaugaggucuucugauugccaccugccaccagcacagccucugccuccuggccuaucugcccaggcagguucugggccuaagaguucacuucaugccauaccugggugcaugaacucaaggcccuagaccuggacgugcugccugucagccuggugccagcuccaguucuggucuugucacccacuccuuccccacucacaggauuuagaaacaaaucuguauauuuucagacaacacguaggguggucagaguagguacaauuguugguauaacuuaaagaagcuccuccuuguucccaaauagguccucugauggcucaugggauaggcugccaugggacugcccaaaagaccaccgauaggauuuugauccuuuacugacaacaaaauuauccuucuuaagagucccuggccaggugugguggcucacaccuguaaaucccagcacuuugggaggccgagaccaguggaucaccugaggucaggaguucgcaaccagccuggccaacauggugaaaccccgucucuacuaaaaauacaaaauuagcuaggcaugguagcacaugccuguaauccuagcuacuugggagauugaggcaggagaaucgcuugaaucugggagguggagguugcagugagccaagauugcgccauugcacuccagccuggacaacaagagcaaaacucugucucaaaaacaaacaaacaaacaaacaaacaaacaaacaaaaaagucuccagugaauaugcaaacaccccugagcagggcaccucuuaagacagggcuggcaaaacagaacucagcuugccacaugccccuuuccacaccuauggcagacaucacgaaucaaucacucaaagacuguauugaggauccucauagacuguauugaggauucaggggcugaguucaaguucauucccacugaaugaagguagaggguaccaacuggccagaccuauuuugugaugugaaacaaauuugugcuggaaucucugggcuccgggucaucuagucuauccccuugccuucuaaagggacagcuccaaacuucaaggagagaacacccaugcuaaggaggcuuccagacuccucugggcuuccugacuuugucugggacugucagggcagugcggggaacagaaugaggcccuugcaccugccuauuugaaccugcccagcugcucgggagcugugugaccuuggguucaucucuugcuugcugagccucagcuuccuuaucuguaauggaggcaacaauagcugccucccugggcaggaggauuaaaugagaucaugggugcaaagccuggcacacaguaggugcucaguaagggugcaggugucuugacuccuaucuacccgcccucuccagccugguggguguggcuuugacuggccaacuuacgcuugaccucauuuccuggcucuacucugggcccaccuccuacucuuucuguuccucugcagaaggaaaucucauucaccaccagcccggccugccccugggucccacuuccuccuccuucuaguaucuggaccugccaggaucugacuguuuugcuaugguccaaggcagacaaccuggaaaucccugaauuaguuuagggaccauccccuacucucaagagaugggaagacugaggugcaggcugcagaggggcugcccaaggccuccuagcaucugggauucccacucuuccuccagcaagcccuccaugauuuacccacuuaacaccagcuugaaccuggaucaggacagacuuuuuaguaucuccucagccagaggugaagcuccugaggcccugccuccuagaacauuccuuccccugguaucacugggcuccuggcuugucccugugccugccucuguggccuggacugcucugcuuucccccucucugagcuucacuguggaguguggcauggacugugggucagaaggaaccgcacucacccugcuucuaccuuguguugguugugugaccuuggacuggcugcacagcuucccucagccucgauggucccaucugucaaaugggaauucucauaguugcuucagugugacugagggggugcagagagaggauacagggaacagucauggguccaugugggcaaaaugagccuaagauucuuccugggaugguguccccucuguccccuggguguccccaagucagcagugaaucauccaacuuugcagaaaauguguggccccugcuggcuuccugcccucauguccggcccuuguuuggcaacacaauagcucaggcugaggcugcaggcgggcagcuuaaccccuuccaggccaguauacaccuccccuaccccucaccaccauaagcugaaauugguagggcugcucaggggcucagcagcucuugggccccuugguggauaccugcugcucucuagggcaggcagaggagagucccaggcuucccaccaccugaggauggaccagggcuucuggcccuggcuccaguggccuguggcaaaagagccuuccagguacacccucgacuccucaaagcugccucccugggaaugcccuuccucucuugucagaauccuaucugcccaucacacaugagaaacguccacgcuggggagggagccugacauggagcagaggcccagaggugcucgcgauguccucucacuugcacccccuuccucguaccugcugggcaccugaggaccccuccgugaugggguuugaccauaccucaagggccaaaaucuuuaucacauucacaaccaggaucggcucugugcuagcugguaaauccagccacuauuccuuaaagaucucauguuaugugccauucccagcaccagggauguagcucacuucacucaauugacugaggaaacacuguuuccccauuucacagaugagacacuugagaccuggggagagcuggggcuuuggaguacgagauccugguucaaauccccacaccagcucauauguuuccaaagcucaguugcuuucacugagauauaaagaaagaauguaucuaccuuguggaguuguuaaugguaaaauaaugagccccacaccaucccuuguuccccacugugguuuggaaacucuggguaacuuucccaaggucaccccagagcaaaugggagagcugggaucuguacccagggcagcugucuccaggccaggcucuuggcccagaccuccugcuucugggggacuuccugggcugugggggccuuggggcucuuaugcucuagccuuugaaagggugcuggugggaggaaugguggaccgcuguccagacuacagcucccuugacacauagugggccccgaugguguuugggcagggaaaggcccagagggaaaggcaagaccucaagugcccagagccaagccucagcuugccuauccugaaaugggggcacuggcugaccgagaggggccaaggcucggagcuuccuuuucagggccccuccccagaucccagcauagagcuuuaguggcguauggguagggggcugaggaggcuggugucaggccuugguaaauccucuccaguaaggguaaggcaccgaggggaggccaaggccugggugccaguccucugccccggcaugcugggcaacuggggcagaauacugcccucucugagccuggcacugaugaaggccagugggccuuuuugaguuggagaauacacuucugggagagccaagcccuugcccugccccccucagccccgagaugcccauuugugcccuuggcacuaccucugggugcaccuuccccgacccugcucugagccacgaggaggcccagcgugcccucgaggagccucucugucaugggagugggacgaugcccauucuacagauggggaagcugaggacccucccaucuugggcgcaggguggcggguuugggguggaggggagugugggagcccccacucaccgugccugugggcugagggauguuucuguuccguuggacugccuguccguccagggcugagcgugaguggagcucuguggagccugucagccgaccgucuuuggaggggagccacaccccgcuggcgagggaggccuggcugccuccccuucagguuuuccagcuggcccuggcccacuucccccugggaugguuuccuguuauuguuccuuugugagggcugggcuggcugcagauaggcaggcccugcggugggcggcugccucggccccggauggcugucuccacagagggcuggcacuggacccugccuggggcaccccacuugaaccccuacucccggccucagcucugggacucugaacccagcaccugcaaagagccuggcuguggggacccuuggcugcagcaucacauuuaacccuccuuggaaugcuacaggcaggugucaucacccccauuuuauagcccgggaagcugaggcucagcggguuuaaggugcuuguccacccagcugggguauaaaagagccaaaaaucuagcuggggucagccuagccccagagcuugauuuucuguggugaucccaugaugucuuugugggaauggacuuuaaaggugacagggaggcuucaggagaugggaaagggacagaagcucuuggcucuggaggaccagguuggcuucuccuggucagagcgggcauggacuccagcucuaaggugccagccucggucuguaggggauguuugcauuuagggauauuggguggagucaagugacccagcucugcuucugaugugaccucuggccaguugugucauccuggagccacaguuuccucaucuguaaaauggggauaaucacagccucauccucacaaggcuuuugacauaaacgagaaucaaagaggggcguggaagacagugacgcugaggcuggaucagagcccagaagaaccaagaggcuggggggaagggaggggccaagauucugcugaccaggagagacauaggaggagcuucuaaaaacuacagaggacugggcucaccccagaucaacugauuuggaaucucccagggcagauccugggaaucuguccuuugaagaguugcuucuguuuuuccaugggugaaugguugggaagucccaaacuuguuuuauuauauagcugggcaagcagagacccugagaaagagagggcccagggccguuuaguaaaucagagcacaagauggggagugugauggaaggauauuuuuggaggaggaggggauagugauuccucugucucaggcagguugaguuugagaugcucguuagauacccagguggaggugucaggcuggugggggagacaggggugaguccagccuggagucgagguuuggaacccaacagcuuauggcuggcaucugaggccaugggcauggaugagcuuggagggagggaggacuuggacccucugacauuuggggauccauuagaagagggucccaugaugaaggaggaaugccaggagagggcagaggaggagggcaggggaguagucagugggucagccuggggagcaugagggcugagacuuaacuuuggauuuggaagaugaggucaucaaugacugugaccagaacagguuaaacaggaaaagguagacaagacagauuggaggggcuagagaaaggggagaaagggggacggggauguggagucacgugugacuguagcuucuuccccaagucuuacagugaaugggagcagagaagugggaggguuuuuuuuuuuuuuuuuuuuuuuuuuuuuuaacuauggcagcacgcucauguccccagggagcauccagcagacgggaagacagaugaugcuggagacugaggagcgaccugcuggaaggagaacaguccuuggggcggaauucugagugggauccaacacauucaacagccgauuguggaaugaacaaacaacagcucagcgcuuccuucuccaaugggauuaacucugcuuucuccugcccagaggggggguuggccgcagaggagccaggacagugcucuguccccuguguuccaguccacaucccccucacccccgccuguccucauggucuacgugcccauggggauacacuggccugugcauugcuuccugcugggucucagacucggggcuguggcagauggggacagggccuguccuggcaccaucugccaauucccuuuguacucccaguccaugaggaaguugacucugcccugaaaacgacuguuccugugguccauaaacaaaggaauggugagccaggcaugagcugugggccccagggguggggcugggggucaccguagcagagguagcugagacugugggagggaggcuggugccuccuuggucccccugaggauuucaugccugauuucuggcacugcccagccucugcuccaaccucucuggaggcaaaggagguaacaggagggcacaaggccaggaagugucauugggagcaaggaaggcggcuggugggcuagcaggaaaugggauggucugugagaccagauuaguagcagaggaggaagcaacaguggaggcagugggggugggauggcgggugggacgacaaggccuggggacgcccaccuggccucugccaggaggaagccugacccgacagggagcgcugcuuggggagguacagguguggggguugcagacccagguuuggauccuagcaugacccguugcugccugcaugaccugggcagccgacuugccucucugagcuucuuuccucaccugugaaaugaguuaucuguucagacuuugcaggccguuuggaagaugaaaugagacaaugaaaauaaaugacaggaccagcaagccuuaucgaguggcuguuucucaaaguguggucuucaagccauccauccugggagagggggagugaauaugcagauuucuugggccccacuccaggcugauggggucagaauggcuggugauagaaucccaggacuuauguguuuguagcuccccaggaaacguguuuguguuguuacauuugaggaccacagccuuugugucugcugcuaaugcacuaagcucuccuugggacuccucauucaaaccucaggacaacccugcgggggugguacuacuguuaggcccauuuuacagaugggaaaacagaggcugggagugaaagccuuucugagaucagaguuugucagugguggggcggaaauuccgagccacgcuucuguuuccagagcccagcuccuuacccagggagcuuuccugcccugcuguaauugagucgggacacagcagggguuccccaaauaagacuuccuuuuccuuccuccccacagcgugagacacccaaggauggggcaggaaaacgaugccaucagcuuggcaggggcggucguggugaagcccugcagccucacgccucaggacuuugcccaugcuguuccaccuuguguguuuccuucucucuccuuccucgccugugcgcagagcccuggcagagccacccagaucucauugucucuacacuccacucccucuucugagcucccagggcacuuuauacagaccucauucacaacccuccucuccuuucccaccgggauuguguccuauuugggugcuuauccccagcaccugguaauaggugagugcuccccaaaugugaacuugaaacugugcacucauuagaaccggcagucagcccgcugcuccccgggucagagagacuggggggagagucgaguguuuuguguucuaaggcaggugauggucugauggcagagggcuugaugagcccaucugcucaguuacgggcaaaggaaaaacccuuuugcccagcuggcugugcugugcugaggggcggacacaccuccagggaacauaaaauagggcugcucaccugagguagucucagaaggggcucagaaggaggaagagcgggaaggaggagcagggaggggucucauccucagcugugauucuacaaggaacagaaagcuugugaugagagcugcaggcccagcugagaacuccuccgagcagaaacugggcuaggcucacuuuggggugccuggaucugagcucaagguggccgucaggcagggaggaagagcccacuguuugaaugaaugaaugaaugaaugaaugaaugaaugcgugaauagugaaugaacaagcggaugaaacacugguauguugaggcagacacgaggugcggggcuggguguguaccuguguucugugguauauucugauggacaguggguccuuuuuccuaaggcuucaaggagucaccaaaucagucaaucaggcaaucaaucaaucaaccagucucucaguccugguuggugcccaguucugcgccagccugggaauggggauccagggaauuaaaagagacaguucugcuacaagcucugaggcugggcuggaguuaaagucaccagcacuaccugagccccuccuaugugucaucccugucucaggcucggucucuuauuucucauacuucacgggguccuugagagaggguugaggauccgcccguuuuacagaauucaguaacgagcccaguguggcacugcccgguucacaccaggcuugugugugucugcugaaccuugcugaauacucgagauccaaucugaggcuucccucuuugagccuuucccaugcuguccucccccaugcuuuccuuccuccuucugcaacccaaaucucccagcccaucagugcucagaucaaacgugccggcccccaugcagcuuccagacuccuauucugacaagcaucuuauccccgcgaagccuuugccacauucugucuaugcauuccaucuccauuuucucauguaaugaugcuuugcaauagcccugaaagauguaagugcuauuuguauucccauuucccugaugaaagagcugaggcucagagaggcugaguaacuugcucaaggucacacagugucugaguagcagagccaggauuucaacccuuauauuccuguuuauaucccaguucaaugcucauucuauagcaccacccuucuucugauaacuugccauuguucaccaauguuuuauguuccuuuguuauuuaaaaaauacauuuggugcucaggcuuuuccuagcccugugcuaggcauggagacguggaggugacuugggcuggguccuugucuuugaugugccccagucuggugggagagacagacaccaagacaugcaugaaccacacuggguggggcuggguuggugacagaggugugcacccugagaugagggugcccggaggagguggccugggagcugccggaggacuggguccccaagcugaucugaaagcaugagcaggaggucaccaaaggcggagcacgggaagggcucugcagacagcagaauuggcagggucaaaggcaaggaggccucuuagggaaggagaagacauuccaagggguaggggagcacugaggugcugagaggggaagagggacuggcuggggaggaggccaggugguagagggccugucacaccacacugaggagcucaggcagggcaccgcugggggccucaugcaggccagggacccaaggaucccuggauuuuaggagaggcgcccccuguccagugcaccguguccccaugcagcugccugcuggcggggccaccuccugugggcuguggucaggccagggagaggccacuggcuggggaaccgcaagggauggcggcucaggaugcagccacuggagcugggugaggaaaaggcuaagugcagccucucuuuggccaggaaaggccgauugaacgggguuugaauucccgacagugagaacaauaccuugccgcagccccugggagggaggaggcugcccagagcacuuccccagauguuucucacuuuuuucucacaacauccugaaaaggcuguuacggaaguggggcucccagggguggagagaaaguggugcccugugguuacaugcuggggcacaucugcuacuuauggucuggcugauccuggaccagccacauggccuuuggugccucaguuuucccuucuguaaaaugggaaugauggcgugccuuccucccaggguugcugaaaggacuaacugagaagaugcauguaaagugcauagaauagucucugguauacaguaggugcucaaugcauguuugucaugacagugaugccacagacacguuaauggugggggcaccugugagugugugaggacgaccguguauacaugugaguguguuagcaugggcauggcaugugcacgguguuuggcaaccauguggcuacacauaaguauguaagaacacgcauggaguguguaaggcauccacauggaugugaccacaugugcuguguucguggugcaugagugggcugagaggugcagucagguugaggccuugggcagcauccuccuccuccguugucuggagccauuggucaccccacugcccaagccuucuguguauccgucacaugcagaagcccagagagggcaaggccuuccuugggguggcccagugagccaggcagggcagggugggaccaagggcccugccuuguugucuggagggcaggccugagucuggaggaaaccuuguccagcggaagccagggcuuccuguuucuagacccuacauuccuugugcucuccaccgaagcguccuggaaaacaauagguuggaggcugcaccaucuguggggcaggaagguggaucaaucccucccaccucuugauggggcaagcagacacggcucuggcaccagcccucagcugggcaguguggcagcaggcccagaaccaggcaagcccaggccaucugccuccugccugucugggucucuucuccaggccaucuccacaccccucagugcacacugcacucuguggccugagacgaguccccugggcaaaauccagcuaggggaggaggcgucugagcuggucccggggaaggaagcuacuaggaaaaacucaaguccgauuggaugggacugacugcacaggcugguggagaccucgaggauccuccagcuucacccaccugccaugccacugagaaccaagagcgaauacagagagguuccgaccagccaaaagaaggaaucuuuccagccucugugcuaaagcucagagacaugccuguuaacucuugguuuauguacaguccuaacaagucagguucuccagggaagaggggcacagugguaagagcagugggcuuggaaccagaagccccaguuuucugaucccaugcucugccgcugacugcucaccagugcuuuuugucucaguuuucuccuuugugaaaaggucguaccuugccauguucuucugaacucacaggcagccggagugggucacaugaguaacauuucuccaagugcuuuguaaacuuggaugccucuuccauucugagagagggcacagaagcucugggcuccaccccugcgucuugccccaugcagcgcuuccauucggcuguuccuaaguuguauccuuuguaauacaugaguaaucaaaaguaaagcccuucucuggguucuaugagucauucuaacaaauuaucgaauccgaaggagggcugcgggcaacccccgaaguuguaguugggcaggcagaagcguggcucacuuggugacccugcuuguggcuagugucuaagccuuuauuaaccugugaagucugcacuaacucuggguaguuaggcucagaaauggcuugaauuguuggaaacccaagugguguuggagaacuggacaauugguuguuguuaggaaaaacccacacagcuuccuuugcgucaggcauggagccuaguuguuuuuuuuuuuuuuuuuuuuuuuugugcugggcaguuguugagggugauagggucuugcucuguugcccaggcuggagugcaguggugcaaucaugggucacugcagccucaaccuccugggcucaagugauccuccugccucagccuccugaguagcugggacuacaggcacguaccaccaagcccggauaauuaaaaaaauuuuuuuuguagagauggggccucacuguguugcccagacuggucuugaacuccuggacucaagcaaccuaguguucuauaugcaucagcuuacccacugucucucuuucuuugcaagacagugguucucaaaguguggccucaaccagcagcaucagcaaauccugggguaccaccccagaccugccgaaucagaagaucugggggugggacccagcaaucuguguuacuaagagauuccagugauucugaugcaugcccaagcuugagaacugcugcccuggagcagagauccucacuucaggcugugcccuggaacugccuggccagcuccccuccccacauccaaguaguaucuggggaaggcacauguagagauucugauuuaauuggccuggugggggcuggacuucacuauuuuauuuuuuuugagacagagucuugcucugucgcccaggcuggagugcaguggcacgaucucggcucacugcaaccucugccucccagguucaagcgauucuccugccucagccucccgaguagcugggcuuacaggugugcaccaccacacccugcuaauuuuuuguauuuuuaguagagacgggggucucacuaugcuggccaggcuggucucgaacuccugaccucaagugaucccacccaccuuggccucccaaagugcugggauuacaggcgugagccacuguaccuggcugacuucacuauuuuguaaagcuccccaggagguuaauaugcucccaggucuuccagcauuaccuuaggagguagcuaccucucuuagcuccauuuugcaggugcauagguucugggagauuaaagggcgugcccaaguuauauagccauguaaagggauggggaauucuaaaucccugccuuuccacuuccccuccuuccucccauucauugcuuuuugcuuuauuuagaacugugugguuucccaagcaacuuucuuuggaaaauuaaacaauuccugaugucgccaucuaguggcuagcgaugagaacagaugagccucuucuggacuuggcaagacggggcuccuggaggacacacgugggaagaggaaaggccaucauucauaguugcucaggcagaugcuuuugggacacuuggguucauuuucccaaaagguguccuuucagaaggacaguggaaugaagauggguuucguguuuaagagcuauugggaguucacucaugaaccccaggagaagcaugaggugugguccccaggcagggggaggcacagagggauccgggaugagggggauucaccugggcaggagagcuugaccuuccugcaggggcuggcucaccuuugcuugggcacugacucauuccaccaucagccacugugggccaggcccgaggcugcacucgccuucagacaucaggggagaagcacagaauauuccaggugcucaguccuucgugauccaagcuggucuguucuuggccaugggcagaagcuccuguggaggcugauggggcgaggagagggucuugccuccaacugggggaacugagguggcugugggggagggggacagcuucuuggagccugugcccagggucuaaauaggagcccauagguaugacucaaauccaauggcugcuccccacccugcuggcucuuguggggccagacaagaggcgccagaggaugucucaggacugaugugcuugggguucucaccauggcagggcacggagagaaguaaagcugucugagaaaggagggagugacugacuacgcucagggcacucacaggguggaauucuuuuguaaaaauaaaucucaguggacaaaagagauuuaagggcuuguacuauuggaagguaaagccucuagccuggaagcuuaccauuagaugucgugucuuugcuucuucauguaaacgcuguuuuagcaucuguuguguaucaaucucaucugauugcagccucuuuuauucccaaacacauacucacaucucaugggaggcaaaaauuuccaaggaauacaguuugggacacauuggccccaagggaggucuccagugguaugccacaagauucuauuccaggcccaucuagacuagcauucuuuuaaaaaauuaaugaaugaauuaauuauugagacagucuugcaaugucacccaggcuggagugcagcggugugaucauggcucacugcagccucaaccuccugggcuuauggcagccuugaccucucaggaucaagcuguugucccacuucagccuccugaguagcugguacgagaggugugcaccaccaugcucagcuaacucuuaaauuuuuuguagagacagggucucucuauguugcccaggcuagucucaaacuccugaccucagcugauucucccaccccagcuuccuaguguugagauuacagguguaagccauugugccuggucuggaccagcauucuuuaucaucaacuuagaugaagacgauugucuacugauccaaucaaugggcucuuuaaacccugaugggauggaggaugggcuggacaacagggucaggauccagaggucuugucagggugaggaaaugauucaaaauaucaauaggaaacauuacaaggaugaguugagggcccuguauuugggauuggaaaaaaaaagucaaaagcagcugcccaaagaugggagacaaauaugagagaaacugaggaccacuuggucaaugguugggauaauaauaguauuaauaaaauaaugauagcugacauggacgaccuuauuugaccuucacaacaaugcaugaaauagguauuauuauugaucccuauuugacagaugggaaaauugaggcuccuagagguuaaauaacucagaaccucccucagggccugcugguaccauguucauuccuuucagggcaagcagagaauguacaggaaacaacuaugggaaaguuuaaccuaaaauagaacaggguugggcgcgguggcuuacgccugucaucccagcacuuugggaggccgaggugggcggaucaccugaggucagcaguccgagaccagccuggccaaaauggugaaacccuaucucuacuaaaaauacaaaaaugaaccaggugugguggcaggcaccuguaaucccagccacucgggaggcagaggcaggagauuugcuugaaccugggagauggagguugcagugagcugagaucgcaccacugcacuccagccugggugacugagcgagacucugucucagaaaaaaaaaaaaaaaaaaaagaaaaagaaaaagaaaaaaaaguagaauaggaagccauggagguagugagcuccccauccuuaggggauguucaaguguaggcuggaaaacacuggcagugcuguugugguaaggaucucagcaacagauagggucuagaaagaaauaauauuuaaggucccucuucccucugcaauucuauaauucugcucuagcaauuuauuucuuuaaagucaaguuuaugauaagggaggacuauauuuuuuccacauggaauguaugcuuuauuuauaauacuuugggguuucuucuaugacaaauaugcucacuauauuucugaguucuaggacuugugacaaauuuuacaugaccauuuaggguuuacauuuucagcugauuauuaagacauuuauaguuuuugcacauuuauauuuaugacauuggguuggucguauuuaugauguacuggacgccuagccauuggucaggaagccuggcugaauaucuuaacauuguuucugcgggaaaacgugucuugcuuuacgguaauucauuuuaugauguggauucagaaacucagugaauuuacucugggagaaaaaacucaacagcuacgcaauuuggggaagucucguagauuuagaggcagaugaccucgaguuagcuauguggcuugggugaguuucucaacacuucugugccucaguuucuguauuuaguaaucugagcuagggagugggagggaggacacacauacccuccccaacauugcugagguggugguuucuguuuugcucuuacugggcacaugggagggacucagcccugaaccuucccucucucuuguccuccuuggauuugcuggugguaccuugggaaccaugugccuugaaggcugcuuucccagaggggcuccagcuuuugggaggauucuuaggaauccuucccaggaaucuugccaggcagcauguuuucagcacguuagaauuuugcucugggcuccaaacuaaacuuguuucaccuuaaauaaaagaaaucaauccucaca

SEQ ID NO: 15758 - RNA, 39877 nt, Homo sapiens
aaccccgggccucuggauccgcucgcccggcuaugcugcuguggccgcugcggggcugggccgcccgggcgcugcgcugcuuugggccgggaagucgcgggagcccggccucaggccccgggccgcggagggugcagcgccgggccuggccucccgguaacgcgcgucuuggucccgccucccaggagccccuaugcgcccaccuacucccggccccucggcuuccggaacccgcccgagcccgaagcgccucuuccgaggcgcgggauuuccuccccggcugcggcugggacgggggcggccaucggccguuacccgggcgcgagaccgcagcgagcgcugggggcgcucggcuuugguucugggauggagagagggccuuuaaagagcaggacggacacgcucugaacauuccggcccaaacucggucccccgacccauuuccugucccgauucuuucgaccuugggggcgauggggacugggagcugccuuaagccgauucugcucacacucuggugccagcgugggggagggggguuacgcccccggcgcucuccugcccucccugggaguggggacccacacagaaacgggucacuguuacacccggguucugguguccgccauauggcuguugagagacgccucagaaccaccugugggacggaugggcagcgaugcccgcccugggccuagaggaacaccugggucccaggcccaaaaccacguccgccgcccacucuuccccgugcaccgcgaguggaggcuguucugccuuuccacuugcuuaacauccagucugugaagaucuaaauaaauaacguggaaaaugcaaaguauaauguacuaagugaaagaacucgagcacacuggggguccacgaagcugcagcugcagcccaggguggcacaucggcgagacgguggugcgcgccuccaaucucggagggcgcccaaaauggaaaauguuuuuaggccagggagugagcauaaacauuaguguuuuuguggucauguagcaaauuagggcagaggagaguuauuuaaaagugaguuuaaaaacugauuuccuuucuuuuguagauaaagaacaggaaaaagagaaaaaaucagugguaagucccucuuuuauguguacucucuaggauaauuugguuuuuugaagaggagagagaaaaaagcagaguaaaaagcaaaaauacauuccauaguaaaaagcaaaaauacaagaggaucuccagggagaaggaagucugucacccuccuagaaggccaccucuguuaccaauuucuuguaucuuuccccagagucugcacagauaggagcacacaaguauuuguauccuucagguagauuugggcuguuaaagcuuaagggaugauugugaaaggauuugaaaaacgcucauuguguuguggggaaggucaguuucaucuuggguugggcagcucagaugugagggaagcucuguccaccaccacccucuccccccaguguugagacuggugggugggcaggggaucagagagaaaccauuaggguccacagauguggguucaguuaucaggguggcuuugagaugcuggcucugggcuggggcugugacuagugugaggcugaaggucaaagaagggucagguugguguccauggggauauugggugcuuuagcuggcugggguagggagugauauuuuggucacaaaccaaggcucaauuccuuaaaagaacugaaagucccuagcuccaguggcugggaaggggguggcuuggcaagugguggcaggaguaccguggcugggaucugcagaggguagacagugcgggcaggcccccagcguacucagggugguggagagcucuugggaaguagugaaaccacauagagaggauugaaaugcuugagauuuguggaaguuuguugaaauuaggagaaggauaugccagcgggugccauagaaggggagggaaaugcaaaguugagcuggaugguaauuaauguauuuuuguuuguuuauacauuuaagagacggcgucuugcuguguugcccaggcuggccuccaacuccugggcucaagugauccucuggcaucagccuccugaguagcugugaugacaagugugagccacugugccuggcuauuuauuaguuauugagcuagcauugaugugagcugggccuguucuuugugcuuuuugggugugguuugaugugcccccagacacacaauagcuaguucauagaaagugguauggagccugcauucaggcucaggacuguuuguaaacauucaaguccugugagcuccugugugggaugcacugggcuaggaccugggcaccuggcaaacagcccugacauuugggagucugcggucugucugaugggggagguuugucugaugggggaggucugucugaugggggagacagcaguaacuaggagaaugguggaacuagaacagcagugaguaugguggcugugaguaggggggcugaugacugagaggagcuuugggaagccuuauugccugcugggagauggagcagaguuugaggcaggaguguuggaacagguacaagucacagaagaaugagaaccugcaggccugggcuuguggccagucccuagagagguggcuggggagggcugggggauaggugcagagggacugagaauagguccuaaaacccagagucacugaagggccucacccccacccagcacgauccggguugccucucagggagcgauguggggaaccaugaguggagggccuaacugggugagacuggaaggggagagaccuuaacuaaacuagagauggcacagagcccgcagcugagugggaaagcagggcccaggggaguugcugguugguugacugguguuggugggugaggagagauguccagaguguuaaaggugucuggguggauggugcagccauuacauggcacaguuuacaauauuagauaauugaguaucacaacaaaguuuuuuaauaaaauaacuggacagaacuuaacauccaacagggccauaccuaauggcucaugccuauaaucccagcacuucgggaggcaaaggugggaggauugcuugagcucaggagucugagaccagccugggcaacauggcaaaaugcuguuucuacaaaaaauacaaaaaauuagcugggcaugguggcaugcaccaguaguccuagcuacucgggaggcugaggugggaggguugcuugagccugggaggucaaggcugcagugagcuguuauugcauugcugcacuccaucgugggcaacagaacgagacccugucucaaaaaaaaaaaaaaaaucaaauaguagggaguucaauaaauugugacaggucuuauauaauggauuauguaaagccauuaaaaaccauguuuuugaaaaauauuuagugaccugggaaggcacucacuauguaaaagaugaaaaaaaaaaauaacaaaaccaacaaaaguauaugaaguaugaucccaaaugaaaaaaaaaacuguccuuaggaaacaaacaggaaagaaauauuauaaacauuaaugccgaaauucucagucuaguuaagagauagaugugggguuaacaaggagcauguaagagagaguuuguggugugaugggguaaaagugucuucccuuaguuauuugaauguuaaaugaaauucagcuggguuccuuuuuaaaacagcuuuauuguaauuugcauaccacaaaauucacccauuuaaaugugcaauucaaugauuuuuaguaaauuuacagaguaaacagcacuacagaguaaacaccacuacaaucuaauuuuauuuuauuuuauuuuuauuuuuuauuuuuugagacaaggucuggcucuguuguccaggcuggaggacaguggcacaaucacaacuuacugcagccuugacuuccuggucucaggugauccucccacaucagccucccaaguagcugggacuacaggcacauaccaccauuccuggcuaauuuuuguauuuguuguagagaugggauuucuacauguugcccaggcugugcaaucuaauuuuauaacauuuccauuacuccaaaaagaaaccuugugcccauuugcaaucucuucuggccccaggugaccacuaaucuacuuccugucucuuuagggauuuguguuuucuggacguuccauauaaaauggaacauauagcgugggaucuuuuguaucuggcuucuuucacuuagcacauuuuuuuuuuuucuuuuuugagauggaguuucucucuguugcccaggcuggagugcaauggcaugaucuuggcucacugcaaccuccgccgccaggguucaagccauuuuccugccucagccucccaaguagcugggauuacagucaugugccaccacgugcagcuaauuuuuguauuuuuaguagagucgggguuucaccacguuagccaggcuggucucgaacuccuaaccucaggugauccgccugucuaggccucccaaagugcugggauuacaggcgugagccaccgcuccugguugcuuagcauaauauuuugacaugcaucugccuuguagcacguauuaguaugucauuuuuuccuauagcugaauaguauucauggcguggcuguagugcacuuuguuuauccacuugccaguuguuagacguuugggcaaguuucuuuugacugcagauuucucagggucuuugauaagacaggauauuuggauucucccuguggaggcuuuggcacccaagccaguuugccucuggaacccuggguucuaauuaaacauccaaaugacaaugauugcugagauuuacgagugauuuuuauuuucuucuuuuagggauuguguaauaagguuugaucagagaaauccaacugauaaauacauauaugcauauucauaaacauauacauauauucaugcauacauacauucuugugugugagaauguauuucuuuuuuuuuuuuuuuuugaagacagggucucacucugucacccagacuggagugcaguggugugaucucggcucaccacaaccuccaccucucagcucccaagcucaagcgauucucuugcaucagccuccccaguagcugggauuacaggcauccgccaccacgccuggcuaauuuuuguauuuuuaguagagacgggguuucaccauguuggccaggcuggucuugaucuccugaccucaaaugauccccugccucggccucccaaaaugcugggauuacaggcgugagccacugcgccuggccacugagaauguauuucuuagcacaagaaugcuuaauuuccauuuuuaggaaagauuaaauauuguuacuuauaauagggauagauggcucaucacaguuucaguuauaaucauggaaaauuggacucaagggcucauagcagaggaaaauggagauaaauuguagcguaaucacagaguguugggccaggccggccaugugcucccacagcauggggaccaucuccuuuucacaguuuccuguugcuuuccuccacacacucaugagcucuuuggccguugcaacgaggcccugaguacacagugccuggcacagcauaggccuucaauaaacaguugaaacgugcucaaagaugaggacuguauagaaaauaauauuuggcaugaaauaugcucauaugucaugggguuuaucucuuaguauugggauuaugggugauaguuucuccuuuuugauuuucuguauuuucuucaaugggcaugcacuucucuuauaauauuuuuagacaucacuuuaaaaagaaauguaaagacucccuuugcuugcuuccuguucccccuuccauuucaggggaacuuugugagauucuuccugcguugccugcuguaaaccggagggcagauuggcugagcucauucagggccugacauucaccagcucuucaggauuucaugcuggggauaggaacaaguuucugggagaagggcuuaucugaacaaccuguuaaaaugcuucaaugaacaggaaagaaaaaagacuguagagugaugucuagguugagcucuuuuuauauaucuaggaagaggaaaaguuuucuuuaaagagcaauaaaaaaauuaaauccauuagugcccuaauggggucuuuucaugcccuuuuguucauucccuuggguucauuuuguaguuuggggcucuaaaggagugggcugggagggacccaggaugggagaguggccuugugucuccuggauacccguuaggaucaaggcaggaggaaccuucuccgccagcugacagaguucuaguugcuggggagacuuuaguggggucgggugagacggcccacugugaccugguguuuaugugaggugugacugaggcuccaucaggagucgugagaaggggccuggaugugaauucuaauucugauucuucccuagccaagucuggcacuuggguaaguuaccuguguugcccagguuucucugggugcuuccagccugagugcaaaggaacaggccucugugcagcaggucgggccccucucugugugugccccuggaggaugucuaauguguucucaggggacaguuugucuuauguauuggagcugcccguucccuguggccaucugcuggagccagagccacugggccuaugucaucagcagugccuggcugagcagagcuuggucagaaucacugggcuacagguucaagggcuccagccuagagucugauuuagggucuggaugcuaccuggugccaccucauguuuaaccagcuccucuggugcaucugaagcaggcaucuguggacuagacagggagaagcucugcuccagccucgugguucccauccuugccugcacauugaaaucgccuggagagcuuuaaaaguuacugaggcuuggccgggugcaguggcucacgccuguaaucccagcacuuugggaggcugaggcggguggaucaccugaggucgggaguuugagaccagccuggccuacauggugaaaccaugucucuacuaaaaauacaaaaaauuagccgggugugguggugggcaccuguaaucccagcuacucgggaggcugaggcaggagaauggcuugaacccaggagguggagguugcagugagcugagaucacgccacugugcuccagccugggcaacaagagugaaacucugucucaaagaaaaaaaaaguuacugagucuugagucucacucccagagauugugguguaauuggucugggcuguggcaucccuguagagauuuuuaaaaggucccaggugguccuagcguauagccagagcugagaaccgcugccuggaauaccuucucucccuaagaugaguuacuucuaggaugcuccuuggucuuugguauagguagacccagaaggcuguuucuggccccucccacuagugccaugacccccuuucccucccacgugcagucauugugagcagagucuagguucaagcuguccuugcuuuauugucuucuacaagccucauuuuuguuuucugugaaaaauguuaggacuuacccuucucagguuucagugagguuacaugugauaaugguguguuaccugucucagggcuuggccugugacaaggugcuuaacaaaguccuugcucuuuuuuucuucuccccuuuccuaaugguuuccagucagugaccaagugcuuuuuuuuucuguaaagcagugaauucgauucuagauaacauauauguguuuccuagccucaaagccauugauuaagcucucguuaaggaggcaggacacuuaggccuaaaaucuaauagucugugggguugaacuaaggaagggcagagcugggcugggcagacaagcuguguaugguuuaggaguugacguaaaggaggaucuggucuggggggaccacaugagccugccacucagggaggaucggcuuaucuguuauuacuaacaaugggaccuugccaguuucccgaggagggauuuugguuuacaugugaaagucuuggacugaaccaauuaugcugguuacaugagcccuuuccguagccauuauucccugacauuccccugggugcuugaguucuggcucuaauaugcauucgucuuuugccagaucugugucgagggcaauauugcaagugggaagacgacaugccuggaauucuucuccaacgcgacagacgucgagguacagccucuaugcuagguuugaaggaagcggagaaagcuugaugggauaauuuauagaggguguggacuaaccuuguccaauaggacuauaauuugagccacaagugcaagccacagguguaauuuaacauuucuaauauccucauuaaaaaaacaaaaggggccggugcaguggcucaagccuguaauccuagcacuuugggaggcggaagcagguggauugcuugagcccaggaguuccagaccagccugggccacauggcgagaccccaucucuacaaaaauaugccaggcauggugguacgugccuguagcuccagcuacuugggaggcugaggugggaggauugcuuaagcccaggagguggagguugcagugagcugagaucacgccauugcauugcauccugagcagcaggagugaaacccugucucaaaaaaagaaaaaaacccacaaaaaauaaaaaggacauuuuauuucacauaacauaugccaaaugugaucaugucaacauuuaaucaauauaaaaaucaucaaugagcuauuuugcauucuaucuuguuauacuaagucuuuggaauaugauacugguugagcaucccuuaucugaaaugcuugagaccagaaguguuuuagauuucagaauuuuucagauuuuggaauauuugcauaaauguaaugagauaucuugaggaugggacccaagccaaaacacgaaauucauuuauguuucauauauacauagccugaagguaauuuuauacaauauuuuaaauaauuuugugaaugaaacaaguuuguguuaaguauuuauguguggaauuuuucauuugaagugucauaucgguuuccagaaaguuuuggaguuuggagcauuuaggauuuuggauuuuucaauuagggaugcucaaacuguuuguauuuguaaaauaaguguaacuuauagcauaucuuaauuuggacuacucauauuucaaggucuuaauaguugccuguggcucauggccacuguauuggacagugcaaguguugacugccucaaagucugguuaggaaaagagucuacauggguaagaagaaaggacaggcuauugagcagggcuagaagugugacaucugagauagcaaugucugagcaguggguauuacuaugcauaggcaauuaauuuaauuucuaguucauuuaaagccuagucacuaaaacuaaccucagagauguuuaagaaucaucucuacacuaagacauugaccugucuuccuuguucuagauuuuagugguauaaucuucucuauugauggcucucuuuuguuacuacagaagcuacaauuucuauacuuuuauagucauuuucuuuccuucuucccuuccuuuccuguuuuuacuucugcuagaaauauaugcauggccaggugugguggcugaugccuguaaucccagcacuuuaggaggcugaagggggaggaucaccugagcccaguaguuuaagaguagccuggccaacaugacaaaaccacaugucuacaaaaaauacaaaacuuagcuggaugugguggcacaugccuguagucccagcugcucaagaggcugaggugggaggauuauuuaagcccaggagguugaggcuguggugagccaggacugugccguugaacuccaaccugggugacagagugaggcccugucucaaaaaaaaaaaaaaaaagaaaaaagaaagaaagaaaagaaauauauauaguuugauaaaaauaauaauaaacauuauauagcccuuguccugcuguguucaugugcugcugugcaggaaagaguuaacauagcagaccuaagacugcugcccuuuagaaaugccugcuugcaaggguggucuuuggcuggcaucugggaacuuagaucuugggagggcccccaccauuccuaacugauaacaguggcucucugcuuaaauuguuucugcaaacaguaugguuuaugcugacaccugcuuucuuccugggaguccggaauuuugguacaugucaggaagugguugucugcauggcugagcgcugaugaaaacccugaacucccagguucaggccagcuugccugcuagacaacauuucacauguauugucacaucuuguugccuggggaauucaguguguacugugcagcuccucuaugagaggacccuuggaagcuugugccugguuuccuccagacuuugcaccugcccuuuuucccuuugcugauccuuuuuucuuuuucuuccuuuuuuuuuuuuuuuuuuuuuucugagauggagucuugcucugucacccaggcuggagugcaguggcaugaucucggcucacugcaaccuccgccuccuggguucaagcaauucuccugcuucagccucccaaguagcugggauuacaagcacccaccaccaugcccagcuaauuuuuuuguauuuuuaguagagaugggguuucaccauguuggccaggcugguuucaaacuccugaccucaagugauccacccaccucagccucccaaagugcugggauuacaggcgugagccaccgugcccgguccccuuugcugaucuuguuuuguguccuuucgguguaauccaucuuagcugugaguaugacugcguguuguguccugugaguucucaugaaucaucaaaccuggggaggagggggggcuuggggacucuugaccccuguccugagugauaugacucuuaauggcacuuuagaagugcuuauagucucacugaagaccuuggacccgauuaacaacgauaguuaacauccagugaguauacugcuauuugcccaacacuguguugaggguucaucauaaauacuaaaugaucucacccucacaagaauagucccucugaaguagguaccauuuuuaccacaguuuuagaugaggaaaccauggccuaaugagguuaaguggcuuguccagggucgcuaggccaguguaugauacagccagaucccagcccggauacagccagaucccagcccaggcugucugguuccaggggccacacccuuguuugauucugugguacgaagagcuuuguuggcuuuaggaagaccacucucccuucagaucugagcuccguguccccugaccuucccagcgagguuaugcuuccugacagaggauccccuggccgcucuguaccucucuuuuauaccacuucuugggguuugaaaacauguuggcuucugugauuaccugaguaaugucugcuuccccugguaggcuuaagguucugugaaggcagaggcugggcugguuuugcuauuguuguguccucagugccuagcauggauaucuggcacacagugggcacucaauaaauguuuguugggugacagugcuauggauggagcaccccugagcugggucggggagcaaggcugccugugacccagacucuggugggccuguguggugcuguguaugcuacuuaggggcuaggaagaagaccuagaagaaggagaggggguuugagaggggcaggggaagggcauauuugaacuggauuuugaaggguauacaggaguuuuccaugugaugaaaguugaugugaaguggaauggggugggaaugcuggucagaagaaacaacguaagcaaagacacagaguaucuugcuugaggguggaucacuugaggucaggagugaaggguggggggugauuacuuuucuuuucuuuuuagagacggagucuugcucugucacccaggcuggagugcaguagcgcgaucuuggcucacugcaaccuuugccuccuggguucaagugauucuccugccucagccucccgaguaucugggauuacaggcaugcaccacuacauccggcuaauuuuuguauuuuuaguagagaugggguuucaccauguuggccaggcuggacuugaacuccugaccucaagugaucugccugccuuggccucccaaagugcugggauuacaggugugagccacugcacccagccaggguggcuacuuuucaagaguuccaugcauugccugccauuggucuuuugucaccuauggccccuucucacauguacucugaaaguucccagauggauccuggcacucugaagaucuuggccccaagaacaccauuuaaaucuuuucuagcacacaccugcauacccagaaaggcucuagcagagucugggguugucccagauuugugugucuagaccacagauggaggcucuagaaaugcccagcagagauccugauaugugucugaaaacacacaggauguuggagagauuggcagucauccuaaaagguacaaacaggaccagagggaaagaaugccuccaaaccagugagacagggagcguacuaaagaaacagggacuaucagcagccagugcacccagugcagugaucagaggcaggaaacggaggcagguggccugccaaggccuagcccuguccagugucccuccuggcuucucccacccaccugccagcuugaugugguaggcaggcaggggugggauagaauacacagaagagggauggacagagccagcucugaccuuggggaggcuaccagggcaauagagagguaggauguaccuaugcuuggcacauuggguaacauggauagaguuauucucaggacauuucuggaaguaaugugaggaagccgugucuagauagaguugugaccucacggggguugucagcuauuuuggccuaccuugggcacccaaauuuggauagucuuuuucucucuuuuucccuucucuccucacuuuccccucaacacuuacacacuuuuacaggguucagcacagagaaacaguagcucugauguuuucuuuccuuccagguguuaacggagccuguguccaaguggagaaauguccguggccacaauccucuggugaguggguuguugguugcaugaacccccggcuuccccuuaagcaccugagaaugauggugccucugccugagcccugccugcccaggcauucucugcgcucuuaacugaguuggagaagaccagggagggacaagcagaaaaugguggcauguugguguucugaggucaaggaucucugaggccugaguggcugugcacagagccuagggacuucccgucagcuaucccauacuauucccaguggccgaccuuagccacuagggguguccauuucuuguugcucauuccagccuuccccuccccuagaagaaaccuaucagaacccgggacuucucaggccuaacccccccaggaccuaucucuaaguaaccaggauccuugguggaccccugacuuggguuugcaaacuuggcccugucugguaacaggggccaccucuggcuuaccuggaagccaccagccugcuuucccaagggugaaccuagcaacaggggcuguagugugcugugucccuuccuucaccuuccccaauucgagguucugcucugguugcuugaaagagauggauagaaucuggguccugcaagagagagcuuuagaagaggauguugguucugagcucccaucccaugagguagggaugauuagucucauuuuucagcuuaggaaauugcacuuauauaaguugccugaggucacacagcuaguaaauggacuuggaagccugugcugcccugugauuuuuuuuuuuuuuuuuugagauggagucucagucugucccuaggcuggagugcaguggcgcgaucucggcucacugcaaccucugucucccagguucaagcgauucuccugccucacucuccugacuagcugggacuacaggugcgcacgaccaugcccagcuaauuuuuguguuuuuaguagagacaggguuuuaccauguuggccaggauggucuccaucuccugacccucaugagccacccaccucagccucccaaagugcugggauuacgggcgugagccacugugcccggccaugcccucugauuuuuagcaacacaauuggcaucuccugugugguucauuagacucugaguucuacuaggagcagggacuguaucuacuuuguucauuguuauuugcuaaaaccaaggcacacugccuagcacuuaguaggggcuugugcauucauccauucauucaaccaauauucagugcaugucagccauguggcagacacuguucuggaugauauggcagugauaaauucaaagcccuugcucuccugccccuaauauuccaguguggggaggcagaagucaaacauauaaucuggcggguggugauagggccuaggaagaaaacuaaagcaggugaaaggauguuucuuaaauaaggcaaaaccucucagucuuucaauaaagaauccuaaagagacaugagaagaauuucuucucugugcauucgggagaagauggaauaccagucaucuucuuuggauauaacaaagaaaccucuguaacauucauauucucuagaagccaaggaggaacccaggcuuaguuauuaaguaagacagcuagaguugcagguguuagggaucauaagugacguuucacgggacagaaucacagccucagaagucuuaguguccuugguacagauagccuuuucaaugagaguuuccuaauaaaaaauacaauagaaguagccauuuuuauauaaguuuccacucuagaccaaaagaaagaucgauacuuuugugaaaaaucucaauucaucacuuuaucugaauugguuuucugaugcagaaaggugacuguuucugcggccaucaggcaagagggaguguuucuccuagccuuuaugagauuuucucucaacugcagucagaggagucugcaguucucaaugaagaacacuggaguuucauuaguuugcaccaagagaaaaaugaaaagcaaaaaugaggaaaaggccgggugugguggcucaugccuguaaucccagcacuuugggaggccaagaucagaggaucacuuaaagccaggaguuugagacaacccuggucaacauaaugagaccuccaucucuaaaagaaauaaaaguaaauaaaauuaauuuaaaaaugaggaaaggagcagaacagguuucuuagcaaguaugcuggagcaugaaguguuuugcuucuagaagggauggagagugauugaguagguggguuggcuucuguuuuacaugagauaaccagggaaugugucuaugauaaggugcuuaaacaugagggugugagcacugcagauaucuggaugaagaguguuuaggcagaaggcgcugcagaggcaaaggcccugagaugggaccaugcuuggcauguuugaggaaugcuaaguaagcucaugugguuggaagccaaccaggccagagggagauggguaggagaugagagaaagccuugugggccaugauaaggguuuggauuucauucugcaugcaaugggaagccacuggaagguucugagcaggggaguggcaagaacugauuuagguuucacagacucacucuuguggcuggauagagaacagacuacagagggcucaaagaccauucacugaacgacuugaacgcauguuccuuggugauuuuauuuuauuuuuugaauuuccaaagaaaaguaauuuauuuuuugcaguuagggcagcugagaaguccaggguugaaggggugcaucugcugagggcuuucuugcuaguggggacucuucagaguccccaggugguacagggugucacauggugagggaguugagcaugcuaggucaggucucucucccuuuucucauaaagccaccaguguaagauaacccauuaaucuauuaauccgugaauagauuaauccauucaagagggcucuguacucaugauccaaucuuuuuuuuuuuuuuuuuuuugagacagagucucacucugucgcccaggcuggagugcaguggcgcgaucucggcucacugcaagcuccgccuccuggguucgcgccauucuccugccucagccucccgaguagcugggacuacaggcgcccaccaccacaccuggcuaauuuuuuguauuuuuuaguagagacaggauuucaccguguuagccaggauggucuccaucuccugaccucgugauccgcgcaccucggccucccagagugcugggauuacagacgugagccaccaugcccggccgauccagucauuucuuaaaggcaccaccugcuacauacugccacaugggggauuaaguuuccaacacaugaaauuuaggggauucauucaaaccaaaguauuauuuguuaaagaugaucuuaaagagcuuaacuucuuuaaaaauuuuaaacuuauuuauuuauuuauuuauuuuggagauagggucuugcuauaucacccaagcuggagugcaguggcacaauuauagcucacuguaaccuuuaacuccugggcucaagugauccuccugccuugggcucccaaagugcugggauuauaggcaugagccacugcaccuggcucucuuuucuuuaugcuagaaacauucaaauuauucucuuauagcuuuuuuuuuuuuuuuuuuuuuuugagauggagucucgcucugucacccaggcuggaguacaguggcaugaucugccuggccagcauggugaaaccccgucucuacuaaaaauacaaaaaaauuuagcugggugugguggugcaugccugugauccuagcuacuugggaggcugaggcaggagaaucgcuugaacccagaagguagagguugcggugagcugagaucaugccacugcacuucagucugggugacagagcaagacucuguuuaaaaaaaaaaaaagauuuuuaucaaaaagacaggugauagguguggagaaaggggaacccucauacauaguuggugggaauguaaauuaguacagcuacuauagagaacaguuaugaagucaggcagugugaugccuccaacuuuguuuuuuuugcucaggauugcuuuggcuauuuggggucuuuugugguuucauaucaauuuuaggauuuuuuuuuucccuauuuuugcaaagacugucauagguauuuugauagagauuacauugaaucuguaaauugcuuuggguaguauugucauuuuaauaguauuaguucuucugauccaugaguguugaauaucucuuuuuuuguguguguucuguucaauuucuuucaucaguguuuuauaguuuuccuuguauagaucuuucacuucuuugguuaaauagauuccuagguauuuuacuuuuauuaauuaauuaauuaauuuauuuuuuuuuucgagacagggucucacucugucauccaggcuggaguacagugguacgaucucggcccacugcagccucugccuccuggguucaagcgauucucaugucucagccucuagaguagcuaggaccacaggugcgugccaccacacccagcuaauuuuuuguauuuuuaauagagacaggauuucgucauguuggccaggcuggucuugaacuccuggccuugagugaucugccugccucaaccucccaaagugcugggauuacaggcaugagccacugugccuggcugguauuuuauauucuuuguagcaucgcaaaugggauuccuuucuugauuucuuucucagguuguucacuguugguguauauacaugcuacugauuuuuauauguugauuuguauccugugguauuacugaguucguucaucaguucuaacaguuguuugguggagucuuuaagguuuuuuuuuuuuuuuuuuggucauuucaacuuuuauuuuacuuuuagcgggguacaugugcagguuuguuaccuggguauauuucaugaugcugagguuuaggguaugauggaucccaucaccuagguacugagcauaguacccaauagguacuuuuucaaccuuugcccccucccuuccuccccacucuaggaguccccagugucuauuguugccaucuuuauguccaugaguacccauuguacccacuuauaaauauccacuuaaagugagaacaugcaguauuugguuuucuguuccugcauuaauuagcuuaggauaauggccugagucuuuaagcuuuucuaaguguaagaucauguuguccgugaacaagguuaagaugacuucuuccuuuccaauuuggaugcccuucauuucuuugucuggccuaauuccuccggucccucggagacuuuccauaggcuccuauuauagcuguuaccauacuguccuauaauuguuucagugucugccuuuguccacccugcugucagagcccugugaucaugcuggguuuaucuccagccccaacccugccuguguagguuucuugagcuguccuucagugccuugugagaccaggguccuccugcagaugccacuuugauggaaagugcuguguuuucccuucugcagggccugauguaccacgaugccucucgcuggggucuuacgcuacagacuuaugugcagcucaccaugcuggacaggcauacucguccucagguagguuucagaugcucaguuucagccuucuuaaacguuuucuucagacuugggguaugugauugccaggaagggaaacuuuacaaggaagccaggcuaggccuucagugcugugcaggccucucuguguggggccaaggucucuggcuucugugguucucuucugaccugccucuagugcccccaccugcaaaccucagccagccagguggugccccugccaccauucugagcucacaucuuuaugaccugaccacugcugggcuuaaugccguuuaacucaguucuucucaaaguguggucccuggaccagcagcggaagcaucaccuggaaacuuguuagaaaugcacauuuucagcugggugugguggaucccaccuguaaucccagcacuuugggaggcugaggcaugcggaucaccugaggucaggaguucaagaccagccuggccaacauggugaaaccccaucucuacuaaaaaauacaaaaauuagucuggcguggugguaugugugugccuauaaucccagccacuugggaggcugaggcaggagaauggcuugaacccaggaggcggagguugcagugagcugagaucauaccacugcacuccagccugggugacagagugagacucugucucaaaaaaaaaaaaaaagaaagaaaugcaaauuuucuagucacaucccagaccugcugaauuagaaauucuagggaugaggcccagcaaucuguguuuuaucaagcccuccaggugacucgaaugcaugcuuuguuuguuuucauauuugagaaccacuuauuuaaccuucauggggucuggcucuuaguucaaauucuugagacaaagaaucugauugguucagcuuuggucagguguccagcccugguucaaucagguguuggggacaggaccccaaggcacaaacauggcugcuuaggccuauuccaucagugaggaugcaucuagagacagagucucuuagaagaaagggggcuguggagguccugaucagcaccuauguuucaaagcuguaagcacaaccuaugaugccagcuuuaaggcucugcaugaaggagacagacugucccuacagccaguuaacacuggcacagcugcugggcuggacaguucggucccagucuggguaccugcagcaauagcuaccauucuucuguaagucugucuuuuaaaauugaaagaugugagugggccguuuuuggugaauaagaauuuccaucuccccaaauaucugucuaaauugcacaaauccacaaaucgaaagaucugagguuagugcauuuugccuuugcuaauuugcuuuuccugagcaggcacucaauugcaaaccuaaguuguaucuaaugauauuugaauaggaagggauauaaaugcacuccucuauuuaaggaaaucuaccucaggaggcagagagagauggacagaccaggaaagaugagcagaaggagaccagagggaugaauggggagcuaggaaguaaggaaagagaggauggaagaauggaaaggaagauggaugggcagaggauggauggacagagggacagcagggagagggaggaagugccuggguuauggcuuugaaucugccuuggauuuguuggcccaggucccaugggugcugugggccauggccaagugagaguaguguuagugugccuggcaucaagggucagggcgccucuugcuucccagaggaacgcuggacaaagggcaaggucgucugcagaggguuugagcauccuggcagaaaggggcacugucaggcugucuuccucccucuugggcaucguucuuaccaguuuccuugggcagagcccccagaacgucacccccaacccgacccucuuggggcuguaccucaugcauguggucccucugcuuaagcaaacucacccuauuuagguccgugguagucaccacauguugccucaaguggacagcuuuggaugguuucuccagggcuugaccguguucuaguugagacucaccugccaucaaagaggcagcugcugaugagcccucagccucggcauugcugggccaugcaugcagcuuugggguguggggcaggucaggguggaagggggacacagccugagccugguggcagauguggcuucuccucccggcaggggagugaggagguccuccugcuucacucucucugccgccuugauucucauauucagcaaaguccccaggcagggggaguaacagacauuucucaaggccuccuggcugucuccuuuuccccugaguuagugauucucuuuuuguuuuccuuuaggugucaucuguacgguugauggagaggucgauucacagcgcaagauacauuuuuguagaaaaccuguauagaagguacuguaguuugaauaguugauaauuuauuaaaccacuaauuuuucaaaaugaaauagaaacuuguuuauucgauugacagauauggaguacccgcuguuguaucaguuauccauugccauagcaaugcgguguaacaaacagccacgaauccucauggcagacagcuaucugcauucauugcccagucagccaggguggucaccaggcagcucugcuuaccuuggcuaggcucaaugagaugucuggggaucagccgauguaggauagccuaagcaagggugacuggagguggcucaucucuuuuccucuugccugucacucuccuucugggaccagcaaaccagcccagguguccacuucucacggugacaaaggguagaagcaacagcagagaugcaaggacauauuuuucaggccucugcuccaaguuugcuagcauuccauuggccaaagcagaucacauggucacaugagcccaggguggaaaggugggaggguccagugaguuacacagcaugguacaaggcuaaagggaaggguggagaguugggcgagucagacgcacagugugcgucgcauuuguuguguuuuucacuaaaagcuucccucaugagagcagacucugugauguauaccuaguuaggggcuucugguggccugucagugccaagggcucaggcauggggcccuccaucccugugcucagagacugccgauuucuaggggucuuggaaauggguugcagaccccaccugucccugccgcgagcuugggauacugcuguccuucccucgcagagcuguucggaugucaacgcuggaggcccuuccucccacucucaucugcagcugucuuccuaaaugccacccugucucccagcccuccccgaccacgcugucuagauagggcaagcuccuuguuagucuuuguuucguuuuugguuuugguuuuuguuuuuugaggcagggucuggcucuaucacccaagcuggaguacgggggcacgaucucagcucacugcaaccuccgucucucaggcucaagccaucguccugccucagccucccgaguagcugggacuacaggcacacaccaccacaccuggcuauuuuuuuuguauuuuuaguagaggcaggauuucgucauauugcccagguuggucuugaacuccugggcucaagugauccuccugccuuggccucccaaagugcugggauuauaggugugagccacugugccugguccccuuguuauucuuaaggacuacuuucuguuaguuuucuuuguaguauuuaaggcaaucauaugaaauuguuuaaccaauuaugaccuacaaaaauggcaguuuugugugguucaacuuaguaugugucuaauuguuuauugccacccacccccccggaccauaagcuccuaagggcaggcaccaaguuuguuguccuugccuaggguggacccagcacagagcaggcuccucguugauaccuguuagcuauuguuggaugaggggaccuguggcugugcuuuggucuccagcccaacuuguuccccaggcucuggucccccacuguuuugcaccuuucauuugaggggccacuaaaaaggcuucuccuaggagcccugagcugccauggaucaugccuuugagccugugucaccccccaaaaugagagccucugccccaaauccacccagagcaucagagcaaugcugugggcucaggggcuggcagccaaggugaguccuggccguggcuuugcccccuggccucagacuuuucuugugggcugcagcuugcccucugagcagguggcauuccugaccuuacggccccauuuucaccugacaaccuggguuuccagguguccacugcuagguuuauccagcccucugcgguccucagcuccugcuccuuagcaccucagccagagggaggacaggcaggacagaggagagcgagagcagaagggagccucuguuauguuuguguacugcucugauuagaacuguaacccgaggcggagguugcaaugagccgagauugcgccacugcacuccagccugggcaacagagcgagacuccgucucaaaaaaagaacuguagccugaggaacagaucuuggcaguggggugggauuaccuaugaaccucgcagaguggggcugugucugucuuuuaaucacauucagcuuggccuguucuguguggggucaguggcucuuguugcuuuuuuuauuuuugagaugggcuugugcucugucacccagacuguagugcagugccaugaucauggcucacugcggccucgauguccugggcucaagagauccuccuaccucagccuccugaauagcuggaccuacagcacaugucaccacuucuggcuaauuuauuucuuauuuuuuguagagacagggucucccuguguugcccaggcuggucucaaacuccugggcucaagcgauccuccugccucagcuucccaaaguacugggauuacaggcaugagccugauuacagcucugcucggccucguggcucuuuuugaagcaaguaaucuggaauggaaugaccagagguuaaggggagaggauagaguguggcauuuggugggccuggguucuauccuggcucugaaguuugcucuguuugugagcaagaccaaguuucuaaauuucucugagcccaucucucaucucugauuccucuuguccaucucugaagagccuuuggaccugccaccuccuucgugucuuaggacccuuuuguggguccuugcccaccuuggucuuuauuaaauuugugaguuccccaauccuacccccaaaccuguaggccacccagcgcuagguagauuuccccaggagccauuugucuuuguuuggccggucacaguuccugcugauggccaugggcuuugguaacucacgcccaugguccugcaucaccacauuucugaugcgucaguucuguaucucccaaucucugugguuacggcauuggucuagaugacaugggccuugccuggagcuguucuguggguaguuuaggaagagaauguagcuuuuaauuuuuuuagcucuuuuccuguccugaugacuuuauauuuaugucucucccuggcccucccagaaugcauggccucugugguuaggauuucugugggacaaugaaccacagaagaaacuuacaguguccuuucuguucuugggaucuaauuguuuuaaguucauauggcuuucggggggcucagauuccccugaagaccuuguuggggccuugagauccaucacugggaucucuugaagccaaaggcucucagugggcauguggccucgggcacuccagaggcuacugggagcacuguggcugccuggagggccaggcuaucuaccauggucuccagagagaugagaaaaggcgguguuccucagacccuuucaucggauuccucugaaggcagaggaaagcuccccacagcacugcuuccucauccucccagacccugugguccaaagcagccaccugccaacaacccagaaguuucuuggagucuccuauuuuaaccuagaauucauugggauuuugcauuuuccuccauaauauguucuuaaguuuguaucuaaaaauaauaauuuacauaacuuaucauugaggacaauggauguuccuguauuaaacaccaugcuuugcauguggcuuggaguucccacucccucagccacauaccccagagucccuaaguccaggaggcagagaaccaagggguagcggcauucaaaacaccuucccagggcaagugauucacuugugaacugcaccugcuuauguguucccuggaaacgggggcaucugcucucaugguuaaggaacagggcagggacccauggacaggagcugcauuuacugucugguuguugacccuauugggcagauaaggaacugagaaaggauuacaaagccagugcuccuuccugaucgggcaggaacuaaccacaggaggggaagguguuccgaacccugcugugugggggcaagcagcaaaugaggaaguggcaggaggcaucuagauuucucucaucaaggccaaaggcuucagggcccacuggguuccccaaagcugagaauccugagguacuagcccaagggggagacucugccucuuuccagacaggcuuuacccuaagcuucucccacaaccaccugugcaucuuguuuacaggcagauuccacuucaguagcacugagguggggccugagaggccacauuucuagcaggugcccaggugggaccauacuccuacuggucggggaucacacuuugaggaauacgggccucagaagaagguggcagggccggguguaguggcuuauacuuguaaucccagcacuuugggaggcagaaggggaaggaucacuugaagccaggaguucgagaccagccugggcaacaaaguaagacucccaucucuacaaaaaauuuaaaaaauuagcugggccugguggugcacaucuguagucccagcuacuuaggaggcugaggcaggaggauuacuugagcccaggaggucagggcugcagugagcuaugagcauaccacugcacuccagcccaagugacacagugggacuuugucucaaaaaauaaaaauaaaaaaagcugguagccaggugguccacagggcgcccuccaucccaaugccacgacccuuuuccccuggaguucugacgguaaggugggcuuccuuggggcuucacuggaccuuugggggucauaagaacaagagccucggccugaggguugucuuugggaccauggugaaaaguucugcgcagugcaggauuuccuguuuccugcaccuggccugugguuucuuaauuucacauuuguugcuucauauuuggguugcugggggcuguguuguguuaucuuuguuuuuaagguuucuggacuuauuccuaggccaagaaucaggcagccauagggcaaaguaaaaaguauuuuuagccagagccacagaagggauaaagggaaggaagacuagagcuuggccacucuccggacaacuccagcugcccucgauggagcggucauccacaacgaaguauuacugagaaaguagaugugggguuuuuuuguuuuuuguuuuuuguuuuuuugauuuugagacagaaucuugcucuguugcucaggcuggaucacucaggcgaucucagcucacugcaaccucugcuucccagauucaagcaauucuccugccucagccucccgaguagcugggauuacaggcgcccaccaccacgccuggcucauuuuuguauuuuuaguagagacaggguuuuaccauguuggccaggccggucucgaacuccugaccucaagugaucugccugccucagccucccaaaguguugggauuauaggcgugagccaccaugccuggccaaaguagauguuuuuagagguuucggcuccuucaaaaugcagauuacugucauugucacuaccuaugcaaaauguagcauagaacugacuuuggcuggguccuuugcccauaccuagaauaaggugucuugguucccaccugcagggaguucagccagguacugggaaccacacgguggcauguggggcgucagcuccugccugggagcucguguuuccucauuuccugggaugcucuaggaaaaggcuucccaaaaugccaugauggggagcccuucacaaggugggagggcacauuaccauugccccuucagugcuuggguugaucuuuuucucccucucagaagcucuugcaaccuugguucaggaucugugggggccuagacagaaggcuauauggcaggcucagguccccagaaaagcccacauauuggaauccugcaucuccucgaaguaaaauuucuugaaggguguucuugcucuuugggcugugaacaaaugaagagcucgccagggaaaagacccaccucuucuggcacugucuacccuggcgagguuggggugugcagaauguaacugcaguuaugccaccagggauucgagagggcuguguuaauugcuggagaggaagauuccaguuacacaguauccuuaaagacgggaacuucuuuuucuuuuuuuugagacggaguuuugcuguuauugcccaggcuggagugcaguggugcaaucucggcucacugcagccuccaccucccggguucaagcgauucuccugccucagccucccgaguagcugggauuagucaugugccacaacgcccggcuaauuuuguauuuuuaguauagaugggguuucuccaugguggucaggcuagucucgaacucccgaccucaggugaucugccugccucagccugccaaagugcugggauuacaggcguuagccauugcgucuggccaaagacaggaacguguaaggggcaggcagcuggcuggcaugaaaagcugaagguggugagcaagauucauguagcuaaagaggccacacaggugacugugugggccgaguaaugggaagcaaagguuuuacaagauugccuggucguccuuuucuaagaacagaagugagggcguggagugggacccagcucgggaaguggcaugcugacucaccuguggcuugugguuggggacacugaguaagaccugguguuuggaaccacaggcugggccuccuccccugcugauuggcccaggggcuuaaguucuucccagcuccugucuagacugaaaccuccuggugugggucaugcgccuaagagcuguggccuuccuggagcucaggcuagagagacacuggacuugauccgagucagcugacagacuggggugggcggguggugcaauggagagcauuuggguuuggggguagggagagccaggcuuggaccccugcucagacagaguuggccuucacuucucugauccucagguuucuucuauaaacugggacugaagccagccucacaaggucuugugaaaacaaaaggaaauaacguauacaagggagcucuuccauuccauuccgcacagacuggggggcucucuuggccucagggaaggaugcaagaaauuguacugauguaacagcaggauucauguggaucaagaccuugguuuugcccccuuggggucagggcaagggugagacccccaugcccacuguugaguugugugcuuggauuugccaagcuuggauuugcuugguauugcucuccgugcauucuguagaaauaaaggcaguggcuugucuugucggugguguggggagccccaugcuugagacagacacaggaggagcugggcagaguuccuaggaggaaauacaguuagagcagcgcccacugugccccaugucccucggagucauggagaucaggcuucuguuuccucacucagcucagacacuggucauucaguccuccuggaucccccagccucuucuggcacaugguucuagucauggaaggguuuucaauaggucuggccuacugacccugcccaugggaggccacccgaccaaggaccccuuccaagagcauugggaagggagaggcugccccucagucugcaccaacccugugggggaagccuuuuguuuggcugugaugggggugggagugggaggccccugugacuaccuggagccgauucccaggggagcuguggcaggggcagagccaccggagucugucagucccagagucccccacaggugugacccccuccccaugucuccaugugcagacccccguguacugugacuguuuugcaguggugguugguuugguuuuaguuaacacugcuucauuuguucugagcugugguucaguuccaugaucauaucugugggcacccucccagcucugggauuggacagagucucccucgagcugugcagacgcaugagguacuccgguggcuaguccagccuuggacacuugggagacugucccaugggcagcucagcuucuccccaguugcugcuaacuggccccaccccuuuggugccaccucuucugugcccucaagccaugaguuugcuggaguaggcgagaagcuaaucagcagcuuccucauugcacauccucauuuucuuagagucaauuuuguucucagucuucuuuuuccagaaaaggaaaauaagagauagugguuugguuucuugaacaucaaauauucggagcugaacuaacugaaacccaacucaggguagccugaacaaugaggugucaucaacucccaacagauggcuuauuuggugccucuggccugguuucucuacauuuugcuacugugcauccuguucguguccucaugcaguucucucagggugacaauguagucguggcagcauugggcuucucacucgcugguuggaguaagggcaggugucuugcuaguggcucuucccuaagcgugcggaaguaucuuuucuguaagucccugcaaaccucccucacgccugccuaauccaaauugggccccuggcugggggaggcccugcacugauugacuuagcuuggcuuccugaacgcauugcuggaacuaggggagacgacuuccuuuagaccgauugugccuacccuaaagcuuggaagcuugggguggggugagguuucccugaagcccuugggucuguggauggacccugaauaaagaaugggcuacuuuuaaggagguaagcggagaggaggcagggaggcagccuguggacacaaaguugucaccugaacuuguagugccugaguuuuguugccugggaguccccucugcaaugcuguaggauuuccuucccacuccuccagccucccacgcagcuucuccagguuuucugggaguccuggccgucccacagguuggucugcccuggccucugugcugcagucugcucaggccccgcugcuguucuccguccacucucccgcuccucugucaaauacucuucucuucugaggacauggggguggucucagagacuaggggagaaugucccucuccaguuggugccaugccuugcuguuagggccccaagacagggcuacuugugcccuuggccucccagagugccugccucacucuuccagccucuuacuuccuuccaugcucauccccucgugggacuggagucagccccucccugcccccuccccacugagagccucccauugcacauggcucagguacggccacucccccauggccagucuugccgaacccagcucugagcgggacccacauggagccacuaguggaauggaggauguuaaagggagaauuccucugcuaggccugugaggguugucugccugcugaugggcuugugcccuccagcuguguccauuccugcucucucuuuccuguucauuuccucccagggcacaggaaacccacaggaauaccaggaauagaugccagauuucuccuucacccuggcucguucuuccuucccacuuucuugccuuuuuuucuuucuuuuaaaguuaacauuuaaaauguguaguaggccgggcgcaguggcucaugccuguaaucccagcacuuugggaggccgaggcggguggaucauuugaggucaggaguucgagaccagccuggccaacauagugaaaccccgugucuacuaaaaauacaaaaauuagccaggcaugguggcgcacaccuguagucccagcuacucaggaggcugaggcaggagaaucgcuugaaccuaggaggcggagauugcugugagcugagaucacgccacugcacuccagccugggcgacagagugaaacucugucuuaaaaaaauaaaaaauagaccauccuggcuaacacggugaaacccugucucuacuaaaaauacaaaaaauuagcccggcgugguggcgggugccuguagucccagcuacucgggaggcugaggcaggagaauggcgugaaccuggggggcggagcuugcagugagccaagaucacacuacugcacuccagccugggcgacagagcgacacuacgucucaaaaaauaaaaaaaaaaaauaaauaaaaacuaaaauauguaguaaugcuccccaacucccacugcugauuugagaaguaauguguuguuaaaauuuggaaaauacaaaaagguauaaagaaaaaaagaaaagucucauguaguccugcagcuugagaaaagcacuuuuuacauuuugauauuuuucuuucccaccuuuccaagaugcauuggugaauacuuuuggaaaugugguugggauauacacaguuuuagauccuguugcuuucacugaacauuagauuugaaauuuuuccaugccauuaaauauuauuuuacaauaucauccuucaguuacugcgugaauuuucuguuauauagauuuaccaagauuuaguuuuuuauugguuuaaacagugccgcggugagcaucaugauuauuuucacaaaauaaauuuuuuuguuuuguuugagucaggggucucacucuguugcccaggcuggagugcaguggcaugaucaugacccacuacagccuuaaaccccugggcucaagugauccaccugccucaguuucccgaguagcuaggaccauaggcaugcgccaccaccccuaguuaauuuuuuuguaguuuuuguagagaugggggucuuuccauguugcccaggcagaucuugaacuucuggccucaagugauccucccaccucacccucccaaagugcugggauuacaggcauaagccaccacccugguccacaaaauaaauuucuagaagugaaauugguuugcugauucauugccuaaccugagcacugucucuguucucaggguacaagcuuuaaagucccuuucucugcuuagaguuccaaucccaagugaauucucccaucacuccgugccauggcccuugcagcauugugccauaagccgcucccaggcagcaggaggucgggaaugcuuaggguccuugucacugcauguccaguauugcacggaucacacugugcccugguacccuuggugacuccuuucauugagagccgucucaagauccuuuugggggaauugcauagcccagaaguuuucucuuaggugaauaagcccuuacaacucucauugcagugggaagaugccagaaguggacuauguaguucugucggaaugguuugacuggaucuugaggaacauggacgugucuguugauuugauaggugagaugcaccccucccaccucccucucuugucucucuccugggucccuugaggaugugcuuggcugggccccaacccuugggggcagugggugaggcacuugcccuuggcaguuccuuccccaugggaguucagcuuucucccugagggcagacagaauucgggacuucuggucucucauggagaagaacccuggccuuuguucuuuaaacuucccucccuggcucagcuacuuucagacccaaauccacugugaucugauggguuuuucuaguuugcaaaggaacaggaaggacagagccugaacauucacugagaccugcugggugugaggccuguuuugagcucugucuaugaacagaaucccauucagccucaaaacgaccccacggggccgcugacacugaaagagaaugaaagucgaggcggagggucaguggucaagccaagagcuggcccucccugcuuccugcucgagcugugcagaccuuccucccgccuuugccugugugccugcuuugcuuccaagccaugagcagaguccugagagccacguauucuuuuaaccucaguuuaccuucggaccaauccugagacuuguuaccagagguuaaagaagagaugcagggaagaggagaaggucauuccgcugguaagaggccucuuugacuugguuaaagacaaacugggaaaccaccucuguccaacccggcuuccucucccggccccacccccaugagaucauugugcccuuguuugcagagagagaacaggaaccaaguguaucagagggugaacucugacuuccuguuuggccagagacccacguggauguccagaucugcuuggcuuccuguggucgcugacucacaguuuggcaacccuccugcuuggaggcguuccccuccccuccccaccugccccuccccaucuuggcagcaccagggcuugucuguucugccuccugaagauugccuggccuugugcucucuguguccucccuagaaugcgaguuccaggagggcaggacccagcccucuuguucacugcugcaucccuagugcuuagcacagugcccggcacggaggcggugcucaugcuuagugguguuugcccacuggagagaugccaugcccuucugaguucugcucaggccacacugacucucauggggacucugccaguauaggcccgggcugugcaucucgcccuggcccuucccuccuugcaucucccuucaaaaucuggccuccaggcugccgcccggcugauauuuccaauacucaucaccacucgugcaauuucccagcccagaaccuuucagugccuugcugcuggcuagaaugcaguccccacuuuguaauacggcuuaugacccggccccaacugccucucuggcguuaucauccuccauucccuacuuucuaugcucuggcuauaaggaacuaguuguggccacacacaaacaaccacauacacaguggaguuaugcaaaugugccuuugcacagucguuuccuuugucuuuaaaguguuacucagaugucaccuccuccaggaagccaccccugaccuuccuuccauuguaaccccccccaaacccacccccuggcuuucugugaucaugggccuuaggacagcauacugacacuauuuguuuauaccuuuguuccccaucccucacuaaugugagcuuuuuaagauugggucuuauucccuccguguccucugcaugugccuuggggccuggugccuaguaguugcucaguuaguauugaacugaaugucccaugugagaagcugccacuggagggagacagaggcugggcaagcauucaguggggugucaggggcucugagcucaggauaggcuggacugggggcccugggaagccuauccaacuccugaaauccugcucagccuuguuuuuccuuggugccagcacgaugcauuccugccacgagggcccaggcgucacucugggcagcuccuuugaaaucuuggagacaagaaugcuaggaagauggaaugugguggaauggggccaggcuggaccaugcugugaugcgcacagcagcucugugcagugacccagaugcuccccaagccugggggccguccaagccgugauccaagccauugucuuaaggguuugaccagguccaugggacacaucuggcuccuauugccaagggagagcugggcaggagauguaaaggcugcugcagaguugacacgcgagccucugggauggcgaguggaaucugugugaggagccaucccacucugugccugggagagcacgaguaucugcucugccuggcaugcaggccccauggcucaggagggccugugccccuuuucccuugggcuccgcugcaucaggcuuucugcaguugguggucuuuauagucuggagggucuauagguuacgaguuguugaggggguagaagggcaaugggugagggucacaguccucuugguggcaagacagagcggaggguuuagaggcugcccagggcugggccccugccugaaggaacugaggcccugcugcugcaaaaguggcaguaaaugggagaagccagguguggguccugccuuuuuuuuuuuuuuuaguauuuauugaucauucuuggguguuucucggagagggggauuuggcagggucauaggacaauaguggagggaaggucagcagauaaacaugugaacaaaggucucugguuuuccuaggcagagggcccugccgccuuccgcaguguuugugucccuggguacuugagauuagggaauggugaugacucuuaaugaguaugcuaccuucaagcaucuguuuaacaaagcacaucuugcaucgcccuuaauccauuuaacccuuaguggacacagcacacguuucagagagcacgggguuggggguaagguuauagacuaacagcaucccaaggcagaagaauuuuucuuaguacagaacaaaauggagucuccuaugucuacuucuuucuacacagacacaguaacaaucugaucuuucuuuuccccacauuucccccuuuucuauuagacaaaaccgccaucgucaucauggcccguucucaaugagcuauuggguacaccucccagacggggugguggccgggcagaggggcuccucacuucccagacugagcggccgggcagagggguccucacauccuagacgaugggcggccaggcagagacacuccucacuuccuagacgggguggcagccgggcagaggcugcaaucucggcacuuugggaggccaaggcaggcggcugggagguggagguuguagcgagccgagaucacgccacugcacuccagccugggcaacauugagcacugagugaaccagacuccgucugcaaucccggcaccucgggaggccgaggcuggcggaucacucgcgguuaggagcuggagaccagcccggccaacacagcgaaaccccgucuccaccaaaaaauacgaaaaccagucaggcauggcggugcgcgccugcaaucccaggcacuuggcaggcugaggcaggagaaucaggcagggagguugcagugagucgaguuggcggcaguacaguccagccucggcugggcaucagagggaaaccgugcaaaggggagagggagagggggagggggaggggguccugccuuuugccuuggcuuugauucaggcgccaggggaagggccaguguuugugcccacgaacccccaguggagcagagcaggguggcuggugacacuugugcuguuuugcucagccuggccaccgaguguguggcugcgucugccgcuguccacuugagccagguuugcucuugcaggguuccuuugucugagucacugcccauggucauugacuacuuugacccccucugcuugacacccuugguagguggggucugcucuguccacucccgacagacugcuuguguuucccuggcaggaauaccuggaagcaauucaccaucuccaugaggaguggcucaucaaaggcagccuuuuccccauggcagccccuguucugguaaguaagacucccuuacaggguacgagacuguucuagaaagaggagugacccggggaaugucagccaccuugcagacaggggagggcacaguccuuuagaguuugacaacuuagaagaaggaaggugggaaggcuggugcucucucucccagugccuguuucugggcugagucucagagugaguuggccagacccgagggaaggcagucugugccagugccaucacaccuggcaguugucacugauccagcaucuucagcgaagacucuagacccgggucucaguuuucaccauuugggauaguaguuccucugaugugaccuuccuccuuccguggaugacacagagccucauuucaccuuuguuuggugacucaggucaucagaaggaaugucauugucuggucugggcugucacacagugaugcccuuaggaaugcugagguguguggaacugucugcccugcccacuaaugucucugcguuccuguguuuacuuuuuacaguaauccuccuuucucuugcugccaugugucauuucugacugauauugaugugucugucccgucagcauuuccuuacuuccccaucuccuuguuuuccaguuugcuguuuccagauuucuuuacucagacaaauaagcaguggcccagaugcucccaagaaaugcggagucuggggucccuccgagucuugauuggagggaaccuaagaugguuacauauacaacaugggauuggcugugaggcaggguugugcgcaagcuuuggugcauggcuauaggagcauuguuugaugggaugugaggcagggcugugcaugagcuuuugugcguggccauaggaauaucuguuugggcucaaacacuucugcuuauggcucuugcaggcagugagguugccggaaagugagauauuacuguaguaauuuuuuguuuguuuguuuuugagacagagccucacucuguugcccagacuggaaugcagugacgcaaucucggcucgcugcaaccucugccuccuggguucaaaugauucucuugccucagccuccugaauagcugggacuacaggcgcaugccaccaugccuggauaauuuuuuauauuuuucguagagaugggauuuugccacguuggccaagcuggucucaaacuccuggccucaagugaucugccugccucggccucccaaaauucugggaucacaggcgugagccacugcacccggccuacuguaguagauuuuuaaauaaguacagcuuauuuuucucccucauuauggaaaaaaaggaggguagaaagugaugagggaaaaaaacaaaucauucaugagcuuacagggucucacuguguugcccaggcuggucucaaacuccugggcucguguaaucuucaggucucagccucccaaagugcuuggauaauagacaugagccaccauaccuagcucuuguaguacauucuuaagugaaaaccucauuggaaauguagauugcccuagagcugaaagcgauuuggcucuaaccuuccuuuuuaucugccugcaaccuucugugcccuucccugcccccugcugccugcuuccaucugucugucuccagcugugaaaggaggaugcugcugaggucagugcagccuugugacccaugugucuaauuuccaggugauugaggcugaccaccacauggagaggauguuagaacucuuugaacaaaaucgggaucgaauauuaacuccagagaaucggaagcauugcccauaggaggcaaaaggucuauggcucaugucugaaaaaugccugcugcugccaaguuagcuauugggagcaaucuggaaaaacuugcucccaggagggcuuugugucuggccagcuugauuuuccuaauggucucaucuccuuugcuagugucuuugucaugcgucucuggcccucguggguaaaugacaaacgggaccaauggguuugccaagcccuuugcuguucgcagccucacauucccccggugccucucccauggcuuugugcugcugagucgcucucaugaagcccuuagggagagcaccuguugugugccugacaccacgcuggagcuguguaccaaucgucucagccuucauuaggaggccgagguaggagucuuauaucccaggugaggaauuugaagcucagaaagguugaggggcuccccagaggucacacagccugugugcaguggagcuggcaccauucagacuuucagccgacucagcaacuuucccuugcccugggcugccuccuccugagagcuguuccccaccgcccugccucuuccgguuggaggcucucaugucucuuuggggagagcuggcagugugcggagcugauaacauuuucccaauauugagcaguucccaaggacagucagcauuucuagacuuccacaaaauuaugcugcauuuggcuggagcccgguguucagugguuucccugcccgaggucgcugcagccccaucuaccacaucuucauguggacauugagauucacaugcuggcuccugaagggugcucagucuccuuggugauuaagguccugcuugaacugcugccaacuccaugucagggaagucgcuuuuggugccuggcugguuugcccagagccaagcuggggcaaggggcagccagcccuggcuuccaaggcucccguacugucuguguccuuguauaaggagcuuugcucuuggaauuacugaaagucuguggcccaagagagagacacaaguggccuuaagucuuuuugaaguguuauuucauccagggaaaugccucgagccauagagccugaaaucaucuuuguuggcucagaaaauaccuuagcuucacucagcuggacugcauugaaggcgaggcugccccuuggaucaagcagaaaacaagagaaagaaagaacguucccuuuggggauagucuggaaaguugggauuugcaaauaaaggcucuggaagcauugcugguccugaagcuuuggaggugggcagagagagcuucaagaagacuagaugcaaacccuggaaaggauuaaggcucaacucuggagaaacaggccacagccucucagagcagcuguuggcuguaaauagagguagcaaggccgcucccaggccccugugagugugggcaccugugcaugcaaugcuccgacucugcagaggugccaagugccccugcugggccagucccagagaguuaggaagucaaggccugcaacuccugguucuuccuguuuggaccaguucuugugccauuggcaggaugagaggcagcagccaggcgggagcugugucuagcagcaccuguagcccacgugcugcuaauuagcuggaaaacuggcgaaggcagaaccuuugcuaccaggaaucuugacauguggggucugucuuugagaauuuguaaaugaacaguccaauauuuccucucggcucauuuugcacauccauuuuuggggaaaugugauuucucucucuuuuuuuuuuuuu

SEQ ID NO: 15759 - RNA, 16232 nt, Homo sapiens
ggaccgaggccuggaacagccaacaaagaggcccuggaggaggguggggcuggccggggacaggagggguggccaagaaagucgcaagaaaacuccggcccccaagaaaaagagagggcauggguugcggagccgacaucacggccggggucuuugcuguuuagacgccuggguucccggaucccagacacgcgcacgggcaggaaguuagaccggagacagcgaguauagacagcccuucuggauaggggcagacgggugggagcuccgaaggggugccggggcggugaucgggaggucuccagcggcccgaaccagggugaagaagaagguggagucugcggaggccccaggccggggagggggcgggucgggcccagcaucccccgcagccgggguccgagggggaggggcgggcuggaggagcgggugggggcggggcggggcguggcggcgggggaugcgccccugcgcgagccagugucgccugcccuccuuccgcacagcccggguuuccgcuucccuccgggcgcgagaagaggggagccaggccgagccccggcccuaccgccgccgccgccauguggcccccagaccccgaccccgacccggaccccgagccugccggcggcucccgucccggccccgcgguccccgggcuccgcgcccugcugccggcgcgggcuuuccucugcucucucaaaggccgccuccugcuggccgagucggugagugcggcgggacccucggccgccccgcuaggacugcgcggcuccuuucggaggaggacgucggggcgcgggugggguccgggggcggccgccgugcuccgauacccccucuccgcgccgccucggccgacuucucucgggcgccuggcgaaguugggucgagguccccaaacuuuggacggcggggcggggcccgagcccaggccauccgcggcgcuguccccgcgaguccagagcugggggccgugggaaguggguggggcccggggauguggguccugcugugugagccaggcgcccccgcccucucugggccccggggacucgggcaacucggaccuccgggacucccgggccgcagcgggguccgcuuuccugcgagcggguagugcgggccggggccucgaccugcggggccgagccggcggggggccgugcggagcgggagggaucccccacccccgggacugggugaggcggccccgcggugacuucaucgcccuccuccccuccgcggccgggcuccuuccuacuccgcccucgcccccaccccggccgguggggcuucuuuguccucuggacaccggaggcgcccgcacuguccgcugugggguagggguggcgcugggccguuggggauggggagggagaggccgggccggagaccgggggaggcgggaggagagagcggcgcacggcggcggccacuuguugcuuagaucccaggaacuuggcgcuuccugcccuuguccccacuuuacagaugagagcgcucaggcgccugauuugacagguggcucaacugaggggcccagugagagcggccaggagggugggggcaggaggaagggggauucugcuccgggaccucucccuggucacucagggcagagggcagaaggugguccugcagccucucccacggucagcccagaggccaccugcccaacgcccaagugagacaccaaugccacacuccgagcccacacucccagccccacccuggagaccacugggagccacuugaggggagaagccucgaauccaccguccccagaguggcuugaacccccccauccccacccaagaccaccucauaagagggaggcauauguccagcaggagcauagaggccacccugggcccagcagaugucaggaauccaggucagggaggauaaggaagggugaacggucagcacucaggguucacaggagccgcugagggcacuccugccucccuaguccccucacucccacccccaggccaagcaagugcagaggcugagauggacagaaacagagagaggaaguggccccagaaaucgcgggaugaaaaaacaggaauugagaggggaauccccagaauuaggcuuuggggugcaggcauaggagacaggaaggggagggccagagcugggucagucccauggaaggccuuccugggaggccccagcagccucccagcccgucucuaugccuuagucuaucuuuccaaagggggcucagcugcacccaaggccaugugcagagcaaaugggggugcucuggggacccccugggaucccugcaguucauuugucugaagcagccacagugcuuccuguggggcaucuggguguccccauggggacuccugcacccacuagaaacuacucagccauagacauguucaaacgcagccacagugacagaaaccagggacagauggccuccccaacacccacagggccaaguugcuuaagaacucuaccugggccgggcgugguggcucaugccuguaaucccaacacuuuaggaggccgagguggguggaucaccugaggucaggaauucgagaccagccuggccagcauggugaaacccugucucuacuaaaaauaaaaaaauuagcuggguuugguggcgggcgccuguaaucccagcuacucgggaaggcugaggcaggagaaucacuugaaccccggagguggagguugcagugaacugagaucgugccacugcacuccagccugggagacggagcaagacuccaucucuggggcggagguaagauaacucuaucuggggggucagccagcccuggguucaaauucuaguagccucugauuagccaugugacagagucuucucaucugucaaguggggcugugcucauggguggaugugagggucagaggagaugcccgugagccucaggguaccaggcacuguggagccccaggcuggccaacaggucaccuuggccugcucugcagcguaccugggcugcaggacugcccagggcucaacauccuccugcaucagcucuucccaccuacagaguugugggcaagaccacagugaacauuuugauucuuguaguucaaguacagcuggccccaccuuucacagcuggcccuguaugaauaaggcagcagggccugaggugucagugccaacgcacccucuguuagauguuccuuucuuaucauuaugaaaauuugcaaauacauuaaaacuccaaaagauuuuuuugcuuuaucuaucuguccaucaaggcauuuuaucuuuuaacacaaaauaaauugcagacaucaggacauuucaacucugaacacuucaggacgcauaucauuaagguucaagguuuuuucuuuucaaggugaaaucuacauucagugacgagcacacgucuuugguguuggguguuacuuuuuggaaacugguuccugccucgcuuugauuucccuccgcagggcacugaguggagugcaugugcuuggaaggcuggggcuuucugacuagguccugucagggagcuggggugggguaaggugaggacucagggccaugcccaggacugggaggcagcauaggugugagccugggccaugcuggguuuuuuuuuuuuguaggggcgggugcggacagggucucucucucucucacccaggauggagugcaguggccugaucacagcucacugcagccucgaccuccccgggcucaggugauccucccaccucagccucccaaguagcugggauuucaggcacacaccaccaugcccggcuaauuuuuguauauuuugccgagaugagguuuugccauguugcccaagcuggggucaaauuucugggcucaagcaauccaccugccugggccucucaaagugcuaggauuacaggugugagccacugugcuuggccugggauucuaaucuggcucugccacuucccagcugcgggacugugagcaguuggcuuccccugcuggaaccuccucuauccugaccacagggccuggcucagaggagcacuggacaaggaacaugaaaaggcucugacuucaccucaaacuccuuccccgcagggucucucauucaucacuuuuaucugcuauguggcguccucagcaucugccuuccucacagcgccucugcuggaguuccugcuggccuuguacuuccucuuugcugaugccaugcagcugaaugacaaguggcagggcuugugcuggcccaugauggugaggacaggggccccaggagggaggggugcccugcacaaaguggccagaugaggaguccagagucgugcacuugggcccuuauccuuucucuagugugcuggaguuugcaguugguuagaacuggauggagagacccagcuucagaucaucccagcuccacuacucagcagcccugugaccucaagugggcuguggugccucuagagcaggucugugaggcagggaacccggagaggggucucuggccaccagguggcgccggugcuccccaccgggccuacaggaaugagcugccgccacaggaauucaagccauuuccacgugggcaggacagguuaacugaggacuugcagggcuuacccagacuucagccaucggcaacccugaccucguuuuaucaccugugagggcccagaccccaguggaccucgcugaaugaaauguguccuagagaaagggcagcaaaggcucaacuugaacccuugucucuugacuucauauccagcaucugcugccucaggagggcugcacccucuguguccccaucuuagggacggauaagcagaaacugugguccaugaauggaucggccacaagagugugacaaagccgaggcccagagccagaucuccccaauggagagcgggaagggagcagguggggguguuuccaacuucugcuuccaccgcaucgcagggcaggcugcacccugauccacacaguuuuuugcccagagcuuaggacagcagccccgcuggacccgggauagggcagugucagcugcuggcaaggcagcagaggcaccucgggggugggacaagggccuaggcauguggguggggccaggaugggauaggagcccucaggugcuaggccuggggcugggaacacgaccaggcugccaggccuccuccccaugcugugcucagcuccaggggcucagggcagcaugccccucucuccccaggacuuccugcgcugugucaccgcggcccucaucuacuuugcuaucuccaucacggccaucgccaaguacucggauggggcuuccaaagccgcuggggugagcagccgccccaccccucuggaaacugcagaugccccucuagccccucauuuagggugggaccuggggcagagccuuucccugcuggggccccccuggggucucaugugggucccgaugaugauuccaaaguccucucauuaaagacugacucuacccgggguuuugaaaggcuguuugucaaaccaaguucacagcucauuuucccacuuccguuacucacaggggucugugccugacacucgggcuguuuguccaagcagaucugaaaugggccgugaggcuggggcagcagccucccggagcagggagucagcccugugaugcaucccauccacccuguccacagguguuuggcuucuuugcuaccaucguguuugcaacugauuucuaccugaucuuuaacgacguggccaaauuccucaaacaaggggacucugcagaugagaccacagcccacaagacagaagguaagcggcugcccugaucaccccagcagugcugcaacaggggccugcccucccucggggaugccagcuaguuugaggcuggggugggaucauuuccucucuccccauggcaggaaguguuuucacagcccauucucaccuacccucaugcagcacugauccaaagccagucccauucgccucgugcacccucaccccagccuuucuaggaggggcaagcagugggcauggcugagccucaggccaggccggcaagucucccuggacgaccccccugggcagccagucacucucgggcaccuguccaccugggauccagaguggccaucccccaaacccagccccucugcugucuuacccauccaggccuguccugggaagcucagagcccagaaaggagucagacccagaaaccguggcaagggacagaugaugugucccguaccaggggaggggccagauggggcagcaaugacgacaguaaaacaggagccgauagagggagggauacaguagcugaaagcaggcccacgcugggugucagcuggcccgaggcucuggaggggacacuagagcuggguacugacagauggcaguagaggagugugcaggcagaagagaccaggccgguguagggaagaaggcugagagcagagacagcaggcgcuucugccuggggagaugcuucucuggaccaggcggaugugccccugugcuggcagugccuguggcuggacagguagacaagggcagcucuggaagggccugcaggccccacccugugguugggaucuucccuaggcaggaccaguagguuaggcuuaagagccacugguuuccuaacagccaggugcuggggccauggggauuugugaaucccagaaaccguccuucugcugaaaaugaaugccacucaucccaucccgucccuuggcaaauauuagguuagagcucccaggcgguuuccucaggcucugcaaccugcucccaguugcccgcagcaagugaucccagacaaccagcccagggaccaauuaguaaacgucaguggaaacuugggugguuuuauuuuguuuuuuuuguuuuacuauuuggagaguuucacauauguaacaauuauuuugcuguaaaauuauucuugacuuauauguuagaauugaauauagcagccaggcacaguggcucacgccuguaaucucaacacuuugggaggccgagacggguggaucacuugaggucaggaguuugagaccagccuggccaacacggugaaaccccaucucuacuaaaaauacaaaaaucagccaggcaugguggugcccgccuguaaucccagcuacuugggaggcugaggcaggagaaucaccuaugggaggcagagguugcagugaccugagaucaagacaucgcacuccagccugggcgacagagugagacuccaucucggggggaaaaaauugaauauagcaaaacccacaaaaucugacgagugcagcccaggaaccggagugagggacagagcugggguuuagggacuaggcugcccacaccccagcccugagcccagccaugagccagcgacagcucauggggacugacugggguucugagagacagaggcuggccagggaggggaugagcaucaggaaguagcaaccagcacuggggugggguuggggguuagugacucuggugcuuuuccuucugggguggagguuccagaaggcucuacagagcuccgagacagaacugggauuucaggaacccucgagguacaccucauaggcaggcccuuaccauuauaaaauuguuucugauuacaauauuaaacaaggauugggggagggggauugaagauauaaaauggcuaaaaagaggcuugcugauuuuccaguauauuuuaguuugggggacaagaaaauagcuguccucaccuuguccugcugaaccuggggguggggguagagcuggaaugcagagguacagcccugacccacccagcugagaaaagcccagggagacuccggaggggcugggccugaggaaggggcaccugggcuucagucuugggguggaaacacccccaccugcacccgcacccacacccuggaggugcaaguggcuucugcggccgggcacgguggcucacgccuguuaccccagcacuuugggaggcugagguggguagaucaccugaggucaggaguucaagaccagccuggugaaagcccaucucuacuaaaaguacaaaaauuagccaggugugguggcacacgcuuauaaucccagcuacucgggagggaggaaguugcagugagucgagaucccgccauugcacuccagccugggugaugagcaagacucugucucaaagacaaaaaacaacaacaaaaaaaaaagagagagagaaaguggcugcugccuguggagggccucaggcccgcggccugcccugaugccagcgaucacugggaacgguagagucagcugcaggaggccugcacccaggcuccugccagcaacccagcugugcuuccccagagaccguucccaggcaccgcugcccugagccuccugccaagcauccucucugcuuuccuuucagaagagaauuccgacucggacucugacugaaggccuggcgggugccuuggcaaccugagccacacaggccuccaccccugcgccucacaggggucgcuggcguuggagcggaggccuggacuucugaguugcagagggggcugcggacacagcaggcccccuacagccucagguucugccugagcccagccuaccaggcuugccccucagcucagcacuguugaccacgcugcguaugagggcaucuuggguaucccacuccuucuccccauuucugucccacaggccuucagcccuuuaacgucucugccaaaaaccagcacaaggagacaaagcagagccuugucuguaucugggcagcagguguuccaugcugcuagguggcgggggucgggggucuucuguuucacuaacaggaacaaagacagaaaccaugacagggcugccccgccaggccccgguggguuugucugcacuuggugcuccugcccacaccagccacuuuggugacaaugacccuuccaagaaucuuugguucaaggagcaccaguucccucuucauucuugaagcagggagaaauugaccuuugccuugucgcccaggaaguggggcucggcacccauaacuaacaccucccacccuuggaaaccaugucuucugggggugagaugaccauucugggucuaagacuguuucaaagaagagcucauagacugacugguccagaagacagaggguacaacaguggcaucacagugacagugucauggggagcugggcgggcccagccaaacccuccuucuuccuagagcccagccagcaggcaggaguuccuggacccucaggacagugaacuuccagaccucagggcaggucuaugggccacugcaggagaugagaccagccuucuguguucaccuaacgauuuauacuguguaucugucuuugauggaauuuuguaacuuuuuauauuuuuuuaugcaaaagcagcuucuuaacagauggcauuuucugugacucuaggccucacaaaagagccagaguucuggacccauguuuggagcauuuguagccuuauucucuugcgugugaaucucuuacccugaaaaaaagccauaaugaauuaagccagacugaccacuugcuuggagugugugcuugaaaaaaccagagcaauacuguuggguauuguaucaggcuucaguacaaacugguaacaccaauguggauccugacagcuuucaguuuuagcaaaaauacacgugaaaucugacuaccauuuaauccuuuauuucccuaaccuuuuuggcaccagggaccaguuucguggaagacaguuuuuccauggacuggggguuggcggguggguuggggugagggugggaggggaugguuucaggaugagacuguucuaucucagaucaucaggcauuagauucucauaaggagcacacaaccuagauccguagcaugcacaguuuacaauaggauucgcauuccuaugagaaccuaaucccacugccaaucugacaggaggcagagcucaggcgguaaugccguugcuugccacccaccuccugcugugcagccuggcuccuaacaggucccaugguaccaguccacugcccagggguuggggaccccugcucuaguucucacacuacccuguuuuauaaacaaagaaacugagacagaggucggguaacuggcccagggcccucucacuuacacaucaggauagugucucacggcagccucaggcagccggaacccuggggcucuccugguuuggaagcugguugcauaacagcccagaggacuacagcccuggaggacccggguccgcauucuuauccaggcugaugggaaaagacaagacauuccacccaaacugucacacaccacaugugcugaaaauggguaagaaagcugggugugcaggaguggagaggccccugguggaauuuacauuccaccuuguaagcccuggcaaagcggcaaagcuggugucacagaggccuuguuccacccugaggaucguggcucuguucaaccuccacacagcagcccuauuucaggaacuggauccguaacguuuaaggggcagaggaggccacucagagugaggagagacaacgacauccuuacacguccauuuauuaaacaaguuccuucaugacaauuuaauacaauaguuauuaacgauuaguguugagaaaauuauuucccucuacauacaaaaauacagauuugaacacuaugaaaaagaucaagacaaguaccaugaaaaacugguccuucaaaugaaagggggaaaauugagggcaaugugaggcuuugccugcugucggggacaaaucaauagcagcaaagcuuuggggccccaacccacuccauacauacagacuugaacccaaaagccaggccagccaggggacgcccacccagggcuuccacgucagcugaaaaaccaaacacauaaaccuaaguuugcccaacgggcaucgccucagaaagcccacaguugugucuuuaaacugccgaaaugaaagagacuugaugaguaaaaugugauaguuguuaacauugccccccaaaagugccaccaggugaaguaccacggagaaaucauauuggaaaguuacuacuuagccaucugacuugacuuccuugguuaucaaauaauuacauauucugacccuucagaaggacaccaaaagcuacaauuuuauguuucaauccaucuguaccuucauuugcaauggcucagcuaguuuacucaaggguuuugggaccagacauaacucacguccugcaggaaggagaagcaaaaggagccggugaagaguacgugucugugucuuggugucaucuagcuccucacagcaaacagccuguuuuguucaggccugaagccuggaaaaggccgccgagccuagccagagcauccacaacgaaccaaucugagauccgaguggaagaugagagccccggagcuggcugaggucccccaggaagcuucccacucugcaguggcaggaaggccaugccucugcaggacgcucgcacugauucuggaaggggcccaggccagagaauacacuugggcucaguucaccagcccaaaccacaggggaaggagccggacaccggccucucaccauuuuacacccaaagacaggaggucagggcucugaugcuacucuucuguuuguaaaauauggaaccacuuucuuuguacuguuugaggugagcaguggcuccaaacugagcaagugguuaaaaaaugccaaaugcaauuauacugacuuauaauuauuucacagaaauauacucuuacucucagacuauuuaaauaagcaggaacaagaugcaggagaagcagcagcagagaggaaagaggaauagccagggaauuuuuuuuguuuuuuuucuucuuuaaaauacauacgaaguguaaagagaaaauggccaaaaccucaaaacuaccauuguugaaaacaauauuaaaaggacacaaucuaaaaucaugcuacaaaaauaguguuaucuuguuuaacuaaauguacaucuuuuuuuccaauuccaugauugacaagagugcuuaugcgacgcauggaaggcaccagaggugaagugauuauuugccuuaaaauauacaaagaauugccuacuuugaaaaaaaaauagucauacuuguaaauaaauaguuuaguguuucugccauggguuccugaaccccuacaaauuucaacauauacaaauaguuucaauuccuaccauucucuuagagggaaccacgucaaacaaaaucaaguuaggaaaagcacugauuuuauccaaguaggucaauuugaggcaagauucaaaaacucauuuuaaaauggguuacagagugaaagaguugggaacaggcagcccccuuugggccugggucagccuacgaguccaucccagguguccugcccucacaucugccagcccucaggccggccaggucucccuucaaacccugaguauuugccuuccucacuucugcgaagaggggaacagaaucuugaagcuugcaaaaucgauucuggaaaaagcaggcaagcaaagcagggccuguggggggaagcagcgugagucaggccucacccuggugcaagggcaccagcaggucucccuccucuccccuccucaccaucccuacgcgucuccucaccaucccuacgcgugacugacuuuccugauaaaaaugggauacuuccuacugggugucagcacugucauccuaaggcaacucagacgugauaguuuuagacuaugaucaaaucucacacaaaccauuaucagaaucuuguuucacaccaucucucuuuucaggcaguuaugaaaagaaacucugaccuggcccuaaaucccaucagcaaagcugacuaagguggucugagauauguucuuacuccuaaacucaaacuuuaaaaguuucaauagcucccuggggguccaagccaaaggcucccuggccuuuguguauuaugcaucccaaagaaaacacgccaccccaggugucuagauagcaagucaccugaauuaaagccucagcauaaaaaaacaaacauagacaacaaacuuacccuaugaaauagauacacaguucaaggacccaucaucugaacuuuucuaggcaaguugccagugauucaaacucagcagguuugugggugauuuuuuccuuacuguuacguuuguggaguaggaaaaacuagaaaggaaaaaaaaaucccaaagguugaaaaacuguauccaaauggaaaaagaauauauuccagacaaaagaagggaaaauacaauaggacccacuccgcuucaagcuaaagaguguacaaaaugccacucacuugcaugaagaagaauuaaacagaacauucacuuucggaagaaaauuuuucuagaccuaacagauauugacgguauuuucucucacaguuucuaaauaaaagaaacauaaaaggucaaauauuuuaaauuacuuucucaaccagacaguucuugugacuugaaugauaucugcugagaagagaagaaacacaagauucuacaaagcgccagggaaguuuacaaagcuaaaagcugagggugucaggccugcguccugucugagauggcagccaagccagcuucagagucaccugcuggacccacauguuccugagccagaugccaggagcucacccacaggacgggaaagaccuguccccagcaucccacucuugcccucaagcugacuguggaacgcgagacagcuuucaaagacaagaggacaggaaggcaguuaacaaaguacacguuuccaagacagccugagcugucuagugcugauagcagacaggugggguguuccaggccacugcuuccucccuuaucucccagaccuggccguguguggaccucaccagccuaccaagcuguugggccuggacgugggugcugauaaaauaagacaaaccuggaaaaaacccuggauucugcaacuucacuaggaaauaacaaggcaccuagagacuucacaagcuaauggcagucccuggagcaggaagcaacuuguuauucugcucaagagaauccaccagcagcucuuggccuagaaacuuuuuccccuuucugauaccuguuuaacgucauuauuacucuguaaacaagaucuggagaagaugacagucaggcaguggcacaaagacuucaugacuguuuuguuuugaacacagaugagacaauaggaacccuuaaaucaucacugccuugcagaaucacuaaauuguucaggugucuccaugcucuauucaucuccuaggugcuaagaccaacccacagaaaaucuggcacagaaagggauuagaccucaguccaccucucagagcacauggauaggugacggguuucucaugugaaucuacaagaaaagguacgccugggccacacgcaggacauggcacccacuaggguuguucaggucucauucacugcaagcaagaauucacguacaugagugcacaaagguguuggagcuuggucuccucaggcuuaacccaaggcugacucacuaggacagcuuccaagaaccacagauguaacugcaaacuugaagagagucagaauguuuucaacugagucacgaagcugucccagaagcacccgacauaggguggaggucagacacauucccuggcugcccacaggcgugagccuuccugccaggggacaguaacagggcccgaagggcugggggugccgcuggcuucccagggccaagcgcucagagcugggccggacuugcccaugcuggcuucagcucacauugccaaggaagauguguauuggggcugugcaggcugccacauucuugcuuuuucuguagacaaaagucaccucccucggauggcuguuuacuucaaaucaaacuucucugacgagauuuuaaucugaaacugcaucuguucuucccagcuuuauguggggccaacaaguaucuccagccuuucaugacuguaaucccucuuuaaggcagggaaaacauauuucccucccaugccuucagcagugugaaagaaggauaucaaagagaaucagagggaaaaaauaccaaauccacccaaucagugccaaaauaaacuuucucugaggacaucaguguuugcauccaucuaaaaccaccagagguuccaccaaaugcuugaggguuucagcuguacaguguccaggaaaaaacccaaaugcacacagcaacugcaguuucuucaaguuuugcuuuaaaugugaaaaccaauaucgucccaccagaacacugagaaaaacuaaggucgcucagccuucaaaugccccaaaccaaacugauauuggucccuauugaaacuauuaaacgcaaaaacgcuuccuucaauuugccaagaggucauuuuaaggcccccagauaucgauugucuucuguuugcauauagaggcaauauaagaaaaauauaggcgucuucauauucaccuuggauaacccuauucccuccagaacuuucgucaccacguggucuauacaugaugacaugugcaaccacacauuacaucaacuagaaagcguccauagcaccacuuccgguucuagugggaguuaauuaaauacaaggagaacauuuacaaaaccaccgaggagccucacggcacaaaggauauuaaauaguuacagggacauaaauaauucugaagagucuaucacgaagaugcaaauuaacuccuaagucacucucuggcgugucauccuuuuuggucauucaucugcauuuaguuucagugacuucagaacuauuucuugcagcugacaacauauccucaggaggccaaccaccugccccccucuuucaccagaugaucaagugguuuuacugaagugagcugggaaaacuugggcaacaagcccaccugaaugguguucuuguuuucaaucucacuucaaagauggccuuuuuugggggccaaguaacaugauucccagcaggagauuucugauaaagcucaggaugguccuuccaagugggccccauuuaaugcaaggcugagccuuuguggcccuauuuuaaaaggaacucucaaagagagauaagcccaauuuugacuuugcaaacacacucaacagaccugacaggcagcacacccagcugugagcuggccuggcugcccucucugugggagcagaggggagacgaguuguuaacaggcuagcagggucagccccugaggcagacguggugcucagccacauagccugggacacugcucccaacucagaucguacugaagguguuggugcaggaagcu

SEQ ID NO: 15760 - RNA, 31072 nt, Homo sapiens
cgguccggacggugcccgccccugccaccgccuccccgcgcauggcugccccggcggcugccugaccgccgcccgccaccucggcggccucgcaacccgugggagcccguggccaucgcagaccuagaggacacguugggcggcgcagucgccgcggcaaggucggcgggcggcgcggcgcgagggacggcgagcggggggcggcccggcccggguccucgcggguccucggcgggcccgggggagggcccucuuuguggcugcaguuggcaagauggcgccgguggggguggagaagaagcugcugcuaggucccaacgggcccgcgguggcggccgccggcgaccugaccagugaggaggaggaaggccagagccuauggugaggccgcgggcggucgggccgggccguggggggcgcggccucugggccggaccgucggacacacugaggggccgacgcgagccgggccaucccagcccggcccggggcugaccacucuugccauugucgccacagguccuccauucugagcgaaguguccacccgcgccagguccaagcugccguccggcaagaacauccuggucuucggugagcgccggcggcggggcguugccccaggucgcuggggugggcgaggcgggcgccccucccucagguccccgccuuccccguuccagccgccugcccgcagccuggcgggaaagggaccgucggcccuggccggucagcuggagaguggucaagccuccagcgccugagggugggaugcugcccucuuuggagagcguaguggugcuuugggguugucggcauauuguuucagucacuuggcccucuaugccuucauugccucgacgguuaccaaauugaggucguggagaggggaagcuaguagaugagauuagguggagaaggugggagaacgaggugaccugggcucggagcuguggggaaaugaccacgggagccuucuuugagccucaucaguagugcauaguccgagguuuuagggacuuugcagaggacagagagucagcacuggggacguuuccuccauuaugcuagcccucacugcuagguuaccugagucaggucccuuacucccucuggccucacucuccucaagugagggaguuuggguacauucacacagcaaguccauuuguugcuugggaccugugggcugggcacaggcucagcauaggcgacucuuaaacacuauagaagaaucucagucugguggaagacagauguauuggugauugcauugcaccaugccgauuauuguggaagcauuacacugcuuagagcuggugaaggaggaugauucggggguugaguauuuugcagaaaagugucaguaugcagggacacagaugacaagagggugugggguuuggaaacugcuagaagcgccuugugguugguggcugcuaagguaaguugggggcagauugugggaaggcugaagaguuagugcuguuuccugaaguucucugauuuuucaaauggcuuuuaucucaccuccaucccccaauucccaugggaaucacugccuugguaguuuuccuacuguuagaaugugugaccuuucucaggaauugacugugguagguaauaccggacccuuagagaucuucaagaagugggggaucaagaucaccagaucugaguuuuagaaagaacgcugccugcagagggacaguagcucaaaaugagcagguacugaagucaggcugacagguccucaccuuggucuggaugcagagggccugaauaagguagaggcauuggagauggagaggaggucuuugaucuguggacugacugccuuucaauucucauguucuguaauuccauauuauuaaauggcagaagugccuaguaauguuuggcgaugguucuccuugauguuuaaggauccggggaagggggguguuguuuggguggagggagaugaagaagugcuuaauaauuaacugagauuguacugaagaguuuugcuaggucuauaauuauuuucgucaguuucuuagccuucagaauguuugugaaggagauguacuaaaaucaaaagugaauaacuuccauucuucaccauugugaagcaggaucagacuuuuuuuaguucacaguaccuggacuuuuagguuaauuguaucauauuuugaagauuucuuguuuuucuuguggugaaacuuuuucuugugagaaacuaacccuaccuuuuacuuucacuucuccgaaugcaugucuuauaaauuauagauagggccuguggaccugccucauuauuucccuuuugaaguaaggauaacugcaguagaaugucauuuuagaucuuggaauuugcugccuuuaccacccucuccuccccacccucccaaccacucuuccagcaaaguccuuuguuuaugaaagcaggugagacuucaacagcagacuuugcaugaaauucuuaguuucuccgugucaugugagugucaugccuccccauccuugcccggaauaaacaguacaccuuugucuugcaaacauccuuuguaggugaagaugguucugguaaaacaacccucaugacuaaacuacaaggagcugagcauggcaaaaaaggaagaggccuagaauaucucuaccucaguguccaugaugaggaccgagauggugagugaagcauuggucccaugguaaggggguguaugcaggacucugacugcuuccuugggugcaguuccugcagcauggccaggcauucucaguuuucuguuugguucucagagaguuaaucacagaauagaugaaguacguaucuuuugcaggacuuaacccccuuuauagaguauguuagcaaaauuggggaaugggacacuuagcuguugcucuggcuagccugccuuuaaaaagagauacugaagauaaauuuuuacuuaacccauaaaggugguaagaaagauuuuuuaaagcuuuggaguuuuauaugagagaaaugcuuggcuguccuggggaccauuguuacucugccugguucuaguagagaauccgaaguuggugugguuuagaguguaacaauuuaacauauguuaauaggagaguuuccugaaucucuuugugacaguuuagaaaugguaguuucugccggauuuggugacuccugucauaaucgcagcuacucaggaggcugaggugggaggaucacuugaggccaggaguuggggacugcagugagcuguguuauacacucaagccugggugacagagcgagaccgucucuguuuuuuaaaaaagaaagaaugaaagaaaugcccauuuucuguguuucuucugguagaggaguagaugcucagaggugguaauauucuuuaauuccucaucuuuaaaacgugaguaguaauaguuacugcuuaggaugauugaaagcacaugauaaacacucuuauaaggauuacauauaauuuuaaaauguuuucuuacaaguguaauugugauuuggaguaaugguuuuggguuacaacugcucaguaaugccuccuuuauaaucuuuugguuuuauguuaguuuuuuuuuuuuuuuuuuuuuuuuuuuugagacaggguuuuacucugucacccaggcuggggugcaguggcucaaucuuggcucauugcaaccucugccucccagccucgggucauccuuccaccucauccuccuaagcagcugggacuauagaugugugccaccacaccuggcuaauuuuuguacagaugggguuucacuauguugcucagguuggucucgaacuccugagcucaagcagucugcucgccucagccucucaaagugcugggauuacaggcaugaaccacugcacccagccuauguuagaucuuuucaaugauucaaaaauaaauaaccauugguaccuagguugguugguugguugguuuuuuugguagaaaaguuaucuguauaaccuaaagaugaaguguauucacuaaauuacuuucuuuagggcaggcgugguggcugacgucuguaauucuagcacuuuggguggcugaggcggguggaucacuugggaucaggaguucaagaccagccuggucaacuuggugaaaccccaucucuacuaacaauacaaaacauuagccaggcgugguggugcaugccuguagccccagcuacucuggaggcugaggcaugaaaaucacuugaacccaggagguggagguugcagugagccgagauugcaccacugcacuccagccuaggcgauaaaacgagacuccuucuuaaaaaaaaaaaaaaaaaauuacuuucuuuauauuugccuuuacucauuuaaacaguaaagauuacgauguaugggcgauuauauaaugagggcugauccuaccaccucuagucccccauuuccuuauugcuaaaaugacaaaguugaaccaagguccuuuccagcaccguaauucuaccaucuccaagagcuguuuaguagagggcauggguggcugggcgcgguggcucacgccuguaaucccagcauuuugggagucugaggcaggcagaucaccugagguccauuugagaccagccuggccaacauggugaaacucugucucuaguaaaaauacaaaaauuagccaggcaugguggcgcacgccuguaaucccagcuacccaggaggcugaggcaggagaaucgcuucaaccugggaggcagagguugcggugaccgagauugugccacugcacuccagccugggcaacagagugagacucugucucaaaaaaaaaaaaaaauguugagggcauggguaagagucucuuguguaagaaggacagaggcauuuggguacucaucuaggcccacuggagucuguacauacagggcugcugagccuggccagaggaucucacauguauugagucuuuugcuuccuuuuuuggacagugugguuacuguggaaagagcuguggcuuuggagccaggcagaacucguucagaaugccaugccuguagucaguaguuguguggcuuuggguaacugacuuaaccacucuguacuugaguuuccucauuuguagaaugggguaauggugccuauacaaaaugauacaggguguaucagguguaacagugcuugagacauggugauagcucuaguacccuuuuguuucuuuugaaaguguaaaacaugauguagguaaucugugaaucucuauagccucuucuguuucaagauaccauaagcauauuucaugccagagcaucguguugaccacauuuauuugccuuuaaguauauuuuaacuuauauacagauuuuuuuaaaguuaccuuaaaaacuucuuggucucugcauuuauuggauuuuuuuaggccacccgcuugcaaguuccuguuugauggaagaauugcccuuaucuguuguuaaugguacauuuuccagcccuagucuuucuuacugugugaugugauugaguuauaaauauacacuuugcaagcaguuacccagguagagaaaacagucucuggcuuguaccuaguuugugguaggaugugacaugucaaaggaccucugccuccagguuugggggcaucuguuuaaugcuacacguggugugaucuccaagcacaugggugaguuacguguagugggcaguggggagagaggcugaaaaaaggaaccaugccuguggauggguaggcauuaaaacccacagacuuuggguacagaguaguauuuuugaggacauucacagaacccaaacuaaagccgcuaaaauagaauuugaaaguauugcuagauuuagauacuuuauacuguugacacaaagccaugaauauaaauuuuuuuauagcauguuaauugcuuauacaaaaaaguuaauaaaagauagguuuuuuuuuaaguauauuuuucuaaaagaggaagauuggguuuuuuuguuuguuuuguuuuauuuuuuuucuuuuuuugagacagggucuggcucugucauccaggcuggagugcaguggcauuaucucagcucccugcaaccuccaccucccgagcucgagcaguccucccuccucagucucccgaguagcugggacuacagguacaugccaccaagccuggcuaauuuuuguaucuuuuguagagaugggguuuugccauguuguccaggcugguccugaacucuugagcucaagugauccacccgccucagacucccaaagugcugggauuacaggcgugagccaccaggcccugcugguuuuaaaguauauguuggaauuuauugaaaaagaagcuaauaggccgggcgcgguggcucacgccuguaaucccagcacuuugugaggcugaggugggcggaccccuugagcccaggaguucgggaccagccuggacaacguggugaaaccccauuucuacuaaaaauacaaaaaucagccaguaugguggcacacaacuguaaucccagccacucaagagccugaggcaugaggaucgccugaaccugggaggcgugggcugcagugagcuacgccagucuaggcacaccccuacaccacaccacuacacuccagucuaggcaacaaaguaaaacucaucacaaaaagaaaaaguauuaauaguuaauaaaauauuuuugaugauaguucucaagguacuuuuauaaaacauaguucugccgggcacgguggcucaugccuguaaucccaacaaggcugaggcgggcagaucaccacaggucaggaguucgagacuagcccagccaacauggugaaacccggucucuacuaaaaaugcaaaaauuagcugggcguaguggugcacuccuguaaucccagcuacucagaagcugaggcaggagaaucgaagccuuagaguaggagauugcaaugaguugagcuugcaccacugcauuccaaccugggugacagagggagacuccaucucaaaaaauaaaaauaaauaaaaaauaguucucaaaagauaacugaaaauuucuaaaaauacauuauaaauuuggccgggcauggugauucaugccuauaaucccagcacuuugggaggcugaggcgggcagaucacuugaggucaggaguucgagaccagccuggccaacguggugaaaccccaucuguacuaaaaauacaaaaauuagccaggcguaguggcacgugccuguagucccagcuacuugggaggcugaggcaggaaaaucgcuugaaccugggcagcagggagggguggcggcgguugcggcggcaguugcagugagccaauaucgugccacuacacuccagccugggugauagagugagacuccaucucaaauaaaugaauaaauuuggagaauugucuucggcaguuagaucauccugguauucauuuggaaccacguuucauuacaucuuagcacuugcacauuugugugaaucuauuuuaguagaaaacaaaaaauauauacaaaguagagagugguaucaugaaccacaguguacuugucaccuugcuucaacaauuaccaguucuggcugggcgcacuggcucaggccuguaaucccagcacuuuagaaggccgaggcaggagcauugcuugagccuaggaguuugagaccagcuugggcaauaucaggagacccuaucucuacaaaaaacuaaaaaauuagcugggcaugguggcuugugccuguagucccagcuacuuggaaggcugaaguggguggaucacuaucccaggaaaucgagacugcaguugccacugcacuccagccugggugucucagacgcugucucaaaaauaaauauacaaacauacauaaccaguucuugaucaauuuuauuucaacuguacuuuuacucuuugcucuguuuacuccccacuagaugauuuugaagcagauuucagacauuaaauuuuaucuauguauacugccauaaggacaucuaagauaagaauuuuuuaaaaacauaaccauauuauuaucauaacaaaaaauuacuaauuccccaauauaauuaggcgucugguaauucauaucucaguuuauguaagugaugauuuuaucuucacauuuaaauacaaagguucugucucuuuggcauccuuuauaguaugugaaugcauuguuuagugugaccaacacaagaagggcuuguuuaaacauaggcucuucagcacagcucacugcuucacugauugcuguuaccuuaggaugauggauuauuuagguuguggcacaguugaccagugaacauuaguaucuuuugguuuuuauugaaagcuaagagacucucacccuuuuuuuuuuuuuuuuuuuuuugagauggagucucacucugucauccaggcuggagugcaguggcacgaucucgacucacugcaacaucugccucccggguucaagugauucuccuaccucagccucccaaguagcugggauuacaggcgccugccaccaugcccagcuaaauuuuguauuuuuaauagagacagguuuuaccaugcuggccaggccggucuugaacucccgaccucgugaucaguucgccucagccucccaaagugcagggauuauaggugugagccaccgcacuggguccgauacccucaaucuuuacuucauagacauuuuggaaaccuuuuuaggugugaacaccuccuauauuacuguaguuuuuuuuguuuguuuuguuuuuguuuuuguuuuuguuuuuguuuugagauggacucucauucuguugcccaggcuggagugcauuggcacaaucucagcucaucgcaaccucuacuuccuggguucaagcaauucuccugccucagccuccuaaguagccgggauuacaggcgagugucacgaugcccggcuaauuuguuuuguacuuuuaguagagaugggguuuugccauguuggccaggcuggucuugaaccccugaccucaagugauccaccugccucagccucucaaaguguugagauuacaggugugagccaccaugccuggacccuauauuacuguaguuuuaaaggcaccaggaccaaggauugcugucuccugagcacuugggcacuuuuugguuuggauuuccaaauuuugcauucuauuuagaauucauagcugucaccuucaagaucuuccugaugugucuguuucugcagcuaugcugauggucacugucaggugguaacuagcuucauucacuuguuuucucagaucacacgcgcugcaacguguggauucuggauggagacuuguaccacaaaggccugcugaaauuugcaguuucugcugaauccuugccagagacccucgucauuuuuguugcagacaugucuagaccuuggacugugauggaaucucugcagaaaugggcuaguguuuuacgugagcacauugauaaaaugaaaauuccaccagaaaaaaugagggagcuggaacggaagugugaguaaaauauaauuuucuuaauugggaaguucacgagucucuuuagaugguuugaaucacuuuccuuuucccaauccuagaggcuucccuugcuucgugguuuuguuuuguuugcaccauuuauuucagaguuccucuuguaaacucaguagucaaaaguauucaaagcagucuuuaacucaagugucacaaguugaagaaaacaaaucaauauuuauuaucuucauugguuuccguuucaaauaagaguucuucccucacucccuaaaauguguuaaguucuguggaucucugugcuuuucuguuacucucugucugcugaguuaacaucagaggaugugaggguuugcuguggucucugcagcuugaguuuacugcccuggaauuccauuaaggcccuauggacccucguguuggcaggcuuagaggaaguccuaagaaagacaaagcuuucagcuccuuaguucauuuuggaauccagcaaaauacgauuuuaguuagaaauaggagggucuuuuuuuuuuuuuuuuuuuuuuuguaauuaacaugaaagguuauuuuaagacuaaggacauccaagcccuuuugacaacaaagaacuuucaaauuaaaggaaguuuguuuggguuuuuuuuuccuuaaugugguucagaagcuuguuuuuccuuucccuugcuucugugcaguuacaucaucuucuguccacuugccagggaaaugggaggggcaggggcuggagccauggcagcagcagcagccguccuggccggggcaagcuugacccagccuggcguauuuucacaggaugacaucacccccucuggugaauuaaugagggcuucucgggcauggcacacgggaucuucacacuuacuggcagaaugguucagaaauuuugaugcgcuuuuuaaaucaaguuucucgcaguguguuuucuguccaguacuucaucuugcuucugucccacguugucuaaaacaaugaguuuaacauuguauucuucgguuuguugugcauguguauauuucccuggucacccgcaugugugcuacugugauuguuaugcagcucagcucaugugucuucaaccacugaccuuucuagauaaugccucuuuuuuccugaaauagagcccuuaaggacaacuucucugaauaguucugagucugaagaccugcuuucauccacugcacagacagcuuuguacccagaugagugggcuaauguacuggugacuucaguucucugaagcuguuuucuuagagugauaaccuuguagagaucuguuaagacagaaaagagagagauugagccaauauuguuuuuucccagauagggaaagugucugcccuauacuguaccagguaccagguucuaggugcuggagacacaguaaauaaaaggccugcuucuggggggcuuaaauuuccaugaaacacugaauuuauuuugugauuuagucauugauggcuguuauuuaggauuagauucagcugcaugugacauaaaaccugagauaacauaauggcuuaaacaagacugaggguuauuucucuccuguaaaugaaaucuggagguguagguaguugaggacuggaaauuagagcccugggaagacagcuggaggaccuugcuccuuugugcuuacugcuuugucauuucuagggugugguucucuuccuccugacugagagcucuagccuucacauccguguuccagucagcaggauggaggaagagaaaugcagggcugcaggggcugcugucucuuaaggaggcugggaaauguaaucuuuacuuuggguugccauguguucuaaauaucaaaguucaguuugguuauaaggaggaagaggagagaggacaccguagggcagcuagcaauugcuggaaccaugucccacgacucugguugguuuuccauuggccucucugcugucaccaccccuucucagauguuuggaaugguagccacgucuuuguguuguauguuggaggagccuuuguuaguacuggguuuaggcuacauuuuaauaaagcaguuggcuauccucuugcccagaggacucuugcuuuccagauuaauuggacucuagauguuauauggaaggagugaagggcuguuauucaaccugguuuccaguccaacaccagucuccauucuuaugauuuuggaaagcugcuccauggccggccagucucuuuuaggguuagguucccagugguuuugugucuguggcagcuguuuggcugcagggaucaucugagugaaagggaaagcauccccuauagccaccagaagguggcgcuuuuuuguacuuuagucuucucuuucuuguuuuauauauggggcuuuucuuaugcuuauguaggacuauggggucuucucaggacugugaaaccaauaaaugagguaggagggaaaaguugagagagaagcagcagcagcagugaagaugcucugugaucuucuuguacccacucccaucugauuccaaagggaagccccaagugggcugauguccccugcugugaaauacucaccaucuggagagaaauuguuaacacugcaguauguguauacccaagaaaaaaugcacguuuuacuauccaacuuacaugguccuuccucuuuuuaauacugccuuuucacucauguuauguauauuugcucugcuuuccaaauugcuuucuaaaaugcuaaguuggccaggcgcaguggcucaaugcuuguaaccccagcacuuugggaagcugaagugggccaauugguugagaccaaaaguuugacaccagccugggcaacauggcgaaacccugucucuaaaaaaauuuagccagucauggugguacaugccuguaguccuggcuacucggaggcagacaaauugauugagcccagcaggucgaggcugcagugagccaugauugugccacugccccgcagccugggcaacagagccaagacucuaucucaaaaacaauuaaauaaauaaaauaaaaugcuaaguuauuuaaaaaugugaauuuccuauuguugggcagccacaauuaagucauuccuuuagagcgugaauaaucuagggcuucugaacuauuuucuccucauggcacagguaaaaaacagcagaaaaguuuacagugcacgagguaaugggguggagguucguggagccagcugucugaacuuccugccuccaccuuccaaccguagcuuagcuuaccugugagcccuuccaggcucugugcuucucacugucugggaagcccuaguugagugccucacgagaucuucgggcauuagaucuugcccaguuaagccauuguauauuuuauugauuugaagauuuguuaaaagugcuuuuaaagagaaaaaugugagaauauuugauuccuuuaaagacccuucaacaaccacauggaggaguucuucucuguuuuuauccaaaauggaguaugguuuacuugacuagauuauuuguauuaacagugaaguauuuguguguguguguguguguguguguguguguguguguguguguguguguguuuguuuuuuuuugaaacagagucucacugucacccagccuagagugcaauggcacgauuucggcucacugcaaccuccaccuccuggguucaagugauucuccugccucagccucccaaguagcugggauuacaggugcccgccaccaugccuggcuaauuuuuguauuuuuaguagagacaagguuucaccauguuggccaggcuggucuugaauuccugaccucaugauccacccgccuuggccugccacaguucugggauuacagacauaagccaucgcguuuagccugacagugaagguauaugaaugagcuuaauuaaagagaugcuguaggccgggugcuguggcucacgccuguaaucccagcacuuugggagacugagguggguggaucacaaggucaggaguucaagaucagccuggccaagauggugaaacccugucucuacuaaaaauacaaaacaaaauuagccgggcauggugguaggugccuguaaucccagcuacucaggaggcugaggcagagaauuacuuaaacccggcagguggaggaugcagugagccgagauugugccacugcacuccagccucggcaacagagcgaaacuccaucacaaaaaaaaaaaaaaaaaaaaaaaaagaagcuguagagaugaaauaucacaucugcacuuuagggccuaaucaguuaguuuucaguuugcucacuguuacaugaaagacagagagcucucagauaauuucagaagcucauauaauaguaacgucaaaucuuuguaaauaaaaacucgugguuugaaauguuugaaacguguucugugggugaagaggagcagguaggaccuuucucuagguccucuucaguccuguuguuugaauuuacuuagcauguuggugagaguaaaaggccuuugauccuucagucuuacuggacuuagaaggguagagcugccuguuuucuucucuggcucaagguagcuuuaacuguugcauuuuuuguucucuggaccaacaugagagccuugaagugcccacauaaaggugcagagcugugggcuuuguggucacuuggcuuaacugaggcucggaccauugucaccuuaauggccuuccuuagcuggauuagugaauauuguaugccaauaaguggauguuguaccacugacccuuucuuguguuaggcaggaauaggccgugaacacugcacaagugacuugggauccccaaaagaugagacugaguccacaagagugaggauaauaaggaaauacaucuggugcugggcaagaccagccugguuacuuagugcugacaagcuucagcuguguggaaacagcauguucuuauaaaauucaauuguuucauuaagcauuuuuuuuuuuuuuuuuuuugagacggagucucgcucugucuuacugcaaccuccgacucccugguucaacugagucucccgccucagccucccaaguagcugggauuacaggcacgugcugccacacccagcuaauuuuuguauuuuuagcagagacaggguuucaccauguuggccaggguggaagcuuguuguuuuuuguuuguuuuuguuuuuuguuuuguuuuguuuuuugagguauagucucacucuguugcccagacuggaguacagugacgcaaucuuagcucacugcaaccuccaccucccagguuuaggcgauucucaugccuuagcacgaguccccaaguagcugggacuacaggugcaccaccauccuuagcuaauuuuugcauuuuuaguacagaugggguuuugccauguuggccaggcuggucucaaacuccugaccucaggugaaccacccgcccuggccucccaaagugaugagauuacuggcaugagccacugugcccagcucauuaggcauuucuaaugaggacugugauaaguauuguaaguuauagcuguuucuaauggucagcuauguugaaguuacacaguucaacucuucugguauucugaaaauguaagauacauaagaaaaguggcuuucuucaugguaagaacuauugaaaccuuaguauuuuuuaaaaaccuguuuaagggccagacaugguggcucaagacuguaaucccauaaucccagcacuuuggaaagccgagguagcaggaucucugcagcccaagaguuugagaccagccuggcaacacaggaagaucccaccucuacaaaaauuuaaaaaguagcugggcaugguggcacaugccuuuagucccagcuacuugggaagcugaagugggaagaucacuugagcucagaagauggugauaucagacugcugcacuucagccugggcaagagagcaagacuuugucucaaaaaagaagaaaaaaaaaccuguucagggguuuggugcaauuaaagaugcccaggggaaugucuuugcugccccgauguuacaaagcucacacugaauauuucagaauuggcauuuuguaucaccauccccaaauccuugauuuugcaguuggaugugacuaagaaguuugucacacacaacugccuguguuuugugcuuauuauugccuucuuuucaguguucuaaagcuaacauguauuuuuauuuaugugcaugugauuuuuuuuccucuuuuucccccaguugugaaagauuuucaagacuauauggaaccugaagaagguugucaagguuccccacagagaagaggcccucugaccucaggcuccgaugaagaaaauguugcccugccucugggugacaaugugcugacucauaaccuggggaucccgguguugguggugugcacaaaggugugugccaggggguuguuggcuuggcuggguucggguggugaacagucaccaucugaaaguuugagaaacuguugacguuuuuuucccaagggagacuugggcuuauuugagauucauuaagguacauugaauaugucaagacagaaaaaauuaucauguaaauuggaaguuuaaaugcaggaaacaugacuagucaguuugcucauggccuaggguuaaugucucugaagcacuguugacuuucaaacuuagaacucacagcaguuggccaguugcgguggcucacgccuguaaucucagcacuuugggaggcugaggugggcggaucaugaggucaguagauggagaccauccuagcuaacauggugaaaccccgucucuacaaaaaauacaaaaaauuagacagccgugguggcgggcaccuguagucccagcuacuugggaggcugagguaggagaauggcauuaacccaggagguggagcuugcagugagccgagaucaugccauugcacuccagccugagcgauagagcgagacuccgucucaaaaaauaaaaauaaaaaaaaaagaacucacagcaguuuccuuaaggcuauuuaaaucagcugaugugguccaaacugaugguggaaaauuagaaugaugagguaggaauagaaauuaaguucagucaugccagacaugguggcucauguaaucccagcacuuugggaggcucagguggguggaucauuugaggucaggaguucaagaccagccuggccgacauggugaaacccugucucuacuaaaauagaaaaauuagccaggcgugguggcaggugccugucaucccagcuacucgggggcugaggcaggagaauugcuugagcugggaggcugagguugcagugagcugagauggcgccacugcacuccauccgggaugacacagugagacuaugucucaaaaaaaaaagaaaaaaaaaacaaacaaaguucagucauagagaaauagagaaauaaaguuguaucucuuauauaaggaaaaacaauagguuuuaaaacuuuuuuuuuuuuuuuuuuuuuuuuugagacggaguuucacucuuguugcccaggcuggaguacaauggugugaucucggcucacugcaaccucugccuucccaguucaagcgauucuccuaccucagccuccugaguagcugggacuacagguguccgccaccaugccuggcuaauuuuguauuuuuauuagagauguggguuucuccauguuggucaggcuggucucaaacucccaaccucaggugaucugcccaccuugaccucccagaguguugggauuacaaguguaagccaccacgccuggccacauuuuggguuuuaaaaguacuuuauuuccagucagagccaucauguuacccaauuauagugugccauucucauccuguucuugagaauggagcccuguggaguggaguguacaacuguguacaccgggccugccuccugaugggagcuuguuugauguuuagaacaaacuguuaggugaucaggccuauuacaucuucacucuacagauaaaaaaaaaaacgaggcccaagaugaaugagaaaaaucuccgguucuuuuuuacucuucucuaauuaaugcuuggacccugagcuguggcuuucuucuuuggagccacaauacuuuauuucugaagaaugagguguucccaucgucagcaggcaaugaagcaaaaaggugacucugucugucuucccugcagugugaugcggugaguguccuggagaaggagcacgauuacagggaugagcauuuggacuuuauccagucacaccugcggagguucugccuucaguguauccuuugggcgcuguguggggccugggucacaggcuuucuuccaaauggggcaucuucaaagagauaaagcaccucccaaacccagaauaguguucugccaaagagaauuuguauauaucuuuuuacuagguuuauguuuuacuguaucggaguuuuagguuuauuaacuugugucuaccuuugaucacucauuuauuuguuuguuuguuuguuuguuuuaagaugguguuucaccacuuuggccaggcuagucucaaauuccugaccucaagugaucaccuaccucagccuccgaaagugcugggauuauagcuguuagcuacugcgcucggcguauuuuuuaauuuuuuuucugagacagagucugcucugucacccaggcuggaguacaguggugcagucuuagcucuugugcuccuggguucaagcaauccuccucccucagccuccugaguaccugggacaacaggugugcgccaccacuuccagauuuuuguuuguuuguuuugagacagagcuucacucuugucguccaggcuggaguacaguggcaugaucucggcucacugcaaccuccaccuccuauguucaagcgacccuccugccucagccucccaaguagcugggauuacaggcaugagccaccacacccggcuaguuuuuguauuuuuaguagagaacaggguuucaccauguuggccaggcuagucucgaacuccugaccucaugugauccacccaccucggcccccucaaaguucugggauuacaggcgcgagccaccaugccuggccaucuggauaauuuuuguauuuuuaguagagacgguuucagcauguuggccaggcuauucucgaauuccugaccucaaguaaucugcccuccuuggccucccaaaguggugggauuacaggcgugagccacugugucugcccacuuuuaauuaaugcuauacauuugauaagcuuuccuauuaagaauuuaaugugaucauuuuaucaucaaauuacuuuuaucauacugucuuagaaauauuuuuaaacuuugcuuuuauguagaaaaggucaauuaccaaacaggguauuguuuuauaggcuacugguguuucccauauguuuauguuuugugcuguccaugauagagagguggugucuguagucuuuugaguccuguuaacuauaaaaagccaauagcaguuggugccgugguuccacacccugggguggaggugagagaugaguuccugccaucuuuuuugggauggcccauuagccuguuggcacccaucccucaaaagauggguuuaaugauaaauuuggucgcauguaggcaucugucugggaaggaaucuguguaccuugauacucugagaguguuuuccugggcuaaccucagagccaauacuuuacuucucaggaaguaaucugugggaucaagacaacaauuuacacguuaaaaaauaaacucuacagcccacuagcaucaacauagcuuuaugcuuuugacuucauucaucugcuacuaugaccuuuuuacuuuuuuauuuauuuauuuauuuuuaccagugugcaguaugccuauguaauacuauaagcguuuuaguuuuuaaaauuguaaugcuuucuguugcucauauauugaucaaaaacugaucaaccuaugaguaguacuuugagguuguauguguucgauuuugucuccuccugcagugaauugauuuuucuugagcagauugauuagauggagcugccuugauuuacacaucagugaaagaagagaaaaaccucgacuuguuguauaaguauauuguucauaaaacauacgguuuccacuucaccacaccugccuuaguuguggaaaaggaugccguuuuuaugugaguuauuuugagcugaugcuuugaaacucuucuuuuuaaaguacauuugcuuuuuacauuuuaccccuucaaggaaggugccuucugucugugucuucuacagccagcucucucacugcaccuucucucuguuccuuuccggauuaugaggcaucugccugagggaagugggugguguggucaggggugcugccuuucuuccucgagagcaaguugccaaaaccuaagccagccauuuuuggcacucacugucaacucugguaaaauacuggcuggggagggaauauagggaauugugcuugggggauccugaaugucuucuauuaaagcgccugcuuuaucuguguguuggcagggaugacugcaaacauccucucggcaucucugucagcaugggcuuucgcuauauuaagugcuuacugugcuucuggcauuucacauuuugggagccaccgggauugauuguccucgauagagacuuggauaccuguuuuccuaagcuggugucuuucucucacuggagaaucauaguguugcuggaugcauaaauaugaagcuguggucucugacaagacuuguguuagcagauugauguucaggcuucaguauccuccugacuuaacaaacaauuacauuauucauucaggaaaccuuauucagcacccacuaggugcucagguucucugcaaaggacacagaaaugaaugauacguguuccuugcauauggcacugucuagaggggacauacacagcugaagaagggaagggcagugaugggguuauggaggaaguauggcagggaaagcaggagggugaugcuggaagacaaaugguagaucccaggcggacuggaaagaauugcaauagggggagccggggagugcagucugugagaggcuggaaaugugaaagccaggagcucucagggauuuggguugccuccugcacagucaaggagagugucacucaggcuagucauagauggcauaccuacaggcuugggcugauuuuagauaguuguucagagcagucaggcaggcgccagaggcacaagcccugugagagguguguuuggaaucacuugguauccaaaucacaugucaucccuaggagcaaggagaccgguuggauuuggggcuggucuggaaugaagaagcaucucucagcuuccgaaggcugcauggcucacggcaguaucucaaucaugcccugcccguuugcacauuugguccuguugguaguuaccucucuggugacuggcaaagucagcaaggauauugggguggagcacccuggcuaagcacccucuugauuauagagcuauggaguagaagacagauggagaaugagaggccugugagaacaaucagucaguugccaucuuucagagcugcucgaguucaaaagugugucauacaggguauuuuaccauugcuaccuuuaagggauucaggugggaacccuaggcuguggcuucacauaauggaacuugggugccauccuacccugugauguugagcuggccagcacugguguaggaaccucaaggacucugugcuucucugguuuggggccuaggauaaacacaggcccugcuugccccuugguucuaggacacaucuucccaugccagcaaaguuaaugaaccagucuacaagauaacuguugaaagaauucuuagagaaacaacccacaggaggggagccaugucagagcccaagaaaaccaucccauccugagcucugccuucugugcugcucucugcauccuauucucugucggaacaggaccccacuguguccuugcucuucuaggcagaguugugggagagugcuaaaugcuuuugaguggggcagccuguggaaugggaucucauacuggcuccuuagaccuugggcccaugaacucaguauggagcaggaccugcgauguucugauggauuauacccacaguguauuuuggcacaucugccaaaagcuacaaacaacccccaacaacuacacacuauaucuugugagaaguguccuacccaggaguccugaaugugaucugaguaugcucuaaggcagccccaggaaaagcaauucagucccucucucuuugccuuuagaccugcaggcugggacaaugaaaagaaaauagcuauuuuacaugaaaauuuuacaaccgugaagccggaagaugcauaugaagacuuuauugugaaaccucccgugagaaagguagucaaagacaauugcuuuaaggguuuagggccgggcgcgguggcugaugccuguaaucccagcacuuugggaggccaaagcgggcagaucacaugaggucaggaguuugagaccagccuggcgaacauggcaaaaccccaucuccacuaaaauacaaaaauuagcuggguaugguggcaagcgccuguaaucccagcuacuugggaggcugaggcaugagaaucacuugaaccugggaggcagagauugcagugaacccagauugcgccacugcacuccaaccuggcaacagagugagacuccauaucaaaaaaagaaaagaagaaaaaggguuuagguguuuuuuaaugcaaaaagaagccuauaaagauggggcgugguggcugauuccuguaaucccagcaguugggaggcugaggcaggagaauugcuugaaccugggaggcggagguuguaaugagccgagaucgggccacuguacuccagccugggugacaagagcgagacuccaucucaaaaaaaaaaaaaaaaaaaaaacuauaaagaaacaggucuuacacauuguauaguuugugggggguaguggggaguaguaagucccagggccuuuuuguugaucuuuaaaugaggucuggcguuauguaaauggcucagggcuggugggaaggagugauggaaugcucaccuggaguuggugguguuucccauuaaguccugccagugcugccguugccucuggauuacuguuacuggauccccucaugugauguccugcagacccugagguguuuagaaccugccagacuuaaaaaugccaguuggcuacaugcugcggcugguuuugggagaggucugugccaggcuagaaaaauauuacucugcagucucaguagggaucucccagaccuguguugaagccugagccucggacucuccuuucggcaugaaguuugacagugguuaggaguauucuuggccuguggccacaaacauguauguuguuucacagcugguccacgacaaagaguuggcagcagaagaugagcagguguuccuaaugaagcaacagguaagaagaccagugagguuagaacagaggccuucucaugcaugaaaugccagucccuagggugggguugggggugucugcaugugggaagucacaaagagcuugcagugguagagggguugagaccaggucuccucauucccuccuuauuucuaggauuaguuggggauggaccaccuccuuaggagaucaccuaccugccuugcagacucuccuacaggaauaguaggauucgcaucuuuuaagugcucuuucuuuggaaaugugguuuucuggcauaauacuuccuauguugacaguuaaccaaguaaccugaccacacuuccauuauuucauguagccucacacagcccuguacauaaaggcaggugaugccuguuuugcagaugaggagaguaacuuccccaagcugacaguuuagaaugcagacuucccauuucugucacccagauuauuguuagauguguccuggguccaccuaucaucugcccagugguacaggcaggucagcaggaaguuuugaugguucuuuuuccaacuguuuccuucuuuuuccaucuuuuuccuuucuguccuuugcuugcuuccuuagcuucaaaacugguuacuuggaguauuuuuuuucaccauauaccaaacggcucaauuaaaauuuuuuggcaucugugguauaaaacauaggacuuaguuguuguuaauagugcccucuaguggaguacuuggaguaaguuuuucucuagaccuucagugcucucugcaggccuugguuaauagccaguuugucccucucuuugcagucacuccuugccaagcaaccagccacucccacgagagcuucugugaguaccuuacacuaaacagagggucaaggcccaguguugugggugucaucaaacuuuauaccauuauuugugagagcguauauuuguguggguuuuguauuuucagugggaauuugguuucccuaaagacccaugaccagaaacauaaaagaaacucaagaaguuucugaugaaagaauacaacucugggaauuagagugagcuggcuuuguuaucuggaugucuuucucucaggagaaagagagccagaaagggcuugaauugagagcauacucccaguccuguaccauagccugugaaaaauaucccucagaagcaugucuccauuuguggcauauguauuuuuuguuauuguuaugccugugugugaccuuagcugcuuuuggacuuaggaaucuccugcaagaggacccucuggcucuccaaggacccagggucggggagggccagccagugugccuagcuccuccccaggcacgucaguaaaaaagccggacccaaacaucaaaaguauguauuccucaaaaguaugucucuuuggagaguaguuuaguuuuagaccugagcccugcaggggcuggguggcugagucuauaagguggagacucauggaagccaggcuauucucuuccccgauaagggcuacuuuccauuucccccauuccagaggaagaagguccaugguaggcagagaccagggccuguuccuuuguuagaauugguagcccaugcaccuggcucugugugagaccucacuuaggcccugcucauuccuucagagaggaaugcaaaauaguaacuuuauuuuuuuagagacagggucucacucugucacccagccuguggcacagugauacgaucauagcacacugcagccucaaacuccugggcucaagugauccucccaugucaacucuggaguagcugggacuauaggcgugugccaccaugcccagcuaauuuuuaaaauuuuuauuguaggccagaugcaguggcucaugccuauaauccuaguacucugggaggccaaggugggaggauagcuugagcuaaagaguucgagacuagcccgggcaacauagugagaccucgccucuacagaauauugaaaaauuagcugggcaugauggugcuugccuguagucccaucuacucaaguggaugaagcggcaggauugcuugggcccagggcauugaggcugcaguugagcugugauuaugccaccaugcuccagccagggugacagagugagagacuguuucaaaaaaaaaaaggccuggcguggugacucaagccagcacuuugggaggcugaggcgggcagaucacuugagggcaggaguuugagaccagccuggccaacauggugaaaccuucucuguacaaaaauuagccaggcgugauggugggcaccuguaaucccagcuacucgggaggcagaggcaggagaacggcuuaauccugggagguggagguugcagugagccgagauugugccauugcacuccagccugggugacagagcaagacuccauuucaaaaaaacacaaacaaaaauauuuuuuauagagguaggggucucacuuacguugccgaggcugaucucaagcuccuagccucaagcaguccuacgcccuuggucuccccaagugaugggauuacaggcgugagccaccaccccuggcugagggagucacuuuaaaauguguauuuugaaucuguaacuuuguuucucauuauguuuauaugaugacugucuaugaauuguggggauuuuucccccuucacuucucuugucaagcucaauuacuuuucagauuaaguagcuuuuaucccaguaacuuagugauacucacagauacugccugcaguaaaaucauuaaaaaacaguuuuauuuaaugcuuguuugaugggugucuucuauucaggaugugagcuuuucacagcagguuuggaauguuaagugcucaugcaacuuugaaaaacacugucucauggacggggaggugguguggagcacagguuaucuauucugcucccaaacaagugggaaauguaaacaugguuccacuuaguaaucaugcuaaguagccucagcaguagcaguguaaaggcaucguagcgaaugaauguuaucaauauccuaggaagcugauagccacaaguggcuaaugccaagcugagaacuaggguguuuaauuuuaagucuuccaguuuauaugaugcuuuuuuuucucuuuaauuuuccuuagauaaugcagcaagugaagggguguuggccagcuucuucaacagucuguugaguaaaaagacaggcucuccuggaaguccuggugcugguggggugcagagcacagccaagaagucagguacagaagggcccuggagacuugugacucuugugguugaguagugcugcaaggauggagaggcagacaccugcccugcagacccugcaguguccugaauagccaagcaaggaagcaggucuucauuuccuacugagcagugugccgugcuuucagugggauugccuuacuaccaugcagguuuccuuggcacauugagagugggauuuguguacauuuggguucucgggaacuggguguugggugaguugagguauagccuaaauuacauauguggcccuguuguagaaccucuccaguagaagucaugguccauggaggguguaccagugacuuuuuuuuucuuuuuccaagguggaguuuugcucuuguugcccaggcuggagugcaaugacgugaucucacugcaaccuccgccucccagguucaagcgauucuccugucucagccucccgaguagcugggauuacaggcgcgugccaucaugcccagcuaauuuuuuguauuuuuaguagagaugugguuucaucauguuggccaggcuggucuuggaauuccugaccccaggugaucccuccaucuuggccucccaaagugcugggauuacaggugugagccaccgucugcggcugacuuuuuuuuuuuuuuugauagagauggagucuugcucugucgcccaggcuggaguacaguggcaugaucucaacucacugccaaccuccaccacccggguucaagcaauucucuugccucagccucccgaguagcugggacuacaggcacgcgccaccacauccggcuaauuuuuuuguauuuuuaguagagacgguuuuucgccauguuggccaggcuguucucgaacuccugaccucaggugauccaccugccuuggccucccaaagugcugggauuagugcaccuggccuacuuuuaauuuuuuaaaauuauacuaaagccuuaguuguucugaaccagugauguuuuauuuguucuauuuuuuuuucugugaugcuuuguaaggauuuuuguuuacuccacugcccccaguuuggcugugaacccucacugucucacugcagagucaaggccuccuccucccugaagcucccuacuugucacauacacaccucuguggcagccacccaccuguccuuccauguaagcagguagggcgggucuaugucuuggagaucucugaaacaaaacaaaacauguuuuccuugggaauuacacauuuucccaagaagcuggaggacauuuuaagggguuuuugcuuuccauuuuccauuggcuauaagguauguuuauacauuguuuucccuaauugaugucuucagggcagaggagacccucaggaaaucacuuggggcagccugggccuccaguggcuccuauguucuaagaaacucagagucuggucuaguggcccagacucugggcugguaguauucccuucugggaaauaggugucuauuucuaggccuguucgugucugacagcagaaaaauacaaguauagauuuugugcaggacugaacuaucuuauucuuauugaaacauaauguuuucaggcuauccauuugagucagucuagaauguuauaaacaaaaacaccuaucuggggcaaagaaaauaguuuccuucguugcugaaauucagguacuaccucuaggaagaugguggugagagugcacaggggucaggguuggguggugagaggguuuucagaaagguucuuguauuuggcacaaaggcaccccccgccagagagcagucaagucacucccuuggaguuggaggaagcacuggccugugacuuuugggauuaggaugugccgaguuggggucuccucaccacugcaguagaaaagggcuuuccucauucuuauuaagguuacugucaucaagugauuauagaaggcguauaauuuuaaaugcuccuuuaaaaaaaauuguuuccucuucucacaucauuacuuugcuuuuuugcuuuuuuuuuuuuucaggacaaaagacuguguugucaaauguucaggaagaacuggauagaaugacucgaaagccagacucuaugguaacaaacucuucaacagaaaaugaagccugaaccuccuuaaaaagugcauaugucgaaugaccaaauaacuauguauauugaucugcuaagaccaggauuuuucugauauggcacaugcuaucaguuuuuuggggcaggggagaugaacuuuaaaaaaaaaaaaaaaacuucauuggcuuguccgagugugaaaugcacauuuaggaagguuacaugucagacccuuuguuaaggauaacccuuggacucuggggcauguggcucuuuugugggaggcaagcacaucugggcuucuuguggaggggaagguagagugaaagaaagagggcccacuuucuaacaggguggagcaaaugagaccaagaaaucauugguaagaugaugguuagucugaccaguuucauguuaguaaauucacuuguucuugggaagcagauuaaguagcagaaaguccaggaaagaaagaccagaaggaguaaugagacaagugaugguggggaagcugaauguugagggagguggaggaaggaggagaugagcagugucaguaaauacugugcauucaguagaaguugaagaaucauuguuagaagcauuuccaaacaaaacacuaagcaaaaugggaauuaggcuuauuuugaaugcaucuuuaacuuacgaaagauguacuaauugugggggugccugagucaggcggagcugacccaggggugggaacgauggcagcugcccaggacccaugugcuuggcccaggcuauguccucgugagagguacugggguccacggauauguguuguggggcagacagucacugugggaugucuucaaagucagcaguuacagaauuaguuuacuuugaauuuuguugucuaaauagcuccugcuuuauuuuuuaaauuaaauuuuuuguuuuuacuaucacaggcuggccuaacuaauacaaaauaggugaugaaccucugguuuuaccauaaugcaaugugccacggaaaguuugggggagguuuuuaauguaauugcacucugguuaauuggcucguaccaagcccugccuuaugacuuguggaaagcuucaaggaguuccacugaugcaaaagggucuuuuccuagcuuccuggucugaucagugcuaugagauggacagauaagugugaauguuuuauacagaaaauggaaaugauacauuucucuuguuagguguuuucauaaaauguagcauuuuuuuucuuauggaaauaagaguuucaggugucuccccaccuagggcaaauucaugcacauugucauguuauaccaccauucuggaaaugauuucuguggauuugaaauugcacuuuuaauuuuauauaugacagcauuuaaaugcaaacacuaccaugaauuuaauguauaaaauguugucaaaccaagggaaaaaaccacaguucaccauguggaguuuacuuuuuuuauaugaauguuuguuguacugugucuaagcauaacuucccuaaugucauuacuuuuacauaccagauuugacugaccacuaauguaguacuggggauaacuuaauauccuauguugugucaagacucuuugaagacuuucuugaauugcuuucguaaaggucugaacacuguuaaggagaaagcugaguaucaacuugccuuucugauagaaauguuucuugugccaguuuuauuguugagauauacuauuuuuuuccuuuuuuaauucaguuuuuuaaaaaaacaaauguauuguggcuuccaguuaccagguugucuagguaaugacaguaaacugacuguagaaugauaauugugguauagugaccaauagaugccaaacagcuuguggccucacuaaagguggggucgcuuaguccccgggaguaaaaugagugaccucagaaacaagaauuccuggaaaggcacaugccgaagaggaauaugguauaauuuuaaauuuuaaugcaaaauuuuaauuugucuuuauuuuuuaucauuugaacugauaagcacuuuuugugucaauauaaaauauacuaaaacugaugaaaugcuaagacaugucuugugaaggaagguuucuuggagaccacuuuuauuuacucaugagaaguggaagcuccuaguaucagaagaagcugauacauagugucaugugcucagugguugccaaagucuaccaacuuuggggagcugcaggguucuuuuugggaggugggaggaagggagaugaguuuuguuauuuugggguuuucaagcauuggaaccaaaggccaaauaauaaacagccuuuaguuuuuaaaguaaaauucauuuuauuugcagaguacacuuguaugguagacuguuaaagacaauuuuaugacuauuuaugcacauuauaaugguuacaucugcuuuuugucuuuaaaauaaaaaaaaaaaucagagaaaagcccaccuuugaauacguggcugaagauaacagccaagaauuggucuuuccuaaaaaugcaacagauaaugcugcuagauuguuauuuuguuugcacuuuuuuuugauuggcauuuuaaaaucgguauuuaaacugaagacauugucauguuuuauuaauuuaacaaaguugaaagugacugcucuguacaucaugaccuuaacaauguuaaugcuguaagugaaaguucacugucgucuguauacuaaauuuauugguguuucuaacuuaaaaguaagacugcagauuaucccccaccagccuuaguccagggguguggcucuguccgggugcaguaugcagucauguggaaccuugcuuucuaguccugggaaaaaaagaugucucuaauuacuggcuucaauaaacacgaauccagacugcuuacaaguuuugguggcuuucuuuauggugaaucaucccacuggagauacauugaauuuucugcuaaucauaugggguaucugaucacauaacuaaaaauguuua

SEQ ID NO: 15761 - RNA, 1503 nt, Homo sapiens
uaguacccuuuuguuucuuuugaaaguguaaaacaugauguagguaaucugugaaucucuauagccucuucuguuucaagauaccauaagcauauuucaugccagagcaucguguugaccacauuuauuugccuuuaaguauauuuuaacuuauauacagauuuuuuuaaaguuaccuuaaaaacuucuuggucucugcauuuauuggauuuuuuuaggccacccgcuugcaaguuccuguuugauggaagaauugcccuuaucuguuguuaaugguacauuuuccagcccuagucuuucuuacugugugaugugauugaguuauaaauauacacuuugcaagcaguuacccagguagagaaaacagucucuggcuuguaccuaguuugugguaggaugugacaugucaaaggaccucugccuccagguuugggggcaucuguuuaaugcuacacguggugugaucuccaagcacaugggugaguuacguguagugggcaguggggagagaggcugaaaaaaggaaccaugccuguggauggguaggcauuaaaacccacagacuuuggguacagaguaguauuuuugaggacauucacagaacccaaacuaaagccgcuaaaauagaauuugaaaguauugcuagauuuagauacuuuauacuguugacacaaagccaugaauauaaauuuuuuuauagcauguuaauugcuuauacaaaaaaguuaauaaaagauagguuuuuuuuuaaguauauuuuucuaaaagaggaagauuggguuuuuuuguuuguuuuguuuuauuuuuuuucuuuuuuugagacagggucuggcucugucauccaggcuggagugcaguggcauuaucucagcucccugcaaccuccaccucccgagcucgagcaguccucccuccucagucucccgaguagcugggacuacagguacaugccaccaagccuggcuaauuuuuguaucuuuuguagagaugggguuuugccauguuguccaggcugguccugaacucuugagcucaagugauccacccgccucagacucccaaagugcugggauuacaggcgugagccaccaggcccugcugguuuuaaaguauauguuggaauuuauugaaaaagaagcuaauaggccgggcgcgguggcucacgccuguaaucccagcacuuugugaggcugaggugggcggaccccuugagcccaggaguucgggaccagccuggacaacguggugaaaccccauuucuacuaaaaauacaaaaaucagccaguaugguggcacacaacuguaaucccagccacucaagagccugaggcaugaggaucgccugaaccugggaggcgugggcugcagugagcuacgccagucuaggcacaccccuacaccacaccacuacacuccagucuaggcaacaaaguaaaacucaucacaaaaagaaaaaguauuaauaguuaauaaaauauuuuugaugauaguucucaagguacu

SEQ ID NO: 15762 - RNA, 1043 nt, Homo sapiens
cuuaaauuuuuugagcuucagguuccucaucugugaaaggguuagauaagauucagugagauaaugugugacucuggcacauggugagcucuagauaaauggcgcuuuuguguccaucagucucauucccaaagccuaggcuuucgggucggucauccggcugcccgacccgcgacggcgcaggggaaucggcgagcguggcggggugcugcgcugcgccccucagccggcagaggccgccagcgcgcccucgguccggacggugcccgccccugccaccgccuccccgcgcauggcugccccggcggcugccugaccgccgcccgccaccucggcggccucgcaacccgugggagcccguggccaucgcagaccuagaggacacguugggcggcgcagucgccgcggcaaggucggcgggcggcgcggcgcgagggacggcgagcggggggcggcccggcccggguccucgcggguccucggcgggcccgggggagggcccucuuuguggcugcaguuggcaagauggcgccgguggggguggagaagaagcugcugcuaggucccaacgggcccgcgguggcggccgccggcgaccugaccagugaggaggaggaaggccagagccuauggugaggccgcgggcggucgggccgggccguggggggcgcggccucugggccggaccgucggacacacugaggggccgacgcgagccgggccaucccagcccggcccggggcugaccacucuugccauugucgccacagguccuccauucugagcgaaguguccacccgcgccagguccaagcugccguccggcaagaacauccuggucuucggugagcgccggcggcggggcguugccccaggucgcuggggugggcgaggcgggcgccccucccucagguccccgccuuccccguuccagccgccugcccgcagccuggcgggaaagggaccgucggcccuggccggucagcuggagaguggucaagccuccagcgccugagggugggaugcugcccucuuuggagagcg

SEQ ID NO: 15763 - RNA, 28107 nt, Homo sapiens
uacauuauuacaaaugagaaaaauguuuauuaagaaaacaauuuagcagcucuccuuuagaauuuuacagacuaaagcacaacccgaaggcaauuacaguuucaaucauuaacacacuacuuaaggugcuugcuuacucuacaacuggaaaguugcugaaguuugugacaugccacuguaaauguaaguauuauuaaaaauuacaaauuguuuggugauuauuuugaugaccucuugagcagcagcuccugaaaggaaaaaggagaaaagcaaaucuuugaaagaguaaacuucaagaguuacauacucaauucuguaaagaaacuuuuccuuuucaaaagcaaagguguuuuaaagugacccaaaacagaugcaguuagcuuacugagucauaucaacauaaaagccuauaauucuuuuuguuauuaaaggaaaucuaaacaguagugugguugaccaaacuuuaaaggauacacacaggcauaaaagauucucaaaggacacccuacugcugcauuugaauuuuaccuuguaucuguuuuauaauaaaaaaggagaaagguauauuuguucugaaugcauuuguaauuuaggaaggaucuauauuaaauaucgccagaccgcuauauuuacucaaaacaaaaaaacuacuaagaaaaaaacuugugcaucuucuauaaccugaagauuccucuuucccaaauauucauggacuggauagaauuuuuuuuuuuuuuuagacuagagucucacucugucacccaggcuggagugcaguggcgugaucucggcucacugcaaccuccuccucccaaguucaagugauucucuugccucagccucccaaguagcugggauuacagaugccugccaccacaccuggauaauuuuuuuguauuuuuaguagagauggaguuucaccauguuggccaggaugguuuugaacuccugaccucaagugauccgcccaccucagccucccaaagcggaggccuuacaagcauuagccaccgcgcucagccgacuggauagaauuugagacuacugugcaccaaauacuguucuaggcaguagggauacaguaaggaaaaaagacaagaagauccacuuacccucaugcuacuuuuuagcagcaagagagagagaauuuauuuacaaauaaauagaauguguaguaugucaacugaccauaggugcuaaggagaaaaagcaaauaagggagauauaaauacaagagaagggguuuguauuuuaaauaggagagucagggauggcaucgcagagaagacagcauuugaauaaaaccugaaggaagugaagggauauaauggcacugugcaaaaugauuacagaaugcacagaaguaaaaaacaaaaaaaaaaaaacaaagaaaaccuucaauuuauacuuuuuucugcuauaguuaagucauccaguccauccaucuggcuguaccucuucuuagauucuggacugcaucugaauaaauaauaauuugcccuuuucugugaauuggcagaaaauuuugcuacuuuggcacaagagacuacuugguuuuaguuuaaaauaaauuauucugaaucaggcuuuaauuuggauuugcuuagaaaauaguuuucuuaggucuguaugaugcauuuacauuuugaacacuucaaauauuaauuagaccuaaaucugccuuuaaaacauucaacaucuagaaggaaaaugccacaagcuaauagcucagucuacaggagaucacaggacaguaauuuuuuuugagggguguuauggacugaaugguucguuucccccucaaauucauauguugaaauccuaacccccaguguaauuguaugaggauagggccuuugguaggugauuaggucaagagcguagaaccuucaugaauaggauuagugcccuaagaagagaccccagagacuucucuugccauuuuuuuuuucaccaugugagaacacagaagagagagcugccuaugaaccaggaaaugggcgcucaccagaccugaccaugcuggcacccugaucccagacuucuagccuccagaacucugugacaaauuuuuauuguuuauaagucuaugauauucuguuacagcagcccaaacugacuaagacaagggggaaguagagugagggagggaaguaaagggagcuuuuaugaaagacaugucauuuuugaguugggucuugaagaacauauagguuuuggacaugcagaaaaacauauuuuuaaggcaaauaggcacagaggagcaaagaucuaggagcaggaaaucaaagggcauccuggggggaaagcaaguaauaugauaaaaccaaggcuggaaaggccgaguggaaccaaaacacaggguuuuuuaacgucaagccaaaguccuuggacuugcuuggaggacuguuguagaguguuauguauauugguggggcagaggguuaguaaaaggacacaaucagagcuaugcuuuagaaggauuaaugacucuuaaggaguuuaaguuggauggcagugggagagauggaaggcagggagaccaguauaggggcaacugaauaaauauccuaaccugagcaacauagugggacccugucucuacaaaaaauugaaaaauuagccaggcuuacuggcacaugccuguagucccagcuauucaggaggcggaggcgagagaucacuugagcccaggaguuugagguugcagcgagcuaugauggcaucaauacacuccaaccugggcaaaacagugagacugcgucucaaaaaaaaaaaaaagaaagaaauauaacauccugcuucacugaccucccuaauuaaaauagcuagacgacaaaacuuuguauuaaaauaguaacuguacuauguaacaacaggugagucuucucauauauggaacucaccccccaagaaugcagcaaugguauguggcucagcagcuccauaucggcaacuaaaggagaccacagagacaugaauuuugauuagccuuaugacagguguggaaucaucuccuagauacccuaaaaaauacucacaauucguggacauaaucaucuuucaccauuacagauaaaccauauuccugaaggaagccagugagacaagacuucaacuuuccuauaucuucuucaacuugauaguuagauacuccuaaaaauaaaaguuaguuuucauuaaaauaaaugugauucaaaauuaauggccaacuccuuuauuuaaucuaguuucagauguucuagucaaaauauguaugaaacugaagaacaaaaauaacaaaguaugagaccaauauuugcacauaucacaaaccuauaaucagagaccaacuaaaaccuaguaaaaauuugaauuuaauuaaaucuuuauuaauugcaucauauucacugucuagaaaagcaucuggcacauagugcuuaauaauuauuugauagaagaacuuaaugaaugagaaaguaauguccuacuuauacccuuuauaaaaguuauucuccaauucuaaaagacuaaaugauaaaugacacugaggacauaaagcuauuaauaauagguaacuuuuuuuuuuucuuuugagagagagucuugcuguuaccuaggcuggagugcaguggugcagucucggcucaccgcaaccucugccugccggguucaaaugauucucaugccucagccucccaagaaacugagacuacaggagugcgccaccacacacagcuaauuuuuucuauuuuuaguuucaguguuggcuaggcuggucucgaacuccuggccucaagugauccacccgccuuggccucccaaagugcugggauuacaggugugagccaccaugccuggccaauaauaggucacauuuauugagcauuaauagaugcuggacacuguucuaaggaccuuauaucuauauuaauugauugaauccucaaaacaguccuaugaaguauguauaguuaucuccauuuauagaagagaaaacuaaagcacagagagauuaaguuacuuagcucauaagugaugcuguaugacuuccaaagcuaggucauaaaaagcccuguaccuuccacuuggguuuuuuggaauguuaacugcagaagccaacugacaugccaaaaggaaguccaagcuagccacgugaagagauaccugaccagccgccagcuauucccacuguucugacuaaggugcuaguuacaugaguaaaaaugucuucuugcaugucuaacucagucagucaagccuucagaaugacuccacccccaggcucaagcaacugcaugccuccccaaggagaacugccugagaccaggcaacccacaaaaucacgacacuauuuauuguuuuaaaccacuaaguuuugaagugguuuguuaugcaacagauaacugaaauaaauacuaaucaaauaauacaaauaaagcaauacauauuugguguuuauucuuuuuuuuucuucuaguaagcuugcuuguuaggacuauaaacucugggcagcgcaguggcucaugcguguaaucccugcacuuugggaggccaacacaggaggaucacuugaggucaggaguucgagaccagccuggccaacacggagaaacccuguuucuacuaaaaauacaaaaauuagcugggcgagguggcgggcgccuauagucccagcuacucgggaggcugaggcaggaaaacugcuuaaacccaggaggcggagguugcagugagcugagaucacgccacugcacuccagccugggcgacagagcgagacuccgucucaaaagaaaaaaaaaaaagacuauaaacucuggagacacacuguaucagauggagcagcagguuuuaugauaccccuagaauguguugcuaugcaauaauccugcacaauuaaaauuaucaucccaaagaaaaauauucugagcaaccucagaucuuugagauuaugccaauucuccaaugacuacauuugcugaagauaaaaaguagauaacuaaacaaagaaauuccuacaucuucagaguuauugaguucagaaauuaguagcauacuuuuuuuuuuuuuugagacagucucaccacagucacccaggcuggaguuuaguggcacaaucacaacucacuguagccccaacuucccaggcucaggugauccucccgaguagcugagucuacaagugcacaccaccaugucuggcuaauuuuuuguaucuucaguagagaugggguuccaccauguugcccacgcuggucuccaacuccugggcucaagcaaucugccugaaucagucucccaaagugcuggcauuacagacgugagccaccguacuaugccuggccagcauauuucuuguggcuuuccuauuccacuaaauuaaacucagugugagucuuaguaacaaacuauggaaaaugacagaaaaaaguuuucuucuauacauauucaaccaacaucccccuguaauaguuuagaaucgaacacuauuuugcaaauaguuaaacuuaaaaaacaaaaggugguucuucacuggggaacguuugggguguaaucuguuuacaaugugaaauucaagcaacacuauuauaaauacccugagaacacuuucaauuuaaauguuuuauugaagaucuuauuauaucugguaauucaauugcuauucuuaccuggauaucuacccuguuguuuaugaaaucuaucaacagcccguaacauuaaguacaacacuauuucauuaucuggauuguccaugcuagaaacugaaaggaaaaaaaauuucaguuuaauuugguuaauuugcaauguaacaaacaaugaagggcugaauuuacuauauacuugaguuucaggacuauuaacuggagucacacaaucucuacugaaguaguaacauacugacuuuaacucauacauaucacacaauggacucagugaccuaaauaugacuuuaugcauacauuaaguuucauauaauauauaaauuauaauuaccuagauaagcuuagaauaaaauuagaauauguuuacguuaucuuuaauaucaucaccauauacucaacacuauuauacacaaaauauuuauaucuuuuaaauuaauuaaaauuaacccagaaucagaaggcuauuauacuuacuaauuucauccuuguuaauuguauccaaaccauauucuucagcuaaggaucgacaucuuaccacucgaagaaaugcagaauugcugccugaacagaggaaagauauucuggaaguaaugacugugacuggugaauauuaugaaucacaggugacuuuaagaacagagaauuauguguauacccuucucagacaugagaaugugaagaaauguuuucuccuugguucuaauagcagagaaagcacuagaacaugaaucaccuuaaauuuauaucccuggcacuacaaccaguucagaagcaaguaaggugauggccucucugaaccucaguuuucaaguguaaaauggggaugauacuguuuaccuuugagaauuguucuacagauuaaaugugacaucuguauaaagugcaucucuagcacaaugccugauauggcucuaaaaauaauaguuuucaucauuauuauggauaaguaguccuaaaggagagagguuuaugaauuguacucuugauauauguaaugacuuuaagcuuuguauuauugaaauuuucaaaaacgccccaaaguagaacagaauaauaaauguucaaauacccagcaucaaacuugugaucuaguauuauauaaucuaauacaacaaacgcuaauucaagauuagucuaauagaacaaacaaggugcaagauuaguaguggcagaaaacauuaaaaccgagccuaaacagacauuguggagaagucauaaaauggaaagcuuggauaaaucuauuuuaaggauggggagcaugcaaaauauaaacuuccacaggacguaggagcaguagcuacagggagaaaucuucagauggcaugcacaacagauuggguauuuugaaacugacucuuaaauaaaagaaaaugcuuuuggccuacugaggaguuacugagaagacuccuacgaaccuaaccacuccgaaacuagauggcaaaauucuuaacuccauuacagucauuuaacacagaucaaaaugaguauuuaaaccaauauugucaauguacaugugacucaagacuucacacccaaagucuucagacaaaaaaacuuccuaaauuacuuaaaauuuaaaaacugaaaauccuguauuaauggcaauuuucaauuaacugaccgucaagccuuuuuagcauugccacagauaaacauguucuaccucugauucagucuuaaaauacucgccauguauuguauuaugagaggaaaaaaaaaaccuuacccaauaauuaucuauaucuauaucacugaggccauggaaaacuuaaaauuucaaccauucaaaauaccugggaacauucccuguggcacauuucuaucaagcaaaauaaggaaauuaauucaaggggacuuacagaguaauuuuaauucuuucucugaaauggacucuggugccuguaaagagauaaauacagauucuguuccaguuuaaaagagaagauuaacaaagggugcggcacaaagccaaucacugugagaugggaaggcuuucuccaagagcugggagagcacuuuaaaaauaucuuguuuccuuaucacaagcuaucccauuaggcagggaaaugacagcucccucuaaagaagcacagaggcagugccacacccucugucucuaaacccuuucuggcuggaguuacgugcugaggccuguaugggcacagugugcccaguagcuuaccuggccaauggacugcagcaauuuggcaacaugauuacccacagcggcagcaucuuucuuugcuuuuucacgguaacuaaaaaagaauaaaaagcaauuacuaacaaauuuuuaaauuagcaaaauuuaaauuguuaccaugaacaaaaauuuucuuuccuuuucaugaaaaaacacaggucugacaauguaugaaaugugaaaaugccagggaaaugcuaucaacagcaccaugaguagcugggaaucuuuccaguguuagugacggacucucagugcccacuaaaacccagggucccucuaacagcacccaacuuaaaaacugcuccccuagagggaucuaugauuucggcuucugugacagaggaccugaaaaaauacauuacugaagaacaugacuuaucuccuggaagucaaguccaaggaaaguuaaauacauuaaaacuguucaucuccaauguaaaacuucuuuguuuuuugagacaggaucucgcucugccacccaggcuggaguacaguggcgcaguccuggcucacugcagccucaacuucccacgcucaacugauccucccaccucagcuucccaaguagcugggaauucaggcacacgcuaccaugcccgacuaauuuuugucuuuuuuguagagacggaguuucaccauguugcccaggcuggucuugaacuccuggguucaagugauuuagaaacugaaaauacuguauuaaugacaauuuucaauuaacugaccuucauaccuuuuuagcauugccauagauaaacaugcucuaccucugauuguuuuaaaauacucuguauuuauuaugagaggaaaaaaaaacccuuacccaauuauuaucuguaucuauaccacugagacagaccauggaaaacguaaaauuucaaccauuuaaaacaacugugaacaucccuuguggcacauuucaccacccgcuuuggccucccaaagugcugggaauacaggugugagccacugcauccggccauaaaaguuuucuuuacgucuauuuaccuuucacccucuaaaaaucaucaguguucaggcugacuaccucccauguaaggucauacuucuuucuauccucaauugaccuuccccaaguuuuaaguaguugaacucuuaggcuaggacaacaaaccaagauucguucaauggugacaugauaaagagugaaaucugucuggggaagagagaucaucucugugugacauuacuuggaccccaaagaaaccgagccagcagaccuggauucuuugcaccaugcccuaacuauacgagggucauauucauugagacccaucccugugauagucuaucuggguucaggcuagugauaccuggauagcaagaugucuagcuauagucauagacuauaacuuaugaaacauuaagauaaaaaauucaucaaaccuucaugguuuuaaguuacaaauacaagguaguauagggccauagcuaagcauacaggcucugguacuggguuuccugggguucaaaucuugguucugccauuuaccagcuaucugaccuuguauaaguaaccuuuucaauaccuuaguuucuucauguguaaaauggggccgguaacagucucucucucucucauaaggucguugugaaccuuguguguguguuaaauuacuuaauacauauaguucauagcacagaguuaagggaucaaauauuaaguuuaucaugaaguaugaaaaaaaacucugccuccuaggcguaugugguaauucuguauuucccauucaauuuugcuuugagcuuaacaagaauugcccccuaaguucuuuuuuuuuuuuuuuuuuuuuuugagacggacucuugcucugucuccaggcuggagugcaguggcacgaucuuggcucacugcaaccuccgucuccuggguucaagcgauuccccugccucagccucccgaauagcugggacuacaggugcgcaccaccacaccuggcuaauuuuuuguauuuuuuuaguagagacaggguuucaccauguuggccaggauggucuugaucuucugaccuugugauccacccgucucggccucccgaaguggugggauuacaggcgugagccaccacgcccggccuaaguucuuuuuuuuuuuuuuugagacagagucucacucugucgcccaggcuggagugcaguggugcgaucuccgcucacugcaagcuccgccucccggguucacgcuauucuccugccucagccucccggguagcugggacuacaggcgccugccaccacgcccggcuaauuuuuuuguauuuuuaguagagacaggguuucaccguguuagucaggauggucucaaucuccugaccucgugauccgccugccucggccucccaaagcgcugggauuacaggugugagccacugcgcccagccuggucuaaguucuucagcuuauuuuuacuuauuuauuugaaacagggucuugcucugucacccaggcugaagugaaguggcaugaucauggcucacugcagccucaaacuccugagcucaagagauccuucugccucagccuccugaguaguugagauuaaaggcgaacacuaccaugcccaccuaauuuuucaauuuguagagauggaagucucacuauguugcccacgauggucucaaacuccuggacucaagcaauucucccaccuuggccucccaaaguguugggauuacaggcaugagccacugcagcuggccuaguuuauuuauaagcaaugagguuguaauaaacuuucauuugauuucugacaggaugauaaaauguuuaucucuaauauaaucagacuuuuucuauuacauaguuugaaaacagugacauacacguuuugcaguuuuauauauuugccugaaucugcaaucauaucaggaauugugccucgaacagguaaauuuccuugacccucuuuggccacaaauuccuuuaaggcacgagcuaaaauccaaaaugauggagucuaaaagaauaagaaaaaauuaacauuaaguggcguuuuacuuugacccaaaguuuuagcagcaauguuuuuacuuuuguuguuguuaccuguuuggugauauuuaugcagcgaucaucauuaaauauaucuucaauacugcuugggaucuaacaaaggaacaugaaacauuuacuuacacaguauuaagaauucgcccaucuuuauuuucagugcuauuucuucagauauguucuuugaauucucaaauuguaaucaaauacaaacuucugauugguuuauaauuuuauuuagaaucaguaccauaugaagauuugauggggaaagaauggaagaaagaccucuccggcccacuguugcuaccauuuaauaccuauucucuuauaccauaaaugggguaaagaaggggccccaguaaauuauuuuauauaguuacaucugaagacaaaacagauuauagacucgcaguauaucaugauuuuccaucuugucaaaaaucugaaacccuugcacccuaauuagugaccguugagacaaccacucugaaaaaaacuaaaaccauaaaguaauuuuauugcuagcaagaucuucauacguuaaucaagaguauaaagcugagcacaauggcucauaucuauaaucccagcauucaggaggccaaggugagagggucauuugagcccaggaguuugagaccaaccugaacaaaacaggaagaccccgucuauagaaaacauaaaaguaaauuagcugcgcgugguggcacgugccuguggucccagcuacuugggaggcugagguggggggaucacuugagcccaggaggucaaggcugcagugagcagugauugugucacugcauucuacccugggcaccaaugugagacccugucucaaaaaaaaaaaaaaaaauacacacacacacacacacaaaucauaggcuuggauucuacugauggguggaaaaaagaaaugucucagugggaccuccuaacugcucucucugcuuccacucccaguccccucaauuguguucuccucaugaaagccagaauggucuuuuagaauacaaagcagcucaauccacuucccugacugaaaugcuuaaauagccugcaaggccuuuaugaucuggcccuuucugccucuccaaacucaaauccuuccuaccacuuuucccccuuuuacacuucacuccaaucacacugacuugcuuacugaugcuugaacaaaagucaagcuucaucccacuucugggccuuugcacaugugcucccuccaacugaaaagcucuuccaccagaccucugcgugucacuucacucaggcuucugcuuaaaugucuuuuggaaagucucccuggcucccuauguacaauugucucucaaccccggauucccuuguccccagcaugcucucugacccuuuguucugcuguaauuuuguucacagcaccuggugcauuuuuaucuguuuauuuagcuuacugccccccaacuauuagaaucuuuucuuuucaacugugguuuuauauucagugaaauacagagauuucaaauguccaauucaaugcauuuugauaacuauauauacauauuuuuaaccauaaccccaauuaaaacagaaaauguucaucaccccagaaaagugauucacaaagcacauuuauuuuuuggacacagggucucauaucauugcccaggcugcagugcaguggcacaaucauggcucacugcagccucaaccucccaggcucaagcgauccucccacuaccuuaggcuccagaguagcugagacuacaggugcaugccaccacacccaucuaauuuuuaaauuuuuuguagagacaagaucucccuacguuguccaggcuggucuugaacugggcucaagcaaucuuucugcccuggccucccaaaguguugggauuacaggugugagccaccacaccuggccagcaaacacuuuuuuuuuuuuuuuugagacagagucucgcucuuguugcccaggcuggaguacacugaugagaucucagcucacugcaaucuccaccucccagguucaagcgguucuccugccucagccucccaagcagcugggauuacaggugcccaccaccaugcccagcuaauuuuuuguauuuuuaauagagaugggguuucaccauguuggccaggcucgucuuggacuccugacuucaugugaucugcccuccucggccucccaaaaguguugggauuacaggugugagccaccgcgccuggccccagccagcacacuuuuaaucacucagcaacacugccuuguugucucuaaaaaguugguaauaauaucuuacgugccuuccuaacuugaaaggcagcauauuugcuguuuuaaguuacaagaaaauucuaacuuaaacuaccagguguuauuccaaagcuccccaaaaacuucaauggucagaccucaacaacuaagccauaacaaaaccaaaggcaucugaggcggagucuuacucuguugcccaggcuggagugcagugguguaaucuuggcucacuauaaccucugccuccuggguucaagugauucuccugccucagccucccgaauagcugggauuacagguauguucaccaugcccagcuaauuuuuguauuuuuaguagagacgcgguuucacuauguuggccaggcuggucucgaacuccugaccucaggugauccacccgccucagccucccaaagugcugggaugagccagcaugcccggcccuguauuuauuucuaacuauacauuuagaaaauauuaacuuaaaucauuauagucaaccauuuaauagccaaggacucuagaaaacaucuuguucaugugaaucccucagcaacucuuucauuaccugaguuguauuuagugcuguguucacauuuuuaauagcuucuucaaaauucucuucaucuucuggagccccauuuucauuuuuuagaauuccuauuguaaugggaaauuguuagcaaacagcccuuuucuuuucacucuucuguucccccauuauaaaaauaaccuugucagauccugcagaauauuaaaucuuaagaagaaauacggcuuaucauuaguccuuaaaacuauacaaggcguggcuucuuaacuucuccagaaggaaaauaaaagcucaugaugcuaucaucugacaaagguguuaacagaaauccaauaaguaccugccucuagcaauuugcuuuucaagcuuuauacaguauuuaaucauaucccauauuaccuugucuaaucaaaucucugaaguccucuuuuucuuuauacguuuuagguauucguccauuugucuaaauugguuaaaaauuuuaaaaaucuaguuauuaaaauucaaaauacagaaauugaaagucuaaagugucccccauucucuacauaagauuucaucaacaaauauauuucucugugaaaucagaggcucacuugauagaaaacagacacugugaccauuuaucuacauucauucccccugccaguuucauaaugacauuuauugaauuucauuuuaauuaaaauuaucaggaucaaaagaggaacugcuagauuuaaauuuaaaagcauccauuugcccuaccauacaacuccauaaggaaaaaaaauuaaucucccauuccccaucaaggaaauccuuuguaagaaacugaaaauacaguugcauaugaaauuuuuuuuaaaaaaggacauacuucacuauaccacugugcuaaauauuuagcuaugaucacaauccauggaguaugacugugguccuaaaaaugagagacaaauaaaagaaaauaucaguauuaugaauucuucacuguaccaucucguuuucaacaaauucaacaauauuuaugaucuccuaauauaugcagaguagugaauagacgaaaaugaacugaguuaauaaaaacugcuuuacaaauuuuucuagaggcagauaccuaguaugucacauauauacuaugauuguccccauuauaccagcaaaacagucucagagacugccacccaaaaacacagcucaaaucucaauuucagacaccaauccuaaguaagaaaggaggaucuuuucuguuuucugaugaaccaaauaagcaacugcauguuaauuaauauggaagugggaaaaaauacauauacgccuuauaguguuaugucauuauuucuauuuguuuagaaaaaguccauaaagagaacuucuuggaauuuuuuuauuucuguuuuuuguuuuaaaauuuuuuacuuucaauuuuuguggguacuuagguguauauauuuaugggguacaugcuuugauacaggcaugcaaugugaaauaagcacaucauggagaaugggguaucuguauagcauuuauccccucaagcguuuauccuuuauguuacaaauaauccaauuaaacucuuuuaauuauuuuaaaauguauaacugaguuguuauuacuaacuauagucaccuuguugugcuuucaaggaguaaaucuuauuuauucuuucuaauuuuuuuuugguacccauuaaccauccccaucuccccaccuggaauagguuaauguccaauuucuugaccuggguagugauuacacagauguucaguauauguacuuuucuucaguaaaaaaguuuuuuaauuuuggagaaaaauuaauauguugaaaacaagguaaaauacuguuauuggguaaucgggaugacaggaauauggaaguuuauaggauuuucucacuuuaguguaauucaaaaaccuuagguuaaaaaaauguuuuaagucuaucuguaaauguaaggucacacacacuaccaaccuuuuuuuccauaugauccaaaucauaggacugaaaauguucucucaguucaggaaauggcuuaucuagucguagauccucuaaugcauuaucuggaugagauucuauuacugugaaacaaagaauucaaaaggauaaauuuaacacuuaaaaaaaaaaaagagagagauggggucuugcuguauuacccaggcugaaguacaguggcacaaucacagcucacugcugaaacuccugggcugaagggauccucccaccucagccuccugagaaggugggacuacagucucgugucacugugcccagcuaauuuuuuuguagggauagggucucacuaugucacccaggcuagucucaaacuccuggauucaagggcuccuccugccucggccucccaaaguccuugcauuacaggugugagccaccgugcccagcucaaaagauaaacuuaauucuuuggcaauacugaugacaauacauugaauuauagaaacuuaggaaaucuuuaauuuuuaaauggacacagggcccacagguuuuuucacuguuuuauuaagguacgauuuacauauaguaaaaugcagaaaucuuaagucaacuauaaaguuuuaguaaaaguaaaaccaagauuccuuuagaacacaauuuguucuaacuggaaaagcucaacauugacaaacccuagguacagauagcaacuaacaaccuauccuuccuccucuuguggucuucaauagacagcaucaccaucuaccuagacuucuucuccagaaaccugaugggcauccuucacuucuugcuuccuuggccccaacaucaguaacuccccacuuccuaaucucacucuguacacugcucuccacaugagagaggacaggagaguguauaauuucagugagugcuuagagguaggcccaguucugucacuugcuaacuaugugaccuuaggcaaauaauuuaaucucucauugccucagcaucaucuauaaaaagcagauauuaaaguaucuacagauuguauaucucucuuauccaaaaugcuugggaccauaaguguuuuggauuuuguugaguuuuugguauauuugcaaauacauauuagaugagcucucuaacccaaaaaucugaaguaagaaauguuccaaugaguguuuccuuugaauauuaugucaguucucaaaaaguuuugcauuuuggagcauuucugauuuuggauuuuuggauuaaggauacucaaucuguaccuuauaaagguuuuggaaagaguaaaugaaauaauucuuauaaaggcaggcacacaacuaguaaugcugaaccuucauuauuaucuacccucucuucuucucuucccuaaauuaggaaaaagaacacacucucucuuacuuaggccacuggaaauuucuaacagcaaucacugccuccaaucuuugccccuuuaaauccauuuacuuuccacucaacuucaaagugacccauuuaaaauaaaauguuuacauggucacucucccacuuucaacucuuuuguucccucccaucaguugacaccacuuucaacucuuaaauggcucaccaccagcagccagagcuuauccugacaagcacucccuaacugcccacacagauauuacuccucagugaugcuaccaaugccaauggcuaucaccacauuagcagagugcuuggcucauaguaaaaauguuuucuugagucaauaaagagcacuguuuugaauacuggaugaaaauuuuaugaucaucuaagauuaaaauuuuauaaguaaagggcuuauauaaacccucagcugauggaggucugccuauaaacgacuuuggucucuuacaacaguuuccuugggaacaguaguuauguaaaugucuuuguugugugaaauugcaccugaauugagagaaccuaaagccugcaugagaaugaaauaaaagauuggacggaccuggugcaguggcucacaccuguaaucccagcaccuugggaggccaaggcggguggaucaccugaggucaggaguucgagaccagccuggccaacauggugaaauccugucucuacuaaaaaugcaaaaaauuagcugggcggccgggugcgguggcucacgccuguaaucccagcacuuugggaggccaaggcgggcagaucacgaggucaggagauugagaccauccuggcuaacauggugaaaccccaucucuacuaaaaauacaaaaaauuagccgggcacgguggcgggcgccuguagucccagcuacucgggaggcugaggcaggagaauggcgugaacccgggagguggagguagcagugagccaagaucgcgccacugcaguccagccugagcaaaagagagagacuccgucucaaaaaaaaaaaaaaaaaaauuagcugggcaugguggcgggugccuguaaucccagauacuugggaggcugaggcaggagaaucaguugaacccgggagguggagguugcagugagccaagauugugccauuguacuccagccugggcaacaagagcgaaacucugucuuaaaaaacaaaaaaaagacuggaguggggaaaggugguguaacuucaugggucagagugauccacauuccuuagcucuccacagccauacaugcccaauguggguuagggggcaaaagaagcuggguacuugcauaguugcuggaucuccuaauaagaugaagaagcugugccugugguauaucaugcuuuguauccuucuauaaugcuacauaaagaguagauugcagccuauugaaucugauugccacuuugaaucugcaacuagagaugugcugcuacaaauuuacuuuguaauuuaaaacugacuuucuaaauugucaaguuucuaaaauuauagcuaaagcaaccaauaguaagcccauaugcucaacaauuuuaccuggauguucuuuuauaaugauccucauauaaccaacuaguccauauguccuacagaucaaaagaggaaucugggaauuccagaggacaucugcuaagcguagugaagugcuguuuaaaaaaaaaaagcaaaauaugaacauaagcaaauggaaauaugccaaacaugaaaacaugcaaaacaugaaaaugucuuacagcaacuuucuuacuaaauaauagaugcaaagguacauaacugcauuuacauaagcaggucaagaacacacugaaaagcaagcauuuccacaggcugcagucucaaagaaaguacaucuuuggacaagagggaugugaaacuuuagucugucauauuaaggagaaacguuaaagaaagauaauucuaaacauuuccaugauagagaaaaaauauaaaacccacaaauacaccccuaacaauuccaauaaccaauucucuguugcccaggcuggagugcaguggcaugaucauggcucacugcagccucgaccucccaggcucaagugauucucccaucccagccuccugaguagcugggaccacaagcaggcacaccaucuggcuaaauuuuguaguuuuuguagacacaagguuuugccauguugcccagguggucuuaaacuccugugcucaagugaucugaaccugucucagccugguucugcuggaauuacaggcaugagucacugcacccagccuucaauaaucaauucuaacuaguuuuuaaucacuaaaacaaacaaagaacaaaaacaacaacaacaaaaaaacaauguucgguuuaacugcucuaaauauauuccaaaaguuucacaucuaagguuaggcuugguggcuccacaacuguaaucccaggacuuuggguggcugaggcaggcagaugacuuggggccaggaguuugagaucagccuggccaacauggugaaaccccgucucuacuacaaauacaaaaauuagccgggcacgguggcacaugccuauaaucccagcuauuugggagacugaggcacgagaguuaccugaacccaggaggcagagguugcagugagcuaagauugugccacugcacuccagccugagcaacagagcaagacucugucuaaagaauaauaauaaaaaaaaaaguuucaguauuuuucucuuccucaucuuuucaaugcuggaagauuucuaagaauuucuuuuauuuauuuauuuauuuauuuauuuuuuuuuuuugagacagagucuaacucugucacaagggcuggaguguaguggcacgaucuuuggcucacugcaaccuccaccucccugauucaagcgauucucuugucucagcuucccgaguagcugggacuauaggcgugagccaccacgcccagcuaauuuuuguauuuuuaguagagaugggauuucaccauguuggccaggauggucucaaucuccugaccucgugauccaccugccucggccucccaaagugcugggauuacaggcaugagccaccgugcccagccauaaaucugaaacucuugaccaggcacguuggcucacaccuguaaucccaacacuuugggaggccgaggagggugcauugcuugagcucaggaauuugagcucaagcucaaaaaaaaaaaaaaaaaaaaaguuucauauuuaaaguuucuauagaauuuaacaauuuuuaaaaccauaucaucauagacugugcaaagaaaauaaaacaaugcaaaucuaauaagauuaaaauaaaaacauauuaacauaaaaauuuaccuuucaggaagcugaguugcaacuacaacaguaaaccuacagaaaaaugagggaucauugucuagaagguuuucuggacucuaaacaggacagcaaagaaaaaaacaaacaaaaaaaaccaauuucacaaucauauuaaacauggcagagacaguuaagcuauuuuacaacaaaugaggcaacaauuccaauucaacuaaucauaaaugacacaaagauucaaaauucuaaauuucuggggcuuugaauuauuuaaaaaauuguauuucagcacagacauaauaauguguguacauauauaccucuuccacaaaacuuccagagacaucgcuauuuaauucuuguaagaauuccauggcagcuucagcucgguucuuuuuaaaaacaaagcauuuaacuugaauuagaaaaaacuuggucacaauauaaucccccaauuuauggaacaggcaaacauacuguaaaacuauccaaauuucaugcauaaguaugacaacucuguuucccuucuuuuuucuuuuuagagacaggcuuuugcucuguugcccaguuuguagcauaguggccugaucauagcucacugcagccuugaacuccuaggcuuaagcaaucuuccugccucagccucccaaguaggugggacuacaggcaugugcuaccaugcccagcuaauuuuuuaaaaaaauauuuuguagagacagggucuugacauguugcccaggcuggucuugaacuccuggucucaagcaauccuccugccuugaccucccaaagugcugagauuacaggcgugagccacugcucccagccaauucugcuucuccuaguguuuaagacucaacagaauauuacuuaaaacagagcaaaaccaucaucauccagaguucucaaaugacauuacuuguacucuacuuuuuugauuaggcaaaugaccaaaaaacucuggguagcaggcagggauauccuggaucaaguucagacucacucuaaccacccacaucuauaauccuguacaagagugguuaaucacuaagcuaaaagucauuucacuaaguugacuaacaugguuuuguaagauuuuuuaggcugggcgugguggcucaugccuguaaucucagcacuuugggaggcugaagcggguggaucacaaggucaggagaucgagaccauccuggcuaacacggugaaaucccaucucuacuaaaaauacaaaaaauuagccaggcgugguggugggcgccuguagucucagcuacucggaagacugagggaggagaacggcgugaaccugggagguggagcuugcagugagucgagaucgcgccacugcacuccagccugggggacagagcgagacuccgucucaaaaaaaaaaaauuuguuaaccagaaugaauauuaacauuacucaagauuuagcuuuaauacaggaugcaauguauaaacacagacaguacaccucuaaguucuuaaacuaccaaacauaugaagauuuacaagauuacaaaaauuaguuaacuuuuuucucagagaaauaauacacguuuuuaaagucaaagcuuuucaagcaaucaaaacacaggggcaucauuagaugcucacauccaacuauauucucuaauuguuuaccuugccgauacugcuucuuugaaggaagaaacuaaagugaacagaauaaaggaaaaaaaaguaaagcuuacugacuauaaaggaaaaguuguuuguaauagcaugcauauuucauucacaguauaaaacaaacuauauugugauuacagacuguaauggccuuccuggaggaagaaaaucagauggaacuuauaaagaaagauaggcuaauaaaucaauguuucuuucccaaauuguguaccacagcaugugaauuucacaagauccucugagagaaaaggguuccuuggcuaaaaacguuugggaaacaccggcgggugugguggcucaugccuguaaucccagcacuuugggaggccgaggugggcggaucacgaagucaggagaucgagaccauccuggcuaauacagugaaaccccgucucuauuaaaaauacaaaaaauuagccgggcgugguggcgggcgccuguagucccagcuacucggaaggcugagguaggagaauggcgugaaccugggaggcagagcuugcagugagccgagauugcaccacggcacuccagccugggcgacagagaaagacuccgucucaaaaaaaaaaaaaaaaaguuugggaaacaccauauacuauauuucccucuuggaaauucauaauacacauaauacaugugauacuaaaaucuuaugguaaagaaauuuuuacuucauuugauccauuucccaaacuaauuucacuauggaacccauuggcccauuuaacagcucuuaucguucccuagaaccgguguuccacagaccacucucgguguauugaaccauuuguuuuugcacguaacuguaacagauuuauucaggcuuccucccacacauacccuugacaugucucaaggcccagauaugaggcugcugaucagagucaggaugccacuuuucgguauaagcucacuggcuccauaagaagaaaccuuauuuuuaucacuuucuacucuaacccaccaaguaagcaaagauaacaagacuucuugguauauaucaauaaaaaagcugugcugugccuggcagaaacuggcacuacgauccaaagaaaaggcaucaaaacuaaauaugaacuaauugcugguuucccuuauauuuacucacuguuguuguuacugacaaacacaaugagagauaccagacuucaagucccugaaaaggugagcuuuaaauccaaauuugggcauguucugaaagucuaaauauaaucuuuaaagaauaauauacaggccaucuuuaaaacagcauuuuuguugacacuguaaagagagauaccccuagacuaagccuaaaagacaucacaaacaacaggcauuauuguuaauuauaugcuaacaccuacggaucaauacaagagcuuaggaagugcccauauuccaugaauaaaggaauaacgacuacuccuuuguauuaauaacaauaaagacaguaaugauggguaacauuuauuaaugcccuauuugccagaugcuguacuagcacuuuaccuauauuaucucacuuccucaccauaaucccaaacauaaggaugauuuccacugagagucgagucacccugacugaggaggugaagcuaagacucaggccuugccuuccuuaacgugaauauauuugaagagaauagaacauacuuguuuccagcaucuucuccgcugaccugauuuccaucaauaauuguaaacgaaccaauaccugagagccaaaacagagucagucaggaauacauaguucuaggucauaaacuuaaagaaguauauuuagaacacaaccacaaaccuacguuaccugguaguaccaaguuuuuaagaauuucaguuccuguggcuguugcauuuauuaggcaaacaugagcagauucuaaagccucuugcccaugaucaccccacaaccuacaaaacagacacaaauuugauguuuuuaaaacuuucaugaaaauacagcuuucuuauuugaauggugaucuuuaaacuuuccuugcauagacugauaugauaaccacagaauacagguaagacgggaacagauauuaguauagugauuauacaguaaucuagaacucagguugaugccuugaaugguuaggggaaaagagggagagggucaaauuagaaacagaaacuuggucuuccagccccuuaucagccugggcacaagagcgacacucugucucaaaacaaacaaacaaacauuuaaaaagcgucuuuggauuuaaacccucaucuguuuucuauuucauuuauucuuuguuuuguuuugagacagagucuugcucugucacccaggcuggaguguaguggcaugaucucagcucacuuggccucccaaaaugcugggauuacaggugugagccaccgugcccagcccuauuucauuuauucuuaaauuauguuagaugugccaggugcaguggcucacaccuguaaucccaacacuuugggaggccaaggcaggcggaucacgaggucaggagaucgagaccaucgugacuaacauggugaaacccugucucuacuaaaaaauacaaaaaauuagcugggcgugguggcaggcgccuguagucccaccuacucggaggcugaggcagaagaauggcgugaacccaggaggcggagcuugaagugagccgagauugcgccacugcacuccagccugggcgacagagcgagacuccgucucaaaaaaaaaaaaaauuauauuagaugcauuuaaguuaaguuagaugcauuuaagaucucgacauagggcuuauuacugugacuucugcaaaagcuuuaccaagaaaacugaauuaucaucugaaaagccucacaucaacuucuacaggagugcuuuaaaguauauuacccaaugaacauucuaauagagugauuaaugugccuucccuguuaccugauuuaaagcagauuaccccuuauuauguagucaguauguccuccagagcaugucaagcaacugccuuguuuuuuguuuuuguuuuugauacagggucuuacuauguuauccagacuggucuugaacuccuggguucaagcauuucucucgccucagccucuagaguugcugggacuacaggcacaagccacuguaccuggcuucauuuguuuuuguuugcugagcauccaucuuuccacuccacuguaugcuccauaagggcccagacagcugucaaauguauggaggaaucgccuagaagaaccagauggaccguaaacgccuguuuucuccaucaaaguauggcacguagaagacaccugacauauaugguugauggaugcuuagauaguuggagaguaaauuuaagaauacuggugcaucuuggcugggcgcaguggcucacgccuguaaucccagcacuuugggaggcggaggcaggcagaucaccugaggucaggaguuugagaccaggcuggccaacauagugaaaccccgucucuacuaaaaauacaaaaauuaaccaggcacaguggcacgcaccuauaaucccagcuacuagggaggcugaggcaugagaaucgcaugaacgcaggaggcggagauugcagugagccaagaccgcgccacugcacuccagccugcgcaacacagugagacuccgucucaaaaaaaaaaaaaaaaaaauacuggugcaucucaagcagggugagauagugugugugccuguagucccagcugcuugggagacugaggcaggaggaucacuccagcccaggagaucaaggcuguggugugccaauaaucauaccugcgaacagccacugcacuccagccuggguaacauacugagacccaccucaaaaauaaaacaaaaagaauacugaggccaggcacuguggcucaugccuguaauccuagcacuuugggaggcugaggcaggaggaucacuugagugcagagguacgagaccagccugggcaaacccccaucucuaaaacaguuagcuaagcaugguggcacaugccuguagucccagcuacucaagaggcugaggcaggaggaucguuagagcccaggaaguugaggcugcagugagcaguguucuugccacugcacucuagccacugcacucuagccugggucacaaagugagaccuugucccugaaaaaaaaaaaaaaaagaauccuggugugucucuaaguaacauguuucaagaauaggccaaaugaaucaguccucucuacuaucuugcuggcccaacuaacgugaaguaaggaggggcuuauugacugcugcauuuugcuucuaacugcuucccuuugacacuucaaaaccaguucucacuaugaaaguaaaguuugggacuuaaauggaaugcccucagcaaaaacccucuuuuguuagaguugcuuaguaaccucaacuaucuucucagcucugucauguacaguuauaccugcauuagaaacacaagaacuccaagaauuuacaagaaaaccuaaguugguuauaaggacuguuacccuguuucuucuccgaaaagcuuggaagcaggauguaacugaguaccuccgaaaaagccagaagagccuuaguuuacauccuggcucaaagauauggggaacucugggcaaauuaccuaacuucuccaagacucuguuucuccaacuguaaagcacaggaaaugguugcuuucaaggguacucucagaacuaagugccuaaagccucuacuacagcacuaggcugguggcgcaaacagaagcuccaguccuuggggacauauaacuucuguugucucagaggcuccaggaaggaggaaagcugagcagcuuuguuaucuccacagccucaagacacagaagacgcucaauaaauaaggaauggguagugcaaggagaaaaggcaaggguggggaaguacccaaggacccuccugauggcuuaggccugcacuguccauuaagguagcugcuagccacauguacuacugagcacaagcaaugaggcuaguguuaacugagaugugcugguaaguguaaaauacaauauuuauacgauaguuuugggggggcuuuuuugacggagucucgcucugucacccaggcuggagugcaguggcacgaucucggcucccugaaaccuacaccuccuggauucaaccgauucuccagccucagccuccagaguaacugggauuacaggcgcgcaccaccacgcccagcuaauuucugaauuuuuaaauagaaacaggguuucaccauguugcccaggcuggucucgaacuccugaccucaggugauccgcccgcuucggccucccaaagugcugggauuacaggcgugagccaccgugccgguccuccaagacaguuuuaaaaaggaaaauacucaugaccagcuuggggaaagguggcaaaaaccucguuucuacaaaaacaaaaauaaaaauaaaaauaaaaauuuaaguaaaauaucucaagaacuuuuuauauuguguugaaauaguaauguuuuggacauauuggguuaaauuguauuuaaaaaucaauuucaucuguuucauuuuaccuuuagugugguuacuagaaaauuuauaauuacauuugcggcucacaugagacuagcauuuuauuuccauuggacagcgcuggcugagaacaaaaccuaacccucugugccgcccucgcggccgggaugcggugcgccccgggccuccccauucggaaaacgaggagccugggcgcaacggggccggcagccgccuuagcuacccggcuggcgcuggggaccccgucccccgaacugcacaccgcguggcgggggaaggggucccagcccucgcggagcaccuuuggcccagggcgggagcuccgagcgccggcuucccgcgccccgcacggcccggcccagccuggaagaaggccugaggaaggcccgaccgcgccgcccgcgcccuuaggcccggcccgaaugcuggaaagcccgccggcccgcccucggcucggugagccucggcucaccucagcugccggucguacuucugcuccuugagcagcuuucccagcugcgccauggccgcgccugccgcgcggaaaacagccgagccccugcggagcgccgccaccagcuccacaagcgcgcaggcgcacug

SEQ ID NO: 15764 - RNA, 28107 nt, Homo sapiens
cagugcgccugcgcgcuuguggagcugguggcggcgcuccgcaggggcucggcuguuuuccgcgcggcaggcgcggccauggcgcagcugggaaagcugcucaaggagcagaaguacgaccggcagcugaggugagccgaggcucaccgagccgagggcgggccggcgggcuuuccagcauucgggccgggccuaagggcgcgggcggcgcggucgggccuuccucaggccuucuuccaggcugggccgggccgugcggggcgcgggaagccggcgcucggagcucccgcccugggccaaaggugcuccgcgagggcugggaccccuucccccgccacgcggugugcaguucgggggacgggguccccagcgccagccggguagcuaaggcggcugccggccccguugcgcccaggcuccucguuuuccgaauggggaggcccggggcgcaccgcaucccggccgcgagggcggcacagaggguuagguuuuguucucagccagcgcuguccaauggaaauaaaaugcuagucucaugugagccgcaaauguaauuauaaauuuucuaguaaccacacuaaagguaaaaugaaacagaugaaauugauuuuuaaauacaauuuaacccaauauguccaaaacauuacuauuucaacacaauauaaaaaguucuugagauauuuuacuuaaauuuuuauuuuuauuuuuauuuuuguuuuuguagaaacgagguuuuugccaccuuuccccaagcuggucaugaguauuuuccuuuuuaaaacugucuuggaggaccggcacgguggcucacgccuguaaucccagcacuuugggaggccgaagcgggcggaucaccugaggucaggaguucgagaccagccugggcaacauggugaaacccuguuucuauuuaaaaauucagaaauuagcugggcgugguggugcgcgccuguaaucccaguuacucuggaggcugaggcuggagaaucgguugaauccaggagguguagguuucagggagccgagaucgugccacugcacuccagccugggugacagagcgagacuccgucaaaaaagcccccccaaaacuaucguauaaauauuguauuuuacacuuaccagcacaucucaguuaacacuagccucauugcuugugcucaguaguacauguggcuagcagcuaccuuaauggacagugcaggccuaagccaucaggaggguccuuggguacuuccccacccuugccuuuucuccuugcacuacccauuccuuauuuauugagcgucuucugugucuugaggcuguggagauaacaaagcugcucagcuuuccuccuuccuggagccucugagacaacagaaguuauauguccccaaggacuggagcuucuguuugcgccaccagccuagugcuguaguagaggcuuuaggcacuuaguucugagaguacccuugaaagcaaccauuuccugugcuuuacaguuggagaaacagagucuuggagaaguuagguaauuugcccagaguuccccauaucuuugagccaggauguaaacuaaggcucuucuggcuuuuucggagguacucaguuacauccugcuuccaagcuuuucggagaagaaacaggguaacaguccuuauaaccaacuuagguuuucuuguaaauucuuggaguucuuguguuucuaaugcagguauaacuguacaugacagagcugagaagauaguugagguuacuaagcaacucuaacaaaagaggguuuuugcugagggcauuccauuuaagucccaaacuuuacuuucauagugagaacugguuuugaagugucaaagggaagcaguuagaagcaaaaugcagcagucaauaagccccuccuuacuucacguuaguugggccagcaagauaguagagaggacugauucauuuggccuauucuugaaacauguuacuuagagacacaccaggauucuuuuuuuuuuuuuuuucagggacaaggucucacuuugugacccaggcuagagugcaguggcuagagugcaguggcaagaacacugcucacugcagccucaacuuccugggcucuaacgauccuccugccucagccucuugaguagcugggacuacaggcaugugccaccaugcuuagcuaacuguuuuagagauggggguuugcccaggcuggucucguaccucugcacucaagugauccuccugccucagccucccaaagugcuaggauuacaggcaugagccacagugccuggccucaguauucuuuuuguuuuauuuuugaggugggucucaguauguuacccaggcuggagugcaguggcuguucgcagguaugauuauuggcacaccacagccuugaucuccugggcuggagugauccuccugccucagucucccaagcagcugggacuacaggcacacacacuaucucacccugcuugagaugcaccaguauuuuuuuuuuuuuuuuuuugagacggagucucacuguguugcgcaggcuggagugcaguggcgcggucuuggcucacugcaaucuccgccuccugcguucaugcgauucucaugccucagccucccuaguagcugggauuauaggugcgugccacugugccugguuaauuuuuguauuuuuaguagagacgggguuucacuauguuggccagccuggucucaaacuccugaccucaggugaucugccugccuccgccucccaaagugcugggauuacaggcgugagccacugcgcccagccaagaugcaccaguauucuuaaauuuacucuccaacuaucuaagcauccaucaaccauauaugucaggugucuucuacgugccauacuuugauggagaaaacaggcguuuacgguccaucugguucuucuaggcgauuccuccauacauuugacagcugucugggcccuuauggagcauacaguggaguggaaagauggaugcucagcaaacaaaaacaaaugaagccagguacaguggcuugugccuguagucccagcaacucuagaggcugaggcgagagaaaugcuugaacccaggaguucaagaccagucuggauaacauaguaagacccuguaucaaaaacaaaaacaaaaaacaaggcaguugcuugacaugcucuggaggacauacugacuacauaauaagggguaaucugcuuuaaaucagguaacagggaaggcacauuaaucacucuauuagaauguucauuggguaauauacuuuaaagcacuccuguagaaguugaugugaggcuuuucagaugauaauucaguuuucuugguaaagcuuuugcagaagucacaguaauaagcccuaugucgagaucuuaaaugcaucuaacuuaacuuaaaugcaucuaauauaauuuuuuuuuuuuuugagacggagucucgcucugucgcccaggcuggagugcaguggcgcaaucucggcucacuucaagcuccgccuccuggguucacgccauucuucugccucagccuccgaguaggugggacuacaggcgccugccaccacgcccagcuaauuuuuuguauuuuuuaguagagacaggguuucaccauguuagucacgauggucucgaucuccugaccucgugauccgccugccuuggccucccaaaguguugggauuacaggugugagccacugcaccuggcacaucuaacauaauuuaagaauaaaugaaauagggcugggcacgguggcucacaccuguaaucccagcauuuugggaggccaagugagcugagaucaugccacuacacuccagccugggugacagagcaagacucugucucaaaacaaaacaaagaauaaaugaaauagaaaacagaugaggguuuaaauccaaagacgcuuuuuaaauguuuguuuguuuguuuugagacagagugucgcucuugugcccaggcugauaaggggcuggaagaccaaguuucuguuucuaauuugacccucucccucuuuuccccuaaccauucaaggcaucaaccugaguucuagauuacuguauaaucacuauacuaauaucuguucccgucuuaccuguauucugugguuaucauaucagucuaugcaaggaaaguuuaaagaucaccauucaaauaagaaagcuguauuuucaugaaaguuuuaaaaacaucaaauuugugucuguuuuguagguuguggggugaucaugggcaagaggcuuuagaaucugcucauguuugccuaauaaaugcaacagccacaggaacugaaauucuuaaaaacuugguacuaccagguaacguagguuugugguuguguucuaaauauacuucuuuaaguuuaugaccuagaacuauguauuccugacugacucuguuuuggcucucagguauugguucguuuacaauuauugauggaaaucaggucagcggagaagaugcuggaaacaaguauguucuauucucuucaaauauauucacguuaaggaaggcaaggccugagucuuagcuucaccuccucagucagggugacucgacucucaguggaaaucauccuuauguuugggauuauggugaggaagugagauaauauagguaaagugcuaguacagcaucuggcaaauagggcauuaauaaauguuacccaucauuacugucuuuauuguuauuaauacaaaggaguagucguuauuccuuuauucauggaauaugggcacuuccuaagcucuuguauugauccguagguguuagcauauaauuaacaauaaugccuguuguuugugaugucuuuuaggcuuagucuagggguaucucucuuuacagugucaacaaaaaugcuguuuuaaagauggccuguauauuauucuuuaaagauuauauuuagacuuucagaacaugcccaaauuuggauuuaaagcucaccuuuucagggacuugaagucugguaucucucauuguguuugucaguaacaacaacagugaguaaauauaagggaaaccagcaauuaguucauauuuaguuuugaugccuuuucuuuggaucguagugccaguuucugccaggcacagcacagcuuuuuuauugauauauaccaagaagucuuguuaucuuugcuuacuugguggguuagaguagaaagugauaaaaauaagguuucuucuuauggagccagugagcuuauaccgaaaaguggcauccugacucugaucagcagccucauaucugggccuugagacaugucaaggguaugugugggaggaagccugaauaaaucuguuacaguuacgugcaaaaacaaaugguucaauacaccgagaguggucuguggaacaccgguucuagggaacgauaagagcuguuaaaugggccaauggguuccauagugaaauuaguuugggaaauggaucaaaugaaguaaaaauuucuuuaccauaagauuuuaguaucacauguauuauguguauuaugaauuuccaagagggaaauauaguauaugguguuucccaaacuuuuuuuuuuuuuuuuugagacggagucuuucucugucgcccaggcuggagugccguggugcaaucucggcucacugcaagcucugccucccagguucacgccauucuccuaccucagccuuccgaguagcugggacuacaggcgcccgccaccacgcccggcuaauuuuuuguauuuuuaauagagacgggguuucacuguauuagccaggauggucucgaucuccugacuucgugauccgcccaccucggccucccaaagugcugggauuacaggcaugagccaccacacccgccgguguuucccaaacguuuuuagccaaggaacccuuuucucucagaggaucuugugaaauucacaugcugugguacacaauuugggaaagaaacauugauuuauuagccuaucuuucuuuauaaguuccaucugauuuucuuccuccaggaaggccauuacagucuguaaucacaauauaguuuguuuuauacugugaaugaaauaugcaugcuauuacaaacaacuuuuccuuuauagucaguaagcuuuacuuuuuuuuccuuuauucuguucacuuuaguuucuuccuucaaagaagcaguaucggcaagguaaacaauuagagaauauaguuggaugugagcaucuaaugaugccccuguguuuugauugcuugaaaagcuuugacuuuaaaaacguguauuauuucucugagaaaaaaguuaacuaauuuuuguaaucuuguaaaucuucauauguuugguaguuuaagaacuuagagguguacugucuguguuuauacauugcauccuguauuaaagcuaaaucuugaguaauguuaauauucauucugguuaacaaauuuuuuuuuuuugagacggagucucgcucugucccccaggcuggagugcaguggcgcgaucucgacucacugcaagcuccaccucccagguucacgccguucuccucccucagucuuccgaguagcugagacuacaggcgcccaccaccacgccuggcuaauuuuuuguauuuuuaguagagaugggauuucaccguguuagccaggauggucucgaucuccugaccuugugauccacccgcuucagccucccaaagugcugagauuacaggcaugagccaccacgcccagccuaaaaaaucuuacaaaaccauguuagucaacuuagugaaaugacuuuuagcuuagugauuaaccacucuuguacaggauuauagaugugggugguuagagugagucugaacuugauccaggauaucccugccugcuacccagaguuuuuuggucauuugccuaaucaaaaaaguagaguacaaguaaugucauuugagaacucuggaugaugaugguuuugcucuguuuuaaguaauauucuguugagucuuaaacacuaggagaagcagaauuggcugggagcaguggcucacgccuguaaucucagcacuuugggaggucaaggcaggaggauugcuugagaccaggaguucaagaccagccugggcaacaugucaagacccugucucuacaaaauauuuuuuuaaaaaauuagcugggcaugguagcacaugccuguagucccaccuacuugggaggcugaggcaggaagauugcuuaagccuaggaguucaaggcugcagugagcuaugaucaggccacuaugcuacaaacugggcaacagagcaaaagccugucucuaaaaagaaaaaagaagggaaacagaguugucauacuuaugcaugaaauuuggauaguuuuacaguauguuugccuguuccauaaauugggggauuauauugugaccaaguuuuuucuaauucaaguuaaaugcuuuguuuuuaaaaagaaccgagcugaagcugccauggaauucuuacaagaauuaaauagcgaugucucuggaaguuuuguggaagagguauauauguacacacauuauuaugucugugcugaaauacaauuuuuuaaauaauucaaagccccagaaauuuagaauuuugaaucuuugugucauuuaugauuaguugaauuggaauuguugccucauuuguuguaaaauagcuuaacugucucugccauguuuaauaugauugugaaauugguuuuuuuuguuuguuuuuuucuuugcuguccuguuuagaguccagaaaaccuucuagacaaugaucccucauuuuucuguagguuuacuguuguaguugcaacucagcuuccugaaagguaaauuuuuauguuaauauguuuuuauuuuaaucuuauuagauuugcauuguuuuauuuucuuugcacagucuaugaugauaugguuuuaaaaauuguuaaauucuauagaaacuuuaaauaugaaacuuuuuuuuuuuuuuuuuuuuugagcuugagcucaaauuccugagcucaagcaaugcacccuccucggccucccaaaguguugggauuacaggugugagccaacgugccuggucaagaguuucagauuuauggcugggcacgguggcucaugccuguaaucccagcacuuugggaggccgaggcagguggaucacgaggucaggagauugagaccauccuggccaacauggugaaaucccaucucuacuaaaaauacaaaaauuagcugggcgugguggcucacgccuauagucccagcuacucgggaagcugagacaagagaaucgcuugaaucagggagguggagguugcagugagccaaagaucgugccacuacacuccagcccuugugacagaguuagacucugucucaaaaaaaaaaaauaaauaaauaaauaaauaaauaaaagaaauucuuagaaaucuuccagcauugaaaagaugaggaagagaaaaauacugaaacuuuuuuuuuuauuauuauucuuuagacagagucuugcucuguugcucaggcuggagugcaguggcacaaucuuagcucacugcaaccucugccuccuggguucagguaacucucgugccucagucucccaaauagcugggauuauaggcaugugccaccgugcccggcuaauuuuuguauuuguaguagagacgggguuucaccauguuggccaggcugaucucaaacuccuggccccaagucaucugccugccucagccacccaaaguccugggauuacaguuguggagccaccaagccuaaccuuagaugugaaacuuuuggaauauauuuagagcaguuaaaccgaacauuguuuuuuuguuguuguuguuuuuguucuuuguuuguuuuagugauuaaaaacuaguuagaauugauuauugaaggcugggugcagugacucaugccuguaauuccagcagaaccaggcugagacagguucagaucacuugagcacaggaguuuaagaccaccugggcaacauggcaaaaccuugugucuacaaaaacuacaaaauuuagccagauggugugccugcuuguggucccagcuacucaggaggcugggaugggagaaucacuugagccugggaggucgaggcugcagugagccaugaucaugccacugcacuccagccugggcaacagagaauugguuauuggaauuguuagggguguauuuguggguuuuauauuuuuucucuaucauggaaauguuuagaauuaucuuucuuuaacguuucuccuuaauaugacagacuaaaguuucacaucccucuuguccaaagauguacuuucuuugagacugcagccuguggaaaugcuugcuuuucaguguguucuugaccugcuuauguaaaugcaguuauguaccuuugcaucuauuauuuaguaagaaaguugcuguaagacauuuucauguuuugcauguuuucauguuuggcauauuuccauuugcuuauguucauauuuugcuuuuuuuuuuuaaacagcacuucacuacgcuuagcagauguccucuggaauucccagauuccucuuuugaucuguaggacauauggacuaguugguuauaugaggaucauuauaaaagaacauccagguaaaauuguugagcauaugggcuuacuauugguugcuuuagcuauaauuuuagaaacuugacaauuuagaaagucaguuuuaaauuacaaaguaaauuuguagcagcacaucucuaguugcagauucaaaguggcaaucagauucaauaggcugcaaucuacucuuuauguagcauuauagaaggauacaaagcaugauauaccacaggcacagcuucuucaucuuauuaggagauccagcaacuaugcaaguacccagcuucuuuugcccccuaacccacauugggcauguauggcuguggagagcuaaggaauguggaucacucugacccaugaaguuacaccaccuuuccccacuccagucuuuuuuuuguuuuuuaagacagaguuucgcucuuguugcccaggcuggaguacaauggcacaaucuuggcucacugcaaccuccaccucccggguucaacugauucuccugccucagccucccaaguaucugggauuacaggcacccgccaccaugcccagcuaauuuuuuuuuuuuuuuuuuugagacggagucucucucuuuugcucaggcuggacugcaguggcgcgaucuuggcucacugcuaccuccaccucccggguucacgccauucuccugccucagccucccgaguagcugggacuacaggcgcccgccaccgugcccggcuaauuuuuuguauuuuuaguagagaugggguuucaccauguuagccaggauggucucaaucuccugaccucgugaucugcccgccuuggccucccaaagugcugggauuacaggcgugagccaccgcacccggccgcccagcuaauuuuuugcauuuuuaguagagacaggauuucaccauguuggccaggcuggucucgaacuccugaccucaggugauccacccgccuuggccucccaaggugcugggauuacaggugugagccacugcaccagguccguccaaucuuuuauuucauucucaugcaggcuuuagguucucucaauucaggugcaauuucacacaacaaagacauuuacauaacuacuguucccaaggaaacuguuguaagagaccaaagucguuuauaggcagaccuccaucagcugaggguuuauauaagcccuuuacuuauaaaauuuuaaucuuagaugaucauaaaauuuucauccaguauucaaaacagugcucuuuauugacucaagaaaacauuuuuacuaugagccaagcacucugcuaauguggugauagccauuggcauugguagcaucacugaggaguaauaucugugugggcaguuagggagugcuugucaggauaagcucuggcugcugguggugagccauuuaagaguugaaaguggugucaacugaugggagggaacaaaagaguugaaagugggagagugaccauguaaacauuuuauuuuaaaugggucacuuugaaguugaguggaaaguaaauggauuuaaaggggcaaagauuggaggcagugauugcuguuagaaauuuccaguggccuaaguaagagagaguguguucuuuuuccuaauuuagggaagagaagaagagaggguagauaauaaugaagguucagcauuacuaguugugugccugccuuuauaagaauuauuucauuuacucuuuccaaaaccuuuauaagguacagauugaguauccuuaauccaaaaauccaaaaucagaaaugcuccaaaaugcaaaacuuuuugagaacugacauaauauucaaaggaaacacucauuggaacauuucuuacuucagauuuuuggguuagagagcucaucuaauauguauuugcaaauauaccaaaaacucaacaaaauccaaaacacuuauggucccaagcauuuuggauaagagagauauacaaucuguagauacuuuaauaucugcuuuuuauagaugaugcugaggcaaugagagauuaaauuauuugccuaaggucacauaguuagcaagugacagaacugggccuaccucuaagcacucacugaaauuauacacucuccuguccucucucauguggagagcaguguacagagugagauuaggaaguggggaguuacugauguuggggccaaggaagcaagaagugaaggaugcccaucagguuucuggagaagaagucuagguagauggugaugcugucuauugaagaccacaagaggaggaaggauagguuguuaguugcuaucuguaccuaggguuugucaauguugagcuuuuccaguuagaacaaauuguguucuaaaggaaucuugguuuuacuuuuacuaaaacuuuauaguugacuuaagauuucugcauuuuacuauauguaaaucguaccuuaauaaaacagugaaaaaaccugugggcccuguguccauuuaaaaauuaaagauuuccuaaguuucuauaauucaauguauugucaucaguauugccaaagaauuaaguuuaucuuuugagcugggcacgguggcucacaccuguaaugcaaggacuuugggaggccgaggcaggaggagcccuugaauccaggaguuugagacuagccugggugacauagugagacccuaucccuacaaaaaaauuagcugggcacagugacacgagacuguagucccaccuucucaggaggcugaggugggaggaucccuucagcccaggaguuucagcagugagcugugauugugccacuguacuucagccuggguaauacagcaagaccccaucucucucuuuuuuuuuuuuaaguguuaaauuuauccuuuugaauucuuuguuucacaguaauagaaucucauccagauaaugcauuagaggaucuacgacuagauaagccauuuccugaacugagagaacauuuucaguccuaugauuuggaucauauggaaaaaaagguugguagugugugugaccuuacauuuacagauagacuuaaaacauuuuuuuaaccuaagguuuuugaauuacacuaaagugagaaaauccuauaaacuuccauauuccugucaucccgauuacccaauaacaguauuuuaccuuguuuucaacauauuaauuuuucuccaaaauuaaaaaacuuuuuuacugaagaaaaguacauauacugaacaucuguguaaucacuacccaggucaagaaauuggacauuaaccuauuccagguggggagauggggaugguuaauggguaccaaaaaaaaauuagaaagaauaaauaagauuuacuccuugaaagcacaacaaggugacuauaguuaguaauaacaacucaguuauacauuuuaaaauaauuaaaagaguuuaauuggauuauuuguaacauaaaggauaaacgcuugaggggauaaaugcuauacagauaccccauucuccaugaugugcuuauuucacauugcaugccuguaucaaagcauguaccccauaaauauauacaccuaaguacccacaaaaauugaaaguaaaaaauuuuaaaacaaaaaacagaaauaaaaaaauuccaagaaguucucuuuauggacuuuuucuaaacaaauagaaauaaugacauaacacuauaaggcguauauguauuuuuucccacuuccauauuaauuaacaugcaguugcuuauuugguucaucagaaaacagaaaagauccuccuuucuuacuuaggauuggugucugaaauugagauuugagcuguguuuuuggguggcagucucugagacuguuuugcugguauaauggggacaaucauaguauauaugugacauacuagguaucugccucuagaaaaauuuguaaagcaguuuuuauuaacucaguucauuuucgucuauucacuacucugcauauauuaggagaucauaaauauuguugaauuuguugaaaacgagaugguacagugaagaauucauaauacugauauuuucuuuuauuugucucucauuuuuaggaccacagucauacuccauggauugugaucauagcuaaauauuuagcacagugguauagugaaguauguccuuuuuuaaaaaaaauuucauaugcaacuguauuuucaguuucuuacaaaggauuuccuugauggggaaugggagauuaauuuuuuuuccuuauggaguuguaugguagggcaaauggaugcuuuuaaauuuaaaucuagcaguuccucuuuugauccugauaauuuuaauuaaaaugaaauucaauaaaugucauuaugaaacuggcagggggaaugaauguagauaaauggucacagugucuguuuucuaucaagugagccucugauuucacagagaaauauauuuguugaugaaaucuuauguagagaaugggggacacuuuagacuuucaauuucuguauuuugaauuuuaauaacuagauuuuuaaaauuuuuaaccaauuuagacaaauggacgaauaccuaaaacguauaaagaaaaagaggacuucagagauuugauuagacaagguaauaugggauaugauuaaauacuguauaaagcuugaaaagcaaauugcuagaggcagguacuuauuggauuucuguuaacaccuuugucagaugauagcaucaugagcuuuuauuuuccuucuggagaaguuaagaagccacgccuuguauaguuuuaaggacuaaugauaagccguauuucuucuuaagauuuaauauucugcaggaucugacaagguuauuuuuauaaugggggaacagaagagugaaaagaaaagggcuguuugcuaacaauuucccauuacaauaggaauucuaaaaaaugaaaauggggcuccagaagaugaagagaauuuugaagaagcuauuaaaaaugugaacacagcacuaaauacaacucagguaaugaaagaguugcugagggauucacaugaacaagauguuuucuagaguccuuggcuauuaaaugguugacuauaaugauuuaaguuaauauuuucuaaauguauaguuagaaauaaauacagggccgggcaugcuggcucaucccagcacuuugggaggcugaggcggguggaucaccugaggucaggaguucgagaccagccuggccaacauagugaaaccgcgucucuacuaaaaauacaaaaauuagcugggcauggugaacauaccuguaaucccagcuauucgggaggcugaggcaggagaaucacuugaacccaggaggcagagguuauagugagccaagauuacaccacugcacuccagccugggcaacagaguaagacuccgccucagaugccuuugguuuuguuauggcuuaguuguugaggucugaccauugaaguuuuuggggagcuuuggaauaacaccugguaguuuaaguuagaauuuucuuguaacuuaaaacagcaaauaugcugccuuucaaguuaggaaggcacguaagauauuauuaccaacuuuuuagagacaacaaggcaguguugcugagugauuaaaagugugcuggcuggggccaggcgcgguggcucacaccuguaaucccaacacuuuugggaggccgaggagggcagaucacaugaagucaggaguccaagacgagccuggccaacauggugaaaccccaucucuauuaaaaauacaaaaaauuagcugggcaugguggugggcaccuguaaucccagcugcuugggaggcugaggcaggagaaccgcuugaaccugggagguggagauugcagugagcugagaucucaucaguguacuccagccugggcaacaagagcgagacucugucucaaaaaaaaaaaaaaaaguguuugcuggccaggugugguggcucacaccuguaaucccaacacuuugggaggccagggcagaaagauugcuugagcccaguucaagaccagccuggacaacguagggagaucuugucucuacaaaaaauuuaaaaauuagaugggugugguggcaugcaccuguagucucagcuacucuggagccuaagguagugggaggaucgcuugagccugggagguugaggcugcagugagccaugauugugccacugcacugcagccugggcaaugauaugagacccuguguccaaaaaauaaaugugcuuugugaaucacuuuucuggggugaugaacauuuucuguuuuaauugggguuaugguuaaaaauauguauauauaguuaucaaaaugcauugaauuggacauuugaaaucucuguauuucacugaauauaaaaccacaguugaaaagaaaagauucuaauaguuggggggcaguaagcuaaauaaacagauaaaaaugcaccaggugcugugaacaaaauuacagcagaacaaagggucagagagcaugcuggggacaagggaauccgggguugagagacaauuguacauagggagccagggagacuuuccaaaagacauuuaagcagaagccugagugaagugacacgcagaggucugguggaagagcuuuucaguuggagggagcacaugugcaaaggcccagaagugggaugaagcuugacuuuuguucaagcaucaguaagcaagucagugugauuggagugaaguguaaaagggggaaaagugguaggaaggauuugaguuuggagaggcagaaagggccagaucauaaaggccuugcaggcuauuuaagcauuucagucagggaaguggauugagcugcuuuguauucuaaaagaccauucuggcuuucaugaggagaacacaauugaggggacugggaguggaagcagagagagcaguuaggaggucccacugagacauuucuuuuuuccacccaucaguagaauccaagccuaugauuuguguguguguguguguguauuuuuuuuuuuuuuuuugagacagggucucacauuggugcccaggguagaaugcagugacacaaucacugcucacugcagccuugaccuccugggcucaagugauccccccaccucagccucccaaguagcugggaccacaggcacgugccaccacgcgcagcuaauuuacuuuuauguuuucuauagacggggucuuccuguuuuguucagguuggucucaaacuccugggcucaaaugacccucucaccuuggccuccugaaugcugggauuauagauaugagccauugugcucagcuuuauacucuugauuaacguaugaagaucuugcuagcaauaaaauuacuuuaugguuuuaguuuuuuucagagugguugucucaacggucacuaauuagggugcaaggguuucagauuuuugacaagauggaaaaucaugauauacugcgagucuauaaucuguuuugucuucagauguaacuauauaaaauaauuuacuggggccccuucuuuaccccauuuaugguauaagagaauagguauuaaaugguagcaacagugggccggagaggucuuucuuccauucuuuccccaucaaaucuucauaugguacugauucuaaauaaaauuauaaaccaaucagaaguuuguauuugauuacaauuugagaauucaaagaacauaucugaagaaauagcacugaaaauaaagaugggcgaauucuuaauacuguguaaguaaauguuucauguuccuuuguuagaucccaagcaguauugaagauauauuuaaugaugaucgcugcauaaauaucaccaaacagguaacaacaacaaaaguaaaaacauugcugcuaaaacuuugggucaaaguaaaacgccacuuaauguuaauuuuuucuuauucuuuuagacuccaucauuuuggauuuuagcucgugccuuaaaggaauuuguggccaaagagggucaaggaaauuuaccuguucgaggcacaauuccugauaugauugcagauucaggcaaauauauaaaacugcaaaacguguaugucacuguuuucaaacuauguaauagaaaaagucugauuauauuagagauaaacauuuuaucauccugucagaaaucaaaugaaaguuuauuacaaccucauugcuuauaaauaaacuaggccagcugcaguggcucaugccuguaaucccaacacuuugggaggccaaggugggagaauugcuugaguccaggaguuugagaccaucgugggcaacauagugagacuuccaucucuacaaauugaaaaauuaggugggcaugguaguguucgccuuuaaucucaacuacucaggaggcugaggcagaaggaucucuugagcucaggaguuugaggcugcagugagccaugaucaugccacuucacuucagccugggugacagagcaagacccuguuucaaauaaauaaguaaaaauaagcugaagaacuuagaccaggcugggcgcaguggcucacaccuguaaucccagcgcuuugggaggccgaggcaggcggaucacgaggucaggagauugagaccauccugacuaacacggugaaacccugucucuacuaaaaauacaaaaaaauuagccgggcgugguggcaggcgccuguagucccagcuacccgggaggcugaggcaggagaauagcgugaacccgggaggcggagcuugcagugagcggagaucgcaccacugcacuccagccugggcgacagagugagacucugucucaaaaaaaaaaaaaaagaacuuaggccgggcgugguggcucacgccuguaaucccaccacuucgggaggccgagacggguggaucacaaggucagaagaucaagaccauccuggccaacauggugaaacccugucucuacuaaaaaaauacaaaaaauuagccaggugugguggugcgcaccuguagucccagcuauucgggaggcugaggcaggggaaucgcuugaacccaggagacggagguugcagugagccaagaucgugccacugcacuccagccuggagacagagcaagaguccgucucaaaaaaaaaaaaaaaaaaaaaaagaacuuagggggcaauucuuguuaagcucaaagcaaaauugaaugggaaauacagaauuaccacauacgccuaggaggcagaguuuuuuuucauacuucaugauaaacuuaauauuugaucccuuaacucugugcuaugaacuauauguauuaaguaauuuaacacacacacaagguucacaacgaccuuaugagagagagagagacuguuaccggccccauuuuacacaugaagaaacuaagguauugaaaagguuacuuauacaaggucagauagcugguaaauggcagaaccaagauuugaaccccaggaaacccaguaccagagccuguaugcuuagcuauggcccuauacuaccuuguauuuguaacuuaaaaccaugaagguuugaugaauuuuuuaucuuaauguuucauaaguuauagucuaugacuauagcuagacaucuugcuauccagguaucacuagccugaacccagauagacuaucacagggaugggucucaaugaauaugacccucguauaguuagggcauggugcaaagaauccaggucugcuggcucgguuucuuugggguccaaguaaugucacacagagaugaucucucuuccccagacagauuucacucuuuaucaugucaccauugaacgaaucuugguuuguuguccuagccuaagaguucaacuacuuaaaacuuggggaaggucaauugaggauagaaagaaguaugaccuuacaugggagguagucagccugaacacugaugauuuuuagagggugaaagguaaauagacguaaagaaaacuuuuauggccggaugcaguggcucacaccuguauucccagcacuuugggaggccaaagcggguggugaaaugugccacaagggauguucacaguuguuuuaaaugguugaaauuuuacguuuuccauggucugucucagugguauagauacagauaauaauuggguaaggguuuuuuuuuccucucauaauaaauacagaguauuuuaaaacaaucagagguagagcauguuuaucuauggcaaugcuaaaaagguaugaaggucaguuaauugaaaauugucauuaauacaguauuuucaguuucuaaaucacuugaacccaggaguucaagaccagccugggcaacauggugaaacuccgucucuacaaaaaagacaaaaauuagucgggcaugguagcgugugccugaauucccagcuacuugggaagcugaggugggaggaucaguugagcgugggaaguugaggcugcagugagccaggacugcgccacuguacuccagccuggguggcagagcgagauccugucucaaaaaacaaagaaguuuuacauuggagaugaacaguuuuaauguauuuaacuuuccuuggacuugacuuccaggagauaagucauguucuucaguaauguauuuuuucagguccucugucacagaagccgaaaucauagaucccucuaggggagcaguuuuuaaguugggugcuguuagagggacccuggguuuuagugggcacugagaguccgucacuaacacuggaaagauucccagcuacucauggugcuguugauagcauuucccuggcauuuucacauuucauacauugucagaccuguguuuuuucaugaaaaggaaagaaaauuuuuguucaugguaacaauuuaaauuuugcuaauuuaaaaauuuguuaguaauugcuuuuuauucuuuuuuaguuaccgugaaaaagcaaagaaagaugcugccgcuguggguaaucauguugccaaauugcugcaguccauuggccagguaagcuacugggcacacugugcccauacaggccucagcacguaacuccagccagaaaggguuuagagacagaggguguggcacugccucugugcuucuuuagagggagcugucauuucccugccuaaugggauagcuugugauaaggaaacaagauauuuuuaaagugcucucccagcucuuggagaaagccuucccaucucacagugauuggcuuugugccgcacccuuuguuaaucuucucuuuuaaacuggaacagaaucuguauuuaucucuuuacaggcaccagaguccauuucagagaaagaauuaaaauuacucuguaaguccccuugaauuaauuuccuuauuuugcuugauagaaaugugccacagggaauguucccagguauuuugaaugguugaaauuuuaaguuuuccauggccucagugauauagauauagauaauuauuggguaagguuuuuuuuuuccucucauaauacaauacauggcgaguauuuuaagacugaaucagagguagaacauguuuaucuguggcaaugcuaaaaaggcuugacggucaguuaauugaaaauugccauuaauacaggauuuucaguuuuuaaauuuuaaguaauuuaggaaguuuuuuugucugaagacuuugggugugaagucuugagucacauguacauugacaauauugguuuaaauacucauuuugaucuguguuaaaugacuguaauggaguuaagaauuuugccaucuaguuucggagugguuagguucguaggagucuucucaguaacuccucaguaggccaaaagcauuuucuuuuauuuaagagucaguuucaaaauacccaaucuguugugcaugccaucugaagauuucucccuguagcuacugcuccuacguccuguggaaguuuauauuuugcaugcuccccauccuuaaaauagauuuauccaagcuuuccauuuuaugacuucuccacaaugucuguuuaggcucgguuuuaauguuuucugccacuacuaaucuugcaccuuguuuguucuauuagacuaaucuugaauuagcguuuguuguauuagauuauauaauacuagaucacaaguuugaugcuggguauuugaacauuuauuauucuguucuacuuuggggcguuuuugaaaauuucaauaauacaaagcuuaaagucauuacauauaucaagaguacaauucauaaaccucucuccuuuaggacuacuuauccauaauaaugaugaaaacuauuauuuuuagagccauaucaggcauugugcuagagaugcacuuuauacagaugucacauuuaaucuguagaacaauucucaaagguaaacaguaucauccccauuuuacacuugaaaacugagguucagagaggccaucaccuuacuugcuucugaacugguuguagugccagggauauaaauuuaaggugauucauguucuagugcuuucucugcuauuagaaccaaggagaaaacauuucuucacauucucaugucugagaaggguauacacauaauucucuguucuuaaagucaccugugauucauaauauucaccagucacagucauuacuuccagaauaucuuuccucuguucaggcagcaauucugcauuucuucgagugguaagaugucgauccuuagcugaagaauaugguuuggauacaauuaacaaggaugaaauuaguaaguauaauagccuucugauucuggguuaauuuuaauuaauuuaaaagauauaaauauuuuguguauaauaguguugaguauauggugaugauauuaaagauaacguaaacauauucuaauuuuauucuaagcuuaucuagguaauuauaauuuauauauuauaugaaacuuaauguaugcauaaagucauauuuaggucacugaguccauugugugauauguaugaguuaaagucaguauguuacuacuucaguagagauugugugacuccaguuaauaguccugaaacucaaguauauaguaaauucagcccuucauuguuuguuacauugcaaauuaaccaaauuaaacugaaauuuuuuuuccuuucaguuucuagcauggacaauccagauaaugaaauaguguuguacuuaauguuacgggcuguugauagauuucauaaacaacaggguagauauccagguaagaauagcaauugaauuaccagauauaauaagaucuucaauaaaacauuuaaauugaaaguguucucaggguauuuauaauaguguugcuugaauuucacauuguaaacagauuacaccccaaacguuccccagugaagaaccaccuuuuguuuuuuaaguuuaacuauuugcaaaauaguguucgauucuaaacuauuacagggggauguugguugaauauguauagaagaaaacuuuuuucugucauuuuccauaguuuguuacuaagacucacacugaguuuaauuuaguggaauaggaaagccacaagaaauaugcuggccaggcauaguacgguggcucacgucuguaaugccagcacuuugggagacugauucaggcagauugcuugagcccaggaguuggagaccagcgugggcaacaugguggaaccccaucucuacugaagauacaaaaaauuagccagacaugguggugugcacuuguagacucagcuacucgggaggaucaccugagccugggaaguuggggcuacagugaguugugauugugccacuaaacuccagccugggugacuguggugagacugucucaaaaaaaaaaaaaaguaugcuacuaauuucugaacucaauaacucugaagauguaggaauuucuuuguuuaguuaucuacuuuuuaucuucagcaaauguagucauuggagaauuggcauaaucucaaagaucugagguugcucagaauauuuuucuuugggaugauaauuuuaauugugcaggauuauugcauagcaacacauucuagggguaucauaaaaccugcugcuccaucugauacagugugucuccagaguuuauagucuuuuuuuuuuuucuuuugagacggagucucgcucugucgcccaggcuggagugcaguggcgugaucucagcucacugcaaccuccgccuccuggguuuaagcaguuuuccugccucagccucccgaguagcugggacuauaggcgcccgccaccucgcccagcuaauuuuuguauuuuuaguagaaacaggguuucuccguguuggccaggcuggucucgaacuccugaccucaagugauccuccuguguuggccucccaaagugcagggauuacacgcaugagccacugcgcugcccagaguuuauaguccuaacaagcaagcuuacuagaagaaaaaaaaagaauaaacaccaaauauguauugcuuuauuuguauuauuugauuaguauuuauuucaguuaucuguugcauaacaaaccacuucaaaacuuagugguuuaaaacaauaaauagugucgugauuuuguggguugccuggucucaggcaguucuccuuggggaggcaugcaguugcuugagccuggggguggagucauucugaaggcuugacugacugaguuagacaugcaagaagacauuuuuacucauguaacuagcaccuuagucagaacagugggaauagcuggcggcuggucagguaucucuucacguggcuagcuuggacuuccuuuuggcaugucaguuggcuucugcaguuaacauuccaaaaaacccaaguggaagguacagggcuuuuuaugaccuagcuuuggaagucauacagcaucacuuaugagcuaaguaacuuaaucucucugugcuuuaguuuucucuucuauaaauggagauaacuauacauacuucauaggacuguuuugaggauucaaucaauuaauauagauauaagguccuuagaacaguguccagcaucuauuaaugcucaauaaaugugaccuauuauuggccaggcaugguggcucacaccuguaaucccagcacuuugggaggccaaggcggguggaucacuugaggccaggaguucgagaccagccuagccaacacugaaacuaaaaauagaaaaaauuagcugugugugguggcgcacuccuguagucucaguuucuugggaggcugaggcaugagaaucauuugaacccggcaggcagagguugcggugagccgagacugcaccacugcacuccagccuagguaacagcaagacucucucucaaaagaaaaaaaaaaaguuaccuauuauuaauagcuuuauguccucagugucauuuaucauuuagucuuuuagaauuggagaauaacuuuuauaaaggguauaaguaggacauuacuuucucauucauuaaguucuucuaucaaauaauuauuaagcacuaugugccagaugcuuuucuagacagugaauaugaugcaauuaauaaagauuuaauuaaauucaaauuuuuacuagguuuuaguuggucucugauuauagguuugugauaugugcaaauauuggucucauacuuuguuauuuuuguucuucaguuucauacauauuuugacuagaacaucugaaacuagauuaaauaaaggaguuggccauuaauuuugaaucacauuuauuuuaaugaaaacuaacuuuuauuuuuaggaguaucuaacuaucaaguugaagaagauauaggaaaguugaagucuugucucacuggcuuccuucaggaauaugguuuaucuguaauggugaaagaugauuauguccacgaauugugaguauuuuuuaggguaucuaggagaugauuccacaccugucauaaggcuaaucaaaauucaugucucuguggucuccuuuaguugccgauauggagcugcugagccacauaccauugcugcauucuuggggggugaguuccauauaugagaagacucaccuguuguuacauaguacaguuacuauuuuaauacaaaguuuugucgucuagcuauuuuaauuagggaggucagugaagcaggauguuauauuucuuucuuuuuuuuuuuuuugagacgcagucucacuguuuugcccagguuggaguguauugaugccaucauagcucgcugcaaccucaaacuccugggcucaagugaucucucgccuccgccuccugaauagcugggacuacaggcaugugccaguaagccuggcuaauuuuucaauuuuuuguagagacagggucccacuauguugcucagguuaggauauuuauucaguugccccuauacuggucucccugccuuccaucucucccacugccauccaacuuaaacuccuuaagagucauuaauccuucuaaagcauagcucugauuguguccuuuuacuaacccucugccccaccaauauacauaacacucuacaacaguccuccaagcaaguccaaggacuuuggcuugacguuaaaaaacccuguguuuugguuccacucggccuuuccagccuugguuuuaucauauuacuugcuuuccccccaggaugcccuuugauuuccugcuccuagaucuuugcuccucugugccuauuugccuuaaaaauauguuuuucugcauguccaaaaccuauauguucuucaagacccaacucaaaaaugacaugucuuucauaaaagcucccuuuacuucccucccucacucuacuucccccuugucuuagucaguuugggcugcuguaacagaauaucauagacuuauaaacaauaaaaauuugucacagaguucuggaggcuagaagucugggaucagggugccagcauggucaggucuggugagcgcccauuuccugguucauaggcagcucucucuucuguguucucacauggugaaaaaaaaaauggcaagagaagucucuggggucucuucuuagggcacuaauccuauucaugaagguucuacgcucuugaccuaaucaccuaccaaaggcccuauccucauacaauuacacuggggguuaggauuucaacauaugaauuugagggggaaacgaaccauucaguccauaacaccccucaaaaaaaauuacuguccugugaucuccuguagacugagcuauuagcuuguggcauuuuccuucuagauguugaauguuuuaaaggcagauuuaggucuaauuaauauuugaaguguucaaaauguaaaugcaucauacagaccuaagaaaacuauuuucuaagcaaauccaaauuaaagccugauucagaauaauuuauuuuaaacuaaaaccaaguagucucuugugccaaaguagcaaaauuuucugccaauucacagaaaagggcaaauuauuauuuauucagaugcaguccagaaucuaagaagagguacagccagauggauggacuggaugacuuaacuauagcagaaaaaaguauaaauugaagguuuucuuuguuuuuuuuuuuuuguuuuuuacuucugugcauucuguaaucauuuugcacagugccauuauaucccuucacuuccuucagguuuuauucaaaugcugucuucucugcgaugccaucccugacucuccuauuuaaaauacaaaccccuucucuuguauuuauaucucccuuauuugcuuuuucuccuuagcaccuauggucaguugacauacuacacauucuauuuauuuguaaauaaauucucucucucuugcugcuaaaaaguagcaugaggguaaguggaucuucuugucuuuuuuccuuacuguaucccuacugccuagaacaguauuuggugcacaguagucucaaauucuauccagucggcugagcgcgguggcuaaugcuuguaaggccuccgcuuugggaggcugaggugggcggaucacuugaggucaggaguucaaaaccauccuggccaacauggugaaacuccaucucuacuaaaaauacaaaaaaauuauccaggugugguggcaggcaucuguaaucccagcuacuugggaggcugaggcaagagaaucacuugaacuugggaggaggagguugcagugagccgagaucacgccacugcacuccagccugggugacagagugagacucuagucuaaaaaaaaaaaaaaauucuauccaguccaugaauauuugggaaagaggaaucuucagguuauagaagaugcacaaguuuuuuucuuaguaguuuuuuuguuuugaguaaauauagcggucuggcgauauuuaauauagauccuuccuaaauuacaaaugcauucagaacaaauauaccuuucuccuuuuuuauuauaaaacagauacaagguaaaauucaaaugcagcaguaggguguccuuugagaaucuuuuaugccuguguguauccuuuaaaguuuggucaaccacacuacuguuuagauuuccuuuaauaacaaaaagaauuauaggcuuuuauguugauaugacucaguaagcuaacugcaucuguuuugggucacuuuaaaacaccuuugcuuuugaaaaggaaaaguuucuuuacagaauugaguauguaacucuugaaguuuacucuuucaaagauuugcuuuucuccuuuuuccuuucaggagcugcugcucaagaggucaucaaaauaaucaccaaacaauuuguaauuuuuaauaauacuuacauuuacaguggcaugucacaaacuucagcaacuuuccaguuguagaguaagcaagcaccuuaaguaguguguuaaugauugaaacuguaauugccuucggguugugcuuuagucuguaaaauucuaaaggagagcugcuaaauuguuuucuuaauaaacauuuuucucauuuguaauaaugua

SEQ ID NO: 15765 - RNA, 10588 nt, Homo sapiens
ggagcuggguccugacuagggaccgccugggugaggugaggaccugguggccgcaguuguggcacugugcgcaggcgcugaacugaccggacggagcgggcggcuguggccucgccagcuggugagaagcgggcgaggguccgagguagggaagguaacgagcgggggauguggacaccucuuuccccgccaggccucgccggcgccugacccucccggccugcggcaccggcucaggugacugggcggagggagagcugaggugagggggcggguccgcggcggagagggaccagcugggccuacgaccacggucaccccacucacgugcgcgcgccacgugggcccgcgggcucgccgaggacccuuggcugccuaccggggcaccccacuagcugcucuggccuaucgagcaccccuuggagcucugugucccgacugcacgccccuguuuuacaggcuggcaagccggggcucagaggcaccaagcgggucgcccgggggcacccagcugggguacggccgugccgggguucuagggagaucgguuuuggugggcuccggaguccaugcacuuagcgaugaggcugaagucagagauuugaacuugggaccugucuguuuucuuuaaggaugcaagaggguuugcguccuggcugcgguguaucacccugcaccgcugccugccuugacugcagggccggagcgucaggcgcccucugcucccggacagaccgcccccgcaccgacuucugcggggugggcuggcagggggugggggagugaagggacgguccucaguccugggaacucuugaggucccgacaaaugaucucgagaucccgagggcaggauucauacaugaaaagcucauuauaaugggucaagguuuuguucuguuuuuuuuuuuuuaauuuaauuuaauuuaauuuaauuuaauuuaauuuauuauauuccaaggaaaaguaccaccagggcuagugaagggacuaggaaacucgucacccccuugaggaggcagaugugaagcuuuuggaaaucaguuuggcaaugagucuacacccuuggaccuacugacuccuuguuugggaaauaacuaggauaaaaccuaaguagagaaaagguuacugcauaaagcaguacaguuuggugggguuuuguuguuguuguuguuuuuaaagagacagaucuggcucugucgcccaggcuggagugcaguggugugaucauagcucacugcagucuugaaaucuugggcucaagcgauccucccaccucagccucuugaguagcugggacuacaggcacuuaccaccaugcccagcuaaucuaaaaauuuuuguagagauggggcacuugcuguaucacccaggguggucuuaaacucccuagccucaagugauccucuugccuuggccucccaaaaugcugagauuauaggcaugagccacugugcccaguccaguuugguauuuuauauuaauaaauagcaaguaguagaaacaaccucuaaauuuccagccguaaagaauaguuaaguaaguugugauuauuuaugucaaaauguagccaucagaugugaaaaaauacucuuaucaggaaagccagauucaaaguugggguuacaacucuacaaaaauacguacagaaugacugugcgcaguagcucccaccuguaaucucagcacuuugggaggccaagggcggaagaucgcuugagccuaggaguuugagaccagccuggaaaacacggggagacccugucuauuagcugggccuggcggcacaugccuguagucccagcuauguaggaggcugaggcaggaggaucccuugaggccagaagggcaaggcugcagugagccacgaucuuaccauugcacucuagccuggggacagagccaggcuccaucucaaaaacaaaacaaaacaaaaaaaaaccaaacaaaaaauacccagaaugacuuagagggguauauaccuaaugaugaaaauaauagcuacuuuuuuuuuuuuagcagaagcgucauauuuuauuaaauucucacaaaaccuucuaagacuaauauucccauuccaccaauagauaacuggaguguuaccucaucagcagugugucugaugcuacacaagauaguaucacagcuagugugcuauugggccucugaaaaugucauauuuagccaguauuugaggacuuagugugugccggguacagggccaggcacuggaaagcuguuggugaguaaggcagccauaguugcuugagucauggaguuuauagacuaguggggaaauauacauguauauaaaauuuaguuuuugagacagggucuugcucuguugcccaggcuggagugcaguggcaggagcacagcucauugcagucuugaccuccagggcuuaagcaauccucucaccucagccuuacaagugaauggggcuauaggugugcgccaccaugcccaacuaauuuguaaaaaaauuuuuuguagaaaccaggucuccuuauguugcccaggcuggucuuggaacuccuaggcucaagugauccucccgccucagccuuuggagugguuacagguaugagccacuaugcccgaagcagauuauuuauuuauuuauuuauuuuugagacggaguuucgcucucgcccaggcuggagugcaguggugcaaucuuggcucacugcaaacucugccuccuggguucacgccauucuccugccucagccuccugaguagcugggacuacaggcgcccaucacugcacccagcuaaauuuuuguauuuuuaguagagacgggguuucacuguguuagccaggauggucucgaucuccugaacucgugaucagcccaccucggccucccaaagugcugggauuacaggcgugagccaccgcgucaggccuguuuuuguuuucuuugagacagggucucacucccucucuagugaggcccaggcuagacugcaguggcacaaucacugcuuucugcagccucaacuuaccaggcucagaugauucuccuaccucagccucccaaguagcugugacuauagauacacaccaccaugccuggcaauuuuuuuauuuuuuuuauuuuuuuggagagacaggguuucaccauguugcccaggcuagucucgaacuccugggcucaagcuauccacccaccuuggccucccaaagugcuaggauuacaggcaugagccaccaggccuggcccccgaagcagauauuuaaaugaacacuuauagucugcuggugagagugaguuuaguguauuuuaaauaguuuauucuaagucauuuuuguucaggauauuagcaaauguuuucagaagucaguauuuuuaagaaauuaaauuuguggcugggugcuuuggcucacgccuguaaucccagcacuuugggaggccgaggcagguggaucacaaggucaggagaucgagaccauccuggcuaacauggugaaacccugucucuacuaaacauacaaaaaauuggccaggugugguggcgggcgccuguagucccagcuacuccagagucugagguaggagaauggcaugaaccugggaggcggagcuugcagugagcagagaucacaccacugcacuccagccugggcggcagagcgagacuacgucucaaaaaaaaaaaaaaaaaaaagaaauuaaauuugaaacuucaacuuuuuaauuuuuagguuuaaaaauauccuuuuuugcugaaggaacacauuugcugguauaguuucagaaugucaaguacuguguccuacuggaucuuaaauucuacaaggaacagcauugccacauugcaaggggguagacgcuuauacuccagguaugucucaaauaggaauaaauuaaaauggaggcucuuuucccgggugccacccacccuaaacaguuccccaugugguggcuuuacucugugcaaagccuacagacacacaucaacagaggaagaugauuuucacuugcaacucagcccugagcagauaaaugaagugcuucgagcuggcgagacaacccacaagauucuugaccuugaaagcagagucccaaauucaguguugcgguuugagagcaaccagcuggcugccaauuccccaguggaggaccggcgagguguagccuccugccugcaaaccaauggacugauguuuggcaucuucgauggacaugguggucaugcaugugcccaagcagugagcgagaggcucuucuacuauguggcagugucccugaugucccaccagacccuggagcacauggagggagcuauggaaagcaugaaacccuugcugcccauccugcauuggcucaagcacccaggggacaguaucuacaaggaugucacaucugugcaucuugaccaccuccgugucuauuggcaggaacugcuugauuugcacauggaaaugggacuaagcauugaagaagcauuaauguacuccuuccagagacuggauucugacaucucgcuggaaauccaggccccccuggaagaugaggugacaaggaaccugucacuccagguugcuuucucuggggcaacagcuugcauggcccauguugauggaauucacuugcacguggcaaaugcuggugacugccgagccauccuugguguccaagaggacaauggcauguggucuugucugccccuuacacgugaccacaaugccuggaaccaggccgagcugucccggcuaaagagggagcacccugagucagaggacaggacgaucaucauggaggacaggcuacugggcguccucauccccugcagggccuuuggggauguucagcugaaguggaguaaagaguugcagcgcagcauucuggagaggggcuucaauaccgaggcccucaacauuuaccaguucacacccccacacuacuacacuccacccuaccugacugcugagccugaggucacauaccacaggcugaggccccaggauaaguuccuugugcuggccucagauggccugugggacaugcugagcaaugaggacgugguaaggcuggugguggggcaccuggcugaggcagauuggcacaagacagaccuggcccagagacccgccaacuuggggcucaugcagagccugcugcugcagaggaaagccagcgggcuccacgaggcugaccaaaaugcagccacgcggcugaucagacaugccaucgggaacaaugaguauggggagauggaggcagagcggcuggcggcgaugcugacauugccagaggacuuggcgaggauguacagggaugauaucacugucacugugguguauuuuaacucagaaucaaucggugcauauuacaagggggguuaagaaucucccauccuauugucaagguuaacauaaaugcucuucuaaaauguuucacuuacuccuaaacuagcuauccaaaccuuacuauuaaaagcgcaggcagauuuaauuugcuaaauagacuaacaggaggaaaaaaacaaacagccuagcuuuaaaaaacagugaaauagcagugauuucaugucccuguauguucugauuaagucuuauaugcagagaggacagagcauaaagucuauagaauuggcuugggcuuguguagccccagucauuugauaaagauguuguuaaacugugucagccugagccuucaaaggguaaauuuaaucaugauucugagaauaaagaacuucaggagcuucuuaggucuugccacaaaaaucugcaaauuugauaauucuccugaauucacaaucauggacuuguagacuaugaagagauauuuuauuuguuugucuuuuauuuaaauuacuaaggucuagguuuacaaagcauacuacaggacccuuuucuaugcaauauccuaacuuuuuuuuuugugauuaugcuugugagaaauuuuguaauacuacauucuaguucuguuuucguuuauuuuaaaacugaauccuuaaacuugcaaacacgccuacuguaagcaugcuuggaaugacuuguuuugguuuucagcugauaggaucuaugccucuggaccagcugaacuuacuggugcagcuuuuugugcccucuacugagucccauuccagaaacuuugagccaugcuaggagguaacuagucuaugccuuaacuccugaccuuuccugcauuaguaaaauuuccuccugggcugagccuuuggggguugauucacagcauuuaagcuuucugauuauaccucucaaacauucuucugucaauuccacacaauccuucuaccucugcuaugcugaaccccucauucacccugcaccugccaacugcaaaauauugucugaaagaaucuuucacauguuccugcuuccuauggcugcaggaaaggagaaaaugugauugcaugugguaguuguggugauagacguuuagacaggacagguuaauuuagcggauuguggacuuaagauucaaccucuaucuggagaggugaaaacacaaaggcuuaaggacaacaguuucuaaccaaguuucucugaauccuuuccugagagguggugggcaggagggaggagugagacuuaucagaugggacgcuugccccaagacugugggauaaaccaccauugcuaguccucaggaauuagaccauauuuaguauaggaguuggggcaaaaauaaaaguguaauuuguaaugguuucugugggcuguagacucuuuguauuuacuuggaaauucaguuauguggauccauuuuggagaugaauuucaucucaugaguugcuguggcauuuaaacaacaggaaaugugucccuaaauggaaacaaauauaaucccacaaaaccaacaauuuuauuugccucuacuacgucaggcagaauucuucaauuaaguugaacuacauuuguugaucccuuuucucaucuuaccccuuuaugccaccuacugaaaagaaaaacaaauagcuagguuugguuuccuguuuuuugucuaugucccagcugacauucagucaaauguugggauacuucuaauuuggugguguuucuuuguacauuuuucagugcaacuguuuagucauguguuuucaucuaagaaauuaucuuuugaauauuuaagccuugauccuuuuauucugaaaccauuaauauuccuucuuggcugggugcaguaguuuacgccuguaaucccagcacugugggaggccgaggcggauggaucaccugaggucgggaauucgagaccagccugaccaacauggagaaacuccaucucuacuaaaaauacaaaauuagccaggugugguggugcaugccuguaaucccagcuacucgggaggcugaggcaggaaaaucacuugaacccgggaggcggagguugcggugagccaagaucgcaccauugcacuccagccugggcaacaagagugaaacucugucucaaaaaaaaaaaaaaaaaauccaucuuaucucuuaguccguccuuccuuccuuccuuccuuccuuccuuccuuccuuccuuccuuccuuccuuccuuccuuccuuccucucucucucuuucuuucuuucuuuccuucuugacagggucucccuguagccaggcuggagugcaauggcaugaucuuggcucacugcaaccucugcagcccaggcucaaacgauccuccugccucagccucccgaguagcugggacuaugcaccaccaugccuggcuaauuuuuuuaauuuuuuguagagacaggguuuugccauguugcccaggcuggucucaaacuccuagacucaagcaaucugcccaccucggccucccaaggugcugggaugauaggcaugagccaccgcacccagccuaucuccuagaucuugaaucaaaaauaaaauguaaaucacuuccauucugcuagcaugaggguuuguugcuaaaauugaggauucuaucugacguuuacuuuuuguuguuuuuugagacaaggucuugcuuugucgcccaugcuggagugcaguggcaucauuauaacucacugucaaacuccuggacuccaauguucccuccccuuuuagccucccaaguagcugggucuacaggcaugaaccaucaggcccagauaauuaaaaaaacuuuuuuuggugaaaacaugaucuugcuauguugcucaggcugguugucuggcauuuucuuuguccuuuauucuuuauacuagcuaaacccuggaguauccuugaagccuuuacuggcauacagaguaccugaaucuuacuuuggagccuagcaugggucauaaauauaucugauucauuaaccugugagacagcugagagaacacagacuccuuaccuguaucuccaggcauaucugguuuuucucugccuaauagauuuuccugcuuucuaguuaguaauauugagaaagaagaaaggcuuauuuaucauuugcuuuuuuuccacugugaaucaucuguucuuuccaugaacauucuggggagcaccuccugauuaaacuccugucucccugaccacuauccugcugucauuggacuucuugaagcacaugggcuacugccccaggacacugggauuugagaggaguuuagugguaauugucaggucuuucaaagcauuuauuauuccuuuuauacggagauuucaguauugagacuuaaaaugaacugaaaaaugagauugaacauuuaauauuuuggauguaacuuuugaagaaaguaugcuuuggugcuuaaaauuguauaugauuuuagguaagaaacuuugauaauauuggcauaauuuagauuuauuuucuuucuuuuuuuugagacagucucacucagucgcccaggcugaagugcagugacacagucucagcucacugcaacgucugccucccagauugaagugacucucgugccucugccacagaguagcugggauuacaggcaugcaccaccacacaccgcuaauuuuuuguauuuuuaguagagacagaguuucaccauguuggccaggcugcgaacuccugagcucaagugauccucccaccucagcuucccaaagugcuagcauuacaggcaugagccaccacaccucaccagauuuuuaaaaaauauauaacugcaucucucuugauucuggggcuugguaaaaauggauagauaagauaguauucuaaauucaaauucguggcuaggcacaguggcccacaccuguaaucccagcacuuugggauuccaagacagaagacucacuugaguacaguaugagaccagccugggcaacauagaucuugccucuacaaaaaaaaaaaaaaauagccagguguggcacaugccuguagucucagcugcuuggaaggcugaaaugagaggaucucuugagcccaggaggucuaggccagagugagcugugaucgugccauugcacuccagacugagugacagagugagacugugucuaaaaaaaaaguuugaauuaaaaaaaaaaaaaaaaaagucggcugugcacgguggcucaugccugugaucccagcacuuucggaggccaaaguggguggauuaccugaggucaggaguuugagaccagccugaccaacaugguaaaacuccaucucuacuaaaaauacaaaaauuagccuggaauaguggcgcaugccuguaaucccagcuacuugugaggcugaggcaggagaaucccuugaacccagaaggcagagguugcagugagcugagauugugccauugcacuccagccugggcaacaugagcgaaacuccaucucaaaaaaacaaaaacaaaaaacaaacucaaauuagcaugauagaucaggcuacuuagauucagcuuucugagauguuauuuguuaacauuaaggcuaauuuauuauaaugaaaauguaaacuuugagguauguuaauauauaaacaucuuuuuccuuuggccuaaaaggucuuuaguauucagcacacuggguaaaguucaguuuagacacaaucaaauuggcaucuuuuaaacauaagugaaauauagagagcuugaacuugaguuacuuaaagaagauacaguauaauuaauuauacagaacaaaacaaagauguguuuagagugacucuggccugacucuuguccaucagccccuaguagccuaucuucagccuuugggaagucuuaacuucccagguuaaacuagaauauucuggaacugagcuguccaaauuucaucuuaaaguggaucauuugacucugaaacacgauucucauggcagaaaaagcccugguguuuccuuggagcuggggauaaaggccagugagccagccugugaugagagcugccccuggcacuaucugaguggaaagcucauugggacagccaugcagcuaucagagccgacugaagcccugucccuuaccccucaggcaccugaugcuuaacuugccuccugggaaauaaugaucuagcauuuacuuggaacaaugauuaaucauguucuuuaauaauugcugacauuuguauuuuaagcuguauaccaauguucguauuugacauugauuuucuaaccauuagagauauuuaauuaaaacuuggaaaugaaagaaacaaaaugaaau

SEQ ID NO: 15766 - RNA, 3890 nt, Homo sapiens
gaggcuuaaauaggcggcucuggagccagagcccagugcgggcugagaaggcgguggcugcagcagcagcggcggcggaaacccuaaaguccgaguccggacuacgagugcguggccuccuaauccggauccuaguccugagcgugucugugugcgagugggugaguguccuggcggagcggggucggggcggcugcagauggaugcgccagguccggaggggucccgggugagggcgccgcgaccugggggcugggggagggcugcggcgggaccucggccggagcaucccgccugacuccggguugggcaggugcgccccgggucccgccucccucgcggcuuacacggccacucggguuccugauccccuagacggucccggacgcgaugacccugaacggcggcggcagcggagcgggcgggagccgcggugggggccaggagcgcgagcgccgucggggcagcacacccuggggccccgccccgccgcugcaccgccgcagcaugccgguggacgagcgcgaccugcaggcggcgcugaccccgggugcccugacggcggccgcggccgggacggggacccagggucccaggcuggacuggcccgaggacuccgaggacucgcucagcucagggggcagcgacucagacgagagcguuuacaaggugcugcugcugggggcgcccggcgugggcaagagcgcccuggcgcgcaucuucggcgguguggaggacgggccugaagcagaggcagcaggugaggggacccagcuguucaggggaggggcgaucccggggcuaggacuaggggcugagaccgguacucaaagccgcaaauaccguggaauuauaguuguuguuguuguuauuauuauuauuauuauuauuuuauuauuauuuugagacagaguuucgcucuuuuucccaggcuggagugcaguggccucgaucuaggcucacugcaaccuccgccuucagguuucaagggauucuccugccucagccuccagaguagcuaggauuacaggcgccugcuaccacgcccggcuaauauuuguguuuuuaguagaguugggguuucaccauguuggccaggcuggucuggaauuucugaccucgugauccgcccaccuuggcuucccaaagugcugggauuacaggcgugagccaccgcaccuggccaauacuguggaauucuauuggcgcuuucagaaucaugccucuaccuacccacuucauaaauggggaaaggaaaggagaagggacaccccccagccuuugguagggaagaaaugcccagaguagaaggccagggcauagauauggcuacucugugggaugggacuggacaucccucccugccuaucagggacaggucagaguuucuaaccagagggauuucuaagagaggagcccuagguggccaagguccccagggggggcauguggguggaggucaggcacaccaugcccuccagcccccacuucccugccuggcacugcuguugccacauaccagcaucugcaaguggaguggaggguaaggagggcucuggggaagaguuggaggguguggccagaacaggaaaccuggcagcagcggcuuugacaaccagcugguaaccugucuacuggccuucugccuagggcacaccuaugaucgcuccauuguaguggacggagaagaggcaucacucauggucuacgacauuugggagcagguagggugcaagcagagacccagggcaggggagggaggagugaguuggguuagaggucugggagugccaggcucgugucgggggcaugaggacuguugggcagauguguguuguguguucuccaggacgggggccgcugguugcccggccacugcauggccaugggggaugccuaugucauuguguacucagugacggacaagggcagcuucgagaaggccucagaacugcggguccagcugcggcgugcacggcaaacagaugaugugcccaucauccucgugggcaacaagagcgaccuggugcgcucucgugaggucucgguggauggugaguaggcggcagguugcagggggagggagagcccagcugggcccugauccaggcagucuuggcucagcuugagucccuggggaucaucagaggcuaaaaauguucagaaagaaaacuggcggggagggaaaugggagagagcuggugccugcucacagggcuccggaaggccccagagggcuggggaaagaaccaaaucugauaggggagcugggcaccgcagggcccuccucuccugccccucuugguccuggccuggcugguuggggggguaaauggguggaagagaguguaggggaacaggccaggaggucagagccugugugcuaggucugggccauucuuagaguagacuuggcccuggggaagacccuucccacuuggccucagcauccuuuucuguggaccccaguacugagccccucagaggaacccagcagugacuuggugaccuugccuccgcaaccccaguccacuggaucauucaucaugauauaaccucgaauuaaaaaauacuaaguugugcggggcaugggccaggggguggcuaacgccuguaaucccagcacuuugggaggccgaggcggguggaucacgaggucaggagaucgagaccauccuggcuagcauggugaaaccccaucucuacuaaaaauacaaaaauuagccgggcgugguggcgggcgccuguagucccagcuacucgggaggcugaggcaggagaauggcgugaacccgggaggcggagcuuucagugagcagagauugugccacugcacuccagccugggagacagcgagacucuaucucagaaaaauaaaauaaaauaaaauaaaauacuaaguuguccaacauaguucucauuuuccuguguuuacuacugucguacuuuguuuaaauaucaggcuucaaauuauuucaauaaauggaucuccuuuugagggccacuguuuugggggcuccuuaaaugcaggcacucugccuacugggugacgcagcagugcccaguacccucaguacaggagcuggggucucuguguuuucggggaggaccuugcaaauucucgaguggcagcuuccauggguggccacuguuggaggggacuccucauucacccacccuuuguuuacuggugccugccuuuccccacccacacagagggccgggccugcgcgguggucuuugacugcaaguucauugagacaucagcggcauugcaccacaauguccaggcgcuguuugaaggugucgugcgccagauacgccugcgcagggacagcaaagaagccaacgcacgacggcaagcaggcacccggaggcgagagagccuuggcaaaaaggcgaagcgcuucuugggccgcaucguagcucguaacagccgcaagauggccuuucgcgccaaauccaaguccugccacgaccucucgguucucuaggucccacccgcucccacuauggugggagacgaacggaaggguuggugggcuggcccagccaacugccccgggugccucagagcaggcucagacucugggucccucggagcugccagccgggcacccccaaccucauggucauggacagauagacagugcugcccugcgaaguggcucucaggggccagugagggcugggcccacagagaugcaugcgcaggcucauaugcgucccaagcagccgcagcgcagccgccgggcaggccugcgugccgggagaggacucugccuuuuuucacagcccgggugugccugcccuggagggaggcucuucagugcgguagcuauuuguuuacaugcagauuuuuguaauaaaggcuauuuccugauagucau

SEQ ID NO: 15767 - RNA, 3045 nt, Homo sapiens
uaggccuagcucugaugaucuaggcacuguaucccgcacagaugaggaagcugagggcuccagagaggcagagugaacagcugagccccagggagccuucccgagcugaaggccucacacccuacgacguguguaccuucugccggacagucccugucugagguggccauggugucuguguugagcuggggaugaagggagucaugggggcggcaggugugauugagucauuuggcuggccuuccuggcagccaggccauggugggugagggacaccaaacugcucaugccacagcugacauaucagauaguucucuugucacucuugacucaucagugccuggccccuggcugccugcagggccaccaucugugcauccugggccagugcccagggaacuuucuggaaccccagaugcuaucugaggacacaaggguacaggggauggugaaguuugagguuccugaaacccuccaccagguaugucuggcucugcuguuucuggccugugacuccucaggcuuugguuaccaugucuacaaaaugggaacaacaaaucauagcugaguuugacccagggauuagaugacauguaugaacaugcccggccaugucuauuuuugcucaucauccugcccccagcacaagggccuggcacacaguagguauuuaguacaggaccgcggaaugaaugaaugcauugggccuuagaacacagcagaggcucuggggccugaaggcuguggugugaggaggggguggggacacugaagcccagcccaguucccucugcagcaucuugucaccugagggacggggaagagugugggguccuacagagaggagacauggguauggggcuaggggagagguaucugcauuguuccugagaccucugccccacuccuggacagaccaccauccuggagagaguggagcagaaacaggagagggaccacaaauucaccuaaccugccccauccaacgaaggaugaucaugauaaacgugcucuuagugagauauuacugugugcccgacuugagccaacuacugugccucugcauuucauguuuguuuugucuuauaauaaccaucaggaagaggugaucccuguucuacacuggagaaacugaggcucagccuagauaaauggacacaggugaaacagcuagcaaggagcacagcugggaucugaagcccgggcggaccuaggagugguucuagccucaguuuauuccuccugggcagccaugcucagcccagagagcugggagaaccagguggugggagugggggugucucaagguuguguccugguguuaaucccuggggccccuggccauaucuagcuuguggugagugucucuggccuguuggagcagccacuggaaugccuggggcuugaguggcccuuugugguugcaguucccuuggcaaugaagaaacacugcugaggucaagagcucagauugccagaggggaaacccagcccuccuucuuugcauggcccccugcugggaagggccacagcuaccccccacccucgcccucugccagacacccagaggaggcucuuuccaguggcacagucaugggguuggagggggcacaggcagcccagccaggauuccucaugggaagugugugguggcucuuuagacuugccugcuaacgggaggcucugcccauaacuuccucuucccacuggaguucguucaggaagccagaaccagcauggggaugcucaggccuccaagauccccuaggaccaugggcaggccaccccucagcccagcuuuugccuacuuugaagaccucaaggacaagagggcccuaaucuuaccgagccaggcccuccucaauccaaggccuucuuaggcguugccaaggaaacugaugcagcagccaaagagccuggcccaggucuccaugacaaccuaccacagcccaccaggguccauccaucugugaugucaccugagccccaaauggaugcccucccacccccaccacacuugucacaaucagaugucacagucugauagcaggucccugucacaaaauaccucacagccugaccugcaacccucagaccccugagagaugagcagggagcuaagacacuccucaugccuugaccacacccuguguuuaugccccuuuugggugggggccugaaccuccaggcccuggaugugcccuggguggcuggcucagccuacagcuagagggaagaagggagaccuugacgacucgaaguggcuggcuccugcuggcauucaacacccauuggccuggauuuccccaacucugggcaacuuccaguccaggagcagaauaaccagagccacggccagggccagggcuggggcagauuauuuauuuuuagcagaguugcuggcagcugccuggugggugcugggaggugggauggggacugaguuuaaucccuucccucuucugggcugggguauccuccccaggguucaagcaggcaucuccaccugcaacucugucagagcugcccccacccccaacagcccucucagggcccccaggggcucauggggugacaccaacccucacacugaagguuaggcucauuagggagaaucuucaacuccaggauggggaguggaaaggauuuugugugaauuuaggacacccccuaaauucuagcucagaccugagccuauggggagugggugucaugggcagagaagggggaucucuguccagccuguaacuagcuuacuugcuaaaaggacgagccgggacuuggggagaggaaagggagaauucagucucacggggccagaccgaauucuucuccagagggcaguugcugcuuuuggcugauuggguuuaccccgcugccugccuccccaucacguacuccccccgcaaccucgcucucucucuccuucucacacacacccucagcuccggaccucgccuaccggucagccccucuauucccagacagcuaccgcuacuccccuggcggguagggcggggugucggggauguaagguccgaggaa

SEQ ID NO: 15768 - RNA, 2642 nt, Homo sapiens
cuggccucuacguuucagcccgcuacuggcucgcacgacccagcgccgccguggucccuucucagcgccuucugcuccagcgaccaucauguucccggguccgagcagccagggccgcggucaccgcuucucucgcaccucaggccgagaacccacaacgcggcgugucccucgcgcgacuccgucgccacgccacgcccccuucccguucuccggaagugcgcggguuggagcggaagcgcacgccugcuaggaucagcgguggugguuccgcgaugguaggcggcggcggggucggcggcggccuccuggagaaugccaacccccucaucuaccagcgcucuggggagcggccugugacggcaggcgaggaggacgagcagguucccgacagcaucgacgcacgcgagaucuucgauauccgccgcugcugggcgcgggcggguuccgggggcuugcgguggggggagcagugauaucgagcagcugguggagccgcaucccagcagggcguuccuggcagaggguucuaagugggcaagggcgcagagucccuuuuccuucacuucccacaucugauucgcuccaucaaugacccggagcauccacugacgcuagaggaguugaacguaguagagcaggugcggguucaggugagucacuuccgaggggagcgaguuguuccagagagucagaaagguuucugugcagcaggagcuggcgugcucuaugcucacgaacaccgaaggguaucuuuggggagggagauuguugugccuauuuuauggguguugaaacugaggcccauagaaguuggaugauuugcccaaaacaacaaacuaagaagagggaccuugggcugagggugguugacucuugacaucucuccuccacaaccagguuagcgaccccgagaguacaguggcuguggcuuucacaccaaccauuccgcacugcagcauggccacccuuauuggucuguccaucaaggucaagcuucugcgcucccuuccucagcguuucaaggucaguuggagcugagccccgggagugagaccaggcauugagggucuacugcugaggauggggacugggagagcaugaacauggauaggacaucagaguggggccuggaaggauccccauuagcagagaggaaacugggaggaagcuuuccaagucgaugugacaagaauaaagaucugagcuggaaaguggagaaaaguauugaagaguguggcaggaagggcaguagggagcggcagauggguuuggaccagggguggggcacaggcaggccuuuaaaucaacaguagugggccaguucuuuggauagaauuggaauagcuagggccgggcgcgguggcucacgccuguaaucccagcacuuugggaggcugaggcggguggaucaucugagguuaggaguuggagaccagccuggccaacauggugaaaucucaucucuacuaaaaauacaaaaauuaguggggcgugguggugugugccuguggucccagcuacacggguggcugaggaaggagaaucaaauugaaccugggagacagagguugcagugagccgagauugcgcugcugcacuccagccugggcaacagagcaagacucagucuuggaaaaaaaaaaagaauuggaauaccuguggauggguuugggguguaacggaagggccagaguccaaaggcaugauuaggaggaaggaucagcuggagauggugccugagggucugggggcugcagggaaaagugugggucgguggguggguguucaggcccugguuaucucccucccagauggacgugcacauuacuccggggacccaugccucagagcaugcagguaaguguggacugguggugaggguguuggcccgggcacccccuaagcagucugaggcuucccccuugcacaggagucuaugggcaagacuggagauggguaacugugugagugaaauugccagagacuccucaguauggguuauagccuagaccgaagcuggccugagaagacucuccuuugcuuaccauguccucuucucccaaauccccucucaccaaauauacaggaccagagugugucaggcuucagcagcgcaggaggcagccagggggagggauccuaagaaggcagauuaggugggcucaggugguugaaguagccugaucaauaugugggguccugggaaggaggugacaggagggcucuguugcugcgggggacauauccuauauagagguucagagguagggcuggcuagcacucuggccagagccuagcuuugacucugccuuccccacacccuucuucccaccuagugaacaagcaacuugcagauaaggagcggguggcagcugcccuggagaacacccaccucuuggagguugugaaucagugccugucagcccgcuccugagccuggccuuugaccccucagccugcauacugguauccuggucccagcuccugccagggcuguuaccguuguuuucuugaaucacucacaaugagaaacuaacauuuugcuuuuuguaauaaaguuaauuuauauucaguucccagcaugccuuggugucuuucaucuugguggagucauuuggaguuugagggggggauggugg

SEQ ID NO: 15769 - RNA, 2896 nt, Homo sapiens
auaauuuuaucccauuuuuaauauuuuggucuagcaacuugugauacauagaugacaauuuugugaguuuuucaaauguguguacagauuuuuguaaauaugacucuuuuguaauuaacucauguacagccucauccuguauaguuuaaugaugaaugugcaggggaccugucucaggcuccuauaugguuccugggccuuauagccagguuuguguggcgcucccgacuuuugugacugacuggugucuucccauuuggacuguggccuggccagagccccuugcauauccccacugucaggggcagccaggacuguucccauccuccuggaaugggggaaccuuccuuauccccugcccacauccccucuccaauaaagcaccugugcccucagcaauggccugccaugugcuguugcugggauguuuguauuaagguaaguguggguauugguuuuuugagcaagggggugguugaagcauauggggaaauuaauagugguggcaucucaggggaagacauuccuuggcuccucugaggggauacagccuccagugggagacuggcauuguugugugaguucaggaggugaggaaagacuagguaggaccgugcacucauuugucccuuauguguggcuccaucccuggugcucagccacaccugggcccaggagagguugugggaagcauaauaucuguuuucagaugagcuauggcaaagugccugccagguucaugaauucaggcuguggcggccggagccccuccaccucccuguggggccuggccuugagagccucugcauacguccgcgucagccuaggggguuccaaauccagcagagugguaggauucccuaagucccugccaccacaccagaacacaccucugugcuacuaggaggaccagacauauccacugcucugggaccuguuggacaagagauggucaucuaccacccagccuuggcucgcucaaagggucaccauuacacggguuucaacugguuccagcaggguggaccgccaggagccaagcuuaacccccauccccugggauccuguggagacaggcaccuggugaucagggaagaaccacauacacggcaauaaucugggaaaccggcuccauucugggucugaguuaggagcuuggggcuguaguggggagcuaggagucccauuggaaggggccugcagcgacaggcuguggaugcgcacaggcuggcccaugcggcccgugcagcaggcgccacauaagccagaugucagcggccgagagcccgugcacuacaaccagcucacgguaaaagcaggggucgaaggugcucaaaugcggcgcggcugaaggcugggggaugccaaaggugcggaaggcagggugaggcucgggcgugagccgcaggcgcugcagacacaugcccagaaagacgucgucgauggggaagagcucgaccugcgcacaggcgccagccaggcggugcagcguggccccggaaagcacaaagccaccgccgcccgcguaggccggauaggcgggcaggccguacacggccucggggauguaguacuugcuagcccgcgugcggaugggccgcgcaugcacaauuacgucaccagcaagcaggucuugcgccgggucccgcggcgccaggaacuccaggagauuucccacguucacgaacacaucugcgucgcccuuaaaaacgaagcgcacgucggggcagaaagcugaggcccaggcuagaaaguggaucuccuugagcguuagguuaaaaaaggugucgucgaaggcccagagcaggauguccgcauacgcaaggcucucggcccgcagcagggcgcgccaguggguucgcgcgcccuccccaacuucgucggccccgcccgagccugcgccccugggcacgcccagcaagaacacgcggcgcaccagcgcccccugcacgcgacccuccgcgccccacgucuggcgcacggcuuggcgccgcucgaaguccucugccaccgacuugacagcaauaagcagguccgggcggccaccgggugcgccgucgccgcggcacuugugcggcugguuaaugagcaguggaaaccgccgcugguccuuggcgcgcaaauagcgggcgaagucaaagggucccguaggcgugggcggcgccgguguguccccuucguaggccggcggggcugcacccgcgucggguaacuggaacgcgcgggguccgggggugggccucggugccgcccucccucgcccucgcggcgcgcucgccgucggggccgcgccgucgcgcugcgcauagaguaagaggcccagggaggcgccaaggagcagcgugagcaaugcgucccugcguaggcgcagccuccuccucaucuccgcgcggccugcgcccucccuccccuguaagggucgcagucggcagcagggggcagcgagccccgcccuccccagcugagggggcgggaggccacgccccggggggggcuccagcgaccgacgguugagccccuugcguuguucuccuccucccggccgugucgcaccgccgggaccggcagccugaagggacaagaaguucacccauguagccaacucccccgcggccucagcuccggcccaggacugcgacccagggccgggcagggagacugggagccucggccccucccccgcccgccucccucgcgcugaggccgaaucccuuccacccugccauccccucaaugucgggcccuggggucccgacacucacgcucggcccucggaaguggcgcagccccggacgcccuggccuccggggcucagcgcaggguccgaggggccgccauggaccgggcccgagccaaaugcagcguuggcaggaagggggaccggugccgugccacg

SEQ ID NO: 15770 - RNA, 4238 nt, Homo sapiens
acgcagaaacacugcaggauuuguuuauuucacacucacccuugaggcccggcccgcgcccgugcccucccucucccugcgccggggccgcggagcugcagaguccgcagagggguggaggcaagagaggggggcaguguguccaggaccgagcggguggggcgucugcagagggugagagcagcgaguggucucagggcgcccaggacuggucccgaugccaucacaguucccaacucgguaaagacccggggggcaacaaucccaaaagaaggcacuagcacucggggcgcgccuggacaccccccccguucccucucagagcgcuuacguccacggggacgggggagagaagucgcccaaucacgccacgagcguaggccuccagggaugcggcucgcgcgugagcuugaggguauaggugcgcaggcgcgggcagugcgcgcggaaggcguccagcaccgaguggcucaccacgcagaaacaaugcaccucgcgcagggccgcgcagcgcgccgccagcuccuccagcgcggcguucagcucggccgaagcggcugcgcgcaccucgagcgcgcacaggguugcggcguaguggugugcugcgaagcgcacugggccuacggugucgccugagagguugaggcgcagcgcagccacggggacggcuggcugcaggacgcgcgucacgcucucagcgggcagcgcgggcuccagcuccagcuccacugccagcccaggguggcggcggcgcaacgcgacccaggcuucguugggcagcggggacgcgcgugcaucuucggggcacgcgcaccgcagagccaagagcgcgaaaggcgcucggucuggcgccgccagugcuucgaggauggcgugcgacaaacuggcuaggugcaggccgagagcgcgcaggcgcgggcaggccuccaguagcucgagcacugagccgggacccacgcugcccacuaggguacuguuguccagaaaaaggcuguggagcucgggacagcugcgcgccgccugcagcaccagcgcgucguccagugugaaggacaagcgccgcaggucgagguggcguagcuggcuggccgccccgcauacagcgugcacagccuccaggacgucgcggcccgcgucgaagagcgguuuuucuccgcggcacuccaggcgcaggccucgcagccccggggcacggcccgccagaaccaucagcagcucgauggccgcccggcggcucggcuuccucgauggcucaaauuccagccguagguugugaauguggucgaggcaggcggacagauaagguggcagcaugccuuccagcucacauucgcaacuuggguuagagccgugcagaaaaggccucagcugagucccugcgaccagcggagaagccucuacccaccccuuagcugggguuccagcugccaucccauuuccugccucccuccccacgucucuguucagaccacgacuguugccccaaaggagggaacucgcauccuauccuuuuagaagauuucaguggcgucugccacaggaugaaaccuggacauggagagccaaugauauuuuaggaacugggcuuucucagcugucucuaaggagucuuggcauggccuccggacugcuagguucgaauucugccucugccauucccuagcugagugacccgugggaagugauuaagucucuuugccucaguuuccuaucugggcaauggagguaaugauaauaccuaucuaccacacaagguuuucauaaggauuaaauuaguuaauauauguaaggcacuuaaaaacaaugguugguauauacuaggcagucaauacgucagcaauuauuauuauuauuuugagauaaacuguuacucugucgccaagcuggagugcaguggugccaucucggcucacugcaaccuuugccucccggguucaagcgauucuugugccucagccucccgaguagcuagaauuauaggcgcccaccaccaugcccggcuaguuuuuguauuuuaguagagacgggguuucagcaugguggccaggcuggucucaaacuccugaccucaggugauccacccgccucggccugccaaagugcugggauuacaggcaugagccaccacgcccggccagcaauuauuuuuuaauaugggggagucaaccugaauaucuaccuagcccacgacuccacggagaaggugagugggcgguggggagaggaguguggaggagcaggcucaccugauuuuugugucgugccacacggcgcugcagguagcagcggcggcccaggcccugcagacccuggcggcggcagcacggucucucagggacagguggcggaagaugagugccagcaccuccucuggcagucccucuccaggcucggccauggcccagauccggcuggggugggaggauccgccacucccaauagcuccggccuggagagagacggacgucucugaggucgggaaggcgcaaaguguugcaggaagaccgagcuuagguguacaaaugcuuguggccugaggaacugagggccucucagacagcguggggcaucagauaaccccgaaacuuguucacaaagcagauuucaccgccucaccuacuaaaucaggcucuccggaaaggguaaggcccaggaaucugcauuucaacaagccccugugacuccacagguuccacguugagaacuccccucccacuuuuuuuuuuuuuuuucuuuuuuuuugagacagggucucgcucuuuacccaggcuggagugcaguggcgcaaucacaacucacugcacccucagucucccgggcucaagcaauccucccaccucagccucccgaguagcugggacuacaggggcacgccaccacgccuggcuaauuuuuguaauuuuguugcagagacgaggucucgcuuuguugcccagacugaccucgaacuccuaggcucaagcgaucggcccgccugggccucccaaagugcugggauuacgggcaugagccaccgcgcccggccugagaaaccccaucuuaaccccgccgguuaguagaaagugacuacaggguuaauaaggcgggagcguuaauguaggcuuuucuuugucagggaccaugagccaaucaggaagcgaggcgugggcggggcaaagcuggauccaccccuggaggggaggcuccuuccccgccuccgccucgccggggagaugucccgggugcuuccuaagacagccccacuggaugaaaaaaaacuugggucucugggaccugacgguucuggggccugaggggcucaagauuuaaguuccgaccccugagcagcccuggcucccgcugagcaauuuggguucggcuggaacuccgcagacccacccuggagcgcagccuuuagagggggauggguuacuggaaagugugcguccucuuugaaguugccaauccuguuuguuuuuguuuuguuuuguuuugagacggaaucuagcugugucgcccaggcuggagugcaguggcgagaucucggcucacugcaaacuccgccucgcggguucaagcgauucuucugccucagccucccgaguagcugggacuccaggcgcgcgccaccucgccgggcuaauuuuuguauuuuuaguagagacgggguuucaccauauuggccaggcuggucucaaacuccugaccucaggugauccaccugccucggccuuccaaagugcugggauuacaggcgugagccaccgcgcccggccgccaaucuuguuuuaagguucuuaaagguuuguguacacaaggcuucacacuacucgccaguuaauguucccauaucuuccgggcuaacaguuucucccggaauuugugccacguguuuccuggggcuucagauacguucggccgggcuuguaccugggacccaugggcaccccguuuugagugcccacugguagcagcgaucuugaagccggauccccagggguaccagaaaauucuggucuccagggggcgcccccuugauuuaccgaagucuggcagcuguagcucuuacgagccccccgccucguaagaaucgcaaacccccaaagucgggucuuccugccgucuaaccuugggcgcuggugucuuaccugcucggcggaccagaugggcuuugcccggggcaggggacuggcagcagaggacagcggacgggaagcagccaccgggagcccgcggggcgggacgcgcgggcggacggg

SEQ ID NO: 15771 - RNA, 6925 nt, Homo sapiens
caaagaugaaggauugagucuagagguauaaaacguuguagcuaauuguggaucaggaggggagaggaagaagucccggagcaaaggcugugagcuguaagcagugggcugggaccagcuaccugaaagccaggggccacugccuaugccugaugcccggcuuccuccugcagguguccuaugaggauguggaccaccugcggccccauggggugcuggauaauacccgggugccccacuucaugcaggacuuggcacgcuaccggcagcagcuggagcacaucauggccaccaaccggcuggaugaggcggagcugggucgccugcuacccgacugauguccguugagggcugcagucagaggcccuggacagaagcuccagauaggccccuagaacaugaagcaguuugcucugugcguccacggccuagguguuucuuggggguguugggagggcaggagcauuccuugaggaggaguggcaacaucaaaguguuugugucccuugccagccucccuggggucuggggaccugcagcagcaugucuggcaaacugagucgcccuccugccuccagcucucuguugagcagagggaaggcaugggggcaggaagagagcugagcauugauggggaugggggugguuugggaauagaaacuuguucuugcaugagauggcuuugguugucccaguacuccagucucucccuucccuuaccuggccccuuggugcuccuucagcauuugugcugucuaccucucacuggguccuggugggggucgggcucccuucuccuggggugauugauggccugagccugggguccugguaguagagacccagcuggccuggggucugcuuuccgacauuuugccucucucacuggucauguauuuauuccauauuuauauggucuacuuccuguggcugggagcagcagcuccugaagguuccgugggggugcgggggguuggacaggacacuccuucuuggaaggcaccaauuuucccagccccacucccauuacacacacacacacacacacacacacacacacacacacacacacacacacacacacacacacacacugauucaggccuugagagucaagcccaagagcucccuuggcccuguuccccacucccuccacuggccucugcuguuccugucuuugcucacacccucacagcugcucucuggcagagguuggcauagccuaggagcagcugcaauugcaccugagggacaggcccuagaguuugguggcccaaguccugaaccccucuuagaccaggugaggugcagaggugguugcugcuuccaguuucccuucagacuuagcugugugaaccccacuccuauccuuuggccuuaguuuucccaucuguaaaacucagaaacgcaguuggaaaguccuuauucauuuaguaagcgaauauauuauaauauguauagagcgccuuuuguguaagucacuggucagaauccucacugagcucccaguccagagagaagccagacaauuaaaacaguaaugacaaugauguguguggccuuugucuacucaaggucccuuucugcuccccucuucuagucucacuucccaaggcugugagcucuaagcccucccuauguggagagaagucacccuccccuugcuccauguucagcucaggaacuugcgugggguugagcugguaccuacauaugcugccaaguggcucaccaggggaaauggguuguguaugcgggcaggagggucagguccuugucccacuagggggcuagguuugggaucuccagggugcagccuggacuccuaagggcagauuagggcugaggacuggaugaugcucguggugggcuugggccugcccaggucccugggacucagagguacccacccuaaguuccugggcaaacagccagaaucguggagagagcccaggucccguccgacccuccggaguuuauucacuuccagcgguacugggcuggaccgagccuugguggcauccgauucagcuccagcagcaucccagguccuauccagcaugggcggggcaccgccugucagagcucuggccuucaggaaucuagagaugacgggaacaguggucaaagaggugggguccggcauccgcuucccaggccaugcccucccgccaagccggcucaggguuugggcggacucacaccuucggacucgucccuuuccucgaagucgggcucgggcucuggguccgguucuggcuccaguuccggcucugguucugcuucagccucggguuccagcucuggcucuggcuccggcuccgguucagccucuuuagaggccucagcuuccagcucuggcucuggcuccuccggggucccggauugcaccgccucggagcccucagggcccccggccucgucagggucugaagcucugggcaacccggggcaugugguccccgagccgggugccuccggcguccaguggccugggcauggagggucauagcugcggucccgguagccuggggcggaagugggagugacugaggcucaauuuaccccugugcgguuucacacucgccuacuucuagcggagacgacaacccugcccuccccgggccuuuugucugccccagccccgucccugcucugcccuaggccccgccccgcgcgcucacccggacccacgugcugccagucccaagcgggguccggcgcgcccgcgguacgcugggcacagcguagcagcuccuggcaggcggccucgcccuugcccugcaccagcagcaguaggcggcgcacccugcgcucggcaucaggcagugcauccaaugccucguacucuggcccggugagcacgccccgcgccagcagcgcguccaacagcagucccgaguccgccugcagcgucucgaccaggcguuuccgcucgcggucgauagucucugacggccgcuccugcgcguugcccauugucggggcugcauggggaaaggggagagaaguaaugggggguugcccuccccgcugcccucgccgccucugaccacucccucaaugcccccagugaacacccaggcugggguuuaaguucaccucgaucccagccgccggacggcuccgcaagcacaggaccuggaggccaacacggggaacucgguguccuccugccucuccagacgcucuguccugucuccuccucaggcuccuccuucuguccccaagcgucagccguggcucuccucuccuccccugccuuucccaggacuggcaucuacucucugaaugcccuccccaaccaggacguccugagcuccacccccggcaaauccgaggcgaguucagaccccguuuauccaaacuaaggucuuucucucaaaucugcuuccccaccuaaccaggcagaaaaaccuaggauugaugcugauacuccacacccagcuugcagacaaguccuuuccagucugacugcugaauauuucucucaccauccucaccacuuacuaaguccagccuucugccuccugcuuuggcccugcagaacccaggaucagagcucccugcuuccauacucuauccuccaguccccucugaacccagagcacaaagugcugagagccucccugccccucuccccuuaccuugacccugauauccaacuuuccaggacaagccccgccucuacacccucccaccaacaccaccaccauagugcaaccccaauguagucuccuggcccuuccugguccccugauuccugagcagagauaccagaaucuucuucaggccuagcucugaccaagaucucuugacaucaccugagacccaccugucucccuacugaagcccuaacuccuaaugugacugucucucugcugacccaccuggcucccugcugaccugggaauuaccuacagacauuuguuguuugaucuugaaguacccaaggccuagcucauacaggauaccgacaaauacuugccgaacuuggacugauuuuccuccauggaucgcacuauuuugagagacuuuuuuuuuuuuuuuuuugagauggagucucgcuguugcccaagcuggagugcaguggcgcaaucuuggcucacugcaaccuccgccucccaggcucaagugauucucgugcccagccuuuuuuuuuuuuuuuuuuuuuagagguggggucuugcuauauauauuuuuuguauuuauuuauuuuaguggagacgggguuucacuauguuggccaggcuggucuugaacuccugaccucgugauccaccugccuuggccucccaaagugcugggauuacaggcgugagccaccgcgccuguccuggucuugcuauauugaucaggcuggucucgaacugcuggccucaagcaauccucccaucucagccuuccaaagugcugggauuaccagcacuuugugaaccaccaugugaaccaccaugccuggcucuugagagacuaucucuaccaacagcggcuauuagggagagucaaucugcuuuauccauuuuuuuuuuuuuuuuuugacagagucucacucuguugcccaggcuggagugcaguggcacauucucucaucacugcaaccucugccuccugaguucaagcgauucuucugccucagccucccgaguagcugagauuacaggugcccgcaccacgcucagcuaauuuuuuguguuuuuaguugagacgggguuucacuauguuggcuaggcuggucucgaacuccugaccucgugauccacccaccuuggccucccaaaguguugggauuacaggcaugagccaccgcacccagcugcuuuguccauuuauugucaaccaaggauuauggcccauuccugugaguggccugacccagccagcaagacccccggcauuaggaggcaaagacaucaggccuugaaccaugcccucagcccacccccacccugauaauaacuucuucuccuccccgccuuggcuuuguucacacggcauccucccaucucuucuucccuuugcugucccuccucugccuccuucucuggcucuaggaggcucggccuucucugggagagaggauuuaguccuagccgccauccugccucccaggucuuucucaguacccucuggugucacacuauaccucccccgucacuucacacccuggcuuccucccauugaagcccuuccccaccaggccgagaccaggacuacccccugccccuccaucucccuuuaugucccguaugugaugaaucuugcuucuccacuucucagugagucuccaucagcuccugccuugccaccccaccaucgucaccucauguccuguaacagucccucugagccccucucacucccauucugccaggcccgauagcacagugacuuugacaacccucugggcuaggauugcuguucccauuuuacagaugaggagacaggcucagagauucagugguaaaacuggaaucuuacuugcuccagccugaacuaugaggaacugaacuauauuuuccugucuagcagaauuccauccuaaauaccuaucuaccucccccccacaccccacugcccaucagagacaacccaaaauaucuggucuggcuacucuagccuccucccaccacccuggacagccaggcccuucccagcuucccuccaccagccagggaucggagaacucacuaugccucuggcaccucggagccuuugcugaugcugaucgcuaagacuggaauccuuuucuccucccuccgcuccguggaccuauccaucguccaggacucaaauguucccuugucuacaccaaugccuaagugucccaagggcuggugguuccuucuucuguguaccgugaacaacacaugcccucacuagugcauuaacugacaucauugcacuguguacacgcagacucuccgcuuucuucaacugaguuuuccagagugucccuccaaucggugggcaaaggaagggagagggggacagcaccuacucgggacagacacagggagggugcagauuggauuggccccuccuucucuccaaccuaaguuguuuucauguuagccgccuccuccuaugaccccaaguccugcccuuuauccugucuggggguagagacuccagcuggucugggcccucccuuugaggcucacacagcucucaauaccgaaguuauuuagcggccaguccuucgagggugacagguccgauucuucccagagagccagguggcggggcacggagcugggucccagcccccaaccccaccucgcugcgcgggcucuuuggccaggaagccagggucuugggacagugaagagccuuugcgcaugugcgacugcacggauuuuccccccccgccccuuaccucccuccacccagucccagagcuugagaguccugcggcagggcggggcccacaguccuacccaccccgcccccccgacccccgagcgccgcagcgggugguggggcgcugauucugcccaaucucgguuucccuucccucccacagccgggaguggggcucccggucuggcccguuuugggcguccccacucacgggucaagccucggcggggcaggagaugacggugcagaaagggccgggcagggugggggugggugcagcagcugcggcgggggcggggcggccagggcugcugggaauagggagggugaggguucuuccccgggcacuaggagccacaccgcggaggccgcgcgcuggcuggggacgugcauguagucagcuuucccuccccacccggggcgcaccaggagaugaggccaggagggggcaguucggcccgcggccccacacguccagcgcccacucagggccugccaauuuccaggugcuuuccaucuaucuugucaucgaccccucuucucugccugucacagaggaagu

SEQ ID NO: 15772 - RNA, 15018 nt, Homo sapiens
gccucggugggaagaaggggcuucuggguggggagugggagagagacuuccuuggggagaggaauucagcugcacgcuggagucagcuggaguugcccaggcccugugagcaaguggcaggcgugcccagcugcauuggggagagggcuguucucaaggccaaggucauuuuuggagggagaacuggacgccugaucaaaucugguaaguucuguaccaaacuguccugugcagcucagagcaggaccaggguccaguggaggccugugcccacucugucucgcuugacaucugcaggggcacgacugggaaaccuagcaggcaaagccucccaggugcccuccgcaucacacccgcucccucucacuucccgagggggccgggaagaaccuccuuccuccucucagaagggcuuagacagaggcagcagcucacaggggcaucuacucugccugcuugccccgggcccaccucagcucuggcuccuccaggcccacaauggacucagcagccaaggaugagaugcagccggcguuguccccugguaugaaccuuuuggguggacuaggggaggaaugauggcaacaaagaugggacuggcugggcgcaguggcucacgccuguaaucccaacacuuugggaggucaagaugggcagaugaccugaggucaggagcuccaaaccaaccuggccaacauagugaaaccccgucucuacuaaaaauacaaaaacuagcugggcgugauggcacgcgccuguaaucccagcuccucgggagacugaggcaggagaaucgcuugaacccgggaggcggagguuacagggacccgagauugcaccacugcacuccagccugggcaacagagcgagacuccaucucaauaaacaaauaaacaaacaaauaaauaaauaaauaaauaaauaagaaagcugggacuggggucguugggcccuccucccugacuacacggcugcccaggcucuuccuucccaggaccugaguggccagagcaggagcgggcagagcagcuggcccggggugcagcgcucaagugggccucaggcaucuucuaccggccggagcagcuggccaggcuaggccaguaccgcagccgcgaggugcagcguaccugcucccuggaaucgcgccucaaggugggcauggggcagggggugcgggugcugggacugugcugcagggcuggcccagccucauggcuccaucuuuccacagucagugaugcagucauaccuggaaggcgugcagacugguguguggcagcuggcccaggccauugagguggugcagggaacccgggaggcccugagccaggcccguggguugcuccagggcaugucccaggccuuacagacucuagagccccuacgggagcggguugcccagcacaagcaacugcaggcccugucucaccugcugccucggcugcgggcaggugagcaugcagggacccugggccucagccuccaauagucaguccacaaacacccaucccuaaucaaggggcuggggcacuagauggggaacugcauagagcagcacaccagggaccucccagacaguagcccgggcuucccauggccuaugaggcagcucauccugggauucccacgugugggaugcuugagucaggacagacacccagucaugugacucuggccaccugguuaucaguauauucaaacucuucccuaacagaguggcugagcgaguacuggcaggaccccccgauuuccccugccuucccuccaggauccucagcuuccucauauuccaugaguucauggguugaccucuggcccaccaggucuuuaggacauugccaagauccucuuagauuggccaguacucuacugguuauuuauuuauuuauuuaugguuuuuuguucauuuuuuguuuuguuuuguuuuugaaacagagucucacucugucacccaggcuggagugcaguggugugaucucggcucacugcaaccuccauaucccagguucaagcaauccuccugccucagccuccccaguagcugggauuacaggcaugugccaccaugccuggcuaauuuuuguauuuuuaguagagaugggauuucaccauguuggccgggcuggucucaaacuccugaccucaagugauucacccacguuggccucccgaagugcugggauuacaggcaugagccacugugcccagcuuacucuacugguuguuaaauauuuuaugcaucacccccgcccugggccucaguauccccugcuguacacauugaggcggugggaaggcugagacccagggccgucuccuuuucacucucauuagugccggcugcagugucccacacacagacucugauugauggccaacaguucuuggaggcauaugugagccuucgggagcuggagcagcugcgagaggauacgugggcaccccuggggggccuggaguugccagucuuccaggggcuggaccuucuguucgaggcacugggccaggcuguggaagcagcugcaggggccgcagggaagcuggcacgggaggacccagcccuguugguggcugcugugcguguggcggagguggagacuggacgaacaaccccccugggccaggucccccgggacuggcgucagcgcugucugagggcacuacaggagggccuggagcaggcccacuuugggucaccucugcugccugcaccaggggcccuaccaggguggcuggaggcucugcgaguggcccugccagucgaguuggccacagcugaggcacuaguagcgccuugcugcccgccacaguacaacgugguccagcuaugggcccacacgcugcauagugguuugcgccgcagccugcagaaccuccuugcagggccugagcuagaagcugcggaugccuucgccuugcugcacugggcacugcauguguaccuggggucagugccuuuggggcagcgggacaugggggaucagaggcugggggcuugguggcuuggugugacaccaggccaccuaucuccaggcaggaaaugauggggagccuggaguuggggccugaggcugaugugucccagcuggagccccuucugaccuuggagaacauugagcagcuggaggcaacauuuguggccaacauccaggugaguaguugaggcacagguccagagaaguccuacuuaucugcugugggccuuuaucugcagaguggaaugucuacccaucuccagcagggucagaucccugcuacauuccuuugccccuggccccuccccccaggcaagugugucucaguggcugcagaaugcacuggauggggagguagcugaguggggccgggagcaugggcccaacacagacccgucuggcuccuauuacucaccaaugccagccauugugcugcagguaggugggaaguggccagacaggcaggcagccuccauggggcaguggggaggagaggaaggagggaggcuuugccgauggcugcucauuucugccugcagauccuggaagagaacauucguguggccagccuggucagugagucacugcaacagcgagugcauggcauggcacugucagaacugggcacauucuugaggagguuugcugaggcacugacccauuccugaucccuaucccugcuccccaggcagcccaaaggggcucugagugaauaagacaugucacagggaaagggcucuuucaaacaaggacuuggguaucuuggaggugggacaggaguaccagggacuggggcuguggggaugccagcauagcagcaaguccaggagccaccucugcccauugcagcuucagugaugcucugauccgauucucccgagaccacuucagggggaaaucaauggccccucauuacgugcccuaccuacuggccgcccucaaccacaagucagcacucagguaccagaaggcccccagggaaccccaccuucacuaacccccuauugaguaccuauuauguaugggcucagcccacacuaggacacuagggacuuuggacucacaucgcccugggguuccaauucuaguucugcuaauuacuaguugugugaccuuggaugaguuaccuaaucucugugaaucucacuuuucucauuaguauuauggggguacuaauggaauguucugagaaucacaugagauaacauguaaaguggccaccauagugccuggcacauggugucaauuguucauucguccagcaaauauuucaaggcccuacucugugccaguaaugucugggguuacagcuguguguauacacgcacacacacacacacucccuuccucuugggugguauguucuuuuuggugggggcaaggaaaacaagugaugauuuuuuacucccuccucacugggauacuucccuuccuuuacgaaugaggaaacagaaaccgaaagaauguuuuccucaaggacgcaccgcgaauuugaggcaggucucgcugggcuguguccuuugcagcucgccaagcgcccgucucccagcccugguccaugccugggaccagaagugcagagagccgcuguucucgcucccucccgucaaacacuugccccacaagguggcgccggagggucuggaccaccgagggccaugcgggccuuggccuugguccugaagccguaguuuugcuugguccagcuccucagugucuguccugcagcuggacggggcgccuucaggggccuuggcuccaguggaagcugcgcuggacgaguugcagaggaggaucuaccgcuugguguuggaggcgcugcaggcggagcuccaggugaggccuccuucaggucaggaugggagcagguggagagguggcgguacagcuacguaugggggucuccgcggcaaugccagaucuggaucauuuccccagccccuguucgcggaucugcccucgcgccaauggcugucgagcccugagcuccugcaaagugugugugaacggacggggcgcuucugccgggacuucuggcgcgugcggaaccccacgguucagguggguugggggaaaagauuggggaaggggcggcgcgggugagaggcgaccugcacccgccugauugccuccccgcagcugcugcuggcugaggccgagcgugccguggugcuccaguaccugagcgcgcugaugcaaggccgccuggugugccgcggagccgacgagaggacccaggcggccgagcgccugcggcacgaugcugcccagcuucagcagcuuuuccucaguuuggugagagcuucuugggcgggcagacgggcgagagucucaguggcugggugggagagagggcuggcgcgagacccuaccccgacgugcucagggccuggaggagaacgcgcacugcgcgccggugcugcucgcccugagggagcugcuaaaccuccgcgaccccgcgcugcugggccuggagguggcuggccugcggcaacaauuucccgacgugaggugcggacugggggccagaagggaagagaagccggagggcggggaggacggggcugacgcgccuccuuggugccccugcagcgaggaccacgucuccgcccucuugggccugcgcggggacuugucccgggagcagcaccuggccgcgcucagcucccugcaggcugcgcugccgccgucgccccgcgcgagccgccgcguccucuucagccuagugcccgcgcccgcgcucgcgccggccuccugccugcccucgggguccugcgcccgagcccugcugcucgcagaauaaaccacggcugccggacgccugagucuguguguguuggggaaggugggauggaauaaaagugcccacgaggguugagggaauucuugcagagugacacgcuuaaaguauccuggcucccguccugguacacgggcugcgccccgccuaugcaggcaucugcccucugugcagacugcguucccgaggccgcgggcuacgcccccacgucuccgcgcccaggccgugagcaagagucuccgccgcccuggccgccuggagccccugaagcccagcaacucgcuguggccuugggaagggggcgggcccaggaccacgaacaccgcccccucaacccugccuggcuucgcucccaguggccucgggggcgcgccgccgcggagacugacgcgaagccccacgcuuucguaagagcgugcgcgcgcccgaggacguacgucaucggcgacggcucccgccggcugggcguccgguggccgguguagcagagcgggagcggcgggcggcgagcagaggagcuaacaggugggggcacggcacgcggacggacccccccaaaggccgggaggaggcgcgcgacgcgaccuuuccugaucucccggagaagccuccacuccauugucuccuggccccacccuccauugggcacgcccuucaccuuaucccccaccacuuauuggcugcaggucacgccccuccucuauuucugguuccccauuggcucuucaccuuguccucuccggggcuucucuccgcacaggccacacccucucauuugucacuagaccccgccuuaauaguggggggcuccucccccauccauccuucauucauuaugcacccagugcugggugcuugguacacgggggugaaucagaccccauuccugccuucggggaguucaggggauugugggaggacacggaccuagacuccaacagugacagcucugaguaaagaagucgccgaagcagugggacacuagacgcggggaaggcuuccuggaggaagugaggccuaaacugagccuugaagaaugguuaagaguuugcuccaggaauauauugcaaaggcauucuuggcggaaggacccgagacgugaaaaaaacaggcguauucugguaauuucgaggagguaugucgaaugaaagaaggggagauggaggggacugggccaagcagaaaccuguaaaggggugaggaguccaaaaaacuguacaguuaguuaaagggagugaagccugggaccugaagucuuuucaagcagcuggucauuaggcaggguagagaggaguggagagggggaagaugaagucuagauagggaagcaaagugcagggaaggaauaauucuaguucugaaagaagagcucuuggauucauuuauuuauugagcaauugcugcgggccaggcacuguucuggguucuggggacacagcugugaauguuggaaaagauaaaacagauaacuaucaaauauaccuaucauacaaauauaaacuguacugaaguacacuccagauggugaugacugcuacaaagaacaauaauuuggggaaggggagauaguggagaggggagaggagguuuacuauuuuauugaggguguguuaggcuuuucuaauaacaugguauugaugcagagauuugaggaaagugagagagugacccaugccauuauacagggggaggaacaucccagacagaggacauauucuguuugauaugccuauuaaacauucaagugaugacacugcagugaagauggacaugauggcaugugccugugguuccagcuaguuggaaggcugaggugggaagauugcuugaggccaggaauucaagaccagccugggcaaauagacaguaucucaaauugcacugaaauuggcaacacuggucuaaaguuuauggaagaagucugagcuaauguauguaaaaccacaagaguggaugagaacaucuagggagugaacguaaauggagaaguuuccauaggcaaguccuggagcauuacaguauuaagaggucagggagacagggaugaccagcaagguaggaggagaacuaaguucgacuguguuuggaaaaccaaguggacagcauguuuccaggaggcagugacuuuuuuuuuuuuuuuuuuuuuugagauggaguuucgcuguuguugcccaggcuggagugccauggcacaaucuuggcucaccgcaaacuccgccucccggguucaagcgauucuccuaccucagccucccgaguagcugggguuacaggcaugugccaccacgcccagcuaauuuuguauuuuaguagagacgggguuucuccauguuggucaggcuggucucgaacucccgaccucaggugauccgcccgccucggccucccaaagugcugggauuacaggcgugagccacccugccuggccuccaggagguagugauuaacuguaucgggugcugaucaauaugaaggucauugcuggucauuggugaccuugaucagaucaauuuggauggagugcugggaacaaaaggcuaauuggagugaauuuaagagagaacaggaaaaaaggaacuggagacuggguauagaugacucgagguaugugcugcaauaggagcaaguggagggagaugcagcggggcuguagcuggaggaguguggguucuagugaggguuuuguuuuguuuuuuaagauggagaaguaacagcauguguuuauccugauggaaagaguccaguagagaggaagagauugaugauguaggagagaggagaaaugcuggaagugagucacugagcaggcaagggagcucagcagcuggagccucuccagguagucucuggggaggguugggauuggacugaguccuggaacagagucggggugagcgcccugacacuggcuuuggaugaccacuggaaagaucccucagauaggggacaagccagagauuggcuuggauuugcugaagcuuccuucugcuucccaaaagcagauucuaauuuggauuucaacagauggcucagaggagagagggcauucugggggguaccggcguaagcauggggcccucaaacauugaaacugacugaggccaaauaggcaggaggauauggguaaagccagguggaugggcagggguggcacugagaagaugccauaggcugaaggcagucccugaggucuucucaccuaccuaaucugcccaggcagcugaagcugcacuguaccaccucccagauuaagugagugagcacagagauuagaaucacgaguaaggggcucaguccuugccuucaggagcucaggcugagaggauuccaguaaccaccaccuagguggguguuuaaaacucuugcuuucggcugggugcgauggcucaugcauuuaauuccagcacuuugggaggcugaggcgggaggaucacuucaggccaggaguuggaggcugcaaugagcuaugaucauugcacugcacuccaccuugggcaacagagugagacccugucucaaaaaacaaaaacgaaaacaaaagugcuuucuuccggcccagcauauuugggugagucugcuggaggcaauggacgcugcagccaaucagaccccugguagcagagccugggcccaccaagggcccagcagaggcaauguggaguacagggccugcuggucguuuggucacacccacucaugcuggucuccacaugcccuucuguguccccagaggucgacaguguggggaguuggagugacccggcuggaugugacccccaggacagaauggugcuggacucaggggcucaggcguaugaucaggcaccccccagcccgccuaccagucccccaucccugcgccauaggcugaagcccucagaccgagaugggccaccacuguaccccuggucucagucccuggccuugccccuggcucuggcaguccccccagcgcugcagccccagccugagcagcagccguucucacagaugcuccugggccaccguggccacaugcgucgcagugagagcaccuacucuguaaauaguacuggccggcgggggcguggcacccugggacggccuccaccuggacggggacggaacccaggugggggcacccugcggccugcagccucccugccucacauugcuaagacucaaagggaugcaggccauauugccagcaagagccccugcauguugguggcccugcggccaaccaacauggaccgugagcgagacaaguucuuccagucccauuacaccuacaauccacaguuugaguaccaggagcccaugcccacggcugugcuggaaaaguacugcgaggccucuggacaguucauccaucaggucaguccagccuccccaccguauccuggcccugaccacccaaggggcuuguccugaccagccacuguggccccguguacaggcaguuggcaucauugaggcuguucuggagaaguuuggaaccuaugaacacuuugaggcugccacuggggggcagcugcucaccaagugccagauauggucgauugugcgcaaauacaugcagaaggagggcugcgcuggggaggugagcuugccugcagagcccuuccucuacaugccccaaaucagggugucuugugggcggucccagguccagcuccacaccugacccaccccugccccugccccagugaggugggagcugguucugagcagaggugaugaagggugggugcccuggccaauugucuggccucgcugcccuguggcaucauuggguccaccugcacccuggccccaggcugguggccauggcucagagcacugccaccugcagguuguggugcagcugagugaggaccugcugucccaggcagugaugaugguggagaacagccggcccacauuggcgaucaaccugaccggagcccgccaguacugguuggagggcaugcugcggcaugagauaggucaggguguggguauccgggcagauggguaggcaugaaaggggccugggagcugggaggggugggaaggaggggccccaauaacuccccuuuuuguuucucccccuucccuccugaggucggggcuuucccuuccugagcagccaccucccgcccucugcuuacagagguaggccagaacaugccugcccaugcucugggcucgcucucaucucuugguccuuucggguauauuuuucucucuccacuuccucuccgacuucucccaacagugcgggcaaggcuggucaggcccugaccggccagagaaagaacccucagggucccaccaggccagccaccacgcuggcccuccaggguggauggaaggccagguccugggaauggacuugacuugaggacacauggcaccugguuuaggaggggacuggccaguuugggcaggggggugcagggcacuaaccacuauuccuaucugucugucccucuuccucgagaauccuguugcucugggcaagagugauuuuuaccgggggcaucagcaugacuguucaagaugauaugggcacccaggauguugggcagggugguauauguauucuugugcccaggagggcugggggcaaugucaguuugggagaguucgugcacgugugugggugcguggguguaggguggggggcggaugggugggagaggauucauguaugugagccucuguggauccuugggugcgaguccacaggaggaggagcuucacgcugccuggggcugggagagccugugugcgagccugaguucaggagcaugaggauggaagugucgcggccagagccccggccagauggaacagggccagggcugggcucgcaggcggguccccgaacgccccgcccagcgccgccuccccucgccuuccccgcaggcacccacuaccugcggggcgugaacaacgcgcgccagccguggcacaacgcggagggccggcugcgguacgggcugcggccggcgaaccccacggaggagggccuggccagccugcacagcgugcuguuccgcaagcagccguuccuguggcgcgcugcacugcucuacuacaccauccaccgcgccgcgcgcauguccuuccgucagcucuuccaggaccuggagcgcuacgugcaggacgccgaugugcgcugggaguacugcgugcgcgccaagcgcggccagaccgacaccucgcugccaggugugcgccagcgcgggggaggugccuagagccggggugggggcggggcuucgggcgaggggcggggcucaccgcccuccugcccucccagguuguuucagcaaggaccagguguaccuggacggcaucgugcgcauucugcgacaucgccagaccaucgauuucccguugcugaccucacugggcaaggugaggggcuguggaccuucagaggucccagccagcucccugccuugcuguagaauucccugagccucggauuggugcuagaccgagggcugggugucaggccuguggugguaggggggagcguggguggaagugagaacaggagaugaaaugacucuggcagcaaaaccaggugcuuaacggaggcugcagguguauguagauacugcaucucaaaggagaugagcauuccaggccaagggagugaucaggaaggccaggggaagaaggcugcagaaauggccagggaccaacucccuggcacuggcauuugugccaggccgaggaaaguagauuucaucugaagcaacggggagugagaggagcuuuaagcagaggagugacucugauauuugcuucagaaggcuccuucuggacaucauaugggagguggauuggagagaggacuagggaagggagugcaggggcacggaggaggccuugccugucacuccugcagaagggaugguggucuggccuaaccaggcaguggccgcuggguuggagaugaagggacaagcuggagagcucuucagagaggggaauacuuuuaacucagcggcuacccugaugggagggugagaguccaagcccccucccgggaaucugaccugggugacuguaaagaggguggagcuggcauaagcuggcacucaggaguugacuuuuggacauggggccauccugaggguuauccaggggaagacauuaaggaggcaguuggaugcccauguuuggaggugagggucugagaggcugggcuggagagagaagugggguuguagggcaucuaugacaaaaagaaacuguugagagaaagggcaaagaugaaggauugagucuagagguauaaaacguuguagcuaauuguggaucaggaggggagaggaagaagucccggagcaaaggcugugagcuguaagcagugggcugggaccagcuaccugaaagccaggggccacugccuaugccugaugcccggcuuccuccugcagguguccuaugaggauguggaccaccugcggccccauggggugcuggauaauacccgggugccccacuucaugcaggacuuggcacgcuaccggcagcagcuggagcacaucauggccaccaaccggcuggaugaggcggagcugggucgccugcuacccgacugauguccguugagggcugcagucagaggcccuggacagaagcuccagauaggccccuagaacaugaagcaguuugcucugugcguccacggccuagguguuucuuggggguguugggagggcaggagcauuccuugaggaggaguggcaacaucaaaguguuugugucccuugccagccucccuggggucuggggaccugcagcagcaugucuggcaaacugagucgcccuccugccuccagcucucuguugagcagagggaaggcaugggggcaggaagagagcugagcauugauggggaugggggugguuugggaauagaaacuuguucuugcaugagauggcuuugguugucccaguacuccagucucucccuucccuuaccuggccccuuggugcuccuucagcauuugugcugucuaccucucacuggguccuggugggggucgggcucccuucuccuggggugauugauggccugagccugggguccugguaguagagacccagcuggccuggggucugcuuuccgacauuuugccucucucacuggucauguauuuauuccauauuuauauggucuacuuccuguggcugggagcagcagcuccugaagguuccgugggggugcgggggguuggacaggacacuccuucuuggaaggcaccaauuuucccagccccacucccauuacacacacacacacacacacacacacacacacacacacacacacacacacacacacacacacacacugauucaggccuugagagucaagcccaagagcucccuuggcccuguuccccacucccuccacuggccucugcuguuccugucuuugcucacacccucacagcugcucucuggcagagguuggcauagccuaggagcagcugcaauugcaccugagggacaggcccuagaguuugguggcccaaguccugaaccccucuuagaccaggugaggugcagaggugguugcugcuuccaguuucccuucagacuuagcugugugaaccccacuccuauccuuuggccuuaguuuucccaucuguaaaacucagaaacgcaguuggaaaguccuuauucauuuaguaagcgaauauauuauaauauguauagagcgccuuuuguguaagucacuggucagaauccucacugagcucccaguccagagagaagccagacaauuaaaacaguaaugacaaugauguguguggccuuugucuacucaaggucccuuucugcuccccucuucuagucucacuucccaaggcugugagcucuaagcccucccuauguggagagaagucacccuccccuugcuccauguucagcucaggaacuugcgugggguugagcugguaccuacauaugcugccaaguggcucaccaggggaaauggguuguguaugcgggcaggagggucagguccuugucccacuagggggcuagguuugggaucuccagggugcagccuggacuccuaagggcagauuagggcugaggacuggaugaugcucguggugggcuugggccugcccaggucccugggacucagagguacccacccuaaguuccugggcaaacagccagaaucguggagagagcccaggucccguccgacccuccggaguuuauucacuuccagcg

SEQ ID NO: 15773 - RNA, 1781 nt, Homo sapiens
ugguccugggcccgcccccuucccaaggccacagcgaguugcugggcuucaggggcuccaggcggccagggcggcggagacucuugcucacggccugggcgcggagacgugggggcguagcccgcggccucgggaacgcagucugcacagagggcagaugccugcauaggcggggcgcagcccguguaccaggacgggagccaggauacuuuaagcgugucacucugcaagaauucccucaacccucgugggcacuuuuauuccaucccaccuuccccaacacacacagacucaggcguccggcagccgugguuuauucugcgagcagcagggcucgggcgcaggaccccgagggcaggcaggaggccggcgcgagcgcgggcgcgggcacuaggcugaagaggacgcggcggcucgcgcggggcgacggcggcagcgcagccugcagggagcugagcgcggccaggugcugcucccgggacaaguccccgcgcaggcccaagagggcggagacgugguccucgcugcaggggcaccaaggaggcgcgucagccccguccuccccgcccuccggcuucucuucccuucuggcccccaguccgcaccucacgucgggaaauuguugccgcaggccagccaccuccaggcccagcagcgcggggucgcggagguuuagcagcucccucagggcgagcagcaccggcgcgcagugcgcguucuccuccaggcccugagcacgucgggguagggucucgcgccagcccucucucccacccagccacugagacucucgcccgucugcccgcccaagaagcucucaccaaacugaggaaaagcugcugaagcugggcagcaucgugccgcaggcgcucggccgccuggguccucucgucggcuccgcggcacaccaggcggccuugcaucagcgcgcucagguacuggagcaccacggcacgcucggccucagccagcagcagcugcggggaggcaaucaggcgggugcaggucgccucucacccgcgccgccccuuccccaaucuuuucccccaacccaccugaaccgugggguuccgcacgcgccagaagucccggcagaagcgccccguccguucacacacacuuugcaggagcucagggcucgacagccauuggcgcgagggcagauccgcgaacaggggcuggggaaaugauccagaucuggcauugccgcggagacccccauacguagcuguaccgccaccucuccaccugcucccauccugaccugaaggaggccucaccuggagcuccgccugcagcgccuccaacaccaagcgguagauccuccucugcaacucguccagcgcagcuuccacuggagccaaggccccugaaggcgccccguccagcugcaggacagacacugaggagcuggaccaagcaaaacuacggcuucaggaccaaggccaaggcccgcauggcccucggugguccagacccuccggcgccaccuuguggggcaaguguuugacgggagggagcgagaacagcggcucucugcacuucuggucccaggcauggaccagggcugggagacgggcgcuuggcgagcugcaaaggacacagcccagcgagaccugccucaaauucgcggugcguccuugaggaaaacauucuuucgguuucuguuuccucauucguaaaggaagggaaguaucccagugaggagggaguaaaaaaucaucacuuguuuuccuugcccccaccaaaaagaacauaccacccaagaggaagggagugug

SEQ ID NO: 15774 - RNA, 1781 nt, Homo sapiens
cacacucccuuccucuugggugguauguucuuuuuggugggggcaaggaaaacaagugaugauuuuuuacucccuccucacugggauacuucccuuccuuuacgaaugaggaaacagaaaccgaaagaauguuuuccucaaggacgcaccgcgaauuugaggcaggucucgcugggcuguguccuuugcagcucgccaagcgcccgucucccagcccugguccaugccugggaccagaagugcagagagccgcuguucucgcucccucccgucaaacacuugccccacaagguggcgccggagggucuggaccaccgagggccaugcgggccuuggccuugguccugaagccguaguuuugcuugguccagcuccucagugucuguccugcagcuggacggggcgccuucaggggccuuggcuccaguggaagcugcgcuggacgaguugcagaggaggaucuaccgcuugguguuggaggcgcugcaggcggagcuccaggugaggccuccuucaggucaggaugggagcagguggagagguggcgguacagcuacguaugggggucuccgcggcaaugccagaucuggaucauuuccccagccccuguucgcggaucugcccucgcgccaauggcugucgagcccugagcuccugcaaagugugugugaacggacggggcgcuucugccgggacuucuggcgcgugcggaaccccacgguucagguggguugggggaaaagauuggggaaggggcggcgcgggugagaggcgaccugcacccgccugauugccuccccgcagcugcugcuggcugaggccgagcgugccguggugcuccaguaccugagcgcgcugaugcaaggccgccuggugugccgcggagccgacgagaggacccaggcggccgagcgccugcggcacgaugcugcccagcuucagcagcuuuuccucaguuuggugagagcuucuugggcgggcagacgggcgagagucucaguggcugggugggagagagggcuggcgcgagacccuaccccgacgugcucagggccuggaggagaacgcgcacugcgcgccggugcugcucgcccugagggagcugcuaaaccuccgcgaccccgcgcugcugggccuggagguggcuggccugcggcaacaauuucccgacgugaggugcggacugggggccagaagggaagagaagccggagggcggggaggacggggcugacgcgccuccuuggugccccugcagcgaggaccacgucuccgcccucuugggccugcgcggggacuugucccgggagcagcaccuggccgcgcucagcucccugcaggcugcgcugccgccgucgccccgcgcgagccgccgcguccucuucagccuagugcccgcgcccgcgcucgcgccggccuccugccugcccucgggguccugcgcccgagcccugcugcucgcagaauaaaccacggcugccggacgccugagucuguguguguuggggaaggugggauggaauaaaagugcccacgaggguugagggaauucuugcagagugacacgcuuaaaguauccuggcucccguccugguacacgggcugcgccccgccuaugcaggcaucugcccucugugcagacugcguucccgaggccgcgggcuacgcccccacgucuccgcgcccaggccgugagcaagagucuccgccgcccuggccgccuggagccccugaagcccagcaacucgcuguggccuugggaagggggcgggcccaggacca

SEQ ID NO: 15775 - RNA, 8496 nt, Homo sapiens
cgacuucggucugcgccggaagugcaugagcugccgauguggugcuuagugauugcgguuucggucgcucucccguguuucccgggcuggguauuugccucgcaccauggcgguaaggaggauggauagggcgggguccgcaccagcaaagcucuccaggggcugugagagugaaaacugagaaagaacauuaagggauauggggugggccagagcggggcgccaucccuggccagaccgugcuagagcugggcuggggggauggcggcgcaggaccauaccaggacuagugccagagcggggugggcaucaguaccagggcaggccagagaucuaagugaccugagguggggguuaacccagaucgggacuacgccagcggaggccugagagaggcaccauucaacuccgcucaggaguacccuuggaagagucguuagccuaaagccagacuaccacgggauccagaggcgguauuagcuuaggauugaauuguuccagggcgagcaagaggcgauugauccuagcugcgggugcuggagagauggcgucagcccuaggcagaauggacuggaggauggguggacaucccagggauuuugcuagguuucugcacuacggggaccuggcugaguugcggauggagcucuauagcucaccaggcugguggggagaaugaggaggaccguggccuccugacggcaucucaucauuccucugcagcccaagggcaaagugggcacgagagggaagaagcagauauuugaagagaacagagagacucugaaguucuaccugcggaucauacugggggccaauguaagugccuaccuccuugcuucuaugcccacuuauagucaguucccuaguccucagcccugcuuggugacgaggagugguacccgaaaaagcucuagaagagagcuccagucaaaaagaaaugagagaucugggcacagagaaagugcuaacuaguaaaacacaaagaaaaugaaggcgugagucguagcugaauuugagagcucuuccuaccuccaaguacacaaaggcuucuuuccugggcugaguugggugucagaggagaguggguauuugggauucagggagcagggcccuuucuucaacccuguaagaacaaccuugcuccucccacagccuggccuaauucuuggucagaguugagggagacccaugguuuggagguaacuucugaccccaaccugauccugugauugcuugcaggccauuuacugccuugugacguuggucuucuuuuacucaucugccucauuuugggccuggguaaguaucuccauccugggagguggaugagugcguagggucaguggcuggccuuugauacccucauucuugcucugcaguuggcccugggcuuuagucuggcaguguauggggccagcuaccacucuaugagcucgauggcacgagcagcguucucugaggauggggcccugauggaugguggcauggaccucaacauggagcagggcauggcagagugagugucccccaccgccagcccaggugagcggccccagggcuggggcccagauagcccaagaagcacagcuacuuguaacuugaaaaggguggaagggaguugcaacuugaaaaggguggaagggcccauaugcugucuuuccagcuuuauuucuauccacaggcaccuuaaggaugugauccuacugacagccaucgugcaggugcucagcugcuucucucucuaugucugguccuucuggcuucugguaugugggcugggggcgcucccaagaaggggcaucuaacccuccccaucuuuuauucccugcaucuugcuucaaguuaccguuucucuuguaggcuccaggccgggcccuuuaccuccugugggugaaugugcugggccccugguucacugcagacaguggcaccccagcaccagagcacaaugagaaacggcagcgccgacaggagcggcggcagaugaagcgguuauagccauugacauuguggccacaggccacuggcccuggguggcucugucagggugcacagccccucaugccuggagcaaugagggucuaguccaggggccaaaagcagucugagguauuggguauacuuauacucuauagggucguugaauaaauggcuuagaauguggcugauggcugugugggugaugagggaugaggcaggaaaagcugguccuaugggauuucccuccugcuacaaacccagccugguggggacccugaaagaagagaaaccuguuggauuagcuaagaaaauuuuauuuugcuccgugcguucaaggagcucacacacaugcacaugcauaugcaugcacacacacacauacacacacacucacaugcauacacacacggcuaauacugcucaaggcauggcuccugggcacagaguucuggggccagaauucugcucugggcccuccucacucugucaucuccugcacugcaguccaggguccagauagauuuccgggauacagcaccuucacaccuccaggccaggacccuugcuuagucccagugccugcaccaggucaucuccgagcccacucuucaacguccuucucacugcagggacagagcaggguuggaggggguugaugggguucaggugggcagugggauugugggggguuacuuacaagacuugcgguugccgcgggaacgcuugcguucccuagcagcuaaggcacgaggacugcucuuggucacugacugcaccagaagguccaugaucucaucugauguaucacuggguaaacuggagccuggggguucuucuggggaugcaguggagggccccacugugggcaugauuggggagcugcucuggaccaugccugaggaaggccagauagcaaagucaggccaagguggcacuggagcccauuccccacagcugcuaugggccucaccucugcugcggcgauugugugugguguccucaggccugcuggucagcagacucuucauacuagcaugacugucagcaucuccccggccuggcccgcugcucacugcuacugggacagagggguugcugggggcuuccccagccacaccugagaacuucucugucuggagaaagaagaagggugagcugggaggagcgaaggaaaccaaggagguggcagucaagacuaagaccuggaagggcacccaccucggugaucaugcguccccgggucuuguugcgcucacgguauguggccugcuucugcugcugcuguagcacucguucccggcaaguccgauacucaagcgcaaauucccgcagcguguggcagaacugcaugaugcgcacuucacgggccgccugcgggguguagcccagguagagcaggaaggcauggaaccuaggcaggucagaguagggagggacaguaaguccugcuuauugucugagggagggugguggccguccugccucucuuggguccaugccccuaccuauugcagacacggcggugcacuauccuuagcauggcaacacggcgggcacacugguccaggaagugggugaggcgggcacgcagggcuggggccagcucaugcuuggccaagcuccgcaggcucuccucggcugcccggcuccggcgcuccagcugccccagguucucagucagcuguucaaaguccaccugagaaagcaagggggugcacauacuguccccccacacccuguagacaagacauggcccgaggcugcuucugggccagaguggccagcuugggcccuaaggacacagacauccaaaucucauagacuagugcaagagacacaaguccaucugaugugaauggggagcagaagguuuacugggggaaguggcaguuaaacagacccaaagacugaguagguguggccaggccaauagaggaaagagcauuucuggcagagggcauagcucacacccagguggcuggagcaagcccuggcacagcagcccaaauggggagaagggggaggagccaggcccaggaagcagcgcuccucaugccuuguccggccuugguugauucuggcaggugcuaaccuuggcacagcgggucagggcagggauuucugaauagaggucagaggacucaggccgggucuggagcacuagggagcagagaugguguagcagugacugucgacgcaccguguccuucaccucugacaccuucuccagguagcucagcucaaagccgcugcucugaaaggacccuuucugagccugggccugguuggcuccagaacccugacucccccuaguccccauguacucucacucaccugggagccauugaggaaguugcccaccgcuaggaggguagccaggaugcagcggaagguggcauucuguaccagcuguuccauacccacuuucaggucaaacaguggcucagcaauuuccugguaugggagaccagggacucucagacuacauggucaugaugcuuaccugucccuacugacugucccacuccaagacccagguacccgcuccaugcugucauaguccagcuugaaggcccagaguuguagacgagcagcgaggccgccaauggaggcaagagucaucaggaaguucucggcugggcccagggguaugucaggguuggccagcugggcuuccucaaucuucugccgcucuuccuccgugggcaucauggucaguagcuucugaggauguagccagagccugacauggcccccucaaugcaggccugaggccugaggcauuggucuugaccccucagucaucuaggggaggccccagugucuggggacugcccugcagaaaugccaagcccaugcccaccaccagagggacaggaaaugcccaccuaccaaaggagaaggccagaccuccccccaacacccauagcugggugaccucaccucaaugccauccuugcugacagcaaacucaucaaaguugagcagagcagccuuaaugacaugcacagguggcagugugguuaggccgauguugauggcguugcugcgcuugggguccagcacuguggucauuguccggcggcccucuccagcuuucugcaugguugggggaagggcaguguaagacugaggaagggggccugacgcgguggcucacgccuguaaucccagcacuuugggaggccaaggcggguggaccacgaggucaggagaucgagaccauccuggcuaacauggugaaaccccaucucuacuaaaaauacaaaaaaaauuagcugggcgugguggcgggcaccuguagucccagcuacucgggaggcugaggcaggagaauggcgugaacccgggaggcggagcuugcagugagcugagaucacaccauugcacuacauccugggugacugagcaagacucugucucaaaaaaaaaaaaaaaaaaaaaaagacugaggaagggacuagcugggacagcaaccucagagggcacuccaaggcccuccucuagauugccaaaugaucccacaacugacaaacuggcaaccuggaauguguaagucauggggaugagcuuagauucuuuugagacagggccuggcucuaccaucuaggcuggagugcaguggugccaucaucgcccacugcagcuuaucuucugggauuuuccugccucagccucccaaguagcugggauuacaggcguguaccaccauacccaacuauuuuuuuuuuuaacauuuuuuuuuccgccucccagguucaagcaauucuuuugccucagccucccaaguagcugguauugcaggcaugagccaccacgcccagcucauuuucauauuuuuaguagagacgggguuucaccauguuggccaggcuggucucaaacuccuggccucaaguaaucugccugccuuggccucccaaagugcugggauuacaggggugagccaccaugcccggcuaauuuuuuuuuuaacauuuauuuauuuuuauuuauuuaguuauuuuugagacgaagucuugcucuugucccccaggcuggagugcaauggugcgaucucgacucacugcaaccucuaccucccggguucaagugauucuccugccucagccucccgaguagcugggauuacaggugcccgccaccacgcuuggcuaauuuuguguuuuuaguagagacgggguuuugcuaauuugaccaggcuggucucgaacuccugaccucaaaugauccaccugccucggccucccaagguccugggauuacaggcaugagccacuacacccagaccaacuuuuaguagagauaaugucucacuauguugcacaggcuggucucaaacucuuggauuacaggugugagccaccaugcccggccacauuuagauucuaguuggggcacugcugaucccuuguuaggagaccuuggacaauuuccuacuccuuucuuugccuugguuuccccaugugggaagugagugacuagcuccaacaggucagauccuuaagcucugauucccuccugccucccuuggggcuaccuugcagaugaguggauuuaccuuggagggcagcaccucuuuggcacgagacucaaagagguguuccagucgggccguguccacugagacaggguccagugaagcccagaggguggcgcagggcccaaagcggcuugcagagacuccauggcccccagccagcuucagcucacgccagaaaaguuuuacugucuuccucuuaguggggagggcugagcugucaggcacugaauggggaagaggggcagccagagguagagguggagguggugggaaggggccuuugaugggugggggagguggaagugggggagggggggguacucccgagagcaggggcagugggggugagggagcugggaugucuuucccagccuccacagacucuacauucagcauguccuggucuucauccuccccuagaucugaaaaguccagguccccaauagagagccugggugcacggguagggagcucccagaugggcucagccuuggggcuugcugguaucaguggcuccuugggcucuggugcaaggcuucgcugggcccggagcaggacacagggggcagggcucugggguguucuggcugcaggggcugucucuggggagucccagaguugccgggcaucuaaagaaagggaaggagcugucagugccaugcccccuguggggcaacaaagcaacaggcaggcucugccugcucacccaccuacucaccuggguguccacccgccucauugggcauggccccggcaagugucucugcccggcccugggccagcgcaaccugcuucucuguuucugcugccgccacauucuccaggaaccgggcucugagggaaggugcuugucacugacagcgucugacacaccccagcccagguguacaugccuugcugagccccuggacaccacccccaauugcaggcacgcacagacacacagggaacaguccaugcgcugagcagaccagaaccacaccccccccaaggccagccccucuucaguccuccacaucuggggaggauuacuaccaacccagcauucccaggugaaaacacagggagaggaucuacuuaacaucuaacuugcaaccucguucauguucacuguccugguuuuuuuuugguugguuuuuuuuuuagagacagggucucacucugucagucacccaggcuggaguacaguggugugaucauagcucacugcagccucacucuccugggcuugacccucagccucccaaguagcugggacuacagacaugugccaccacguccagcugauuuuuuaauuuuuuugaggagacagggucucacuguguuguucaggcuggccuugaauuccuggccucaagcaguccucccaccucagccuccugaagugcugagauuacaggugugaaugaugcacccagccaaauuuuaaaaaauuucuuuguagagaugaggucuuacuguguugcccaggcuggugucuugagucuagacaaggacucuuagagcaggggaaggggauagcugucccaaugggcauaucaggcugucccucccuuggcaugucugguagcuucugggagccuaugcccaggaaagggccugguaaacaggccaggugcgguggcucacgcuuguaaucccagcacuuugggaggcagagguggguggauuacuugaagucaggaguucgagaccagccuggccaacauggugaaacccugucucuacuaaaaauacaaaaauuacccagguauccuggugcaggccuauaaucccagcuacuugggaggcugaggcaggagaauugcuugaaccugggaggcagagguugcagugugcugagaucacaccacugcacuccagccuuggagaccgagcaagacucugucucaaaaaaaaaaaaaacaaaaaaaaaacggaugugguaaacaguggacccucaguuuaugcugaaauaaugggugcaaucc

SEQ ID NO: 15776 - RNA, 24817 nt, Homo sapiens
uuagauaguggccggccaggucucucucaguugagggacaagauagcccucauuccuuccauuugaggggugagucccugugguuuccucauuuagggaaagcagugagagggggucccuucaauuuggagcaagaagugagaauaaauuccacccaguuugaaggaagaggugggaucaguucccuuuaguugugggaggaagagggaaggaugcccuucaguuuucugggaaaagauugggaggagucaguuugagggggcagauagaacacguuccccucaguuuuggagaaaaagugggaugggugccccucagccugaaugaaaaguggagacgguccuccucuguuuggggcgcuaugagccgaaugccccucagauuuggaaaaaguugggugcaucucgccuaguuugaagggaaucaguaggcuggguuuuccauagguuccugucagcuucaucaaagagaugagacaguucucuguagugugacugaaagggagggccaggugccccuugguuugggagaugaagaacagccucccucuucgccuggcacgagcugggccagucugggccuuaggguuucugggacguugggggcagcguuguccgucacugcuuuggggagcguccagugcgcgugcgcagcucagguccgggugggggccggcaggggguccugggcuuggcaacgugggcggagggcggccaagcacgguccccugcguuuugcacccggccgcgccuuggucccaggggggugcugcucgccgcacagcagcgcuggccgaggaggagccgugccccucccguccugaccgcgccccccgcagacccccgcccuucccgcugcgggcugccccaggggggccguggccgcgcaccgcucuggaucuggugggggcgguuuuggggagguuugggggcgcggacucgaaggaguagguuguggaacuugggggagagcugcacuggggaauuuccggagcugggacugauuuagggaggaaagaggagagaguccccgacuacgagaguccgaggcagggucucggagccuggaccuggcuuggggguaucggagccgggauuggggggagcgggccccacgugccugugacgcgggggcgcccgguagguggcggcggcgacgcggggccggcggccgugcggugccgggagggcggcugggcaggcggcaggaugcugcgcgccgcccugucccugcucgcgcugccccuggcgggggcggccgaagagcccacccagaagccagaguccccgggcgagccucccccaggcuuagagcucuuccgcuggcaguggcacgagguggaggcgcccuaccugguggcccuguggauccugguggccagucuggccaaaaucggugagugcgugugugcgugcgccaggccgaccgccagcggcggacccgcccccaacacccccaccuccucgguccucagauuggggcuggcuucuugcacggugcugggacuuagguuuggauuccacaaauccgggcucucgcccaguuccugcaucgcuucuugugggucccaggucccugucuucuccccugggagcucugaggauuugccuuucugaagggcugucccccgcucuccccaacuccaucuguaggcuccuuugcccucuccgcuccccucuuccccuugcaguaggcccucuucagucuggucucucccccaccaaucccuagccucccagaaaccucugucgcuggugaggauguguggggacauugaggggaggguguucucccaagaacacaggcauccugguucugaaaaagcagccuucccuggagaccauguccgaguguccauucccuugggaaacuacacugccacuuuuccuccagcucuccccugcuccccacuuaaagcugcugccuucuugugccuguguauggguacccccccaacccacguucagguccacauucuucucacuucaggguauaagaaacuuccguguaucggggccuuccugugugcugucuacccuagaugcuuucauacauccgaccucuucaguccugacagcauugaaggcugugcuucagacuucuuuuucccugaauagagcugcuuuuccuugcaucugcuccuuccuccucccuucugagcagccaguggucccuccucccaccagagacccuccuccuucucccuguugugcuggcucugcugugggggugacuaauuauagcugagcguugcuacucucuccccauggaugcuggcacagccuguacuccagucucaccaauacagccuucauggaggaaucacccagagccuagaauuugccccucuucucccacauggacacugcuagggggugagggggcugggcaggaacagaacucuccacucugcuguggcagccugagauuaauaauggaaaguggaacucaauaugccuuccgggagcgugguucugugauggggcuuggaucucggggcugggguuaaugcaugaagagaugaagaugaaauaggguccccgaaggagagaagugggagaccaaaguagggacaaguauggagagaucuaugaccauguuuaccuuagagguccagcagcaaugagaguaagaguagaaagagccucagguuuggagccaacgauuggguuugcuaagucugugaguugcagaagaguuccugucuuaggguuuauagcaaaaacuguaguuuuccccauaaaucaugguucuuuuucuaguuuggaugacauuuccuauggaaguaagagaagagagccuccuuuucacaagucaaagaaaauccucgaacaagagaaaaggcagagcauucaggaacaccuucccccagcuucauugcuaggagacuuuuucccuuuuauuaaacaaauauuuacauagagcucacuaugugccaggcacuguucuaggcccuuuggguacagcuuccaaagggcacugucuuggcauagggucucacagaggcuaauuuagaggucuccuuccccaacaccccagggauuauguagagagagauguguucgcuuguggucugaggacuuaaaggagagccaaagaguuuauuuuagaggacaaaaguaggaguggcuauagugcuagaaacgcuuuucuucuccccuccuacagacagaacuguucuauuuaauuaacauuuggugugugucuaacauacuaugugucugacauuaugcuaggcacauuugcauacuuuauaucauuuuauccucacccuugaugcuggguauuuuuccuauauuacaaaagaagaaauugaaguucaaguaaguuaaauaauuugccugagaucacauagaaugugcuaaggcuggaagaagaccuggagaucuucugauugcuaaagccaaaguuuuaaaaacuacgcaguccugagugagcccauauaaugaaaagcacauugggcuaggaagucuacacagcuccuaggagguauaauauacauucuggucuaguuaaggagugaggacauuauaauagguaacauuuauugagugcuuacuguaaaguagugugcuaagugcuuuugaguagauugucuuuuuuuuuuuuuuuuuuuuuuuuuuuugagacagagucucacucugucacccaggcuggaguacaguggcaugaucucggcucacugcaaccucugccucccagguucaagugauucuccugccucagucucccaaguagcugggacuaccggcacccgccaccaugcccagcuaauuuuuguauuuuuaguagagacaggguuucgccgugcuggccaggcugauccagaacuccugaccucaggugaucugcccacuuuggccucccaaagugcugggauuacaggcaugagccaccgcgccccgccuguagauugucuuuuuuaauggucacaauaaucuuaugagaucauuaucguuuuuacucccauuucacugaugagaaaacugagucagagacaugaaguuauuugcccuaagaucacagaacuaagcuuugaauccaagcaacuugacuccaaagacccugauuuuuacagcuuucuuacauauaaaaagauacuggguagcauuagcugagguucaaauaauggcuauggauaaggguugucagagaaaggugagguccccugaggaugaaaguauaaaggaagggacauuucuagaaggggaaaaagcaguaaaggccuagguuaccauagugugacaggagcacuaagaaacagaugacuuugacugcaggggaggguuuguagcccuggagauuggaaauucuagaagucuugcauauuucuccucccuuggucccagucuuagaagguuggccaggcgcgguggcucacaccuguaaucccagcacuuugggaggccaaggugggcggaucaugaggucaggaguucaagaccagccuggccaacauagugaaacccugucucuacuaagaauauaaaaaaaauuaucugggcaugguggcgcgugucuguaguccccguacucaggaggcugaggcaggagaaucacuugaacccgggaggugaagguugcagugagcugagauugugcuacugcacuccagcuugggcaacagagugagacuucaucucaaaaaaaaaaaaacaaaacugggaguucauaggccugugugugggaggauauuccauaaacugauccauccugcacucuuuuugcauugcaguguuucaccugucucggaaaguaacaucucuggucccugagagcugccugcugauuuugcugggccuggugcuagggggaauuguuuuggcuguggccaagaaagcugaguaccagcuggagccaggcaccuucuuccucuuccugcugccuccuauuguguuggacucaggcuauuucaugccuagcaggcuguucuuugacaacuugggugccauccucaccuaugccgugguaggcacacucuggaaugccuucacaacaggcgcugcccucuggggcuugcagcaggcuggacuuguaggugagugacccuaagaccugggcuuugccagacccaucaccccucucccuucuccucaagcucuggaggcccaugcuggugugagccaugcccugaaagcuccauccuaggucccucccucuggagugcaaggcagugcucccgcugggguucaggccucauugaggucucugccagucugggcuucugcagcauaacagcugagcaggagucuggcucccagcuguaugugggcugccaaggcuggggagccuguguuaccauucuguugccuccugcccucuguuaccacauugccauuugccagcccgucuccccugaggcauagcugugcaucauuucugcaagggccugcuguccuggcucuccccaggccaggucugggugguuuucuguuuuuauuauuauuuuuuuuucuuaacuauauguugucuauaagaaauucauuauuuuaaacauuuauuuuuuuaaauaaauaaauagauauuuaaaaaauaaauauuauaaauccaucaaaugcuggcacuacacuggguuuucucuccuuacuuaucccacugacucuucauagcaacccuuuuguguaguuugucacauuuacacaugaggaaauagaaccccuugcauuuguuugcuaucagguccaagguuagcagaagagguccguguuuguuguuguuguuguugcuuguuuuuuugagauggagucucacucuuguccaggcuagagugcaauggcaugaucuuggcuuacugcaaccuccaccuccuggguucaagcaauucuccugucuuagccuccugaguagcugggauuacaagcacaugucacuaugcccagcuaauuuuuguauuuuuaguagagaugggguuucgccauguuggccaggcuggucuugaacugcugagcucaggugaucugcccaccucaaccugucaaagugcuaggauuauaggcaugagccaccacgccuggccccaggucuguuuuacugaggcucuuugccuuuagguugcccucucuugcuaccuucuuuauuuccuaacccaagaaauucauucaacccugaagguuaaugauucacacuuuuuccaagguauuacaagaaaacguuuacaauugcuaccugggacucuaaccugguuucccuauugagguagugaacuauuuggggcaggaagggaagggaggacaucagaucauaauaacaguaauagauaauaauaucuuuugggugcuuacuauauguuaggcauuggcuaaggaacuuuuugagguagauauuguuauuagucucaauuuagacauggggaaacuggggcucauagaaauuauaugacauauucaaguccgaucuguguugcuuuucuuacuauauucaguucuccacaccugcugagaauugugucacaucccuuuggccgggaaccacaggugugggagaaagcacucucuuuuguuauucccccuaauaaaaauaguuagcagccaauuuccauuugcugguaguuauuauuacuguugcuacagugcuuuuucccuauuuuauuuuauuuauuauuauuuuuugagacugagucucacugugucacccaggcuggagugcaguggcacaaucucggcucacugcggccuccgccucccugguucaagugauucuccugccucagccucccaaguagcugggauuacaggccugcaccacugcgccuggcuacuuuuuguauuuuuaguagagacaggguuucaccauguuggccaggcuggucuugaacuccugaccucaggugauccagcccaccucggccucccaaagugcugggauuacaggcaugagucacuguaccugggcuuuuucccuauuccaaauggcuggguugaguuuugaaacaaucuugugaggcaggcagaugaggaggcauggcuaaggugagccacaugacagugacggaccagcaucacacaguugguaaguggcaaagccagaccuuaggcauagguagcuugacugaagucuccugaucugcaggcuaaugcugucuuugccaucccaaguccucuuugggcuuccuugcuguuaucagcagggguggggccugggcuuguuccagggcgugcuccaggagacugggucgucuucaaugacuggccuguccuacacaugucccuuaauagccccuagggugcaggcuggcuuacuggacuuccugcuguuugggagccucaucucggcgguggaccccguggccgugcuagcugucuuugaggaggugcacgucaaugagacucucuuuaucaucgucuuuggcgagucccugcucaacgaugcugucaccguggugagcgugcucagcugacugccauucccugaccccaggcugcaugcucugaccaacuaggggucugcgcagacucagucccuucccuuggguccccuggggcagaaauaugcugucugcuuucacccugcucucccagcagucugucucccagcagucccaguugcugccuucccgccucacugcugacucuccucuucucgcucaggugcuguacaaggucugcaacuccuuuguggagaugggcucugccaaugugcaggccacugacuaccugaagggagucggucaguauuuccccgcucccagcuggcauuggaggucugccuccccuggguugcugaggcccucccaccccgcaucaggacagaagaggcuauucggguugccucaucuccucuauagagaaauggggucugggaggggcuugccagggauccuggcucugggguuuugagccccugggagugcggugggcaucaucccucacucccugccaggcagcagucuugucagcccggguaggguccgggccaggggucaugcugacaacccacuccucccccagccucccuguuuguggucagucugggcggggcagccgugggcuuagucuuugccuuccuccuggcccugaccacacgcuucaccaagcggguccgcaucaucgagccgcugcuggucuuccuccucgccuacgcagccuaccucacugcugaaauggccucgcucuccgccauucuugcgugaguucugggggccuugcaggcagauagcugggagggggcacuggagaugguugccccucauagggacacaggcaggaacuucaggaguccauagguuucccugagcccuugugguagugggagccucagacuguccuggggagucaguaaaccucagcaauauuucaggagcugcccccagagcuguccucagcacccugaaacccucuggguguaggcugggcuggaaguagacuuuaaggccuggggccaccagcucuggaggccgcagcacuccagaaggugcauuagagagcccgcuagucagagcacguuccuuccaccuucccuuccaggagacacugaaugggaagccuggagaucuggacucuuagcccagcacuaccauucaagucuucaggccucccugggcuucagcucugagagucugacauccuguaaugggcaaugcccccuccugcaguaugcucaaacccuggaggcugagcccccuggaacccuuccccacuugccaugucucuccauccucucccagggugaccauguguggccugggcuguaagaaguacguggaggccaacaucucccauaagucacgcacaacugucaaauauacaaugaagacucuagccagcugugcugagaccgugaucuucaugcugcuuggcaucucagccguggacucuucuaagugggccugggauucugggcuggugcugggcacccucaucuucauccuguucuuccgagcccucgguauugcuggcacccucugcuuucccacucuccuuccugucccgccccucccugcagcucaucucccuaucugaguccacaucuuugucaauuccuaagccuccucuuguugcucaccugucccagccccuguuagaccucagcccagauacuuggucccauccggucccacguccuccacucccaacgcuuugcucccacuggccucccucccgcuguaggcguaguccugcagaccugggugcugaaucaguuccggcuagucccucuggacaagauugaccaaguggugauguccuaugggggccugcggggggcuguggccuuugcucucgucauccuacuggauaggaccaaggucccugccaaggacuacuuuguagccaccacuauuguaguggucuucuucacagucaucgugcaggugggagugcccacaaggcuggguagggagaggguugggcaggcccugggggagucuuggagccugugggacaggggcuucucuucccgcugggagauggagggcccugacuucccagaccuugagugcagugggguagggguacugaagcugaagccucauuacggggagagaaaggcagcagggaacugaauaggaauagggcagggcucaccuccugccuguccauagggcuugaccaucaagccacuggucaaauggcugaaggugaagaggagugagcaucacaaacccacccugaaccaggagcugcaugaacacguggguaucagaaccccagcccucgccugucccucucgaccuucuccuauuuugggcagaguccugauccagucccccuacccaccccccuucuagacuuuugaccacauucuggcugcaguggaggacguuguggggcaccauggcuaccacuacuggagggacaggugagggagcugccccgaggcuccuucagcagcagcagccccaccagccagggaagcaugggggaugugccacacuucugagaagggacagagccagguucaggcugggugaccucugccugaagcccuucaguggcaucccagugcucucagguuaagacaaggcuccccaguguggccugcuuggcccugcaugguuuggcaacugccagacuccagccucaucaugcucugcucugucuuugacugucugccugcuaauuccauggacccugucuuagauccucaggacccaccaugcucccccagccuggccacugggaccuucucuguacuagaacacuccuucaccucccucucacuuacucagcuucgauucauccuucacaacucaccauaggcuucaauuccuuagggaggacuucccuggccucccuggcuaggacguaucugugucauauucucuaauuauccuuuguaguucuugucaugguugcaauuuuacagugauuuguaauaauuucaguuacugucagccuuucccaugacauuguaaauuccaugagggcagggacuagccuugagauucucucuggcugaggcccauaucuaaaaagccaggccagugcugacgguguccuugccccgucugaggaagggccaccuggccaggccuugggaaugggacucagggccgggccuggcauccucuguaggugggagcaguuugacaagaaauaccugagucagcugcugaugcgacgaucagccuaccgcauccgggaccagaucugggauguguacuacaggcuuaacauccgggaugccaucagcuuuguggaccaggugggccagcagcuuccaggugggccaguggugggugggcagauggucagcagagcaggacagaaagggguggcaagcaggcuggcccugagcagggaguugggaauuccuagcuggcuccauggucuggugaaguggcagcggcaggaagcagcugggucuggugcugacauucagagucuggcaggcaguccagagaggugggaaacagcuggacucuggggucagcucaaccauuaucacuuccaagcuugugaccuuggguaagcacacucucugagccuguuuccuuagcuguaagaaagcaggcauaagaggcugggcacgguggcucacgccuguaaucccagcacugugggagccugagguggguagaucacuugaggugaggaguuugagaccagccuggccaacauggugaaacccugucucuacuaaaaauacaaaaacuagccaggcaugguggugcaugccuguaaucccaacuacucuggaggcugaggcaggagaaucgcuaaaaucugggaagcgggcugggcacgguggcucacaccuguaaucccagcacuuuggggggccaaggcggguggaucaugaggucaggaguucgaaaccggccuggccaacauagugaaaccccgucucuacuaaaaauacaaaaacuagccaggcgugguggugggcaccuguagacccagcuacuugggaggcugcggcaggagaaucgcuugaacccugguggaguuugcagugagguugcagugagcugagauuguaccauugcacuccagccuaugugacagagcaagacugugucucaaaaaaaaaaaaaaaaaaauccgggaaccagagguugcaaugagccgagaucgugucacugcacuccagcuugggugauagagugacucugucucaaaaaaaaaaaaaaaaaaaaaaaauagaaagcaggcauacaaguaccuauguuauagauuuugugaauucgauauguaaagugccuagcagaguaccuggcaugucaaaagaguaaacuaaguguucguuauuauuauuuucuuuauuaccccugacuccugggcaacccuccaucugauugcuggcugaccuuggucuugacaccugcagggaggccacgucuugucuuccacaggucucacucugccuucuaugcccagccgcaauucuguggcagaaacuucugucaccaaccugcugugaguccuugagccccuuccccuuccucauacuccucuccauugugcccucucucugagucccuucugggggagauuugucagcaccuuuucaucugcccuucuccuggacugccuccugcccccucuccagcacauguguccccugccuccugcaggagggagaguggcaguggagcgugucuggaucugcaggugauugacacaguacgcagcggccgggaucgugaggaugcugugaugcaucaucugcucugcggaggccucuacaagccgcgccguagggugagagcaggcaggcaucaggauuuugaggggguggagguggucugaggagagcuuaagaggcaguuggcgccagcuuguuggagagcugcagaugcccagcuaaagaguguggguuucagccgggugcgauggcucaugccuguaaucucagcacuuugggaggccaagacaggcggaucacuugaggucaggaguuugagaccagccuggccaacaugguaaaaaugaaaccccaucucuacuaaaaauacaaaaauuagcugggugcgguggcacaugccuguaaucccagcuacucgggaggcugaagcaggaaaaucgcuugaacccgggaggcagagguugcaaugagcugaggucucaccacugcacuccagccuggguaacagagcaagacuccaucucaaaaaaaaaaaaaaaaaaaaaaagaguguggguuuuaucucaucaguaauaagaaaccucugcuuuguuuuuauuuuuuggagaaaggguugaccuaauacaagcacuguuuaaggauaccuucucugguagcagagugcagaucaaauuggagggggugaguugagaagcugggacagccaguugggaagauggagugaaauauuguggauuagggcugagcggugggaaagaagaggggcacguaggccuaggugauuggcucugauggugagaggaggaggagacagaguacugggggccuugagggucacuggagaaugauggagucacagacagaagcaagagcacugaggaagccuccuagaccagcuuagccuguggaaggugggcaucuguuuuaaauaauggaaguuaguccaaugcagaucaugaagcuuugcgucuggaaaggcccagcucauccaggagagagucuguugcaaccccacaagagggcagcaagccauuaccuugcaccuuucuaaaaugggaagccagcugucaccaguucuggcaguuucaacagucaaagcucuuucuacuguugaaacagaauuggccuccuuuaacuugcacccacugguccugauuugacucuucgcagcucugcagaauacaucuuccaaaauuucaagacaguucccuuucacacaggcucucuugcccucaggccagaaucucuuaccuccugguaugucuucucuggacuuaaaaaaacagcgcccagaauggaaguugcuacucuagcuguggcuggccagggaagggccuagaagcucugacaccauucuaguucuagaacuugcuauuucucuucccacagcccaagaucccuccagccuuggcucaccacccuggggccccacauuguccuuagaaucugcuaaacucccaggucuuccucaguuaauggcuggcagacccugucucacugcauccuaugggguuuuuaaaaaaccuuucuuauucaaaauuccaguagaacgaauaaaauaacucauauuuaucuaucaaccagcacugaaaaaucagugcaugaucaauucuauuacauucugcagcccuaccacaucccucccacacuuuaucuuaaaacaaacuccagacaucguaucacaucaucucaaaauauuucaguaugucucucuagguggcaagaacucuuacauccagucaguauucaauaaauaucuuuuccccgcuggauguucaaaucagggucuaaauaaguccacacuuagcauuugggaaauaugucucuucauuuaaaaaaaucuauaauaguucuuuuuccccucucuaucucccuugcuauuuauuuauugaagaagcuggauacuuucucuuggagaauugcacauuuucuagauuuugcugacuguauuccagugguguuguuuaacauguuccuccguucccuauauuuccugguuguuaaaucuagaggccugaucaaauucagggacauucaauagguaugcuauauauuuucuguggugucacaucaggaaguacauaaugauuuggugagguguguguguguguguguguguguguguguguaugugguguuuauguauaagauuggucaauggguucaguccaaucgguucauguguagucuguuuuuuaaaaaucuggaauaaguuuguguguauccuguuaaaugucaucuuauuugcuuuagcccaucaucccauuguuugguucccaugucugccaccaaaugucuccuucuuagauucauaucaucugaaaauuuguuaagccuguuaacuuuguauucauccaaauccacauaaacauguugaacaggauagagcugaggacagagcccuguggcaugcuacuaaagacuuuccuccagacugacauggaucaagcauuuuugggguaugguaacucaaccaguucugaauccacuuaguaugauaacacaauccacaauuucucauguucuucaucgaaauaucauuagagagagacagagauaucuaguuuucaguuagaaagauaagauuauaguuuaauagagagauaagggcuggagagaaauuuggaagcaaucuguaucagguuuugucaccuggcuaccacagaauccccuggggaacuuccuggcuucaccuggagauucugauucuguagucuggagugggacuaagaaucuguguucuuacuaaguuccccaggugauucaaaugcagcuggucugaugacugauguugggggaccacagaucuguaucacugggauagcuggggcagagagaauggauaaguucucugaggagaguguuucauggggcgggaggagggcuaaggauaacacugaggagugcgcaugggagaaaaggaaagagagccaaagacaaggaacccuuggagaagcaguggcagguggugccucaggccuggggcagaaagagggcuggaugcugcgcagaggccuggccagcaccuaggcagagcccacagcacuggugaccagcaagaaggcagcacuguggaguuguggacccuggaguugcauuucugguuuuuaaggaaauaguggguaggagagaaagugucagaaucaaauuauaaaaguguagcagcaaaagggagacaaugguguucaagggaagacuuucuuuaaggaggcaagggcaggagcuugaaaacagaggggagggagccaaguggugagguaaggagugaagauacaggagaguggaggaauaggaggcagcaggaacugcuggaggcaggaaggagggaacugagcaauguggaggccggggcugggcagcaaugagccuugugaaggagauggaccccuucuccccaggagagaggguaccuccuggugcauagguagaugaggagggcagauggaagacuugaagggggcucuuagaacugguucagggaagcagaaaauaugagauaaagggaccagacuugggauuugaggcaagauaagaugauuuggcaggcacugggaagcauuucaggggauuaccacuagaugaugaaaaggugcuaagcaaggaggguagaggcagaggcagucuaggugaguguguagcgggcuugguguugauaagaguuaaaaagagcauggccaggcgcaguggcucaugccuguaaucccaggacuuugggaggccaaggcaggcagaucacuugaggucaggaguucgagacuagccuggcaacauggugaaacccugucucuacuaaaaauacaaaaauuggccgggugugauggcaggcaccuguaaucccagcuacucgggaggcugaggcaggagaauugcuugaaccccagaggcggggguugcagugagcagagaucgugccauugcacuccagccugggugacaagagcaaaacuccgucucaaaaaaaagaaaaaaaaaagcagaugaugggggugauccugaauuauugggacugagaagguccagggugucaggggagauaguuaugaaaguucaaagugcagcccaggauaucauggugguucuuguagaaauggcuagauaggagauuccagcuggagaaaggauccuguguagcuagaagggggcagguaggcugggugugugggcgaagcucagauaaauggagguacaaagaaaaugucccccauguugucacaguaguagaacaagacagagggucaccuucaaaccagagagaaucgggaaaggauggcaaggguuggggaaggccagguuugggggaauaaguucugggauaaagggaagcuuuucccagggaacugagaacacagggucucuggcuggguuccuguuguauuuuuuguuuuguuuuucaauccauuguuaauucuggaaaagcugggcuggcagguccuguggugaauauguuggggcuguggccugggguucuugugggaggccaaggcauccauccucauagccaggcggggcugucauugccaguacaaagccagcugcagucgccacuucaucucagaggaugcgcaggagcggcaggacaaggaggucuuccagcagaacaugaagcggcggcuggaguccuuuaaguccaccaagcacaacaucugcuucaccaagagcaagccacgaccccgcaagacuggccgcaggaaggcaugucuucccucagggacuccucuugggagcuggaggcugacagcaagcaguuuugagcccccuaguguuaggauccagcuuagggggaaccccaguugggacaguccucaggggcuugaugacuacagcaguuuggguucccuuuuagauguuccuggagucccagaaggguaaggugagaccuucagagggggagcagccucuuggccauguggucaccugcugggaggcagcagggccgccuaccaaagaugaaaaaggcaggagaaaaggagauuccuuugaggggcaacuccaugagcuccuaagucagcccacgcugaugcauccagauuucuuacuggggcaugggucacucuugccugguuggccaagggaugguagaaccacugggacugacauaaauucccuccccugcuggguuaggaaaacuuguccuguugaccccaccagaugacaggguuggggugggaagccggggccagaggcucagguuuucuuucuugguccucagaaggaugguguggcgaaugcugaggcuacaaaugggaaacaucgaggccugggcuuucaggacacaggcaagcagggagcagugugggauugaggaugggagggaggagggaaagggcuggggcuugccagccagaauccuggaggacccgcuguagggugcauucagcaccgugaccuggggcucuuccuccagggacuugauuuccaaguuggaaauguucaaagcaguuauuagacaaugcgugacaggaggcaucugauugcuaacuauggguuacaggccccgaggacuuggaaaaugugucauggagaugggggaguuuggucugggccuuggaggauggguggacucuggggcccaguguccugucugcaaagccaauuuuguuuuguuuuuuugagacagagucucacucugacaagcuagagugcaguggugccaucucggcucacugcaaccucugccuccuggguucaagugauucuucugccucagccucccaaguagcugggauuacaugugcacgccaccacaccuggcuaauuuuuuuuuguauuuuugguagagacaggguuucgcauuguuggccuggcuggucuugaaugccuaaccucaggugauccgccugccucagcuucccaaaguguugggauuacaggugugagccaccgcaccuggcugcaaagccaguuuuguaugagcugaauguuaaugggccuuccagcaauccaagugcucauguuuccaguggaucgugggauuuggggcugaaagaagaggaugggggagcuggaaagugugguccucaugacuuccuccggggacuuagcuuccucuggucgcuuccuugggcuccgcaaugucaguucucuuccucccaaguccccaccucuuaggccagugcuugaaacagccagaggagaaagcaagugucucugccaacguguguucugccuagggagacagggagcuggcuuggggcuguguagucccaacaggcagcugccagcccaggaugccugacucugcucuugucucuguccagcugcugugauauuaaccguggagucugaggaggaggaggaggagagcgacaguucagagacagagaaggaggacgaugaggggaucaucuuuguggcucgugccaccagugagguucuccaagagggcaaggucucagguaauggcuuccucccugcccaccuccccucuggagcaagcugguuuccucucucuucacucauggccucuacuccagacaacucccuuuuccuauucacuaguuuauucaucagccagcauuugcagagccucuucuucauaccagaugcccgacauagguaauauucaacccucacaacaaccaagauggggaaacugagcuuagagagcuuaagagacuugugacuuguccagcaucacauaguagaaccagaauuugaaccugacucaucugacucccaagcccacagccuuucuuuuuuuaauuuuuaaauuuauuuuauuuuauuugagacagaguuuugcucuugucauccaggcuggagugcaguggugcgaucucagcucacugcaaccucuggcucccggguucaagcaauucuccugccucagccucccuaguagcugggauuacagacgugcacccccacgccuggcuaauuuucauauuuuuaguggagaugggguuucaccauguuggccaggcuggucuugaacuccugaccucaggugauccacccaccuuggucucccaaagugcugggauuacaggcgugagccaccaugcccggccuauucuuuucuuuuuuuuuuuuuuuuuaaaugccauucuugcauugcuauaaucuuuuuuuucuuuuucuuuuuuuuuuuugagacaggaucucacucugucacccaggcuggaucauggauugcacaauggcaugaucauggcucacugcagccuugaucuccagggcucaagugauccucccaccucagcuucccgaguaguugggacuaccggugugcacuagcacacccagcuguuguuuuuuuuuuuuuuuuuuuuuuugcuacgggguuuugcucuuguugcccaggcuggaguguaauggugugacucaggucauggcaaccucugccucucggguucaagugauucuucugccuccgccucccgaguagcugggauuacaggcaugcgccaccacacccagcuaauuuuguauuuuuaguagagauggggugucuccauguuggucaggcugguuucgaacuccugaccucaggugaucugcccuccucggccucccaaagugcugggauuacaggcaugagccaccgugcucagcacccagcugauuuuuaaaaauuguuuguagagaugagguuucacuguguugcccaggcuggucucaaacuccuggcagucuucccuccuuggccucccaaaaugcugggauugcaggugucagccaccgugcccacccacacccuuucaaggccaugcugccucccuuuguagucuagugaggaauaggagguggugagcaaaccaugggcucuguugagacccaugcccucaaguagauccccaggugaagguggcagccugaccuggaggagcagccugaauucaucaaaauggaguuauuguggacaaaaauacaguauauaagcauuuuucuguauguauagagaccuaauucacucauauuguuaguaucacuggugguuggcacccucaagugucuuuaaacauuuuuuauuauagaaaauuucaaaauauacaaugauagaacuauaaaauaaacucccaucuauccauuauccagcuucaauaauuaccuacucauagccaaucuuauuucaccuaaaccucaccuaugccccacccuccacuggguuccuuugaugcaagucucaaauaucauaucacuuuaucaauaaauacuucaguacaugucucuaaaauauaaggauucuuuuuuuuucuuucaagauggucucucucugucacccaggcuggagugcaguggugcgaucauagcucacugcagccuugaaugccccgacuuaagcaguccuuuugccuuagccucccgaguagcugggacuacaggcacacaccaucaugcccagccuuuuuuuuuuuuuuuuuucugguagagaugaggccuuguuauguugcccaggcuagucuuaaaguccugagcucaagugaucuuuacuucucagccuccuaaagugaugagaugaaaggcgugaacuaccaugcccagccagauaaggauuuuuuuuuuuuuuuuuuugaguuaggaucucucuuugacacccaagcaagagugcaguggccggaucaugacucacugcuuccucaaccucuugggcucaagccacuccacccggccucagauaaggauuccugaugcaugccucuagucaauugaccccaggaggcugaggcugcagugagcuaugaucacgccacuacacuccagccugggcaacagaacaacacucugucucuuggggaagaaaaaaggauucuuuaaaaaauauguaaccacaaugccuuucccauaucuaaaaaucugucaucaaacaucguucaaauuucccugauuauauauauauauauauauauauauauauauauauauauauauauauauauauuuuuacaguaggcuuguccaaugucccuuuuaaccuauagcagugauucuccagggggauggugguggagugauuuugcucccccaggggacauuuggcaaugcccagagacauuuuugguugucacaacuggggaggauggccuuggauggagggguagaggccagggaugcugcuaaacauccuacaaugaacaggacaacccucaccagcaaaggaguagcugucccaaaaugucaagugucaacuuugauaaacccugauccauaguuucccccaaacccccuacuuuuuuuucuucacgauguauuuacugaagaaaccugcuuauuuguccuacagucuuucucugucuggauuuuguugguugcauccccaaagugucauuuaauauguuucucugucucuuaaauuuccuuuaaaccaguaaauccacaggcaguggcucacaccuauaauuccagcacuucgggaggccaaggugugcagaucaccugaggucaggaguuugagaccagucuggccaacauggugaaaaccugucucuacuaaaaauacgaaaaaaaaaaaauuagcuaggcaugguggugggcaccuguaaucccagcuacucuggaggcugagaugggagaauagcuugaaccugagagguggagacugcagugagcugagaucgugccucuacacucuagccuaggugacagagcaagacuccaucucaaacaaacaaaaaaacaaaaaaccucgccucaucaauuauuugguuacuuugagguacaguucacccaguaaaugcuugauucuuucauuuaucaguuuucagaccaaagaauucauucccuagcagccuguaaaggugaauaccaaagguuuuuuguuuuacacuuuuuguuguuguuaucgcauuuuaauauuccaggucuuucaagagauaccauuuuacuuuuaaucauagcaucaauacauuucacacauguacucaaacagaagcuuauugggcugcucaggacuuuaucgaugaacagauacaggcuguacuguacuuuggagagcuggggugguugguggccagaggaauucucuuuccagguuuccuccuucagaaccucagauuuccuguaauucagccccgccccugcaguucugggauucuuagcucagguccccuaugccucgucauccccuuugcggcaaagcucuggccugcuguuagguuugcaugagcucacacuccugggcuuugucccaccaaagggcugugguggguacucaggcaggaugcucagcagaaaaaccuuuggccuguagccuccaggucuuucuuucccucucugguggcuggcguuucucccucgcugguuggcugggauggggcuuggcaggaggcuguuucagagaccagugcugcaguagggugaggggacuggagauggggcuuccugccuggcuccugcuuuugcuaucuucuuauuuuuuauuuuuauuuauuuuuuauauagagucucacucuuucacccaggcuggagugcaguggcgagaucucggcucauugcaaccucugccucccggguucaagugauucucuugccucagccucccgaguaccugggauuacaggcgugugccacugugcuuggcuaauuuuuguauuuuuaguagagacaggguuucaucauguuggccaggcuggucacuaacuccugagcucaggugauccaccaccuuggccucccaaagugcugggauuacggcaugagccauaagccaacuuuccuuauuuucguuucuuugaugaaaauaauguucaauuucuugagcaacuacugugugcccggcccugugcuagguguuggggauagaguggagaguaaaacaagcugugguacuucgccucagcaagacauucauccgauaaucgcaaaaauggacggcauauggaaacuguggcaugaauuuauaagaaugugcuuauacuugagauuuccacuguauugguaaugaguucauguguacucucuguccccaggaagccuugaggugugcccaagcccacgaaucauuccccccuccccaaccugugcagaaaaggagcuccccuggaagagugggcagggggaccuggcaguguacguguccucggaaaccaccaagauugugccuguggacaugcagacggguuggaaccagagcaucucaucccuggagagccuagcguccccucccuguaaccaggccccaauucugaccugccugccuccccauccacggggcacugaagagccccaggucccucuccaccuaccuucugauccacgcucuagcuucgccuucccaccgagccuggccaaggcuggccgcucucgcagugagagcagcgcugaccucccccagcagcaggagcugcagccccucaugggccacaaggaccacacccaucucagcccaggcaccgcuaccucccacuggugcauccaguucaacagaggcagccggcuguagcucaaggccucggggaggagcaggagguggaaucccugugggaagugcucccugggugauggguagagcccucgaaacuugacauggggccagaagggccuggguugaaguaguaauugggcuuccuuggagcuagucagaggggucaccuaagcugguccucacaggggccuuucucaccaccucccugcuccuaaccccugccacuuucuguuucauuaaggccucuacucuggcucaggacccaguccaggccuucuacgggcuaggcccagagacuuggguugcuggucccccuucccuaguggguuuucccggggacucuauaggcagcugcuccugcccgcaaagcaagagcaucauuccuauucuucaguggaugccagccuucccugccccaacucccuccccagcacugggucagugguguccuggcagugaggcuccgugaggggcuggcccuuagaggaacuggggugggagguggggcaggccucacccuugggcuuugcugcccuguugggucagcuacccauaguccauuuuuuuagggcagugggaaccucugccuccacuuccugcuuuagccccuucccuuugcugccagguauugggguaauauuuccuccuuuuccaagaccaaggccaagaggcugggccaggcuucaguucaggccuguugcuuaacuggggucacccugggaucugcugcucugggucuaagucuagaccuuucugauccuugggucuggguuuuuugaggaggggacauaguggccucugggcugccaugucaccaccugaacauuccccaaacagagaaggaacccagcaucucagggccacugcuccauugcucugggggcugggaugccuggcuaagcaggggcugacaggguggcaggugacuuucuagggaucagcaccugcccuguguuuuguaccuugaaccuaagauauauuaaacaucucucagauggaugggugucuuguguccaugugucaggggguucuuaggguggggggcaacaggggcaucuggugaaggaggugagaacccaacugccugccccagggauugagaauggaggggaauccuaggcaggacuauucauccuucugguccccugucaugcauuccccaauacuuuuccaauauuguccccuuagcagggguccugcagugguggucaaggggaucacuguuuuggcaucgagucacagaacuaaaagucugcaaaaugagaaaggcuagcagggaaagaccccagaggucaggugccaagcuguccugaugcagccaccacacaccuaggaccagaugagcauuucuugaaaaccuggaugcagguacaggacacaugaacagagguggccuuuugcacaugacagacaggaaggcaaucucaaggg

SEQ ID NO: 15777 - RNA, 3733 nt, Homo sapiens
auauugguacaaaaggugucuuuauugaggucuggguuaaaauuaggcacuuggccagagcagcagcuuaaauaugaggcaagcagucagggguuagccaugccuggggcuggguuggggucaugaggcuacaggcacagacuguccccagguggacagaaguuggagcaggaagaggaggaggaaggggccgcagagcagccugggucagaggccuggugggccagcccagugggacuaggcaggaagcucuggguggcagguccagcagggaggggaccaggaucucuugcuccacgugccccuuagacccaggccugagccucuggcaggggcagccgcacuuggcagggcggucuucccaagccucacuucuucaccuuggcaucguaggugccugcauucuuguaggcgcucacguagccacugucguccaggauguccugccgucccgcaaugcccuugcccuugccgcucucaucgaagcgcuccuugugggagcccguguaucugcugguguccgucagccggucuacagcacccccuguuuuugcuuucuguuuggacagaguuuccccaggggcaccugaugagggagcccagcccuucccacccacagccacgauuccccacaccccauuccguggccacccgagaccagcagggcacuuacagugacgcccacauuggcuggcucuuugccugccaccagcuggcagauggcaucgaaggccuccuccuugcucuuccccuugaaucucuuggucgccagcucuuccagggccuucuugaacuccucauaguugaugacccgagcagacuucccccugacaggcaugugggcaccaugaggguuccccuuucuuuuuucucccccaggggaaagcucaaacacauuugcugccaccacaaauuaugcaauugcguuucuuucccacguuuggggaagucgcaggggucagcaacucuggagggcaauagauauaagguuugcccuggaagaacgaccuucgugaucaugguguuucccugaccccuucuugauguccucccugguuccagccccccaguuccccaccuccugggaacaugagaagcaggggcugcuuagggcucacuugacuuuggagaagacgauguccacaucggucccugucacggacuuuccgucagccaccuugcaguccuugcacagcuuggcccaguucuugccauucaucucuugcccacuggccuuggggucaccauggauggcaaacuugcggaagcucuccuccagcccagccaugucugugcucgcugccaugccacccuauagagacccaccugggucaucucccagccaaucugcccuuccccucccccaagcccagaacaucccagccucuaccucaaaccugcaagaccugggcagguucugcuacagaguuggugcuggagcugccuggggagaggggcccgucacugucgcccugggccacagagccccaaggaagagccccgggaggcacggucuugucacuaaugccagcccuggcucucagcaggguucagcagaugaaauaaugaugcccacagggaacagaguggcacuguccagaaagacuguuagggcagcagcuggggcccuggcuuugucuggcccuggcacaaggccuugcuuggguggaagugaggguggcagagcaggcccccucccuggaagcuccaugccaagcuggcuuggggccaggccaggcugcuggucgggcaggcauucagugaggacagcaucucuguaagggucaugaggacccagcaagagccagucugggcacgggugcaugcccugggcaggggugcagcugguccagcaaggccuuguuacuauuugcuguuaaacaaaaacaugaggggagcuuggggcuggccuggccacaguuugugaagccuggagacgguugcuaagggaggguggugcugcuuggagaauguugcuaagggcaggauggugucagggcagcucagggagaagcucccagugcugaggggcugggcugggcugggaagcuggggcccacggguggggcacgccagcacucccugcgccuagggcauaaccguggcuuccuggccccuugccaccgacuggugcuguaaccucccacuguggaguuuugggggagcaggagguugggggcuaguagcgugggggcuguagaguuacgaaccccaagagucgugcuggcaaguggggcuguggcugaaacacacuucaucaugucuacaccucagaccuccccuggccacgcccugaacuuggccacaccagcccacauucccagcgacccugugcacucagcccuggccugccacccccugggccuuguaccccuggccauaccuucagcccuccauccuccaucuucacacccacagccacagcccucggccaccagcccccacauauauacuaacaagccugcgccaaccccaguaauacccacaguccagcacuaaagugccccccacacccacagcccuccgcugcagaccccuggccacacccugagccuacacagcagccuucuccauccccacacccgcagcccuggggcugaggccccuggccacaaaccugcaucccuuccugagaccccugaccauagccucagccacucacccccuccaauacccgcagcccuuuaucaaggcgcccugacccucagcaccccuuuguccacacacccucagcccucuggccacacccucagccugcacugaaggccccaguccacauccacacacuaacauuauaagacucccagguacuaugcggagauccccugcguagagaccuccccaccacaucccccuccuccacugccaccuccugaccacacccucggucucagcaaccaucuucuagcucugccuuuuacacuagggcuuccagugaccacggccugggcucugcccggcugccccaucuuccaccaaaaacuccucgccagugaccacacucccaucccuaaguggcaguuucugggacugugagcaccggugguuccuacguuacagggaccauaaccccaguccacgcugcacuccccuucccuuucccugggugcaaccucccaccagggaccccaagacccgcacuugguucaccaaggguaacguccaggggagcuuggaugccacagggugcuuggcccaagcacugggcggauccugcgugcagugcucacuccuguccguggaaagauggauucuuggucaucucagcgcggucagguggcgcuggguugcaggccgcagccccaugggucugcaggccauggauggaguggccacacccgugaacuggagccacccgucccgcucccacugggacagcuggagucaucaaucagccggaccaggaggugggggcugcgagguggaaugcuuggggccagggcagggccgcucagcuggcuccucggcugggaccgccggagguugggacccuuuccaggcugcuccccccaacccucaucgugcaggauacugauugggguggcgggcaucugggucuccuaugggcuucuaccucgcggcugcuccugaagugugcguucggaaggacagaacgacgcaggaauggaccgauggacgcgggagaccaggcggcuccgcagcuccgcucccugccggcucccgggugggacugcagcccaggcggcuccgccguauuauccccuguuucucg

SEQ ID NO: 15778 - RNA, 3733 nt, Homo sapiens
cgagaaacaggggauaauacggcggagccgccugggcugcagucccacccgggagccggcagggagcggagcugcggagccgccuggucucccgcguccaucgguccauuccugcgucguucuguccuuccgaacgcacacuucaggagcagccgcgagguagaagcccauaggagacccagaugcccgccaccccaaucaguauccugcacgaugaggguuggggggagcagccuggaaagggucccaaccuccggcggucccagccgaggagccagcugagcggcccugcccuggccccaagcauuccaccucgcagcccccaccuccugguccggcugauugaugacuccagcugucccagugggagcgggacggguggcuccaguucacggguguggccacuccauccauggccugcagacccauggggcugcggccugcaacccagcgccaccugaccgcgcugagaugaccaagaauccaucuuuccacggacaggagugagcacugcacgcaggauccgcccagugcuugggccaagcacccuguggcauccaagcuccccuggacguuacccuuggugaaccaagugcgggucuuggggucccuggugggagguugcacccagggaaagggaaggggagugcagcguggacugggguuauggucccuguaacguaggaaccaccggugcucacagucccagaaacugccacuuagggaugggaguguggucacuggcgaggaguuuuugguggaagauggggcagccgggcagagcccaggccguggucacuggaagcccuaguguaaaaggcagagcuagaagaugguugcugagaccgaggguguggucaggagguggcaguggaggagggggaugugguggggaggucucuacgcaggggaucuccgcauaguaccugggagucuuauaauguuaguguguggauguggacuggggccuucagugcaggcugaggguguggccagagggcugaggguguguggacaaaggggugcugagggucagggcgccuugauaaagggcugcggguauuggagggggugaguggcugaggcuauggucaggggucucaggaagggaugcagguuuguggccaggggccucagccccagggcugcggguguggggauggagaaggcugcuguguaggcucaggguguggccaggggucugcagcggagggcuguggguguggggggcacuuuagugcuggacuguggguauuacugggguuggcgcaggcuuguuaguauauaugugggggcugguggccgagggcuguggcugugggugugaagauggaggauggagggcugaagguauggccagggguacaaggcccaggggguggcaggccagggcugagugcacagggucgcugggaaugugggcugguguggccaaguucagggcguggccaggggaggucugagguguagacaugaugaaguguguuucagccacagccccacuugccagcacgacucuugggguucguaacucuacagcccccacgcuacuagcccccaaccuccugcucccccaaaacuccacagugggagguuacagcaccagucgguggcaaggggccaggaagccacgguuaugcccuaggcgcagggagugcuggcgugccccacccgugggccccagcuucccagcccagcccagccccucagcacugggagcuucucccugagcugcccugacaccauccugcccuuagcaacauucuccaagcagcaccacccucccuuagcaaccgucuccaggcuucacaaacuguggccaggccagccccaagcuccccucauguuuuuguuuaacagcaaauaguaacaaggccuugcuggaccagcugcaccccugcccagggcaugcacccgugcccagacuggcucuugcuggguccucaugacccuuacagagaugcuguccucacugaaugccugcccgaccagcagccuggccuggccccaagccagcuuggcauggagcuuccagggagggggccugcucugccacccucacuuccacccaagcaaggccuugugccagggccagacaaagccagggccccagcugcugcccuaacagucuuucuggacagugccacucuguucccugugggcaucauuauuucaucugcugaacccugcugagagccagggcuggcauuagugacaagaccgugccucccggggcucuuccuuggggcucuguggcccagggcgacagugacgggccccucuccccaggcagcuccagcaccaacucuguagcagaaccugcccaggucuugcagguuugagguagaggcugggauguucugggcuugggggaggggaagggcagauuggcugggagaugacccaggugggucucuauaggguggcauggcagcgagcacagacauggcugggcuggaggagagcuuccgcaaguuugccauccauggugaccccaaggccagugggcaagagaugaauggcaagaacugggccaagcugugcaaggacugcaagguggcugacggaaaguccgugacagggaccgauguggacaucgucuucuccaaagucaagugagcccuaagcagccccugcuucucauguucccaggagguggggaacuggggggcuggaaccagggaggacaucaagaaggggucagggaaacaccaugaucacgaaggucguucuuccagggcaaaccuuauaucuauugcccuccagaguugcugaccccugcgacuuccccaaacgugggaaagaaacgcaauugcauaauuugugguggcagcaaauguguuugagcuuuccccugggggagaaaaaagaaaggggaacccucauggugcccacaugccugucagggggaagucugcucgggucaucaacuaugaggaguucaagaaggcccuggaagagcuggcgaccaagagauucaaggggaagagcaaggaggaggccuucgaugccaucugccagcugguggcaggcaaagagccagccaaugugggcgucacuguaagugcccugcuggucucggguggccacggaaugggguguggggaaucguggcugugggugggaagggcugggcucccucaucaggugccccuggggaaacucuguccaaacagaaagcaaaaacagggggugcuguagaccggcugacggacaccagcagauacacgggcucccacaaggagcgcuucgaugagagcggcaagggcaagggcauugcgggacggcaggacauccuggacgacaguggcuacgugagcgccuacaagaaugcaggcaccuacgaugccaaggugaagaagugaggcuugggaagaccgcccugccaagugcggcugccccugccagaggcucaggccugggucuaaggggcacguggagcaagagauccugguccccucccugcuggaccugccacccagagcuuccugccuagucccacugggcuggcccaccaggccucugacccaggcugcucugcggccccuuccuccuccucuuccugcuccaacuucuguccaccuggggacagucugugccuguagccucaugaccccaacccagccccaggcauggcuaaccccugacugcuugccucauauuuaagcugcugcucuggccaagugccuaauuuuaacccagaccucaauaaagacaccuuuuguaccaauau

SEQ ID NO: 15779 - RNA, 6444 nt, Homo sapiens
cagagaaagcgagugucccucucgcgccccaggccgguguacccccgcacuccgcgccccggccuagaagcucucucuccccgcuccccggcccggcccccgccccgccccgccccagcccgcugggccgccauggagcgcuggccuuggccgucgggcggcgccuggcugcucguggcugcccgcgcgcugcugcagcugcugcgcucagaccugcgucugggccgcccgcugcuggcggcgcuggcgcugcuggccgcgcucgacuggcugugccagcgccugcugcccccgccggccgcacucgccgugcuggccgccgccggcuggaucgcguugucccgccuggcgcgcccgcagcgccugccgguggccacucgcgcggugcucaucaccggugagugcgcgggucgcggagcgcggggacuccaggcucgagggcgggacuggacacucaacaggacugacuccccaugggcacagccaaggcgggcuccucagcgcaagagugggagaguucuccaccccugggugcagggagcgagccaaauagggagcgccgggcaccuccccaagcccggguucacuaccugccgcugcggggaguguuggagggaaagugagacagggagugggccgguucgagaaggaaacugacugguggcugagaagagggaaccuccuggaguuugagaguuuaugccauucccuuccccaagagagcagucucaggggacuucggaggccuugagaagggaggaucguuaccccuugaacucugccugacauccccaccuaagauacccaucucccauuccucgggccagagggaagagcuuagauggggaacuuccccaccccacccaucccccacuggcugggauccuuggaguucagaaaagcuagaggucaccgugaggggcagcuggacauucagcugucuuucugucuagccacccacugccaaacugcugaggcaguaguuuggagccuacacccagcaccccacccccaagcccuccugguccucugugcccaggaaggagcucuuagagagcugggcucaggugccucuggccgccuagcugagcuccuuugucuggagcagggaauaaaucugucaccagagggagggaaggggaaggggggggggggcuggaggcccgccggaaguggggagggggagaaaggccagggggcacugacuccauugcaucgugggaggagcagccuggucucucgccaauacccacggcuuuggacaggugcuccaggcuuuguccuugcgcugggccuuugcuggggcagccagcaaccuggcuucucagagaccucggucuaguaggggcccugugugaucagauggggcugggagaauuuuccggaggaggaaauccuugaguggggccuuggagcaugaguggagauaaguggaguaugaaagggaucucggaucagagaaaggaugugggacaaaggcuuaaggcaggaguacacacggucucuguaggggacagccagucuggguguggggguggggagaaggggauaugaggugguuuccuugggaggggccaugaaucagguaagaagccagacugcugaggcagaguaggggggaaggaggcacaagggccuugcacuccagcaaagaugguagagauggggaagcauucgggcuggacaggagagacccagguuccaggcgcagugugaagccucagcagaccccaguuucagagguuugaggaaggaaaaucaacagacaccccggguaugaaguaggggccagguugugggcucugccucuggggacagggcagaucccuuccugcuuuauuugugagccaccucaacaggacccaggccaucugcagguacuaguggccuagcuggguagucuuuccugaggucucaccucaggccuuugugcugcugcuguugcuucuggccuugagccugagagagaggugagaggaaggaugcuuucucuaacuugggcuccuccaaucucugguugcaaagcugggguugggggagagaggaccacccaaccugcccuguacaagcaucaguaagacuccaaguuucccagggcccgaacacuuggggguugucucucaacacccggcuggaagacaaguagguaaccagguucagccccaccugccaagaacacuguguuuugggccuggcagagcugcuacucccccucucccuccuaagaaugcccagagaaucacuugccaaggcuacuccuggagcucagcugugggaucaggguuugggcugaggaucaggugccugugugcacacaugugcacaugugugugccaaugggugguagggauugagcccguugugagaacauccagccagguuggaaguguguacagguaucugagggugugcacgugagcaagagggugugcaagaugugggugacuguugggaccacagagcugaggccuguggucagcucaggucagaacugggaggucuguuucccuugggaggaccugucugcucugagggggacccggacaagugcacauaugcaugugugugucuacacacacacacacacacacacacacacacacacacacacauaugcuugccucccucuccaaggcagacuugccugggaaguaccccuccucagcaggagcucgaagaccccugcccagugcuguuuucaguagagggaguggagcugagauggggagaccguacugagcgguccaggaguagggaaacagagcugcuuugcagcuucuguuccagaagauggggguuggggggcgggguugagggccaggggugggagcaggagcagaacagaaagccucccugcucacuggccuuuccccuucccucacuggcugcccauggagccaggaucagcaugggaacaaucaaggaggcaggggcuuaucaguacuauggaccccuacacuggcucugccuggugguucuucucuucgcauaccaaagacagaaauuaagccuccaagagugguaacugaccucggucacacuuggugggugugggaaaggauucaaauguaggucuguucucuucuucaucuaucauggucccuguccuggaggcaagucgucuggggcucagaaaacaccccuguugccacugauuggaauuccaagggucugggugaaguggggaugggccuccagcuugccuccagccugaaaaaauaguagaggguguugaggcugggaagggagguggggcucauguuguacagggccugagccagggagcuugggcuucauucugaguacuguggcagcccugggaagguuuguagcacagagggauauugucauuuuuggaaagaucccuuuggcugcuuagguagagaagggcuucaagagggcaggaagggacaggacuacagaaggggcugcuucagaguccagauuaaggaaggagaggccugggcagucagaaaggaagagaagccggaugugguggcuuguaucuucaaucccagcacuuugagaggccaaggugggaggaucacuugagcccaggaguucaaaaccagcuugggcaacauagugagacucccaucucuccaaaaaaauuuaaaaaccagccagguagacugggcgcaguggcucacgccuguaaucccagaacuuugggaggccgaggcaggcagaucacgaggucaagaguuagagaccagccugaccaacauggugaaaccccgucucuacuaaaaauacaaaacuuagccaggccuguggugaugcgcaccuguagucucagcuacucaggaggcugaggcaggagaaucgcuugaacccgggaggcagagguugcacugagcugagaucacgccacugcacuccagccugggcaacagagugagacuccgucucaaacaaaaaaaaaaaaaaagaaaaaaccagccaggcguggugacacaggccuguagucccagcuacucaggagaccgaggaggaaggaaugcuugggcccaggaggggagguugcagugagccaagaucaugccacugcacuccagccugggcaacagagcgagacccugucucaaaaaaaaaaaaaaaaaaaagagaaagggaggcuccuacuaauacugugccugugccugugagcuguggccugaaaucaagaaagcagaaccacacuggggccugggacugucccagaccugaccugugugaauuugggaagcaacuuagcauuacuaggccuuaguuuccucuucuguaagccacauuagugggguagccacggggagucaggcagaugacagcugucacagaguuacugcccagggcucagcuagagggacacagccugccagggaugggccuagggaaggaguuaggguuguugacugcugguggcuugguuugcaggggccuggaucccauccagacccuggugauucugggguugucucaggcuaggcugggccacaguggaaguucacugacugcccuggccuggccaggcugugacucugguuuuggcaaggagacggccaagaaacuggacuccaugggcuucacggugcuggccaccguauuggaguugaacagccccggugccaucgagcugcguaccugcugcuccccucgccuaaggcugcugcagauggaccugaccaaaccaggagacauuagccgcgugcuagaguucaccaaggcccacaccaccagcaccggucaguggcaaguguccaccaggcaagggcguggcaggggagugggaaggacacggggacuggaaguuugcugcugggcugaccuaaggcuucccuccucugcucugugaccccaggccuguggggccucgucaacaacgcaggccacaaugaaguaguugcugaugcggagcugucuccaguggccacuuuccguagcugcauggaggugaauuucuuuggcgcgcucgagcugaccaagggccuccugccccugcugcgcagcucaaggggccgcaucgugacuguggggagcccagcgggugagugcccccccccacuggagcaaaaaggagcccccuggggugggggagggcuuagggagccccuugccaaagcugagcugccccacucccaauccauccgcaggggacaugccauauccgugcuugggggccuauggaaccuccaaagcggccguggcgcuacucauggacacauucagcugugaacuccuucccuggggggucaaggucagcaucauccagccuggcugcuucaagacaggugggaaucagggcugggggugggguggggguggggaauggggcugggaauggucuuaugggggcaggucagguuugaugaauggucaugguuuugguuggggguguaguuuuggcugcagaccuggcgcggguuaaacaguccuaauuggcuuuggcuccccuagcugaucccacucugaccuugccacuccuuccccagagucagugagaaacgugggucagugggaaaagcgcaagcaauugcugcuggccaaccugccucaagagcugcugcaggccuacggcaaggacuacaucgagcacuugcaugggcaguuccugcacucgcuacgccuggccauguccgaccucaccccaguuguagaugccaucacagaugcgcugcuggcagcucggccccgccgccgcuauuaccccggccagggccuggggcucauguacuucauccacuacuaccugccugaaggccugcggcgccgcuuccugcaggccuucuucaucagucacugucugccucgagcacugcagccuggccagccuggcacuaccccaccacaggacgcagcccaggacccaaaccugagccccggcccuuccccagcaguggcucggugagccaugugcaccuauggcccagccacugcagcacaggaggcuccgugagcccuugguuccuccccgaaaacccccagcauuacgaucccccaaguguccuggacccuggccuaaagaaucccacccccacuucaugcccacugccgaugcccaauccaggcccggugaggccaagguuucccagugagccucugcgccucuccacuguuucaugagcccaaacacccuccuggcacaacgcucuacccugcagcuuggagaacuccgcuggauggggagucucaugcaagacuucacugcagccuuucacaggacucugcagauagugccucugcaaacuaaggagugacuagguggguuggggacccccucaggauuguuucucggcaccagugccucagugcugcaauugagggcuaaaucccaagugucucuugacuggcucaagaauuagggccccaacuacacacccccaagccacagggaagcauguacuguacuucccaauugccacauuuuaaauaaagacaaauuuuuauuucuucuaaaaugcggca

SEQ ID NO: 15780 - RNA, 43252 nt, Homo sapiens
ggccuuagagagggcaguuuuauugucucagaggggcagggcugagggagggagcugaggagcaacauccccccaggccccaaggacacacacacucuguccuucccaugggccauggcucugggagcgacccacagaagggagaggaggcucaaacugcccccaggccccaggguucucaggucagggaguuagggaggaacaugaaagugacaugcuucuuagauacaucagcggcuguaaccacagggcugagggggccuccuugcucuggagggggucuucguccauccuuggugggggggggugcccagccccuuuucaggccuaagaacagucucuaagagggucaggagaacugggcagccgcuaggacagcguacuacaccccggacaggcaggugagccacaggcuugucacagaccacauacacacacacgcacacacacgcgcacacacacacacacacacacaaagagugcaauugagagccuugggccaggacgcuagaagauagggauguaguugucgauuuuggcgcgguggcgcugggcgauacauucagcgauccacacgauguugcgacacuccugcuccuugagcuucacgaaggcauagaagacaccaaaguggaacugguucaggaaggccaacuuguucagcuuuaccuguggacacgggcagaugugguguccagguggccauggccacagagucaggucuaaaccaccagguuggccucccucugacaagcagacccugcagacucaccucgugcucaaagaaucgguccuccagcgucuugucuccaggguugcuaccugcacccucgaagagcagcuuguacuccuggccagggggguggggggaagcacaagcaugaggguucugggugggggugcuuggugacaacacauccaaccgcuguccugccagccggggcacucaccggguaguaaucggccacguucuugaccuguucauagucgucagcccgagccagcugcgccaggcccucaggguagagccgcccacaguguggaaagagcuuggcacgguccucuuuggacagcucugugccgaaagaauugauggugaugaugaaggcgcggcggucugcuucaaacuguggagccagugcacagguaagaagagagggaggaagaaggaggcaguagccagucaguuggcagagccuccccaggccagggcuagcgggcaccagcaggcaggagggcgggcaggcacucaccuccaggauggggcacauggcaucagccguagucccgcccaguagggugcagaacuuguagaaggacuccagguaggccuguagagaguauggagcuugcucagcacaggcaaggaagcucuggagggcuugcuaggcacaagcccucacagcucccuccuccccucccuagccccuuucaagguggguacaagcacacccauggaugggccggggcagcccuuacagcaaagccaaugaaacacuucugugaaucagccaaguggcagcugcccacagccucccacccaggagugccagggcagggcccacccgacugucugcuucaggcuacagucuccuucacccccucaccucacagaaggcugggcucgcagggguccucugacuuuccccugcugcucugccuuccuuuuccccaaaucuuuccaaaccuccccuuccucagccucugaaaaccagguguggcuggacgcaguggcucacgccuguaaucccagcacuuugggaggccaaggcagguggaucacgaggucaguucaagaccagccuggucaagauggugaaaccccgucucuacuaaaaauacaaaaaauuuagccaggcaugguggugggugccuguaaucccagcuacucgggagacugaggcagagaauugcuugaacccgggaggcggagguugcagugaacugagaucaugccacugcacuccagccugggcgauagaaagagacuccgucucagaaaagaauaaaaaaacagguguccguaggcuggugaggaaaggccacgccugaaaguccacagggauggcagggacugagugcccccggcccucucugccaccuucccuuacagaacaccuccuccucccauccuccaggcagccccucagcaucacagagcaggaacaaaauugucaggccaguuccugcugagggaugguuauugccuacacggacgucagcugggcacaguacaauggcaggcacaugggcugccggcgggaacaagcacucccugcccaggcaaauuggaucugcugggcaugaggaaagaagaggucagcccaggccccaggucccucccaacgcucacucacaaaagcagccaugcuuccucccaacaccucuccaugccaaggaagguggaugaucuuacgggccccauggggagcucccuuguaauggccacccuccacucagaccucccuggucccaucugcuggcaugggcucagagacccuggcuccacaggcuagagacuauucuucuagauuguaggcaaggguuggauggcauggaaagcuuuucauaccgaggucugaacuccaagguguggagaccuuuccaccaaccaucagccaacuugggcucacaagcucugcuggguggugcuccaagagagaugagaugagacccaggagucugugagcccaggccugcccuggccagcaaugcugggcaagcccaacucaggggaaggccugagagugaccucugggaucacgggaaacaaaaaucuaggacaggucaggaaguaagaagccuggaaaagaggguugaccccagcacagaggaucccaggaaugagagggccuggguggcagagacagcugccaaccccucccauggcuuggugguaccuuucacagucccucuaggggucuguccccagccaccuccuucccuguggccagccaagcuggauaugucaaaaaucccacagccugccccaguggggcccugcacuuccuauuugugggggaaccaaccaaccagguauugggcuccaugcccugcuacccacccaauugcuuagccaaucuguaccaaucccaggagaggcugaucccagggucagggaggcuggugggacucuccucuggaggcuagggcagcuaaagaaacuggcaagaucccagcaaccccgguaccaaagucaccuucccacccccgcccuguccccuggagucugccaauccacggcugcugcaccagcugccuacuguucccaccugcugggugguugaggguccgccuaaucucccaucuguggucaccgggcugggacaucgccugacaggcuggcaguccuggcacaaggcccacagcauugggucuguguuuaugagcuagugccugggcagcccucgccggcgacuccagcuagaaccagucaggcccggugagggcaugggugaggcuggcggacagccgcaccccucacccugucucagggcaggcaacccggcaacaggccagcuaggcgcgugcguacacacacacacacaaacacacacguguguaugcucucucuccucucagcuaacuggcuggccugugcccuauuagcggagugggugagagcacucacuuuugcaaacaagcugagccaggugugaucccuggcgcugccagugacuuauuauguggcuuuaggcaacccacccuacuucucugagccuucgguuuccccauuuucacauggggauaaugacaccuuccuaguuccuagcgcagucugaaggauuaaagaagcugacgaccuucccaccucugguuucaggcccucuaaucugcucuccacauuguggcuagaaggggcuuucugagaagacucugcucuguuggaaaccucuacuggcugacccugcccacgggacuauguucaaacuucuggccuuacauucaaagcccuggguaacuugaucccaugccugccuuuucuucuagacuucuccccuguccaucuggaauguguccuuccacagcaaacugccugccacuuggcccaugcucuaugcuuuccuucugcacgugcuggucccuugccgacaccacugcaaccuccaggcaggcccuuccccuaccaccaacccucacugugcucuggcccaggccccugcagggagauuggcaggccugggcucaggcugcagccaaaugucagccagcucgcuccaaccagggcaggagaggacucucacccaauagacaggugaggucagcaggucccucggccagggccauccucagcccugcuuuggggccugcccacugcggauccauguuccugacugcagcccaucugggguccuggcgcuauagcucagugccucaccgcagccagagcagagucuaucccagacaccccuaaccuaacuggucucgggcuuuuuuuuuuuuuuuuuaaauuuuuaaacuuuccucuccucuccgguccccuggcucuuuaaucucuuugggccaggguagugcugacccagaaauccucagggguugcccagucuaugcuacagccuggugggaggcaagaggugggcaggggaugaggacagugggaaguggcacugacuccaagcuugggaaccuacgagggacaugaggaccuagcuaugccucgccagaucccuccccccaccauaagugagcacacuguugccuuugcucaagugccuguccuugcuggcaauagcuuagguagggcgguuccaggggccacggccugggugguaguccaugacccuccuggaugcugggggagcggcuguccaggagccagcuguaacaggccagcgguggagcaccagccacuccugcugauuuuaucugagcccgucacaggcacuaugggauggagaaccuguuccacacagccuugugcccagcaugggagccagagaauaagcaguaagucccugggauaggagccugacauagcugcauccugucccagcaccucacauaaaucaccacccuaccacuucccacagccccacccaccgacaggccaaucccccauggcuuguguggggcauuaccuuguagaggguguugcggaugaucucgauguucaucucgucaagguccugcucugaaaugcaguccuggaaaaaagccgcuggggaggaaacaugguuugaggggugggcagguggccuaggccagaauccugauguucaaaugcccuacacggcacagagugcccgugccacaaggcccacagggcuggguauugagggguccccagccuaggcuguugccuuggaaguggcagaagcaaugcucugggccauguacacugaccugagcuucuccugccuccuugcuccuaaaauugauuuauaaaggaggcagcuagccauaacaugaucuaaucaccgcuggggcagacccaagcucagaccaugccaaagacaggcuugcauaagaggccaugacauccucccuucuggaggggcagcuguggauucggggccuaacgccuacuucucuacaccucccaggaaggccuggcguccacauuuggaaaaccagccuccuccuuaggacaaguccaacagcaggguaggcacagaccagcgacccagggggccacugugggguuggaaagagaggccagagcaggauagagcacccccaucccccaagagggccugcagacucacuggucuaucucuucauuaaagauggagaaacugaagaagccacaaacagcccagaaccagcucagaguugcugggagagccuacggcagacaaggucagcagguagggcucaggccucuuagcucagaacccagugcagcuuagagcccuguaguucaacccugguggcuucuuagaggugguaccccaggcccaggacucuggcuacaaggacacuuaaugccuucuccucggccuccuaagcaggcaggaacuagcacugccuaagcagggcucugcaggaagcucuugauuccccuucccuggcuucugauacggaccuugcauccugcuggaugcugucugaccuggcccaggggaccugcucgguggagggaaguggcaguguuugcuucgcuccuugccucacaggcagccacucuggcuuuacucaggcuccagcuccgggccacagucugucagagcucucgggacuccaagggacuugggccucucucacucuucuccaugagcucagcccuccucugcacucugggagaucagacugcuucacaaagugagacagucccagucaggcccuggguagccugccuggcccagcaaaagcaacaggacaggagcagaagaggggugaagugaggagagaaucggaggaggaaguugaagggagacaaagguaagcagcagugggcaggucucacuuucuggcucagggucgccccccagcggguccacaaaccccacccugaugcgcugaugcugacaccacugcccaccucccaugaccaccacagcggcucaccaagaggcguguccaccagaauggcauuguagagcucagcaggugucugagcaauguucacggccuccaucugcucgaagcugccuaguggguggcacuugggcacgagcucagcgauggagcgcuggugcagcgugccugugaugagcaggaucacguugucgaucauguaacuguaacuacagggggcaggcaauagcaaggagcccaucaaggugggggccgggaaguccuggcauagcaccaugcccucgcccgccugcacaggccaucaccccuuaacaauguaugcugacucaugggugcugcggauaagcaccagugucuccucucccuccccauguuccucucaagcuucugaccacccccacugccagaggccuaggacagacacaggccccccaaacgggcgggggcaggggauucaugcccugugagggacugggacacgagcuaacuaccccacagcaugaacaguguucuaacaggacacaggaauggggcacaggaggugagacaugcagcccagcccagggggugaagagcgugagagccugggaaauuaaagggcugggagaagaaaguguguucugggaagagggaacagcaugugcaaaggccuggaggcacucacugagugacggaugcauuggaggaacuggcauggucaggacuggcagagggagagaaaggcgcagcagccggcagcacggggcugcagcaggcggggggcagaggcugggccuggagggcccuggcuuuguuuugagcacuagggaucuaugagcaggguguaagcaggggaaucgccauccaguuagggucacucugucccccaguggggacagaagaggaagaggcagagauagcgacaggaggaaaggcugaggaguggaguggagagaagcuucuccagggaaggccagcaaggagccaguggggguucucuggaaugaaggcccaggucaggcagaccugcacagccuaugccagagauagagaacuguccucuucuuuuagggccugaggccagggcugggcauucacccaggacggccuggauaagacccagagaccugaacaggaggcugggucaggucgaucccaggccgaggcucccaucacucugcccugcagaaggccagcucugugggguacaugggcagcagagggggcuguggagcuggggaggggugagacugcccaguucagacuuggcaagggacaaggcucugccuccaaccagcuacaaaggggcuggggcagagaguucuguguagucaccuguguggggaugcagugaaggcaguaagccccauuccacaguuaggcugcaguagccacaacuauccuccagucugucaccaaagaugaacucaggguaugagggagcuaaaugaggccuaggggaaauuccuccaaggucaaggugaggcaccuaugggauaaaaguugggguggaggcugcuguucugagcugggcacugaacacgggucuuguccuagcuucugagugggccagagcuaggccccugcccugugacaggaccuugugcaacuagugcucaggcuguccagagaagaccuugguaggaggugucuucccccauacugaagaaagaaaggaggggagguggcagcccagggcccaggccacggcucaaagcacuggccacugggggagcucccacagggcccucuagaaaggcggcaggaggaaaaggccccagcuccuguccuggccugacccccacucccccugcuugcucugcacucccccagcucccacccagccuggcgcccugcgaagaccuuugcucuccugggccuggagccaggcaacugcccucucuccacccccaaucuggcugggucagcuacaggaugugcacugagaagagacaguccccuaacucccaaccauaacugagagccuuaagcagggcccacuugcagcugcaagccaagaggcccaaaugggcagccuccugcccccaaccccacagugcuggcagagugagggaccucagagcucgccagagcuuugggccauggucugcagcuccagccugcauauuuucuaccccggacagcacacacgccuccugccuaugaggccuccaacaucucacauaccccagaacccaugcugcauaugcgccaccccgcaauacucuaacugcaccccauccagccccaauguagccuuggugcucccugagacagucacaaauccccugcccccaagcagaaggaugcuuucuuaugcucucccucccuuucggacgggaagagggagaaaaagcacacccaaggcccaccuuauccaagugaucccacaaccacuagcauuaccagccccacugucagagcagauaaggcccagagagggccagcaccaggcccuaacacaccacaaagcagaggagcuccacguccccauggccaauguccacacaccuccacccaugaccagggcccccugccuggcucuacauaccccaccuagucucauuuucucagagggauccccaccagccaaucuccucuuuuucaacgucccccuccuugcgccccccacucagggcaucuguuuaugugggggaaaugcugagccuaguaagggccacucacaaucgcacuaccccagccccuucaaggcccucuucaaacccaagccaggccaaucgugggcgauccugugccaggcccagcacuucccuugccgggcuggcuauaagcuuguugcugcugcagcccugcuuuucucuccugcccagugaggggcagaauccucuuuuucaggagaugagaggcuggacaggccuggcagagauaaggcuggcccagcagucugccuuucucccaaggccgaggccuucggcaggcagggaaauccuccucuuccuccuugccuggcuucagcagcugccucccugcccccagaaagccacuccaccauuccuccccucauuuggccucaauaggagggaauaagguuccagcuggucagcaucucccuccaggggaagacagcuggggaguggagggccggcugcccgccaggccaaagaggcccuugugggguggggguggggccgucuguauuccucugcccagaggcccucccuugcccugugccuucaaaacucagcuugggcccacagacaucuuggguuggaguuuaggaagccacuuccuccaagaagccuucagagucccuagccaacucugccccucugcugcgcccuuuggugccaccugcuggaacaauauggcuucucaaccccggguggcuggucuggugcuggugaggcagccaugaugccuggguaacccugccagccuguccacugcaguccccagcaggugcuccagugagcugcuaaugacaguaucuguauucaaucacuucuggguccugaagagcccugugcagaguggaaagugaacagaaauaucacuguuucugagcucuguccauggccucagcacaccaccucucgagacuuaguuucuccuccauaucaagaugagugagggccaggcaugguggcucacaccaguaaucccagcacuuugggaggcagaggugggaggcucucuuagcucaggaguuugaggccagccugggcaacauagcaagaccucauuucuauuaaaaaaucaaaaaaauuagccaggugugguggcaugcacuuguaauaccagacacuugggaggcugaggcaggaggaucacuugagcccaggagaucaaggcugcaggugagcuaugaucaugccacugcacuccagccugggcaacagagcaagauccuaucucaaaaaauaaaauaaauagaagaugagggugggugcuguggcucaugccuguuaucccagcacuuugggaggccgaggagggcggaucacuugaggccaggaguuugagaccacccuggccaacauggugaaauccugucucuauuaaaaauacaaaaauuagucgggugugguggcgcacaccuguaaucccagcugcucuggaggcugaggcaggagacucacuugaaccugggaugcggagcuugcagugagccgagaacgugccacuacauucuggccugugcgacagagugagacuccagcucaaaaaaaaaaaaaaaaaaagcauaugagugagguguggcuccaacagagauagugagcuuuaaccugcucauaaaaguccugccucuccccaaggcccaguuggguccuuccaccuggucugagccuucugggccucacggagcuccugcaugcuugaccccaggagaagagugaaagugcuggcacuccuucaaggcaggagccaggucuagcccaggacccugaaaccacagcaggccuacagcccccaacugcagaguccugccauggacccagaaacagugacuguagauagcaaagacaggaacuggccaggggagugggggccagaggaaccugaugucccucugugaccaagcagggccccaagguuggggugacagguccuggagaaaaucacagaugugcugacaggcccauuaggcauuugaggccacuguccugggacaaagccucuuaccaguugcccacuccaggcugguggcacugaggccccugacacaagagaaauaugggcccucagaucccccagguggugcagguuacccaugcccaggcucugccaaugggcaccugggcuaggcccccuccagggaggcucacucauucaaagacaaaggccuuuaaagcccaccugggacuccccagaggccgcacucacuccucccacaagucucucagcaugucuucuaggaccaacucucucaagggaaaacaucauggaauggcccagaucaaaguccccuccaaggccaaaaaacccugacagacaccaucccaagucccacagcaagguaaugacugggcuugggcauggugacauaacaacauguuaguggcaugaaacugagccagauccucucaagagcacaugacgacagucuacuucaggggcccuaucucacucaggcugucggccccaugccagacagcugccucaugccagacagcugccucuucuccagccaccuacucucuccaguggcuucucuauccccaccugauccuggaguccucccaaugcugugaagccaccugugacccccaguuccauuugcuaaagcugcucacaguccucuccaggcacugucuauacuaucacuggugccaucccacugcauccaggcaccucccucccagccccaggccuggcccagagcagguacugguuaugugugcggcugaaggcuggccaggaccuacgaaagcaguggacacugucucucacacagaagggcagaggcagccucagccagcuccugcuuucaucaccuccuggcagaagccugcuccagccagccuggggcagcuccaaaagcaacuaugaggcccugagggauggagcuaaggugaccucuguaauggucccaaccucugucccuagcugggccaacuuugucugugggcagucagggcacuguucccucaggucuucacacccaggacagggccucucgcugaugcuucuacugccuggaggacuguacucuccugaguauauuccucugcguuuucuaggguagcuuccucauucccagagugggcacccauaucuggaggcuguuguguggggcacagagccaggugcaccaugcucgcuacucaggacauguauaguucccucaaccuaaaaacccccuauuccaaugcuucccuuaaaugcuuuuccccucagccaaacuagccaccuccucagggaagccaaucgugagccccagccugggggagcucaggccucuauggaaggcuucaccccuuccugcaacacuccacacacacacuggggauggccugcuggggcagagcggagaagggagaguggccagagagguaggaguuaagucagagaggcaucaugggagcaaagaaauagcuaggggggcugggggguggacaccgcagaguggucacgccuggagaccuuggcuacgugaaggucagggguggcuuuagccagggccuugugguggagugacgggacuguugaaagcucgagggaugaggggaaaugagagaacagacagugaauguaaaaguuuaggucccacgagauguuuuuuaauuauuugagcuugcuuagauacugaagagaagaauucggaagggaaggugccugcacagacaggaaugcaaaugaguggccacucagcauccagggaguaaggugagggcacucagaacauugguggaaggauccaagagaaaaggaagggcacuucugccauuggaauaggguucgggcgguggggggcagaagcagcacugggaggcauauuauuggcuuccacugucuuugugaagaaggugggccaccugcccaagaggaggcugggggcaggagagcaaugguguuuaagacgggaagguggucuuugcagugcugguggggucugcagggugcugaguagguagagccagaggcugccaggcagaaaaaagcuugaggcuggcuaagagggugagcaugcaagccuggcagcaaggaugaccccccacucaaggcuggcuuccccagcuuuccucccggcaguggagguagggggagagcggcuccaggcuggaggcugcugggauuccuccagggcuggggggcugccagccgggugggaccaugagucgggcggccaagagagcugcggauguuggcagaaaagugcucgaaugauggaccagggaacuucaguuggggagggcgggaaaugaagacagaagggguagcaggggaggaagcaaggccuagugucccgcugagucuggaacccgugucccacaagggacugagagugggcuggagggccugaaggcuguggguagagaggugccugauucagcaauuucagggguggagcaguuccagguggugacaugggccugggcagccaucaguggggauggcugaagugcagagcagaggagcaaaggagcaggucauuggagaugacgaggucauggaccaagcagacacaggcccugaugggcugacacgugacugcugagcuccuucugagugaggggaggagugaguggcugguaggacuggaagccacaaucacccaugaauggaaggggugggaaguggcagauucggacagccuuccacaggacagcacuuggcugcuuuaagcacccuuggugcuugcagccaaccuccagcugugguugugcagccucagucacgcucagagcccucuccaguuucauggccuggcaggcuaagaccaagacaggccaaaggcuagcugcacaggcaggugggccagugggcaguggggugggugauaucuacccucugaccaugggcauggggucaggccuccucuggccagccuagcuggcaaggccagaacauucaccaggaagcugaagcagccuugugcaaacaagucucaggcugggcucuagcaauaaauguacugcuuccugguauguccucagcucuggcuuugcagcaaggaacacagagaccaaggccagggaaugaucaacagauggggagcugcaaugugaccccuaauguagcaccacaagagacaccccauuaccagccuccugccccaguagguccauguuggcauaccuugauggaggccagggcagcaaggagacucucaggaaaggaggccuguggccaggagagggccugcuuccuagcuugggcauguucccuggcccuucaggugucccagccucugacuccugccugagaauggagcccuuuggcugcagcacuucuugagcaaguggauccugggcaaguggcuccuaacugcaggggauaagaaucaggccaggcagcaggcaucuaacucugucccugcagggacaaguggggcaggugugccaggucccaaggaaaagagugggggcaccauaaucaaggaaugguaaaaguuagacaauacccagagagcucagggaaaugcuucaccauacugcacacucacacucugccaaugcaggguacucuccuagacgcuagccgcugagcaugccucugcucaccaccccuguggggccaccaccuaggcugggacuauuucuuuguccaccaggacuuggcucauggcucuugggacaucccugcaaagggacccucccuaccucccugugcaguccaggugcccuccccgugcaguccaggugcccuccccgagccugcagaucccaagguccuuuccuccacucagcuucuccaggagcuugaugaaggcagagcugugcccaagggucagacaaugaagaagcuggggcagccaagagucauaagaaugggagccugcccaccugaguuccugagggcuugcgucagaacugagaaaggcagcuagacguucagccugccccucaacucuacuccgaaccaaucucccugagacccagggccauggucagagcagauagagaaugggccuauccuaagaccuuggccuuucagagcucuguccaucccgacaccugaccccucgcauggggaguggggccuggugaguguucuguuugggugcuguaggguaagaaaaagggcucccaccuucccagguuucccugccccagucuaugugacugggggaagaggcuucauccagcacuacugcgugggacacucuugccugcccaucauaucuucagccaguagugaacgugcuggugacccauuucauaggugguggccuggaaguccaggguuguugaaugaccacgcacacagucagggaggacucugaagguaggguccugggacaccuggccugacagagcugccaucagcucugacagcugacacaggcacgaaggcagcuagccuaagccacacugaacccagcuccugcagguguagcuauccugcccagguaagagaagaaggcgcuacaaagcacacucacguaaugaagucuaggaagcuggcgaguggcucauaggcaugguuccucauguggcggaacuccaccaccaucuucuccuugagccggucaucgaugacugacaccgucagaggugaugccucguuggccaggaaguuaccauaaucagugcucugcagaugcaguuucaagucugaaacccaaggguaggggguaagggcuagccuugcugggccuccccaagggucccaaguccccauccccaccccaacucagccccagcucuccccugcaguugugucccgcuacuacccugaucuccaucucccuguuggcucagggccuaccacagggcaaucagcuaaggcccuggagaugcaccagaucuuugggccacaauccagcacauggagccccaaaguucgagcauaagaggaacaguuccuccccaagaugacaagaaagccugggaaauuccaagguccaauccacaacccacagccuuugaagcccuucuguauguuaagcuguaggcuggcccuaaucuagagcaggguaagucaugagcccugcacuccagggccucagggucagaggggcaagccaacacaccccgaggcacaugaaauacaagagaugccugaagcugugggaguggaguggagagggcaccaaagaucagacugagaagaugagaaggccacaaaaggcugggccacagcaaagggcaggggcaagaaaguacaaaggaaacagccaggaggauggugugagugacaaguggccugcagggcaaaugaguggcaugcgggggaggugaggcuggcaggaaagacugagcgucccuucagaguggccggagacaggcagaccaauccugaggguucucuugagcauucagagaugggguaagggaaaaggaaggagaggcagagcagaagggcccgggggaagcaggccaagggagaggcagugggauccugaugagaaccuaacaacagucucccagaguguuuuguuuuuguuuuuguuuuuuguuuguuuguuuuuuuuuuuagagauggcaucuugcuagguucccaggcugaacuugaacuccuagucucaagugauccucuggccucagccucccaaguggcugggacuacaggcaugugccagccagagugaucuuuuuaaaacacaaggcagaccaugccauucauuggccuuaaacucuccgcuacuccuacuuuacucagaaagagucccuuccagagcccucaugugguggucccaccauccccgcuuaaccucucugacuuagguccugccauucccccaugcucacuauccccagccauguccccaccucagggcccuuccccguccccuggccugaaaguggagcugucucccccucuuccuucagaucuuuccucacacgcccccucuucagaggcuucuccagcagcccaucacugucccuuguguuauucuucuuagcaguacuuaucccaccugauacaggacacagaagcucccuggggacaguaccaaggacaguggcugagaagauacccaggcacaugguggcggaggcuggcuuggaagacuacaugccucucuguccccuggggaggcugcccaggggaucaaaggcggagcugcacuugggaccaccuccacacgcuguccuggccacggccuccccagaugucuuugaggcucaggagaccaugcuagccuggguuguuuagagaagaagggaaguggggcacauaaacccucuacaagcuuaggggaccccugugaugccccuccugcuguacuccaucaggagaagacagccccaaccuggagucaggcgagcuaaaggagagauggaacacagcauguuggaauacagcaggucucuggaauagaugccuuccaccugcaucucuggggggcugguagcaggccacacucaugaccucuguggcuccugggcacucauggagugaacuucaaccuccugaggccugcaggagacaccugcugccuucaccauuacucugcaauugaccacuacuuuucucccauggccacccaaaagggcauagaagagaaagucaggcagggcaggcagaagccaccagccccuguucugcucuguggaccccaaugccuuuuugccugggaaaugugcacucuccuacauccuuaccccaggccgucugcaaugaacccuugcccugagaucucuucucccacauccucaccacaucuaaccaagccccagcuacuccuagaguaaggcaugggugagaaaagaugcuuugcucaguaaacuugggugguugcauuauuucauuacccauuugguuguuaacuguucuuaacuguaauugauggucauugcugaaauaauauauugccuguauuucuaccucuagaaauggguuucaugugcuagauuuuaauauccuugagcuugggcaaguaugcaagccuuuuuuuuuuuuuuuucugagauggaaucuugcucuguugcccaggcuggagugcaguggcacaaucucggcucacugcaaccucugccucccggguuuaaacgauucuccugccucagccucccgaguagcugggacuaaaggugcaugccaccaugccuggcuaauuuuuuuuuauuuuuaguagagacgggguuucacuauguuggccaggcuggucucgaacuccugaccucagccuccaccugccucagccucccaaagugcugcgauuacaggcgugaaccacgugugcaagucuuuuuaagagaaacaugguuuauuuguacaaaacugagagauuguuaaugccccugaugugguuuuuguggaugugaaaugguaagaauauuaacugguuccucuuacugugguauuaaaaugaagccuucuuaauuuaucaaagucauguucaugcucugauuuuauauacuugggguucuggcccaggcccagcaagugcugaaaucuccacuaggggaagcugcagagcggauggcagcugggagccaagacuggaauacaguucucugggucagacccaggcacuggugcggcagcugccagaccaaaccugucugcuuauucacacagccacugcagccagccaagagcccuucucaggccaggagacuucuuccuuuucagcuauagccugggccuagaggccgggccagauguacagggugagcuccagagaaaaacucaguccuuugggugguggcacuccugccagugacuccacuauucccugggacugggagucuggaccccggucuggccuccugaucccuccccuccaaagcaucaggggcugggccucacccgggcaucuguguacacacugcucuuccaggcccuggcacaagcugcugggaggcuuccccgagugagcugucaccuccuacucaggauccucaugagcucucaagcagcaugaaacuuccucugcuccagccucccacuuugcuccacauggcuucucucccuagcucagcaacuuccccacugccaagcaccuuuccccucccuaggccuccaugacucucuauccaacaccugggacuggccaggggggaguccccucaucccaacaugaagcgggcaacccagaucuacucuaacuggaaacacaugggcuguacgguguacucauccccaugccaggagcaaccugugugcuggaccucucaaccaugcccaucucagccucaggaacagaaaucagacagaacaugaaaccuguccagagucccagaguuggggcauagaggggcugggauguggagcaggccugggggauucuaucuguccccagaucuaguuuccuccucuccuccccacucugcaccuccuuuaccgcucuauuccccagcccuugacccaggacaggcuuuucagauacagacucagcuguccagacagauuucagucccagaugagcuggcaggugguggcagaggggugggagaagccagggcaugccuucuuccccuccucggaggcagccugaacacucacugcucaccugacaggcauggaccaucagcacugucacuggacugucaucacucagggacaagucccucuggcaucccuuguggcaccauccauuccuagagaagccaggaaugugugcacgugaaugagggggcaaagccaagcagagggcucucuucugcaggccccccacuccugggcucagcaagggccuccaagcaaacaccccugugccuuggcugcugcauucugcugacacugcaucuggggaagccacggcuccaagcacugcuggaacgcaggcggcugggugguuucugcuggcauuugucagaucagagcaaacccgggagacucuacugagaauccugcccaaggccugaggagucuuccuuaccaggaaacuuauuuuuuaaaagcccccagggacgaugucaaagggccguuccagaccacuuucccuggccaaaccccacaucucccugugacccagggaagggggacagccugccagccaagaaggcgacuuagagaaggaggccugcugaacccucagcucacccaugaggagaccacacagggcuucuaaaccagcucuggcccuguuggagaaaccuggcucccagacccaguggcuggcagccccaagcccuaagacaguacuggucaggccuaggacaaggcugguugggaugcucccuccuccccagcuuccugcucucucugagggaugcggaggaggggaugugacugggaggggacgugacugggagcaggaucuaagcacagaaggagaggccuggaacuuguugagagcuuugugggagaccuggccacccagcccuggcccagccucugagggcagccaaggacggcaggggcucugggaagccaggggcuaguucugcucugggccuugggcucagcagccugacagccucagugauggccacugagaggcccagacgugcccagccaaggcaugagcaagcaguguucuggcuagcacagacucgggggaccgcucuggucuacccacaagcccagcugucuaccccaaauccucccauccauggcccaacaacaggaaugucuggccagcuugggaucucucacaguaaaagacuuccuugaaggcugauuucucauguucaaaagaugcugcugcucucaggaaguucucucugcugucugaccugaaccccaacucagaagcagcagaccaacuuggucucccgguaucuccagccuucccucaggccuaggcuugcuccucagucugcaccccaggaccuucccacaacuccucugcuucccacauucuuguccccauguucagaugacucuccccccagcuccaucuccuggcacuacccaggccuucugccccacaucuuggcucccuacucccaagaccacucuccauaccaucaccagaaugaaguccuccaaauugaaugguucgcugucaccuucacccagcaguccauguagcccugaagcuggaguucugccucucccccacagccugugaggccccgugcccucagcccuagcauuaccucagcccuugacuggucuaacagugcuacuugcuggccagagugaccuuccugugaucucugcuccagcaagugcuccagggaaguccacaggcugccggagagagaagcccuugaagugcaggaaauagugcugcuuucucaggcccauagagaggcuggguugggaagacacacccccagccuggaaagugagagucccugcccucccaccuccacaggccggcccuguccacccugagguugccugugucaaggaccauugcccuggcuccagcaggggcagcugaggucuuugaagaggccugggaaggcugcagcccaagacccaccuggcauggcugccccucucaggggucgccaggcugcaccagacucaggcuggccacacugagccccagcuggcaccccuaucacccuagcccuugauuaauaggagggcaugggacacucagccugcccagugcuuucugcucucugugugacaaaguaugggcuuggcagcuaaccccagacaggccuugagagguggcagcugggcagcccugcccccgcccacuuccugaaacuuuucccagauccugccaacccagaaggggaucuuucagccucuccagggcucccaggcucagauggcacacggcuuuuucagcccccaggccucugcaguuccuccccaagggccauagggaggcagaaaggaggguccuggcccgugccaggggguuggucccacaugccccagggcccaguaggcauggaggcagccccuggccagcauacugggcggggcagacccgcuugaggcucccccauggccucauggccggcccauggaggggucuugcuggccagcuggccacagcacagugugagaggacagaguguucccagacuuuacuucugcuuuuccagaggucacucagugaggcucuccuggggagcucagggguuuucaggaauugaggcccacugaauggaaccagaugugagaacaugcucccuagacucuggugugcccacaaugccauucucugcaaggguggcagagucuuggagccuguucuaccacuccccugggccuggcugagaagucggcuucgaagggacuggaccugggcucuaccuccaaugcuacaacuucuacuggcucaaaguaggaaaacucagacagauggaccaauguggacagauggccaggcugguggcccaacaaagcgagagcugcccugccccuccucggugaaugugcugcgccugaccuccucccuaggcucaggagugggaggagaccuuuuuuuucauaucagcuccaaagcagaugugugcacuggcuggcuggaucugcagggucagagcaccacaucuggaacucucagugugggagccacagcauagaaaccauuaacccuggguuuaccuggggccugcagcacaguaugaguguccucuucagcccccaggccucugccagggcccuucgcaggcucucugcaaaccucacguaacaccaauugacugaguaaccccaaguuccaacacuuccuaucaaaugccagcuuuccccccuccccccaugccaucugccauuccccauccggaaccuuggcacuaucacccucaacugggguauccauggcaccuuucccuggccagugcaggcccacccaucacccaucagcugauccaucccacagccccagcccccucugcagauccauuuugccagaucacuggcuucaagacauuauuccuuaggcagcugagugggacaggggagaaagaaucugggcuucagagccacaaggaccuggguucaaauccugucuacaaauuggcccuaaaacacuuguggaaucucucuggaaccaggccccuggccagucaccagguaacagguucugcagugccagccucccagggcacugcacagacacugagcaaaggcagcgguuuacagagagcugagcacagcauaccacaguccauuucuccuggcagacaccaugagcccagcaguguguagccuugacuccaggcuguugcuuaggcuguccuacuaaguccuguacagaagguaccuguuccuccucuccauggucugucccaacccuuucccaggccucuagcaugcuguccucccugucauaaagccugcaggggaccuugugcagcaugagcaugcuaacacucugcuaucuccuggggaaagagaaacagggcuggcucaagagccggggcuucuguccccaaaccuacaucucaccuaucagcaagaucauagagagcucugagcagccccagcaaccuggauagagagaggcaaggacagaacucugcaccacccaccacacccugaguugcccugagggucucaggagcagguaggagguaguauagccaaggacagcucuugcuucaugggaaaccucugggcuggcaggccaguagucuugggaagaaccuggagucuccugcuggcacggucacaugcaaguuacuagguuucagguggcuaaggcagagcuccugcagggaaaagacaguaaguucuccuuccucggucccuggaccuacauuuuguuucaugcuagagguuuuucagugaggugaggcacucacaguaggggaauggggccaaucugcagagaugguccagcugacaccaggggccagcggcaccgaccaucagcaacaucagacacagggaucaaaugggagagucaccucccaaguccaggaagcaaaaggaugucugcccuggguucaucaccccacucccugcucugggacaggugguaggugguggcagagacacauuuaauuacccucauacucucaggaacaccuugucccugaggcugggaggaugaaagcauuucucacauccuaggaggaagucaacucguuugacagucaggagggugccaggcaggcgacagucccaugugccaaagggaggggcagaacugguuacugcugcacccagggcaaguuccaagaagcucuccucugacugaguggagauccgccuggacagcccgucaccaggccguccccacccaggccugaaggcuccaugggacuggcaugucccaggagacacagggcuugcagggcagcuuuccuauguucccuggccacagcccagccugagaaucagacaacccagccucacccugggaggugggggccacacccuccucuguugaugcccugcacuuugaccgaagcaagcuauuucuucuccagguuugccaccacgguuauagaaccggcagguugggguggaucuggaacugugaagaagagcuucuuuucauuuucccaaagaugugaguuugccugggcaugaguaagagguaaaguggucuggccuggccagaugccagguagcccaaggaaggccaguuauggcaaugugcugugcucaaaagcuggccgaggcugggcacaguggcucacaccuauaaucccagcguuuugggagaccaaggugagggaaucacuugaccccagggaguuugagaccagccugggcaacauagugagaccuagucuccacaaaaaauaaaacaaaaugagcccagcgcagugguacaugccuguagucucagcuaccugggaggcuaaggugggaggauggcuugagucugggagguugagacugcagugagccaagaucaugccacugcacuccagccugugagacagagggagacucugucucaaaaaaaaaaaaaaaaccuggcccaugcccaugucuagcuucugggucugcuggccugcaccaccugagcaauccugucagcucuugaugcugggcuccuguuccacacgcacagccaucuucagaaggacacgaaggaaaguuggggcucacucaguuggagguggaggggauuucuagggcucccuagagguggcuguucucagugagaauaagcaggucaggcuggauccuggcaggagcauccugccaguuccacggugccuagagccagcccaaaggagaaaaguaggaaauacucauuuugcuuugaccuaggcccuguguuugggcucgugggaucaaaccucaucuggggcugugagcucaugcacugucagcauaaagucccauucccugcggcucauaaaaacuggacagaggcugggcgugguggcucaugccuguaaucccagcacuuugagaggcugaggugggaggaucacuugagcccagaagcucaagaccagccugagcaacacagagagacucugucucuacaaaaaauacaaagauuagccagauguggcagcaugugccuguggucccaacuacucgaaaggcuaaggugagaggaucacuugagcccaggaggucaagacugcaguguucaugccacuguccuccagccuaggugacagaaugagacucuuucaugaaagaaacaaagaaagaaaaaagaaagagggagggagggaggaagaaggggaaaaaaaaaaagaaagaaaaagaaaaaagaagaaaaaagaaacuggacagagcagcccaggccagagguagaguuaauccaucccauaccuuucgcuggcagagccaagaggcuugguccaggcaagaagauggcagaagcaguaacuauacaagcugguccaguacagcacccccaggaccccacccacccugccuuucagcccuccccucagcggcccugcucaagggccuugugggacaggugcgggggcaacaguaacaugccagagugagccagugcuguggaccugggcuggccccugggagggacguggucaccugcuugaccacacaguggaagcuagguccaaaugacugaagccacugggggaggugggaggcauggagccugggcagauaccgaagggugacauuccaggacccugugcucucccaggccuugugauaugguaucuaguuugaagguuaaaggguugggggcaugggaaaacaggcagagcugaacccaugaccuggcagccucagggccuugugugcuacaucauggacugcagcucaucuguauucaucagcucccaacccuucaaguuucaagcuagaucccauguggcaaggccugaggaaaagacaagggccccagaaacaggguccuuuuugcaugacuacccguuccugaguugggggccaguucacagagauauaguccaggcauccuugagugaacaaauggaagaauagauaaagggggaaaaaaaucaaagaacauagagugauuggucaggaacugccaagacaggugucaggagaccauaauuacgcccuugggccuuaccuuggacccagcuucccagaugaagagagcuggauaacgguaccuccaggagccuguccagcuaugacacuguucuagccucgucaggcccagaccacauugacucccugcaacccagccccugagggccacucaggggcucccagugagaccaguggccuggauacccauggaacagccucagaagaacugaugacagcugcaggggagacccuggggcuguggagccucugaguggccaccagcacagggacaagggcaggcaguaaaagcugaguuucagaugacuccucagagggaaaagccccauccaccagccaagcacgaaagccucuguugaggucaaggccugaaaaccauugccugagcauccaaaguggggcaaggucugggcaagugcccagggccaggcaagagcuggccaggaaagcaguguccagcaccagucagggcugcuccuccacauauuccuuuccccugccaccaaucugcccagcgguccucaggaccacacacauucacacaggggcaaucccagcacugccccuugugccuacuccuugguccuucaggggaguugcuagguuuggacacacagagcaggugcccaggccacaaagcagcagccuagccuacuaaagcacccuucggggccuugacuuuccugccucugaaaaggaggaagaccaacauucuagugcaggauagauuuuuuaaaacaucagccagggaguagguguuggaugaggcagacgccaaggagcccaauggagaggccuccaaacugggguacaggguaggagagacuugucaaucaacugauaacccaucgccagccugaccguguggaccugcagugcuuacaugguguucaggugccugguuuggccaucucccggagucacccugcauauauguaccuauacaugccacauacauccuacaugccccucagagggagugccaaaugagguugaggagagagaaaaauucauccucuguccugaagacaaauuuucccucuccuggagaggccaggguggcaagacaagaguggugacuaccuagggaggugcaugguucuaggagccugagaaguguagcccugaucccugggcugccucaagcuccuacuuggagcucccaagacccauggguucauagcacacugugcuguaccugcagcuccaacucugagcugcuggcaugacccaggugaggguaaaugaggacgguguggugggcaaggcuggagcagccugcacugggcaccaaggcaaagagcaucaggaaauguccccuggccuucuccuucccaacccaggaagauagggcacagggaggugaggauggguagagguacacagacaggagacacuaagcgacaagcccuaccucaucugagaaggccaacugagacuuaagugagggaaguagggcccagagcagagacccaagggacagugcugguggcagcugccccacggaaaagcagagagagagccuggaugacucacgggguccagccacaccucccuccccaggcuccuugagaaguggagugauccuggcgcacccccuuguggugggaggauggcauuguccacagcgaggggccccucuggugggaagaggguacgccagcuccaguuccccuucaacacaucccuccaauuuaaucacugccucagacuccuggucagcaucucccagucaucaaccucugagggagugggacuacagguacccacagagcuaugcaggaaugucucauaaagaacaggaguugggccaggcgcgguggcucacgccuguaaucccagcacuuugggaggccaagaugggcagaucaccugcggucgagggcucgagaccagccugaccaacauggagaaacccuguaucuaguaaacacauacacacacacacacacacacacacacacacacacacacacacacacacacaaaauuagccaggcaugguggcgcuugccuguaauccuaguacucaggaggcugaggcaggagaaucacuugaacacgggaggcggagguugcggugagccaagauugugccauugcacuccagccugggcaacaagaauaaaacucugucucaaaaaaaaaaaagaacagaaguuggccgggcacgguggcucacaccuguaaucccagcacuuuggaaggccgaggcugaaagaugacuugagcccagaaguuuugagaccagacuggccaacauaaugagaccuugucucuaccaaaaauaaacaaaaucagcugggcgucguggugcaugguuugcagccuagguggucaaggcuacagugagccaugauggagccacugcacuccagcccaggcaacagagugaggcccugucucaaaaaaaagaaaagaaaagaaaagaaagagaacaauagguggauauaagccuggaaagccaaaccggagaccacacagaccugagucggucauaaggaacuggucugucuugcaugagugaagacaaagccuucagagggacaaggcugaagaggacguggagggaagcaugggcauccucagcccucuacacucuugcucucccucucagccagacccucccaagucuccaauucccuuuaucuaagucucaacuccuuuugucucuacugccuaguaugugucuaauaaaagcaagugcuuaauaacucagaaacagggaaaucuaugauauggugcaucccugggguuggggggugggagacuuggcuuuuccucccccacacccccaaagccuaguacucagccagugccaguagagcugucauggcugggcacaguggcucaugccuguaaucucagcacuuugggagaccgaggugggcggaucacgaggucaagagaucaagaccauccuggccaacaucgugaaaccccgucucuacuaaaaagacaaaaauuaggcgggcgugguggcgggugccuguaaucccaguuacuugggaggcuaaggcaggagaaucgcuugaacccaggaggcggagguugcagugagccaagaucaugccacugcacuccagccuggcaacagagugagacucugucucaaaaaaaaaaaagagcugucacucauccaaucaggcaaauaucuauugagcauccacucuggcuaggacugcgcuguugaauccuuacaaccuacgaguaagugauuucuguuucauuuuacaagugggcaaauacaucucugcaucacacagcuguccggaagggagccauggucugccugaugccuggcuccacacagaagaacucaagaaagguucuggcaacccauaggggcacuaggguccugacccugagcaggcgcagaugacuuagagacagucauaucauguccuugcaccuguucauucuggaugcagauccuccuaacaagcugcagugugucugaucacugagcucaaagcccaagagcagcuacagguugggaaggggacccuggugcuauagcaggcauccugaccacagcaggaagagugaauggguggccugacagaaggccagggacaaaacuaugggaggcagaccugggcccucagggacagugguucuguuccaucucauuccaagucuaacagccguuaaugcaggagagacucugcuauguucaguguaugccacuuaagaaagcagggagccugggcaacauagugagacccugucuccacuaaaaaauaaaaaauuagccagacaugguaacacaugccuguacucccagcuacuugggaaaggugagguagaaggaucacuugagcccaggagguugaggcugcagugggucaugaucaugccacugcaauccaaccugggcgacagagugagacccugucuuaaaaaaggaaaaggagcuaagcgugauggcucaugcauguaaucccaguacuuugggaggccaaggcaagaagaucacuugagcccaggaguucaagaccagccugggaaacauggcaaaaccccuucucuacaaaacauacaaaaauuagcuaagugcgguggugcaugccuguagcccuacauacuuggggggcugaguugggaggauugcuugagccugggaggucaaggcugcggugaguuguguuugggucacuguacuccagccugggcaacagagcaagacccagucucaaaaagaaaaagaaaaaaaaaaaagaaggaaggaaagaaagaaaggaaaggaagcaagcaagcagggaaaugagacuaauauauuccagaaguguauuaugcaauguuuaaaauaagguguugaagcauuuccgucucugccaucaagaaacccuagucacccagaaagccuuauuuacuaagggcccugaauggcugacaucugccuaggcugaggguacuucaaaaggccuagcagggguucaagcacuggcuccaccucggaaaccaggcccaagaaaucgcugaguaaacccaagaaaaaguauauguuaucacccaccagagcaaguucugacaagacauccuguggcagggauuuggaaacagcaguuauuggcuccuguggggacucuuacugacuugaccauaaauagcuucucagauaaaaucgggcuaaaggccaggcgcgguggcucacaccuguaaucccaucacuuugggaggccaaggcagguggaucacaaggucaggaguuugagaccagccugaccaacauggugaaaccgcaucucuacuaaaaauacaaaaauuagccaggcgugguggcacacgccuguaaucccaguuacucagaaagcugaggcaggaggaucguuucaaccugggaggcggagguugcagugagccgagauugcgccauugcacuccagccuaggcaacaaagcaagacuccuucucaaaauaaauaaauaaauaaauaaauaauaaaaucgggcuaaaguauaugccagugcaagauguaaccaacaaagggaauacaggaguaggggucaggaggaagaggcaaaggacagacagaaaaacagccaguuaaguggucaccugcucacaguggcuauaccuggacaggggcccugcagcucuggccagcugacaugagaaggguccagcucuggccugggcccucaagcacccccauaggacuugggagucuucagguguaaagagaaguggcuucauggggguucccuaagacucagaccagcccuacaaugccccacaaugcgaaacaaaaccuggaccacaaaggucccaggcucuccagcacaggccucagcuuugauggcugcuggguguggguacccuucucuuugcuuaccuauauguccuaauuuuccuuaaauaucuuuauugaauguaucaaauuauaaaauguguucacuguaauacauuuaaacaauagaagaguacauaaaaagucaacauugaaaucuucccccuaccagccucuauaaaucccucuccccagagguugucacucaugacaacuuggcgccuaugcuuccaaaaacaugcauauauguccaucugguagucuaccaagaugagggauuacauguaacgcuuugcaacuuuucaccuaacaacauauuucuaaaucagcccuuauggaacuucaugcuuuugagcacucucucguaguauuccauuguaagaauagaccaugguuuacuuaaccagaccauaaccaaaucaccggauauuccauugguucuaauaguuugcugcuaccaacaaggcuggcauaaacaccucuguacaugcuaucccauguuaaucuacgggacacaaucuuauaaguuggguugcagggucgcacgguauauacaugcaguguuuugacaaaggggugacaauguauaccccuuggagagucuacaccaagucauccuucuaccaacuuuuuggaauuaaaaaauuauauuuagucaaaaagaaaacaagaaaacaaaaaaccaccaugccccagcaucaugcaggaagagacacggcaggaaucuggagggagagcccagcugucccucucucugcuccgcuugccaaacugggcuccaugccagguguccucguuaggccacacuuguguccacuuggcccacaguuaaggcugcucucuagccuccuggcaggacuugugggcagagcuaggcuuccaaggcaggcuugcccggcuaugagccaacagauggccuggcgcgggccuaacugccaccagccaguguacuggugacuuccagguuaauaucuuuaguguuacuaucucacacagccaacugccugccggacucccucagacaucugagauagaauacuuccccucccaccccccaaucugcaccccuaacuuuccuaucccuucucugguagcccguaucucaaaaggagcuccagcauccacccagucauuuauuaagccagcagccugacuucuaacccucuucacccacaucuaauaaaaacuggaccaaucuuguggguuucaucucccaagcugaucucugaccugguccuucauccccccucauuccacuccagcccugguuaguccauauucuccuaccuagagagcugcaagagcagcuagcaaguguccugcuucuggccugcucccacaaauccauccucuagagccucagagcaaguuucuuuuuuguuuauaauugacguguaacaauugcacauauuuauaggauacaugugauauuuugauacauauauacacuguguaaugaaugaucaauucaggguaauuagcauauccaucaacucaaacauuuauuauuucuuuguuuuugagacagagucugguucuguugcccagacuggaguacagugggggugacccuggcucacugcaaccucugccuccuggguucaagcaauucuccugccucacccucccaaguagcuggggauuacaggcaugcgccaccacgcccggcuaauuuuuguauucuuaguagauauggggguuucaccauguugcccaggguggucuugaacuccugaccucaagcgaucuaccugccucagccuccuaaagggcugggauuacaggcaugagccaccacacguggccuauuauuucuuuguguugagaacauucaaaauccucucuuacagcaguuugaaaauauauaaugaauuauuguuaaauacagucacccuaugguauagaauagaacuucuccuaucuagcuguaauuuuauacagauuaaucauccccucccucagagcaaguuucuuuuuuaaaaaaaauuauuauuaauuuuuuuuuugagacggggucucucucuguugcccaggcuggaguguaguggugugaucacggcucacuacagccucaaccucccaggcccaagcgaccuucccaccucagccucccauauuauuauuuuuuuagagauugggccggggggugguucucacuauguugcccaggcuggccucaaacuccugggcucaagugaugcucccaccucagccuccucaguggcugagauuacaggcguuagccaccacaccaggcccagugaguuucuaauuguaucauaccaccaacccuaccuccuccacaauuccccuuuucuucacccagugagggguuagguucccacacuggcucaugacagcgagaugccaaaccuccccccugccuagcccuagccuccauuccugcucuggggccucauucucgcaggcagcagcagcagcaagcuggaggggagcaacaggugcagcaggcugccagacaccaccaacaaccugugccaguucauccgccacugagcacugggguccccuugugcagcaaugccacugcccagggcaguggggccaacaagagggaaaaacuucaggcuugugugggguccaggcucucacaacucaacaugcucauucccuuucuuccacagaguaaauguuccuucuauuauugccuucugcacacccuucucccaaugcccucccccagcccccagcuccucucucuugcuuguagucacuagauugccaguaccaugucaucucuuccuuuggaucacguuugacucagaggaauuuaggacugagcuaagcucaucuugcuguccaaguuguggucaucuaauuucaccaauucaauagaguuuccuuugacaaacaaaaugaaauguauaaaauauuuccaggcggcugggcgcgguggcucaugccuguaaucccagcacuuugggaugccaagacgggaggaucacgaggucaggagaucgagaccauccuggcuaacacggugaaaccccguuucuacuaaacaaaauacaaaaaauuugccgggcgugguggcgggugccuguagugccagcuacucgggaggcugaggcaggagaauggcgugaacccaggaggcggagcuugcaaugagccaagaucgcgccacugcacuccagccugggcaacagagcaagacugucucaaaaaaauauauauauauuuccaggcaagagcauacacagaaaauccuaaacaagacauuuccuacacauuaaccuuaaucuaagaaucucucucuuuuuaaaacaauuuuuuaccauaacuuucauccuuccugagcaauauguccuucuaagacacccacagccuuccaggaaccagcccaaugcaucuauccagaccucgcugcugcaaauccucgacacacacucuacuuucuccuuccaccucccaaggcugcugucaugcacgaggcaguuucguguuucugagacuacuaaugccauuccuucucccuaugcucuucccaccucuuggccuggcuaauuuggggcugggggggguggcgcagcaacagcuuuacugagauauaauucauuugccauacaauuugccaacuuaaaguguacaauucaugguuuuaagcauacucacagaauugugcaaccgccccacaaucaguuuuaggacuuuuuuuuuuuuagauggagucuuacucugucacccaggcugcagugcaguggugcaaucucagcucauugcaaccuccaccuuccggguucaagcgauuuuccugccucagccucccagguagcugagguuacaggugcccgccacuacgcccaacuaauuuuuugugguuuuguuuguuuguuugagacagagucucgcucagucgcccaggcuggagugcaguggugcaaucucggcucacugcaagcuccacuucccaggcucaugccauucuccugccucagccucccaaguagcugggacuauaggcgcccaccaccaugccuggcuaauuuuuuguauuuuuaguagagacgggguuucaccgcauuagccaggauggucuugaucuccugaccucgugaucugcccaccucggccucccaaagugcugggauuacaggcaugagccacugcacccagccaauuuuuuguauuuuuaguagagaugggggucucaccauguuggccaggcugguaucgaacugaccuugugauccccccgacucggccuucuaaagugcugggacuacaagcaugagccaccguuucuggccaguuuuaggacguuuuuaucaccccaaaaauaaagcccauacccauuaaccgucacccaccacauaacauccccucccuaaaguacccugcacuuacugugcacucaaugcuguuuugauggucacucagucugccuguuagacaggcacacuugcccuaagcaagaccugugugacauacuuguauuagccacucaaggcccaccauggcaccugucuccuaggagugacagcagggaaugaccacaguggagcaccuggccucuccaacuguucacuuggucccaggcccugugcuuacacuucacaaacaucucagagacccuaauauuauucccauuuuacagcugaggauaaaugacuuguccaaggucacaaaaccaguuaaguggcugcgcugggaucaguccaucaguaaggucuucucuaacugucuagacauugucucugcccauccacugcggucaccuucuagccucaccuucuucuguucucauuaaggucuccuaugaccucugaauggcaaaaccaaauggaaggcugacuuuaucaaucucuuggccacauuuggcacucacuaccucauuuauuuucaggcucuccuuuggagcuacccacauuucagggaaugccuuuggccuuuuuggcaggaccaucauuuucccccaaguccugugaucaacugaagugcuuccugggggagggucccaucuucagccucuagucuucugauuccaugguuaucucuuggggaccguggacacaccgcuaucucaauuucccaagcucagaacugucacaccugagcaccaaaaauagccuucauaucuccacucagauggcucacagaucccucaauuucaucuucucacuucuacaacguguuccuucuccuacaugccaccaucauuucauuuugccaccuacacaguugccuaagccaagaugaggacaucgaccuugacuuauucuucccccagccuucuugcccaacgcucaaguccuaucaaauccccuuccuaaaauucuccuacaauacucccagccaaugcuugaggucaagcugccuucaccgccagccuggauuacuauaagaaccugcaaacuguucuuucugccuccaggguggccuccaccuucaaauugcagguauccuguuaaaguacaagucuaauaguuuuacuaucccauccgcugcacucaggacagaguccuuucuaugguuuuuacgauccuucuagagcuaaucucuccuuaacuuuccagccacaguccuaaccaccccacagucugugcuaaacgaccugccacaccaucaacauuugcaucugcaguuucaugugacauugcgacuggcgauuggccaaguccagccuggagucucucuucuuccugcauaaaauugucucuugugaaauaauguugaaaggcacaaagagauguaauggacagaagacaaaucaaucaggguagagagggauaaaaguguucuggacaacagccagcacaucaaacaugggcccuucacccauggccuccaacgaucuaacucucuggcugagaagaacaauuuccaggaccacuagcucacauggaagcugagaaggucacaggacuccucuugaguguuaauuauauuucuuugcaacaggaggaagauguccugacuggcccaaguaucagguagagcuccuauuccaaauuaggaaacuggcauucugguacucaucagcugaaguggugcuacauaauccagcaagcuguuugcuucucuguauuuuccaaguuucugaguaagagaagagcuaaacuagccauggaaaaaaccaagacugauguccaauacaguaucaaugagaaccccauaugacucagauuauggucucuaaauacaauuuuguaauacaaagaaccaagucuccuaagagaaaugaagacucuaggucugggucaagaaaucuucaagguaagauuagaacauaugggcaucccaggccagauggaguggcucacaccuguaaucccagcacuuugggaggccgagguggguggaucaccugaggucaggaguucaagaccagccuggcuaacaugguguaaccccaucucuacuaaaaauuagccaggcgugguagcguaggccuguagucacagcuacucaggaggcugaggcaggaaaaucacuugaaccugggaggcagagguugcagugagcugagaacgugccacugcacuccagccugggcaagaaaacaagauuccauuccaaaaaaaaaaaaaaccagacaucucagauaguaaggaagcuuucaauggcuacaggguuauauaaaaaagacuuggcagucaacugaaaaagcuuccacuggccaagagacaauuuaagcaucaauaagauuaaucaacugaaacauaacaaauacauuaaaaaccauuaguguguuauaauacuaaacaaaucuugguugguuuagucacaaaaccucauuagucauuuuuggaggaugucagugaaacaacucuuuauuuugaaaccugguaacuauuggaaagaaauaagcauuuaucuuaaccucuccuauacagacuguaucucaggauaacuaaguacuugauuacuggaaguuuacaggcauagaaguagucaagcuggcaacuacagaaggaaacagaauuagaauagcacuauuuugcaacccccgaugaaacgauggcuucagucaauaaaugucaauuauuccuuacauccuaaaaagagaaacuagguauuaugugccucccaauagagguacaaacauuggcuggguguaguggcucacaccuguaauccugacacuuugggaggcugagguggguggaucaccugaggucaggaguuccagaccagccugggcaacauggugaaaccccaucucuacuaaaaguaccaaaaaauuagccagguggcgggugccuguaaucccaucuacuugggagacugaggcaggagaauuacuugaaccugggaggcagagguugcagugagccgagauguccagccugggugacagagugagacucugucucaaauuaaaaaaaaaaaaaaaaaaaagaaguacaaacaucaccuauuaaguauuuacaaaaaaaaaaaaaaaagaauugaaccaaaaucugagcaagccucuagaucuacuacuaauuuaaagugggaacaagggacagaggaacaaguucaacuauaugucagagaugggaucaguaaaauugagauggauggaaaaucuauuaaucaagugaucuaacuucaaucuauauauuaaaauacuugagagaguaucaacugaaauguauggaucauauuugcaucccaauugaaacaaauaaaucauauuuuaaaaauuugagacaaucaggggaauuugaauacuaaauggauaucugauuacauuaacaaauuacuguuuuuaaggaaggaggaauaauauugucauuuuuuuaaaauacucaugacuuuuuucagagaugcugaaauauuuacaacugaaaggguaugcugucugggacuuacuucugaauaauuugggaguggggguauaaauggaacuaguauugaaacaagacagauaauuauuuuaucaauaagaauuuaugauuguuguaguuagaugauuauuacuuaggggcucauuauauuauugcuucuuauuuguauauguuugacaguauccauaauaaacaguuuuuuuuuuuucuuuauacggagucuugcucuauagcccaggcuggagcacaguggcucgaucucggcucacugcaagcuccgccucccggguucacgccauucuccuaccucagccuccggaguagcugggacuacaggcacccgccaccacacaaggcuaauuuuuuuguauuuuuaguagagacgggguuucaccgagccaggauggucucgaucuccugaccucaugauccacccgucucagccucccaaagugcugggauuacaggcaugagccacugcgcccugucaauaaacaguuuuaaagagaaaagaggaaagcgaaauucuggaggguacagguacaaacaauacugaaaacaagggcuaacauuuaccuagcgcuuauucuguccuuggugcugggcuaaguguuuuacauguuguagcuuguugacauuucacaaccuguaugagauaggugcuguuaauacaccaguugaaaaacccaaggcccggagguguuaaauagguuaucuaaaguaguccaguaauuggcaggauuggaauucaacccagguuugccuaacuccaaaguccaccacacuuugugcaccaagugcuggagggauggcuugcaugagggauaugagggauagaaaugugugugaauggccaagcgugguggcucacgccugcaaucccaguacuuugggaggccaagguggguggaucacuugaggucaggaguucgagaccagccuggccaauauggcaaaauccucucuacuaaaaaauacaaaaaaauuagcugggcaugguggcacaugccuguaaucccagcuacucaguaggcugaggcacgagaauggcuugaacuggugagguggagguugcagugagcggagaucgcgccacugcacuccagccugggugacagggcuagacucugucucaaaaaaaaaaaaaaaaaagaaagaaagaaagaaaugugugugaaugagcaaaggauaccugaaugccacacuaaagaucuggaugguauucuacaagguggggcagagggcgggagggugggugccuauguugagcaguguuauaggaaaaauguguagaaagaauggccuaacauguucaugggggaugauagaggguccccugggaagaugggaagaacccugugcccccagaagcuguuacaggagagcggacagcagcaggagugaggaaagucaagaagggaaacaaccaaccgaaugucuauugaugaucaaugauguucaccuuagauuuaggcaaauaaagaccuucgacaagucccaggcaguccacaaaacucacauuaagcuccaacugugugccaggcccugucccaggcagccucccucuauucuccccuuuuuaccacaguaaggguaaucgguugcuggcagaugccuacuacccagcauccuaaagugcucuccuuccccaccuccacucacauaaguaagguaaacaacuuuucuugcagauguacguuaacaucauaacaccuacaauuauuguacugccgauuuuuuuuuuuuuuugagacggggucucgcucuguuguugcccaggcuggagugcaguggugcagucuuggcucacugcaaccuuugccucccagguucaagcaauucuccugccucagucucccgaguagcugggauuacaggcgccugucaccacgcccagcuaauuuuuuguaucuugaguagagacaggguuucaccauucuggccaggcuggucucgaacuccugcccuugugauccacccgccuuggccucccaaaaugcugggauuacagacgugagccaccgcgccuggccuguacugcagauuuacauuaaaaucauaacaccuacaauuauuguauuuuaacgguaaguuuucuauuuuaaagguauuuauuuucacuuuacugguccaguuugcaaggcaaacaauaaaugacuuuuucauuugagcucacuuuuaaccucacgaaguuucugacgagaaaauguucucuagugggugaaacaucuggccauccuccccccacccagcuaccaauuacgaggcuaucagcaccucugcucaagaguaccacuugaggaucaggaauccccucacauccuggccacccuucccuucccuaccaccuggagcgggagugguuggcaaagacuggaauuagggacaccucuaacucaguacaucuguuggagcugugccucagaagucaacgccacggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaagaagucaacgccacucuggagcugugugcugagaagaaaggggaacucgguuucucauuacucuugugcucagaaacccugucccaacaggcaucccccucgcugagggggugggauuaauuggccaaauacuuguauaugaacuuccagaccugcaagggccacccuuguucucccaaacauugccuucaggagauacugcccagccagcaguucagaguugggagaaaacccucgauaaacuggcucagcaauuccccaggaaggcucaccccgcaggccaacgcgaagacacgaugaucccaaagaccuuagugucuuggcggggggagggggaagaggugggggacuuuuccgcuuagcuucccuaaggguugcuacgcgacagcucucgggcuacgucaggguaaagagguuuguauggccacaccucgcaccgaccaacuacccccgaaacacccccuccucccaaacugcagggugagcacagcgagagaaaagguggcccaagcagaggcgaacaacugcgguucuuaaagccuuguuugaguuugggcccgcgccgagccacagcuagagguagaucccgcuccugcgcguccgcuaucagccccaggauucccagagaggccucucaggcccuucaagacccccccuuccggcuucccggccuacaccucugaacccucaggccccggacagccucuauccccgccuuucgcggccccggcucacccucuagcgucucgcacugcaccagguugagguagucggccuggcugagcaccccggccuucaggccgcgcaccagucccuccaaguagccauuguccacguuaaaguaaagcuccgggaagaacgacauggcugcugcgggagcggcgggaccggagaaccaggaccggccggcacgaaucgcgacuccccaggucagcugacgcugcguccucagcgggcugucaagugcgucaggugacgcgcaagcgccucacgugaccauaagggggcguggcucugagcggugcccggcuuccggguggcugcgcggaag

SEQ ID NO: 15781 - RNA, 647 nt, Homo sapiens
uguaggaaaaggugcugcagagcugagcagucaaggugugugacuucacugaggaccagaccacagaauucaaggagguuuucuagcuguuugacugaacaggugaugguaagauccuguauagucaguguggggaugugaugaggguccugggucagaaccccaccgaugcugaggugaugcaaguccuggagauccccaaaagugaugagaugaaugugacggugcuggacuuugggcacuuccugcccauguugcaggcuguggccaagaacagggaccagagccuaugaggauuauguugaaggacuuuggguauuugacaagaaggggaauggcaccaucaugggcacugaaaucuagcaaguccuugucacacugggugagaagaugauagaagaagaaguaaagaugcuagugcagggcauaaggacagcaaugguugcaucaacugugaagagcuuguccauggggugccaaauggcuaaggaccuucccagucuccccagagcccgugccuuucccugugugagacuucguaucuagccugaaggcuuucuaggcucuuuugucacagcaccuuucccaucuugucuuucuuggauaauguuuggucagcuuuuaccaaauaaacuugcucucucugc

SEQ ID NO: 15782 - RNA, 12876 nt, Homo sapiens
ccaggagcccugcucugucugggugagcauagccccucugcagcuggaggguagaacaaggaaggccugagguagagcugggagggagcauggguagccuuggaugggguugggguccuuguuagcucuuccccagacaccauaccccuuucaggaacccccaaagaggcaucgugaugguucugccuuccaguaugaguaugagccacccugcacgucccucugugcucggguccaagcugucaggugagugccugggucugccccaacucuuggucacuagucccaggcuccauugaccugcagcggugguuucuuuccaggcuuccuccccagcucauggccugggccuugcacuuucugauggaugcacagccagggucugagccaacuccgaugugagacgucacgcaggacagauaccgcuccacacucugcuuccuuugaguuuuuuaauaaaauaaucucaugcggcaggagaggagaggaucagggauuggggccgccgccucuuuggucuguggcuggggagggugggcuccgcucagggcuggagggcucugugggcugugggggcagaggcucgguuccaaggccagauccugugaggggagggagggagagagaggaagggucagggcugggcuaagcaguccugccacccucccagcuggccuggacccccucuuaccuaggcuuggggauggaggugccucgaguuuuggccugcguuugaggacgggggagcgcugcagccucaggggccguucuaagggacacagaaaggcuugggguggguugcuaaggcuuggggucuguccauccccugccccucucuuccaccuccagugcacauaagcaugcacucacacacacugcugccuucagagcaucccccgucccugcguccucaccccuggcagaggcugcucuucgggaaguggagccagugcuaguuggaagggcuugcugucaaacccuugcaccuggucuucuggcucccugauuucuugagaccucacacacugguggcucccuccaaggaccaaagcuaugaagggagccccagaagcccacccucccacaucuccugcauucaagcacacguggaggugucuccccucaccagcaggggccuggagcugguccucaugcacagacacugcucgccgcccugccgagagaggccucggccucagcuggccaucugagggaggccagggaaucagggguauuccaacagcugcccccacuccagcccuugccucccacccucaggguccuuagaggagcugaguucccagcaggaacuccuccagccccgaggccaggauugggguggggaaucaggugccugccuaccuucauuucuggggcccaagcaaggguccucugggaggcccaggcugucuggggaggggcugguucugcagggacuugggcuuugaccaggggagggagggccuggaccauccuguuggccccaaccacggcuccugagcuccgcauucaacugcugccccagugucuuccagguggcagacucaggccccuggcucccugggccaggucugcaggaagggucuguagggagaaaggugucagccaagaccuggucaggcauuggcgauaggucugaacaacagucugacccaacuccugccugucccugcucccacuaccaacacacacaguggcccucacucaccagcagacacagagugggugcgggacuugaucgagaugggaggggccuccguggaacuguccauaaugucaccugcaaggcggagcuggggacucagguaccagaccuuggaggugaggggaagaaaaaccuggccucuccccuuccuccccaaggagagcaagugccuugggggcugucuauaaggacaccuccuggcaaauguacugccacaccccagggucccacuuaccaucugagccagcuuucuugaucucgccaucuuugcucugcaggaaacagggcaaucagauuccagcccugcccgcuccccacacccuagccuuuuguucguucuuguucuuauaauccugccacugaaugcccaccaugggcuggacaagaacauggcaaacccaguacagcccucuuagaacucuuugcacacuugaauauuucuaaauucaggccgacuucauguuuuuuguuuguuuuuguuuuuuguuuuuuaagauauugaauggaugguauggagggcugggguucuuugggacucuaaugagagagacauuagcaggguggcccacagaggagagucagggaagaaccaugggcacugcagggauggcugaggagggaccuggcguaacccacaauuagagacuggaagcgaggcagggaggacauccagaccacccagggacguguguggaggcucugauuugcaccaggggaggaaagcagugagguuuuaagguggccagggccaagaccccacagggcucugaagcagguuguggagucugaacagugucuugagaggaagccccuggaggacuugcuauuucaagcacaagugacaaggucagauuuuuuucuuuuucuuuuuuugagaugagucucacucuuguuguccaggcuaguguguaguggcacgaucuaggcucacugcaaccugucucccagguucaagcaauucucgugccucacccucccaaguagcugggacuacaagugcccaccgccacacccggcuaauuuuuguauuuuuaguagagacaggguuucaccauguuggccagguuggucucuuaacuccugaccucagguaauccaccugccucagccucccaaagugucgggauuacaggcgugagccauggcgccuggcccaggccucagauuucuauuagaccugcagagaaaagacuuucucagguccaaagaggagaugcugguggccugugccugggucaaagccaagagggaagaaaggucgaaucuguaaccauuucgaggagaauggaguagaacugacaauuagaccuaucugucaugagucuccuccaucuuggucacuuaugucacccacagcaugccaucugcccucucacuucaugcucagguccccucaacucacuugcuuccucuugccuucggcacccccgcugccucggcugacgccuauccucugcagcauuacuuguacccgcuguucaaaggauggagccaguucuguuucuccccgcuccaggggccgccgcuagggacagagaugcucgaguuggagacaguccgcgcccugggucccagaagcgccuucaccaccccccaucagcaagccucaccuugucgggucuggcacccagcguugccuccuccucggcaggcagcaguaucaucgaguaggccuugcuaucucuuguguagcgaggucggcuccugccggcagggucagggcugcuggugucccccucagccccaccaagcuccucaccacggcugggacggguuggcggccgcaguaggucgccaaauguaguuuuucggguucggggagcugccccagggcuggucucuagaucaguccguggaccccgcguugaacgaggcuucuugaaggcaaagagggugcccagcuucuuucgcaguguacgggggacaggaguggcgccccccucaguggccggguccuccucgggggcccagcuguggggacacccagcagugagcgagaaagcccaucaggcaucccacccucucccacccccagcagaugccccucacucacaggcgauccugcuggaucagccuuuuggagaagaauuccuccacgcccucguccacgcgggcacugagcccauucccuuccugcggcaaggcuggggguaccuggggggcaucauggggucaggggucaggguugagugcaacucuggcuucuacccccccccccccccggccggcagccuggacugaauaacuccaggauuccagacuggggugacccuaggggcugcugauaccagccuccuacuguccugcugcuggacagagacuccagauuucacgcacuccucacucgcugcuggcucccgcacacccaguccacacccguccuugucccacagaguauccuacacgcccgagccacccggucaccagcaaaccuagcccucacgugcccccggggucacccguucccacuugccaccagcucugcuccgaacaguucccugcagugucccccaccccacccccacuccacccggccugcugccggcucaguggcgccggcugcugcgucagacccucuggggggccucaagccggcuccuccccgcccuccgccagugcccgcugcccccgcgggcuugcagcccacacacgcaucuccccacacgcgccgccgccggacgcgcagcagacgcaggcuuggccccgcggcucggcuacccggcugcccggcaucucucagcagccccgggggagggagggaggacggacacccucucucgcgcagccacggaggccgcgggccgccccgagacggagucccacacccaggcacaccccgaacggaacccgcacacccauggucccgcacaggcauggccuggggugggggguggucaggaagaagccaggaugugaccgcggccgcacgaccagguggccuugggcccccaccacccccucuccuugaccgcuaccacccaugaggagcggccgggccacccgugauccccaauuccacgcgcuccggagugggggaagggugcucaccugggggccccccggcggcgggcggugguggugcuggcggcgcggccgcggccgggcccgggucggauggcgcaggggcugccccgccaguggcagguccaugcggggcagcgggccggccgggggcccaggggcggcagggcucggagagccgcgcgcggacggccccgccugcggcucugcaucuucucccggagccgccagcucgggcuccggcuccgcuuccucagcagcaccugaggggacagcaccagaagagcaccgagcgccgagcccggggagguggcggcggaggcgcuagggcggcgggggacccgcccagggcgcggggaggggcccggcuacgccgcccguccccccgccccucugccccuccgccccucccccgccgccgccgcuguccguggugcugagcgcggccccgagcgcgcgcggcuccgcgccgccgcccagcaugcgcgucccugggguagggaaaggggcgcggggaggcgagcugagccgguguccugucccagauccgcccaggucccgccccgggcugaccacagcagaccccagcuuugcagguugcacaaggggcccgaccuggcccagucaagggcugguggguacccagacaaggcugaaugaguucauccagguccccggguccccaagucuaauggagcuucagcccacccacguaaacucccucccccaaggcccugacuuacugugaaugaaggggaccaggugaagaccguggcugagcucaggccauuucuguggaggacugucauccugguggggagggcacaaacucagccugggguaggagagcaccaacccaaaagagcugccuuucaccuuccacacuccacagcaagaugggaagacugggagugccaugccccguguucuaaaaccacuuaccuucuccuucuccucuuccuucuccucggggaagaaaagaccuuccaauuccccaggcucaaggaggcugggcucaccuccauccggugcugguagggcagggggcauugucacuguugccugcugagccagacucuccaccugcaauaccaagcagccaaagauggcagguagggccucagccaugaucccauugaugcuaacuaaggggacccugaaauagcccugggcuacaugaccccagaagacauuacagagccccugcaagggagauggccaagucacugcauguguguguuugcacgaaagugugugcacaucucccccucaccagcugaucccgggcugcacucaggccugccaaagccugagccacaaugcucucugccaagguccccgugauugauagccgcaugucccuaagggcaggagaggacagggguuaaugggcuggcuuugcucagccuugcccagcccagccccauccagccuaccugagccuagugaaggcaucuugcagcagcugcucugggagcagcuccgggaggccccucgagccugccaggacccccucuagcugcucccuccagcuggaucccugcagcaucugugggcagaggcuccuugcuguguccaguguggccugagugaaguccuagacaaaggucagucagagcauggugaggauguggccagacaccaggcugcuggcuugaggcuccaacuccaacagaauauugagucaggggauaucacaguuaaaacuaaaggaugggagucaaaccugcaaacggaggugggguuggggcaggaguacccucucaccuggauguccuggcggcagaccucgcccaccugucucagaaggcccuccagcuucugcccaagcugccagugauggcuuggggagcuuccagcuucauauagaauggggagaaucugagggccaaagaggaaaagcaguugcgagcugacaccugacuaagaggggaaggguccuuguagcaggagggggagugcucacgcugagagagaaguuggcauuuuggauggcauccucggccuggcgcacagcggcuucacccuggggcccagccccacagcccagcagcuccacaugcuccugcaccgacugacacaauucauucacuuccuggggcgaaauggggaucagucucagccuagcccccucccagucucccagauccugccugccuuccucccaggcucuuuaacagagggagguccugaagcugacacccuuagaccagccacuuuggaacccuaucuguucaaggagggaaggaacuaucuguugcuuugguucauuuuaaggacuuuauauacacuuccuaagugcccagaauaggaaggaaaggaguuguaaaucaugucuguguuuuagaagcucagucuguccacacagaggauagacugagagagggguagaaaagggagugaguagcccuggaggagggaccaggaggagcaagggauaauugguguggggguaaggaguggcauguaugaagguuggucuagaggcaggacgaaggaggccuaugagggcuccagugugaccaggagagaccuggaagggugccccaaccucuguccacagcacuggguggcugugggcaccagugggauugggcuccaggguagacaacaggguuugugagcgacgaugacaucacuuggagaagugcagagcaugaagcccagcaggaugucuggauuaagaccuuugggcucugaagcuuaggaaagaagagguauuugggaauggagagguagaaacaucuccaacagauaagguaguggagggagaugaagacagugaaggagcagcuggguuugggcacacaauggagaggggaggggagucacguauaugugaggacagagauggggcuacaauugggggaaaauugaggaaggacauaaaaauuccucucuaacaggacagccuguuuacaggcuuaacguuaggcagccaaggguguuauuuggagagcuauuuaagggguguuuagccgccuccagaucaaggagagggacuuugugugggacagcagggcucaggcacccuggccccaggaaagucagacccucugacucauggaggcucccggaugccacaggucuccucaugcccuaccucucgugguuggggaggggacauugaccugcucugaggggucugagaccagaccaaguggcugaaggcgggucguguggucagaagaggcagggucugcgcgguuguuccucaagagacaggcuuggaucuaggggcaagggguauugagaaaugccgagggacggaguuaccgugcagagaagggcaagggaagagggggacgcccaccugauggacugcacgugcugucaguuccgggcggcugcgcugcgccugggccacgucguucaguggcagaggcauggccuucaggcugugguucugcuccagcgccugcgccacguccagcagacccaaagcagaugugugguuccggucccagaccacagaccugggccgggccuggcuucagucggggacggagcuucccaacgccccacccaacccucggccuaguccauucgccucgucagccugcuccauuugcuccgccucauucagucccuccccuuagcccggugcccuccucuccaccgcgcccccugcccgcuggucccaccccucugaccccgcccaccggagccucgaguugacccgcagcgccuuggccagcaacuuggcgcccgcgucccccauggcguugccgcugauauccagcgcggucagguuaggauugguggcuagggcccggaguaggacgcuggcacccagcuucagccgagacucagccaccgacagagacugaagaggcugggguuaagagaaagccauugauggcuggagucaggggucagugagggcaggucacagggucugagggaacaagagaaaggaggaccaaaguggucuaauugcccgaggcccugcaaggucccgugaacucacacaaucgucguccugcaugagcuggacaauccggugcaggacgucguccagggucucccugugggcaggggccgcaguugugggggacagggguggugggguguugucugggaggcccaggaguagggugggggcucacuugcaccggacguugaaguuccuuccaagcgccacaugucucagggaccggcuucucccgauggccagcaccagagucaccaugucugagccgaagccugggggugacucgggucacgcacgaggcgaaguugcaaggguaggguggggauugggaaucgaguggaugaugcgaggaugggcucuccugcagccucaccguuauccgccagauccagggagcucacagcgccugcgucgcacacuaagucuuguaucaccugggcgccggccgagcgcagcuguaugugggaggugggaggugggaagugggacccacuuaggccgcgaguggggaggggcaggcggcccacggcccugcccuuccgccucccagcgccucucccaauguguggucucuucugggggccggcgcucaccucgcaagcgcugagguccaggugcaggucgcggaggugcguguugagcgcgaggccauccaaaagggcucugggagaggacguuacacgggguggcgggagcugggacagggggcuccagggugcgaacgaaggaggcagggccaggaucugggggagguugugggagcgacagaagcaggagcggggaggggcgaaggccagggcagggugggagcgcccgcgggggcguggccgggguccgacacugaccugagcgcgucgggcggcagcuugcagcccgccaggcccaggugccgcagcguccgcgcgcggcugaggaagagcugcagcgcggccggcgcggcgcgggacuuccugggggaagugggaaggugggccuggggccgcaaggaggcggcuuccagcagccucccccggccccgacaggucccccuuacgugcgggagaagacguuccucgaagcgucgagguggguaaggcuggugcagcagccucgggauaccgcugcgaagagcugcggggggaggcuguuggcuacacccgcggggggaccgagcccuccccgucccgcccuccaguccgcccugccggucauccauccccccacggagcacccccucacaguguccagggcagugucggugccugcgagauucaggaacgacaguacguuaggacggcucaggaagcuauagaggcccuggagggaggacaggggugcgauggagugggggaucgccuacccagggcuuaugagcaaccccaagcucccacccugaagacagccacucaccccacuguccucggaggcccccagcgccccaggauucccagaaagguccaggugggucaggguggagucgaaggcggcauugguggccagugcccggcccagagcccucauuccugguggugggucggggucacucagcaguuggacagacccccaccccccuccccucacccccucccucauccagccuaccucgcggugucaacccugucugggccaggcugagucuccucagggcuccuggacaacgcucgaggugucugcugagugcagucaugccuuggggggugggaacagccacgugggucucaccuccuccugcugcccaccccugcgguccccaggcucagucauaccucggucauccagcagguuccccgcgaggcugagcucccgcagcccagagcuugagugucccgccagcgccugggccagucgucggacaaagucucuggggaccagaccccaggcaugagauucugccccugguuugccaaccccucccaggccacuagcccccagucccaagccuccagacucuccucuccaagcccugcccugucccccucacccccucaggcugcaggucuccagcaccagcuccuccaggugugaugacugacucaucaugugcagaaucuguucugagaccucaaggcucugagaagcagagggcggcggcucacgggcugcacccuggcccucagcgggcugcacccuggcccacacccuuggccccucccugcccuuaccccgaacccccucaccagcuucauguccacacaggagaggcaccggaaccacagguuguaggacagggcagccacacucaaggccaggucccuggugggagggugggaacagaggcagagcucagggcccuccagccaggucccaggcccagcagccccuccauggagaaacugaggcccagggauaugggccccgggaucuuccuccucucccauccuggcaggccacacaccgacugccgagguggcugaagucucccaggcugaaauggcggcagcccuggcgaugguaaaugguguccacguccugggugagaaggagaugcuuacaguucgccuggggccacaaggggcagggaggggcucagcacacaugggggaccagaugucuccagagcccuucaaaagggcccuacccucacccacugaaucuccucucggaaagggaagccauuguagucacacagagccucguaugucuccaagaagccaccuggggaggggauaggggugcgauguggaaaaggagagagacaaaacaucagcgauggaggaagaccagacccacagacuaggugguggcugggaccugaauggcucuguucaguuuggggcccccccagcuugcgggucuggggaggcagagguggggcaggcuggaaggccuguggcucugccuucacccuuaccacaggggcugcaggggucaguggacuccgaggggcugcuucucuccagccgagccagcauggaggcuggugugggccuccggaauagcuuccugguaggggguuaaggagaagggggcaaaggacuuccagccucugggaugggaagcagcccuucucaugcacucccuccuccccugccagccccucgaauuugccaggccucacccaagggucgagcgagggaagaccuucuugauggcugcagccacgugcugggccagcuguuccagggcggccacaccaggaaacuccaggaccagcucacgcagggacuccagcucaaaggugaccuagggaaggggcacuacuaggccucggcuccacacaugggcgcaggugauggugguagcaugaagaccaggcugcaggcccagguaggguacuaggugucucaccugagggggugucuccugcagcgccauggccuggaccuccagguagcugaacgugcaguccaccuagaaagggccuagaucagcugggaccaagcccccagccccgcccucauggaaguccaguccuuugggcagccuggggcagagccagaucugccuggacuccccuccugucggcugcccagagcccagugcuggugcaaagucagggcccacaaggccaagaaggaccacucugcagaugcagcccccugccaagguagcugcuggcgggcggggguguggccaggcccugggacucacccucagcgggaggcagguggugugcagcagguaggcucuccaucguagcagugccuggggaaagacagucugauauccugggcagagcaagaggcucuuucuguggggccacagccgccuccccggcucuguccccugccccauaccaggacaugguuuugcacagcacccuccccggguagccagguuuucagcagcagcuccaccucuuugggccacaggaaccuggugaucucgccuguggaagggcagccugcugggugacuucaguccuugcacagaagccacuggugcccacagucugugccaggcuggggcccuggggcuuaucugcggccagcgaggaaggaggggagaggaucuggggcgccugcccuccuggggagcagggaggaccucugaccaggcccucuggggcgcugggugggccucugauuuuggggcugcacuacuuccucccggccaagaaggcaggaagggccagcgcuuaccucggagcucacaggagaugccgucgggggucugggccaugggccgggcgggccggggaggcccaacgagcuccggcgggaaacagcagaggacgagcgcgcacacaggaagccuggggcccagacccgcacggcagccaccugcuccuccggcg

SEQ ID NO: 15783 - RNA, 5720 nt, Homo sapiens
cagauaggucuaauugucaguucuacuccauucuccucgaaaugguuacagauucgaccuuucuucccucuuggcuuugacccaggcacaggccaccagcaucuccucuuuggaccugagaaagucuuuucucugcaggucuaauagaaaucugaggccugggccaggcgccauggcucacgccuguaaucccgacacuuugggaggcugaggcagguggauuaccugaggucaggaguuaagagaccaaccuggccaacauggugaaacccugucucuacuaaaaauacaaaaauuagccggguguggcggugggcacuuguagucccagcuacuugggagggugaggcacgagaauugcuugaaccugggagacagguugcagugagccuagaucgugccacuacacacuagccuggacaacaagagugagacucaucucaaaaaaagaaaaagaaaaaaaucugaccuugucacuugugcuugaaauagcaaguccuccaggggcuuccucucaagacacuguucagacuccacaaccugcuucagagcccuguggggucuuggcccuggccaccuuaaaaccucacugcuuuccuccccuggugcaaaucagagccuccacacacgucccuggguggucuggauguccucccugccucgcuuccagucucuaauuguggguuacgccaggucccuccucagccaucccugcagugcccaugguucuucccugacucuccucugugggccacccugcuaaugucucucucauuagagucccaaagaaccccagcccuccauaccauccauucaauaucuuaaaaaacaaaaaacaaaaacaaacaaaaaacaugaagucggccugaauuuagaaauauucaagugugcaaagaguucuaagagggcuguacuggguuugccauguucuuguccagcccauggugggcauucaguggcaggauuauaagaacaagaacgaacaaaaggcuaggguguggggagcgggcagggcuggaaucugauugcccuguuuccugcagagcaaagauggcgagaucaagaaagcuggcucagaugguaagugggacccugggguguggcaguacauuugccaggagguguccuuauagacagcccccaaggcacuugcucuccuuggggaggaaggggagaggccagguuuuucuuccccucaccuccaaggucugguaccugaguccccagcuccgccuugcaggugacauuauggacaguuccacggaggccccucccaucucgaucaagucccgcacccacucugugucugcuggugagugagggccacuguguguguugguagugggagcagggacaggcaggaguugggucagacuguuguucagaccuaucgccaaugccugaccaggucuuggcugacaccuuucucccuacagacccuuccugcagaccuggcccagggagccaggggccugagucugccaccuggaagacacuggggcagcaguugaaugcggagcucaggagccgugguuggggccaacaggaugguccaggcccucccuccccuggucaaagcccaagucccugcagaaccagccccuccccagacagccugggccucccagaggacccuugcuugggccccagaaaugaagguaggcaggcaccugauuccccaccccaauccuggccucggggcuggaggaguuccugcugggaacucagcuccucuaaggacccugagggugggaggcaagggcuggagugggggcagcuguuggaauaccccugauucccuggccucccucagauggccagcugaggccgaggccucucucggcagggcggcgagcagugucugugcaugaggaccagcuccaggccccugcuggugaggggagacaccuccacgugugcuugaaugcaggagaugugggagggugggcuucuggggcucccuucauagcuuugguccuuggagggagccaccagugugugaggucucaagaaaucagggagccagaagaccaggugcaaggguuugacagcaagcccuuccaacuagcacuggcuccacuucccgaagagcagccucugccaggggugaggacgcagggacgggggaugcucugaaggcagcagugugugugagugcaugcuuaugugcacuggagguggaagagaggggcaggggauggacagaccccaagccuuagcaacccaccccaagccuuucugugucccuuagaacggccccugaggcugcagcgcucccccguccucaaacgcaggccaaaacucgaggcaccuccauccccaagccuagguaagaggggguccaggccagcugggaggguggcaggacugcuuagcccagcccugacccuuccucucucucccucccuccccucacaggaucuggccuuggaaccgagccucugcccccacagcccacagagcccuccagcccugagcggagcccacccuccccagccacagaccaaagaggcggcggccccaaucccugauccucuccucuccugccgcaugagauuauuuuauuaaaaaacucaaaggaagcagaguguggagcgguaucuguccugcgugacgucucacaucggaguuggcucagacccuggcugugcauccaucagaaagugcaaggcccaggccaugagcuggggaggaagccuggaaagaaaccaccgcugcaggucaauggagccugggacuagugaccaagaguuggggcagacccaggcacucaccugacagcuuggacccgagcacagagggacgugcaggguggcucauacucauacuggaaggcagaaccaucacgaugccucuuuggggguuccugaaagggguauggugucuggggaagagcuaacaaggaccccaaccccauccaaggcuacccaugcucccucccagcucuaccucaggccuuccuuguucuacccuccagcugcagaggggcuaugcucacccagacagagcagggcuccugggcuccccugguagcuccgguccugggaaaaggcggccgauucuugcagggcaacccuacaaacuccuugaacuccaggcuagguuucuggggccuggucacaagagccugguguggacuggggacauggcuacggggugagagacugggagugcagcucuggaguggggagcuggggguacggcuggcguguggggaccugggggucaggguggcaggggcugagcagauggcuggugagggcugggagcugcuucucugcccugggucuggagcagccaaggacagggcaggcagaaggcugaugcugguaccacuuuccucggaugacauguggccggguaaggccgggguuccugaggaggaggggacuuauuguaggcacagcccucuccgcucagggcagcugaguggccugcgagcucagacaggacugcagggaccguguucaucccccacccaccgugcaccuuucacagcauccugcgcagcccgggaaccugacugacaggcggcagugagugccugugaccugugcaucaccucaccugaggaacugggugaggaaggaggagaggcuaugagggucagagauagguccugcagagccgggucuggugggggcagcucagggccugggggguucaggaagucuuaucagcacuguggaccugggccccagguauccccccaaccucuccagucccccuuacccuguguccucugacaggggccuagagagcucagaauuagcuggucauucucagagaugcacagcauugagcuggggacaguguacacagcuucucccugugggacaugaacucuguaggacaggcccguuuacucucauguccugugggauaugacccuugcccaacuccucacccugacaucucccaagcaaauccccagacugaccguggccuugcaucgugaggcagcccagugggugacagggggugcugugcaagggcccuccagugucaggcagcuuucagccaggcacacgagugcccccugaugcuccugguccucccgcauuucauccagaagcugggacagugauaggccuggggacaggggaccaugggaugagucaaggcuuaaaggggaggaccaggagggugagggggaagacagcuuauugaggaagcauaagguuaaggcuggagagaucacugcacagcguguuaggaucacuggucaagcucuacaguaccugcauuggacgagguggacucugaaaggugcucccuacaggaagagaguggccaggacucaggaaccaugcugaggccugucuaccuagauacaccauccccucaccaaacaacacguggcccccgagcccaaccccagacucacucaaggcagucauagagcuuuuucugaacaucuaagucuugguugcuaagaaaaagagaaggguaguuaaugggggcccaagcccuccuaccccauaggcgucugccagcgccggccaggcugggguggggagagcugcuggagggcggaggcaucacuuaccaaccaggcacccguagccggggcugcuccgugggcagcaggcugaagcgguccaccuggagauagaacucugcgggcuggaggaguucggggggaagggggggucucagaaucgucacgaagagucaugcccgguaacccgcccaaggcagucucaccacucaccgcgccgcccucagcgaccuggacaugaaccccgcaguccugcagcagcagcagccggcccucugucccgcggaagccgaacuccuucuccucccugcaacaagcaggauccucacugccgggcccaccugaacacaaggcccgcccaccucgcgcucuccugccggacuccgaccuccagagccgcgcggggccucucaccaguccgagguguccagggccucccgcgucaccaggcaucggacacugugggucccgucagacacaagcagcguggccccgacgucggacguaucaggggcgugggaugggcccgcgaccgcggccucggcguccuguaguaccugacggcggcgagcggcgucaaucccaccaccccgggccuccgccucggucuccgggcccugaaugggggcucaccucaagcagcugcccggcucguggacuggagggugucucugaccccagaaucagcucccgaauccagggccguaggaccagccuccccgaaccugccauccccacggcuacacccagcggaugcaacgggcccggguuucccgcgggcgcccaggccccgccuuuccucggaagaggaagcuccuucgcugggcggggccggaggaggaggccccgcccacguacaccccgcgccugcgcacgagggcguccugcucgggggccugugugcagacucccgcugguccaccccgcuggugcacgggaugcuggcccguuuacucucaucgcggcgucacucugacagcggccaggcauuugggccguucgucaagauuccugugguaccgguagggaacagaacaagggcuggucccgucccuggagaggguuccagggccggaggcugaggccgagugccguccgagcgaguugacucgaaaccauuucagcaccgugugacccccgaacgguucagcacauauuuauuaugacucaguuuccucaucuacacagugcacggucuuguaaggccaguggaaauaag

SEQ ID NO: 15784 - RNA, 2576 nt, Homo sapiens
ggggccacggggagcggugguguccagggcccggucggaagucagcaaguccagcuucagcgcguuucccucgaggcgcccuugagcuguggggcggagccgggcggaguccggggcucagagguggagccagggccgaccccugagccucgcaccaccgccaagcccccggacucacccgaggucggccgccuguaguugucaggacagagcgucgggucuggggggaugggccccgagaugcgggacgggcccucgcacaugccgccggcgccgcccagcaacggugccccgaggccugcagggcuguuuaccucccuccccgggcccccuuccccaaccccgggcccccucccucgcccggcacccugacccuggcgugcccgccacucccgggccccugccgguccccgccugggccccggccucgcucgccaccuccgcgaccucugcucccagcccacuucucggucccgcucgcggccucucccccgcggcacucgggcaggggcucacucgagagguuuugccgccagccgcugccacccgacgggacuuguuguugccgggcaaccguggcuuccguccccggggucagggcccacugaccccggcgcaaagcguccuggggcuuguaguuucggccgagggugggcuccgcggucgccgguuucucuucccagcucugcccucgcuugcuggccggucuccggggucagcgcggggccaccauccagccccuuggggcccgccccaagcagcugucgaggacgcacucagccugcgcagccauggccucggcaggggcggagaggcggccggggguccaggaggcgacggucguggggcagggacagcucacggaggagcccggcagcgcucagaccuccgaggugaccgucaggcuguuuaaccuucaaacacagggccgcagcgcucugagagguggaacugagcgccccgacccgcuaacugccaggcugggcccuccaggcggggaggggcacaggcugguguccuuauucccguuucggugucuaacguuagguguucagugacggaucccuauguccuuugcccggccauggugaccgauggccugugugucaucucuaguguccaguggcgggagaccaguuccuggugccugcccaugaggcccgcggaacccagagugaagaccagcgcccagcaggcgcagcuucggagucggagcuccaggaggaaggacccaagcugggggaggagcggcccaagccgcaugccggggcgcuagaggagagaggccccaggcccguggucuccauugugaggccccgucaugguccaaagagaaagccugucaagugagggggcucucggggggaaggagcugcagccccgggguuggggcacacaccacaguaggauuccuaaauccugcacuccugcagggaggauucucguccccagccacuaccaucacucuccucccguuccucaagagcccccguguagggagcagcaggagagugggagcuucagggcuuguaggggccugggcucacuggccucuaagccucuugggccuggggucucauugaccaggaacgggacaggcgucgagcccuggggcugugggcaggcugggcuauucccugggccagggaaugggagccagggcuggagccuggcucaagucucuugucccuggcucaggucucucagccucccgggccuucgugcccaucuuaaggcugaagcugagcugccacccaagcugccgcugcaggaggaggagccagaggacagccagagugagcccucaccaucugccaaacagcacaaaaaagccaagaagcgcaagagccugggggcucccgugcuccacgcuguggccagcauggugucugcacccuuagagacauugaggcuggagcgugaguggcagucccuggacuguuccuucucccccugccuguggggcccgacauggcacaaccuggcgcucuagccucugcccugcccugggucuuugcaggaaaggcccagcgccugcggccgcuguaccaguacgucaacuauugcaacccugagcugaaccaggcagggaagggggacggggaggcugagguggaggcagaggcagagcuggccccgguucccgaggagggagguguggagcaacugcaggccuugcugcccuuggcaggugagcugggcccaggccucgcuuugcccugucccaguccacuagugacccccacccaugcccuggcuccccucggagaggaggcuggagaggagccugggggcuugcccagcuugggggugagugaccacaaggccgagguggauaagucaacccagguggacaucgacaagaugcugagugucugcacugcuccacuuguccccccgcucucuccucaguacaagugacugucccgccccacugguggcuccccuccuuccacgccugaauuuggcuucaggcuuccugugggccuaggcccucugguggcgggggcaaauuuggcaccugcccccacuugggacuuuggucuugcugaaaauaaauauuuuucuuuuucaaa

SEQ ID NO: 15785 - RNA, 91896 nt, Homo sapiens
gaugagagguaagggccgcugcagaaugcugagcugcuggggagggaugucugugggcagaggcgaguucucucucugccuagggagauccgggaaggcuuuucagauaaggagcaggcagccaguguacacccuucuccccaaagccuggugggccuggccucucugagccacacucucuaacugagaagaagccacucuggugggcauguuucaggugggcauguuucaggugggugguacucuuggguugcaggaagggagacggauagggucugggggcugacauuugggguuccaaaacaacauugucacuaaccagcguccuucguuucugaagaagcuugcgauucugggugcucuugucuucugugagaaaggauucgucuauggucacuccugaaggccguggcuguaaucugcacagagaagggaaagcugauggugggugacagaguccagagugggaagagaacucccauccuuucuagauccacaaggcauagccgucucccugagccaggcucugggugcugccuccggauucccagagacacugccaagcaagucccuggccuuggguccaaaccauuugcuuacauucccagaaacauucuuuucaucaccaaaauuucaccaacuacugcagcagcaggacauccuccccaugaacccagagaaccccaugggccuauacuucuguucaguguucaacuguggcugugguauugguuucauguacacaacucuggcauacucuggggcugugauacaaagggcaggugcuguaggacaagaagcacagggucugggguccaggaucuggggugugagucugaguccugcacuuacuggcagcugauagggucuaagggcugacaucugggguucuaauaggaccacccuugagcaagucauuuaauauuucucagccugguuucuucacaaagaaguggagacaacucuuuuuuuuuuuuuuuuuuuuuuuugagacggagucuuacccugucacccaggcuggagugcaguggugcgaucuuggcucacugcaaccuccaucucgcggguucaagcaauucucugccucagcaucccgaguagcugggauuacaggcaccugccaccacgcauggauaauuuuuguauuuucaguagagacgggguuucaccauguuggccaggcuggucuugaauuccugaccucaugauccaccugccuuggccucccaaaaugcugggauuacaggcgugagccacugugccuggccagggacaacucuugcuuugccuaucuuacaaaguuaugaaguuuauuuuauuuauuuauuuauuuugagaugcagucucacucugucacccaggguagagugcaguggcgccaucucagcucacugcaaccuucaccuccuggguucaagcaauucuccuuccucagcuuccugaguagcugggacuacaggccccugccaccaugcccagcuaauuuuuguauuuuuaguagagaugggauuucaccauguuggccaggcuggucuugaacaccugaccucaaaugauccacccacguccaccucccaaacugcugggauuacaggcguaagccaccgcgaccggccugaaguuuaaauaagaaugagcugagugugguggcgggugccucuaauuccagcuacucaggaggcugaggcagaagaaucacuugaaucugggaggcggagguugcagugagccgagauugcaccacugcacuccagccugggugacagaguaaaacucugucugaaagcaaaacaaaaaaaauuagaugugcaucugggcgugguagcucaugccuguaaucccagcacuuugggaagccaaggcgggcagaucgcuugagcccaggaguucgagaugagccugagcaacauagugagacuuugccucuauuuuuauuuauuuauuuauuucugguuucaaacuccugaccucaggugaucugccugccucagccucccaaagugcugggauuacaggcgugagccacuguaccuagccaauuuuuuuuuuuuucuugagacagagucugacucuguugcccaggcuggagugcaauggcaugaucucggcucacugcagccuccgacucccagguucaagcaauucucuugccucagccuccugaguagcugggacuacaggugcacgcuaccgugccuggcuaauuuuuguauuuuuaguagagauagaguuucaccauguuggccaggauggucucgaucuccugaccucgugaucugcccgccucagccuuccaaagugcugggauuacgggugugagccaccgugcccggccuauuuuuuuuuaaauaaauaaaaaaaaaugagauaugcaaaauaccauguaaacugcaaugaacugcauagauguucauuaugacaguagaacaggaaaagccucuuagaacagccauccuaggaaggcauuuggggaccaacaggaagggcuacugugggcaggcaggcucagguggaacaaaaggaagaaguaauuccaacaauccauggggugggggugugugauuuauguugccagauagaucuuguguucacuccucuugcuugcuggugauuuugggcaugccgcuuaacaucucugaaccucagugucuuugcuuauaaaaguaggauuaggacuacccaaacuccagggaaguugagagcccuaaugugaacccaguugagaaacucugcccuguaaugcugcucagcuauaguccauggagcaguaauauuccaaacccuaguccucuauugcuucucaacauuggacaagugugagcaaaacauauggauuaagcagucggugaggagaaggaagagugucugcccagaugagcuugggugugagacagucuuggagaccaacaagauacaacagaucaaccccaagugcucacuggguuaaaucaauaccuucuuaucaagacuaauauauuauucgccgugcaguggcucaagccuguaaucccagcacuuugggagggagaggugggcaaaucacgaggucaggaguucaagaccagccuggccaacauagugaaacccugucucuacuaaaaaaauacaaaaauuagccgggugugguggcgggcaccuguagucccagcuacucgggaggcugaggcaggagaaucucuugaaccugggagugggagguugcagugagccgagauggagccacugcacuacagcuugggcaacacagagagacucugucucaaaaaaaaaaaaaaaaaaaaaaagacuaaucaauucuccaaacucuguucuugcucaugcuggaagcaccaggaaaggcaagguaagcaagaaaauuggggaauucuauaaauucugagaagcuguugaauggaaaaguucaguagguaacagauguuguuaguuuugaauaucaaaggagacaacauuauaaaacagacuuaaaacaaggcaaaccaaacaccugcuagggccuguacacuuauccaaaaagcuugggcuugggcgugauggcucacaccuguaaucccagcacuuugggaggccgaggugagcagaucaugaggucaggagaucggccgggcgcgguggcucacgccuguaaucccagcucucagggaggcuaagaggcgggaggauagcuugagcccaggaguucgagaccugccugggcaauauagcgagaccccguucuccagaaaaaggaaaaaaaaaaaacaaaagacaugaggucaggagaucgagaccauccuggcuaacacggugaaacccugucuacuaaaaauacaaaaaauuagccaggugugguggcacgcgccuauagucccagcuacuagggaggcuggggcaggagaaucgcuugaacccgggaggcagagguugcagcgagcugagaucaugccacugcacuccagccugggcaauagagugagacacuccaucucaaaaaaaaaaaaaaguuuaagauguuuuauauuaaauauuuuaugguaacccucagaggggaaugggaaacauuuauauuucuaccucaaagcuggaccaaacucaguuauuuauuuacuuuuauuuuuauuuuuuuaagacguaaucuggcucugucgcccaggcaggaguguaguagcaugaccucggcucacugcaaccucugccucccgggcucaagugauccuccugccucugccucccaaguagcugggauugcaggugagcaccaccaagcccggcuaauuuuuguauuuuuaguagagaugggguuucaccguguuggucaggcuggucucgaacuccugaccucaugaucugcccaccuuggccucccaaagugcugggauuacagacgugagccaccguacccggccucaagcucaguuauuuaagugguaguaggcaguggguuugucaggguuauaucuugguauucagugaacgcaagcugcugaguuccauccaccaagugccaggguuaugagggugaaaggagaaaagccgauagggaggagaaaccugccccaggaaaaugcacaauucgaaggucccuugcagaggguccugaugacauguuccacagugcuaaggucuagcuuauccaucaugcugccccuuuuuaaagggaaaggaugaggacauccacagugucucuaagagaaacagugagucuggcccaacaucacuaaaugcuggugaauaaggaauaugguagauuaaugauguuguauuuuuuuuuaaauuuuauuuauuuacuauuuuuugagacagggucucacucucuugcccggacuggagugcaguggcccgaucucggcucacugcaaccuccgccucccagguucaagcgauucuccugcuucagccuccugaguagcugggauuacaggugcaugccacuaccgccuggcuaguuuuuguauuuuuaguagagaugggguuucacuauguuggccaggcuggucuugaacuccugaccccaaaugauguacccaccucagacuccuaaaguguugggauuacaagcaugagccacucacugcucccggccuguauuauuuauuuauuuauuuauuuauuuuuuuuugagacggagucuugcugugucucccaggcagcuggaaugcaguggcaagaucucagcucacugcaaccuccuccuccuggguucaagcaauucuugugccucagccuccagaauagcugggauuacaggcacaggucaccaugccuggcugauuuucuuucuuuuuuugagauggagucucacucugcugccaggcuggagugcaguggcaugaucugggcucacugcaaccuccaccuccuggguucuccugccucagccucccgaguaguugggacuacaggugcaagccaccacaccuggcuaauuuuuguauuuuuaguagagacaagguuuuaccauguuggccaggauugucucgaucuuuugaccccgugauccgcgcaccuuggccucccaaagugcugggauuacaggcgugagccaccacgcccggccauuuuuuuuuuuuuaauagacagggucuugcuuuguugcccaggcuacaaggcacuagugugaucacagcucacuacacccucucgaacuucuggguucaaguaauccuccugccucagccuccugaguagcugaaacuuuuauuauuauuauuauuauuauuuguagggacagggucuuacuauguuucccaggcuggucuugaauuccuuaccucaagugauccucccaccuuggccucccaaaguauugggauuacaggcaugagccaucaugaccagcccugugcuucuuucuuaaaaugaauggggauucucuuucugggucugcuucauauccuuuucauagagaauggcaguuuacuaaauuaauccugugcuggguaacaauucucuuucucucucucucuuuucuuuuuccuuuuuuuucuuuuuucuuuuuuugagacggagucucacucugucgcccaggcuagagugcaguggcgugaucuuggcucacugcaaccucugcccucugccucccugguucaagcgauucuccugccucagccucccaaguagcugggaauacaggugccugccaccaugcccggcuaaauuuuuuuuuuuuuugagacguagucucgcucuguugcccaggcuggagugcaguggcaggaucucggcucacugcaagcucugccucccagguucaugccauucuccugccucagccucccgaguagcugggacuacaggugcccacccccaugccuggcuaauuuuuuguauuuuguagagaccggguuucaccacguuagccaggauggucucgaucuccugaccuagugauccccccgccucggccucccaaagugcugggauuauaggcgugagccaccgugccuggccucuuaggggcuuuuguaggcuuuucucugucaaggcagcagacccugaagaguuuaggugggauugggugguguuuuuuuuuuuuucccccacugggaaugaguagaaggggggacacuacauucauucaacacuuacugggugccuauuacauacaagagcugugucaagagcuucacauauucugccuaaauguucccaacaauguuuguggggugggcuguaucauucccauguuugagauauauaagcugaggccuggaacuugaagggcccugucugaagucccaaaacuagaaaacgauuuagccaaaauuuuuguuuuaauccguauguauggcucuccaggcugauggagcuggucauauuuugcaguacccagaggcuauacaccugaguacaggcagaagcuacccagaggaugaucucuccaggcuucuaaaguauuucuuuacuuguucaaugguaauauuacuacuuuauacaguuguugugaggauuaaauaugguacguaggccggguguggggguucacgcuuguaaucccaguuugagaggucgaagugggagggucgcuugagucuaggaguucgaaaccagccugggcaacguggugaaaccucgucucuacaaaaaacaaacgaacaaagaaacacccaaaaauuagccaagcguaguggcgcaugccuguagucccagcuacucgggaggcugagguagaaggaucgcuugagcccgggaggucgaggcugcagugagccguaguagugccacugcacuccagccugggcgacagaacgagaucuugucucaaaaauaaaauauuuaaaaaugugguauauaaagcauuuggcauauaguacauucaauacaagcugguuguuacuaguaaugauaaagugcgccuaccguuuugcuagcacguaacgucuucacugggcuaaaucagcccgauucuaaccauugacucuguggugcuggagcccuagaucaauggucagaggccagcaggaggugcagagguccggaucaagugccauuucccucucuagaaguacucaaacccucaucucugcccucaucccugccagcgccuaccucgacgcggacgagaagcugugguaccgcgacugcuggcaggccaugacccacgggcaggcgggcaaucagcacccgcggccugggaagcugugguagcguacagccggucgccauggcgaccaggccccagaggcccccccgcggcgggggcggagucagggaugcgccacgcccccgagccuagcgcccgcgggcugggaguaggacaaaguagcaaagguggacugggacccggcagcgggugcccugagagucaaccacuacagccgauuugaccccagguaccagaacugaggcagggggaugaacagaggccauggggagggaagugugcugagaggccggagccgcuuugccggcgggaaugguaguuuucggugucccgacgucucgaugggacaggcuuauggcugaggacgguuauacuacaucucccagaauucucuaccagcccgaguugcuccgccucucgagagcucugcauugugggguauggaguucgaaaugugguaaggcgugucaguguccaaagaggggugccggacucggacucgguuucccugcggcccagggaggcucacgggccauuggcugagcggggcggaucuggucccgcuccuccccgcccccagugacacaauaguagcucccuccaagauggcggcagcgacggcagacccgggagcugggaacccgcagccuggggacuccuccggcgggggcgcugggggcgggcugccguccccuggggagcaggagcugagccggcgcuugcagcgccuguaucccgcggucaaccagcaagagacuccgcugccgcgcuccuggagccccaaggacaaauacaacuacauuggucucucccagggcaaccuccgcguccacuacaaagguaucggcccgucaggcuggggggaauuaaggcuagagcguccgugggguggcucugcugccaggcccccgcccuaucaccucccuuucccugccuaggugcuccaaguuagggcuuggcccuuucaggauguccaggguggugaggcugaacaggccgagggcugacugccuguucucuguccugagacaccugccgucaagagaaccgcaacagguguccaaacccagugcugggccggaccuuccacuccagggccuccgugcuuauccuaggcuggcgccaacggcagcgggaccuuucgccacugcuuagaagaaagggguggucacauaccuaccauuagcgugagacucaugggcuuccccaccugccaggcauccuagacugagccugggguuccgugcuagaguuuggggggugucuuccaggucggccucauccuucuuccccuggccucccaggugggcugccuggauucuagagaggcugccagcagcacuugaguaucucucacauugccucuacccuuguuuuguuuguaugggcagugucucaggcaggacugcuguucucaggaggaggugaggcaaagguggaagguuuaaguguuuauucaguugucuaaugauuccucggccuguguaagugcguccucuggccacagaggaguggaguugucauggaggaguugcagagaaaaaugaggcuuccauuugcauuuccuucugcugaaauuucuuacuugcccucuccuguuaggucauggcaaaaaucacaaagaugcggccucagugcgugccacccaccccauaccugcugccuguggcauuuauuacuuugaagugaagauugucagcaaaggaagagauggguaagcccuucaugaccacccucuuucccugaucauggagcugaucccuguggucagaguucagguccuuuggcuggcacuuguugcugaugugagcuggggagccgcaugggucugggcugccauuauuuccugacugugggcauggucuggucuaagcagcagaucuugauggccaguggguguguuggggguaaagcagggauuauuuuuagugaugauguaauuugauaccuagaagguuaggcaaacaaguaacaaguuuacuuuaaaaauuuaguguccagaauggaguuucccucaugagcaugugguguuuuugugacuuccuuccuuucacauucuugcuguauucaugagguucuuuuuuauggcauuuagucauguggaggcccugguagccuucaaagagauaguagagucuuugcagcauucaugaaagcuucuguggccaccggccugucaucucaggguaaacagcauacacaugaucagaaucaggugaccuugcugcucauaaacuuguuuuucaguccaaggacuugaacacuacuaguuggaucaacuuuaggaagguccucauuaaagucagcauuaggagccaggcacgguggcucacgccuguaaucccagcaauuugggaggcuaagaugggcagaucaccugaggucaggaguuggagacuagccuggcaaacaugcugaaacccugucucuacuaaaaauacaaaaaaauuaacuggcauaccuguaauccuaucacuucagaagaccgaggcgggcggaucacuugagaucaggaguucaagaccagccuggccagcaugguaaaaccccaucucuaaaaaaaaauucaaaaauuagcugggugugguggugugcaccuguaaucccagcuacuugggaggcugaggcaugaaaaucacuugaacaugggagguggagguuguagugagcugagauugcaccacugcacucuagccugggcaauagagugagacucugucccaaaaccaaacaaaaaaaaaagucagcauuagggagacucccuauuuuaggaugauccaagcagacacaggaaaucauaggggagauacuuaauuuuuuuucuuucucccagucucccuuuuuuucccagugauugugacgaagcagguguguaaguuaugaaguaacaugacugcagcuaccuuggaaaggcuuuccucaucagacuuuagguuuggugucugaaguuugccaaccccucuggugaccaugccaacgcugaggguguguucucgaacauucagaacuucuuucuccuagggacuguccccuuuguagugcaugcaaaaugcuuggccaagggacuaggcugggggcaacacugccagagucagagccuugccuacuuccucagugauguaacuucucugccugagaggucucuguggucuuggguagauguuggagcuucagucuccugaucugcacugugaggauccaggccagcaucuaagcugccugaacuccagaauucuaugccucugaaauucugaucaugggaagcugcuguaucuuucucucucucucucuuuuuuuuuuuuuuuuuuuuuaaugagauggggucuugcucugucucccacgcugaagugcaguggcaagaucacaaucacagcucacugcagccucgaccuucugggcucgaguuauccucccaccucagccuccugaguaacugggaauacaggugcaugccaccacgccuggcuaauuuuuuuuuuuuuuuuuuuuuugagacggaguuuugcuccuguugcccaggcuggagugcaauggcgcaaucucagcucaccacaaccuccgccucccagguucaaguaauucuccugccucagccuccugaguagcugggcuuacaggcaugugccaccacaccaggcuaauuuuguauuuuuaguagagaugggguuucuccauguuggucaggcuggucucaaacuccugaccucaggugauucgccugccuuggccucccaaagugcugggauuacaggugugggccaccgcacccagccuaauuuuuuaaauuauuuguagagaugaggucuugcuauguugcccaggcuggucucuagugauccucccaccuuggccucucaaacugcugggacuacaggcaugagcuacugcacccggccaucuuucauuuuuauccccaucuagugcguuuacagacaggaaaguuaaauuuaugggagggcuucaaagcuccuauuuucaccuuccaccgucugauagaagcacauauauuuagugugcuugaacuagugugaaugagaauagccccuuaaaacaagcaccuugaaaauaauguugacuaaaaugguggugcuggagucucauacugccacagaaacugaagugcacuucuuaaauuuguagggaggaaaauggauuguuuucuccuagucuuuaucauagauaacagcugaguuaguuaucuagguagagagcagagaccaacuucagaagggaaguguuuacacuuagagaccuggauucuuuuuuucuuuuuguauuuuuugagagaugaggucuggcuauguuggagaucuggauucuuucaacugguuuuaacauuucaguuuuagucgaucuugcugugucauguuagauuggugaacuauagguguugacuggaagucuaaagaaaggugggcaucuauucccagcauuuuacaugugguaaacauggcuguugagcugaucuggaaacaucagauguuaauuaauuaauuuauuuauuugccacacagucuccuuuaucauccaggcuggagugcauugacucaaucucggcucauugcaaccucuacuuucuggguucaagugauucuccugccucagccucccgaguagcugggauuacaggcauacgccaccacgccuggcuaauuuuuguauuuuuaguagagaugggguuucgccauguuggccaggcugguuucgaacuccugaccucaggugauucaccugcgucagucucccaaagugcuaagauuacaggcaugagccauggugcccagcaaggaaacaucaguuuuagaaaggucucaggucauguauaccugugguauccugcuucaguugaccacugucagauggcaagaguaugaauagcuccucauggucucuuuauggaaucccugaaagccuucccauggcugggaugcagccacauguuaguaugggccagguggguuuugaggaggccaaaggcaguuacacagggcaggcagacaucaacuggcucauuucccuuuuuuuguagauuuuuuuuuuuuuuuuugaggcagggucucgcucuguugcucaggcuggagugcaauggcaugaucacagcucaccgccaccucaacuuccugggcucagucaauccucccaccucagcuuccugaguagcugggacuauaggugugugccaucaugcuuggcucauuuucuuauuuuuuguagagauggggucucacaauguuuccuaggcuggucuugaauuccugggcucaaguauuucuuccaccucagccuuccaaagugcugggauuauagucaugagccaccaugcccagcugauuuuuuuuuuaacuauuuuauagagaugggaucuugcuguguugucuaggcuggucuccaacuccuagccucaagugauccuccugccucaaagugauccaaagugcugggauugcaggcaggagccaccauugucagccucccauggauuuuggagguguguuuuuuauccugguuuaguccaugacccaagcauuaacugguugucuagcuuuccuguguuaccuaguuugauccucacagcaucucuggcaaguggcuagagcaggugaucaucuaccuucccauuuugugagugagcccugagucccugggauguuugguggccuacccuggcugcagggcuuagggugugcaguggaguagccugacuuaucagauguccucgccugauccuagacacacauguccaugcugcugcugccuuuccccauuguagcuguugcauuucuucccuggguagagugaaggaauguucuguuggauuccuaccagauugcaauguuaggggacagagcugaaaggugcauggugcuguguagggccagagaauuguggcaugcucugggccgggcuugaucaacuuacuguuccauuuaaucuguaaacuugcuuuucuguagauuugaguacaccuccuuuguaaaagguauuuauaaacccaguuguuagugucauuguucuccagaacguccuuuguuuugacaauaucuuuuggagaagaacacacuaagcuagucuaauaaggaaaguuucaugucaagauuucacagaauauuuauauauaccuacuauguuccaggcccuauacuagguauagggagaacagauguaaagccagcacagaucagcuuuguccucaggaagccuguggcccauucaguagagaguggacugaaagucuuucugcaagaggaggcagagccugggaacaguugggaggaaugaguaggaguuccccaguaggcgagaccuguuagaccuaugagucugauggguaacuagcuugacuucugggugcuaggcuuucugggcacuccucaaguauaagagagcucuguggaguaggaggggcuguguuugagcuaagagcuuggcacagacugaugggcuucaacugcauuuugccgagucaccagagcugugaacucggggagcgggucugguggggugaggagacaucagagcacugccaguggugccaggagauaaggggcauccaggucugucuuucuaggaagcgaaggagggccugaagcugagggucccuggggaggagcaaugucugcaggcagaguucauggaccugugggugucccuggcucuuagugaugacacauggaggguguggcuggcuaggcugacagaugcuccagugugacccucaaaauagacuguaacaucaucccagcggcggaggccuccugacaugugaugguugcuuuacccaagaguaguaggccugggcuagagcacuggaaggcauggagaggggugggggcauuuuccucuguagccagugucugggcccaggcccagagcaggggucucugaccacagccagccuucccuugcuccugcagcugacuuccuuuggccaggcagcagugcacucauucauucauuccagacaccagggcgcaguacccauuguuuuuuuuuuuugguuguuguuguuguuguuguuuuugaaacagagucucgcucuguugccaggcuggagugcaguggcacaaucuuggcucacugcaaaccuccgccuccuggguucaagugauuccccugccucacccucccgaguagcugggacuacaggcgugcaccaccaugcccagcuaguuuuuguauuuuuaguagagacgguguuucaccauguuggccaggauguucuagaucucuugaccucaugaucugcccuccucagccucccaaagugcuaggauuacaggugugagccaucacauccauuguuuugucccagccugggccccaggagcacaggcaugaggccccaccgguggugucgaagggucaggccaccguaugugucauauccagggguggccuggaggauggacuguaccucagaguuugaggaaaacaucauagaaucauauaagaggugaugugggcucuggaaagaggaguuagaguguucuaggugaacaaagugagaagcagaugcuucaggcagaagaaacagugcauaaaaagacauggagcuggccgggcgcaguggcucacaccuguauucccggcacuuugggaggccaaggcgggcggaucacgagguaaggagaucgagaccaucguggcuaacauggugaaaccccgucucuacuaaaaauacaaaaaauuagccaggcaugguggcgggcgccuguagucccagcuacucgggaggcugaggcaggagaauggcgugaacccgggaggccgagcuugcagugagccgagaucgcgccacugcacuccagccugggcaacagagcgagacucugucucaaaaaaaaaaaaaaaaaaaagagauguggagcgcagaacaugaggucgguagggccagacugaaaauaccuuguguguggccuggcucaugccuguaaucccaguacuuuaggagacugaggcgggcaggucacuugaguucaggaguucgagaacagccuggccaacauggcgaaaccccaucucuccuaaaaauacaaaaauuagccaggcgcuaauaauagugguggugcaugccuguaaucccagcuacuugggaggcugaggcaggagaaucacucgaaccugggaggugaagguugcagugagccgagaucacgccacugcucuccagccugggugacagagugagacucugucuuaaaaaaauaaaaaagaaaauaccuuguaugcuguggccagggagcgugggcuguaucuugagggcaguagcaguguggggggcuguggaucuacccaugcuuuugagagugaagaaaagaagagacucugccagucugguucagccaggcuucucuggccaagagcccuuguccagggugggccagugacuuuaggucuuuggcucuagcaugguuuucucauagcgguugucuuuuuuucucuuggcuguuccuuugguaugaagagaugaagggauggggugugaaagacugguagccaggaggcuucucagaggugagaggacucugcuugugcuggaguucugguauuuugguuuugccagcucccaucugaaagacaguaaugccccauguuuuauacccaagcaucuccucuggugagccagaaucagccaaagugauuuuccauggagaccuagagagccacuguuaauuaagauaucuugauuaagaucucaccugccacauuccugguguggaggaccaucuaagcuuaggcccuuccagcugagagacagcuguggcuggcuucucacccuggauccccucaccaaguuccagucuacaugcauuguacagugcuguugagaacuuuggugcucauaugucaucuggggaaggcguuguccugcccgcccugauaagaaggugcuguccuugcccaagguagguacaggccgugguugugccccauuuucccuuacugccccccggaguugauggucuuacaggcagaugcugagcuuugggcugcacuucuacucagguaacacauugugcuauuuguggagacauggaauguuuggguucuggaacacaggguaggauguuuggguucuggaacacgggguaagagaacuggagucuagaugguggccacuguucuuugcuuuuuuuuuuuuuuuuuuuuuugagagagggucucucucugucacucaggcuggagugcaguggcacaaucauggcucacugcagccucgaccuccugaguucaagcaaucuuccuaccugagacucuugaguagcugggacuacaggugcaugccaucaugccuggcuaauuuuuauuuuauuuauuuaauuuauuuuuugagacagaguguugcucugucacccagguuggaguccaguggagugaucucggcucacugcaaccuccgccucccaggguucaagugauucucaugccucagccuccugaguagcugggauuacaggcgugugccaugacaccuggcuaauuuugguauuuuuaguagagacgagguuuugccauguuggccaggcugguuuugaacuccugaccucaaaugaucugcccaccucagccucccaaagugcugggacuacgggugugagccaccauccccagcccuggcuaauuuuuaaauuuuuuguagagacagggucuugcuauauuuccuaggcuggucuggaacuccuacgcucaaucaauccuccugccucagccucccaaagugcugggauuacaggcaugagccaccacaccuggccuguggccacuuuucugguagggccucccuccucacuguauguugcuacccaggcuccaacugugagcugagaguggggagcgucguugccuucuuuauagcuggggccuucuuggucaaggauuagcuuuuagagaaauuccuagaauucacuucaccuccugccuuucugccuugaugguguuuuuguucucuggaacuuuuggucuuuucccuguaugggucaugguguaagggagauuccuuguuagaagagaagcagaagcucaucaggccagagcacaggaggaugaaccuagcagccccauguggcaggcacugugugccauuccuauuaugggaccauugggaaggaauaaagggcuccagagugggucuuguguggucgggucaaguuggaaagaagggacucaucaguggaagagggauggauaauuaugucuaaaugcaaagauguuccucugccucuccauucuguucaaaauccauauaaaaugucuuuguaauucuaggaucguugguguugugacuuggugguggaacagagccuagcccuucugucaugaaggggccagaacaagaugcucuguacuauauagggaaguugggaggggacuggggaagcccuuggcaccccucuuaugccauuucuuguuacuuaacucuuggaauuagagaugcuugggguuucaggggaguuuaguuuaggucagggguggcaagugugaaggccccaauaccccacaauacccucagcuucuaugaccaacauuacugauugacaguagcacuuguucuuguccagacagagcccagaauuuuucucaaugcacagcacaucaggcagcuauaauuuacuggucagaguuucaucaugagaugaaaucuacuagcccucaggguggaggugguuggaagauaaguggauagaggcccagaugguugagggcucagcuuauuucuucuaaaggagagucccaaggcagagcugaaccaagaggaaagaaacagagggguuggauugcugaguagaacugauucuaacccaguuuauaaagccauguaucugaaauuggcauggacuuuuuaaaaaaauggaaugcccuguuuuuauaacaacuugcaccaguaguuugucaguaguuauauuuacuuuuauaaaaaucaaaauaggcugugugcuguggcucacaccuguaaucccagcgcuuugggaggccgaggcaggcggaucacaaggucaggaguuugaaaccagccuggccgacauggcgaaacccugucucuacuaaaaguaaaaaauauuagcugggcaugguggcaggcgccuguaaucccagcuacucaggaggcugagucaggagaaucacuugaacgcgggagguggagguugcagugagcugagacugugccacugcacuccagccugggcaacagaguaaggcucugucuccaaaaaaaaaaaaaaaaaaucaaaauauuuuuauuuuacguauagaaaacauuuguuuguuuguuuguuuguuuauuuuugagacggagucucacucugucgcccaggcuggagugcaguggugcgaucucagcucacugcaagcuccacuuuccggguucacgccacucuccugccucagccuccugaguagcugggacuacaggugcccgccaccgcaccuggcuaauuuuuuguauuuuuaguagagaugggguuucaccguggucucgaucuccugaccucgugauccacccgccucggccucccaaagugcugggauuacaggugugagccaccgcgcccggccgaaaaccuuuauuuuuaaaaaauuauuuuauuuguuuguuuauuuugagacggaguuucacucuuguugcccaggcuggaguacaauggcacgaucuuggcucaccauaacuuccgccucccggguucaagcgauucuccugccucagccuccugaguagcugggauuacaggcgugcaccaccaugccuggcuaauuuuguauuuuuaguaaagacaggguuucuccauguuggucaggcuggucuugaacucccgaccuuaggucauccuccuaccucagccucccaaagugcugggauuauagguguggaccaccgcacccagccuauuuauuuuuuugaggcggggucucacucuguugcccaggcuggagugcaguauugcaaucauggcucugcaaccuccccuccugcucaagagauucucccaccucagccuccugaguagcugggacuacaggcacaugccaucaugcucagcuaauuuuuuuuuuuuuaaguagaaauggaauuucaccacuugcccagggugaucuuccugggcuuaagugaucugccugucuuggccucccggaguacugggauuacaggugugagccacuguacuuggccuuuuuuuguugcuguuuuuuuuuuuuguuuuuuuuuuuuuuuaauuugaggcagggucucacucuugucaccuaggcuggagugcaguggcaagauaguggccugaaauuuuuuuuuuuaacuguuaaagaauauguaggauuuuuuuuaggcugggcccaguggcucaagccuguaaucccagcacuuugggaggcugaggcagguggaucaugaggucaggagaucaagaccauccuggcuaacacggugaaacccugucucuacuaaaaauacaaaaaaauuagcuggccaugguggcacacaccuguagucucagcucuucgggaggcugaggcaggagaauugguugaaccugggaggcggagguuauagugagccgagaucgugccacugcacuccagccugggagacagagugagacuccaucucaaaaaaaaaaaaaaaaagaauauguuggauuuuuuuaauaccugauaaagucuacguuuaaaaaauacacagcaggccgggugugguggcucguuuuuuauuuugagacggagucucgcugugucacccaggcuggagugcagcagcaugaccucggcucacuccaaccuccgcccccugaguucaagcaauucucccgccucagccuccugagagcugagguuacaggcaugcaccaccaugccuggcuaauuuuuguauuucuaguagagaugggguuucgccauguuggccaggcuggucucaaacugcugaucucaggugaucugcccgccucggccccucaaagugcugggauuacaggcuugagccaccaccccgaccagucccagcacuuuggaaggccaagacggaaggauugcuugagccuagggguucaagaccagccuggacaacauagugagacccccaccucuacgaaacauuuuuaaaaaugagcggggugugauagaauacuucuguagaccuagcuacuugggaggcugaggcaggaggauugcuugaaaccaggaguuugaggcuacagugagcuaugauugagcuacugcauuccaguguggaugagagagugagacucgucucaaaaauaaauaaauaaauaaauaaaauaaaaaauaaaaauaaauagcagagggauagagagaugcagguuuaaacaaaugcaggcuuauggccauuaugugcauaguacuaguagaagcaaaugcagaaaacagaaaccagaaauuuccaguagaaagggguuuaauauauggacuuugaugcuuauaaaauuaucaagacuuagaauuuucauguagugguggacuaggcuacuuaaauaaugucuccgauugaaaauaagauggcagauaaaauauuacaagcgaggcugggcacgguggcucacgccuguaaucccagcacuuugggaggcugaggugggcggaucaccugagguuaggaguuugagaccagcgugaccaacauggugaaacccugucucuacuaaaaauacaaacauuagccaggcaugguggcguauaccuguaauccuagcuacucgggaggcugaggcaggagaauugcuugaaccugggaagcggagguugcaaugagccguggucgugccauugugcuccagccagucaaacaagugaaacuccaucuaaaaaaaaaaaaaaaaaaaaaaauuacaagccagccaacucaaggccagugucuggaugaacaccuguaacuagaguuaaggguagugucuguguaccaaaggacauuugugguguucacacacugcuaugcuugugugcuucagcuccguaauuacacagggccauagagguggagguuagaccccuguggggucuaaugggaacucucucaaauuaagcuggggcauuaguggcuacacccuccgguuacgggcagugccuuuggguuuuugaauguggcaggcucuggaaagucaagguuugguacuugagacucuguuaguacauuagagaaggagcucagaaccaaggauguguaaccugccuagggccaccaauaggggcuguucugccccuuuugucugguaaucucucggggugcuuugauagugcuggugacauugggcacaugagggucuccugacccauacacagaaccacauuucuccauacgagcacccuaacuugaggccccuuugcuuucuggccuauucuuuuuuuuuuuuuuugagacggagucuugcucuguugccaggcuggagugcgguggugugaucuuggcucacugcaaccucugacucucaguuuuaagcgauucuccugucucagccuccugaguagcugggacuauaggugcguaccaccaugcccagcuaauuuuuguauuuuguauuuuauggggcuucaccauauuggccaggaugguuucgauuucuuuuuuuuuuuuuugagauggagucucgcucugucacccaggcuggacugcaguggcgggaucucggcucacugcaaccucugccucccagguucaugccauucuccugccucagccucccaaguagcugggacuacaggcguccgccacuacgccuggcuaauuuuuuuuuuguauuuuuuuuuaguagagaugggguuucaccguguuagccaggauggucuugaucuccugaccucgugauccgccugccucggccucccaaagugcugggauuacaggcgugagccacggugccuggucuagccuauauuuuuugaauaguucuaaggcccaggucacucaucucuguaaugcccuuccucuuaguagcaaaucuacacagaauugggcucagugggugacugcauggcuuccuggggcaggggcggguaugguugcuugcuggaggagcagcuuacacguagcagccagugucaugauggacugaagcuugcuuuauuuauuuauuuacuuuuuuuuuuuuuuuuugagacggagucucacucuguugcccaggcuggagugcaguggugugaucauaacucacugcagccucaaacucuugggcacuagcaauccuccugccuuggccuaucaaaggcugguauuacaggugugagccagcacaccuggcauugacuauggccuuaagugggccgauuagacuaugaaauaaaauuccuagcacugaauauuagcccucauuucagaccuaaauaucaguuguuguuuuuccugaaccaucuuccaaggaucauuuuguaacugaggucccagaguuccccuuugauguagaggcuguugauuucuuuucuggggcagguucugauagcaacaagauugccagccugcugaacuguggcuaagguauuagaugucaagaugaaacuguccagugagauuccuggagccccugggaggucuaggguuggggguacuggugacuagcccuuucaccugaggguagguggcagagcugguaccuuccugcagccuccaacagccaucucagcccugaggcugaagaccuugucucuucucuccuuuucaucacuuccuaccagagcccuguggguguagggacauccugcugauggagcuuaaauuuaaaacgucgagccccauuggcuccuguaucuuaugcagcaguucuuaaaagugcccauaggcuugccagcccaugaaauauaccuucccucuaaaaagaaauugguaaaacugggccgggcauaguggcucacaccuguaaucccagcacuuugggaggccgagguggguggaucacgaggucaggagaucaagaccagccuggcuaacauggugaaacccugucucuacuaaagauacaaaaaauuagccaggcguggucgcacacgccuacagucccagcuacuugggaggcugaggcaggagaaucgcuucaacccgggaggcagagguugcagugagccgagauugcgccaaugcacuccagccugggcgacagagcgagacucugucucaaaaaaaaaaaaaaagaaauaaauugguaaaacuggccaggcucuguggcuuaugccuguaaucacagcacuuugggaggcugagguggguggaucaugaggucaagaguuugagaccagccuggucaacaugaugagaccccgucucuacuaaaaauacaaaaauuagccaggcaugguggcgagugccuguaaucccagcagcucaggaggcugaggcaggagaauugcuugaaucugggaggcggagguugcagugagccaagacugugccacugcacuccagccuaggcaacagauugaggcuccaucucaaaaaauaaaaaaauaaaaaauugguaaaaguagaaacaguuggguccuucuucacucuugucauuugcugugggcuaagugcgggacuucuggccccaaugugaggccagaauacucuuaugcugcccauugugcucugugccagggccucccuugucucaucgggaaaagccagaugcgguccuugcugguuugcagggccauagggguguucuuggugucucuguguaugugugugugguaaaauauauguaacauaaaauaugccauuuuauccauuuucaguguguaauucagugguauuaauugcauccacaauguugugcaaccaucaccauaucacugucuauuucuagaacuuuuccaucaccccaaacagaaacucuguacccauuaagcaguaauucuccauuucuccuuccuccuagucccuguuaaccucugaucuacuuucuguuucuaugaauuugcuuauucuugauaguucauguaaggggaauccuacaauauugguccuuuugugucugacccauuucacauagcauuauguuuucaagguuuaucuguguuguggcauguuucauaacuucauuucuucuucuucuuuuuuuuuuuuaauuugagacagagucucauucugucacccaggcuggagugcaguggugcgaucucggcucacugcaaccuccgccucccagguucagcaauucuccugccucagccucccgaguagcugggauuacaggugugcaccaccacgcccagccaauuuuuguauuuuuaguagagaugggauuucgccauguuggucagauugaucuugaacuccugaccucgugauccgccugucuuggccucccaaagugcugggauuacaggugugagccacugcgcccaguccauuucuucuuauuuauuuauuuaguuguuuuuaagauauaugguugucugggcaugguggcucaugccuguaaucccagcacuuugggagacugagauggguggaucaccugaggucaugaguuugagaccagccugaccaacauggugaaaccccgucucuacuaaaaauacaaaaaauuagccaggcgugguggugugugccuauaaucccagcuacuugggaggcugaggcaggauaaucacuugaauccaggagguggagguugcagcaagccgagauggugccauugcacuccagccuaggcaacagagugagacuccaucucaaaaaaaaaagaaauauggucuuguucuguugcccagacuggagugcaguggcacaaucauggcucacuguauccuugagcuccuaggcucaagaaauccucuagccacagccuccugaguaguagcuaggauugcaggcauaugccaccaugccuggguacauuuuuuuuuuuuuuugagauggagucuuauucuggugcccaggcuggagugcaguggcaugaucuuggcucacugcaaccucuaccucccagguucaagcuauuccccugccucagccuccugacuagcugagacuacaggcgugcaccaccacaccuggcuaaauuuuguauuuuuaguagagauggcauuucaccauauuggccaggcuggucuugaauucuugaccucaaguaaucugcccgccucagccucccaaagugcugggauuauaggcgugagccacugugcccggccugccuggauaauuuuuuuuuuuuccucuuuugagacggagucucacucuguugcccaggcuggagugcaguggugugaucuuggcucacugcagccuccaccucgguucaagcuauuccccugccucagccucccaaguagcugggacuauaggcgugugccaccacaccuggcuaauuuuuguauuuucaguagagauggaguucaccauguuggccaggcuggucucgaacuccugaccucaagagaucugcccgucucggccucccaaagugcuggaauuauaggugugagccacugugcgcguccugccugacuaauuuaaaaaaaaauuuugggggcaggagcgguggcucaugccuguaaucccagcacuuugggaggccaaggcaggcagaucacgaggucaggagaucaagaccauccugguuauauguugaaacaccgucuuuacuaaaaauacaaaaaaaagggcugggcgcgcuggcucacgcuguaaucccagcacuuugggaggccgaggcggguggaucacgaggucaggagaucgagaccauccuggcuaacauggugaaacccccucucuacuaaaaaaauacaacaaaaaauuagccgggcaugguggcgggcgccuauagucccagcuacucgagaggcugaggcaggagaauggugugaaccugggaggcggagcuugcauugagccgagaucgcaccacugcacuccagccugggcgacagagcaagacucugucucaaaagaaaaaaaaauuuguagaggccaggcguggcucuacaggcugacagagugagacucuaucucaaucaaucaaucagucagucaaucaaaguuccagcuacuugagaggcugaagcaagaggauugcuugagcucaggacuacaggcucacgccuguaaucccagcacuuugggaggcugaggcggguggaucaugaggucaagagaucaagaccauccuggacaacauggugaaacccagucucuacuaaaaauaaaaaaauuagcugaguguguuggcaugugccuguagucacagcuacucgggaggcugaagcuggagaaucacuugagcccaggagguggagguugcagugagccaagaucgcaccacugcacuccaaccugggcaacaggcgagacuccaucucaaaaaaaaauuuuuuuuuuucuagagacagaaucucgcuauguuacccaggcuggucuugacaccgggccucaagugauccucuugccucagccucccaacgugcugggauuacaggcaugugccaccauacccagccuagaacuucauuccuuuuuauggcugaauaauauucuguuguacuuauauauacaucacauuuuguuuauccauucuucuguugauggacgcuuagguugcuuucaccuuuugguuauugugaauaaugcugcagcaaacauugguguacauaguguuugaguuccuauuuucaguucuuuuggguguucaccuaagaaugguauugcugggucauaugauaauuuuuauuuaacuuuuuuggguaacuaccgaacuuuuccauaguggcugcaccauuuuacauccccaccagcagugugugaaggcuccaauuucuuuacauccuugccaacauuuauuuuauuucuuucuucauuuuuuuauuuuuuaaagccuugcugucuugccuagucuggucuugaacuccugagcucaagcaauccucuugcuucagccucucaaguagcuggaacuuugauugauugauugauugauugauugagauagagucucacucugucacccaggcuagagugcacuggcgcuaucucagcucauuggaacuuuugccucccggguucaagugauucucccaccucagccuccugaguagcugagaucacaggcaugugccaccacgccuggcuaauuuuuguauuuuuaguagagacaggguuucaccauguuggccagguuggucucaaacuccugaccucaaguaaucugccugccuuggccucccaaagugcuggaauuacaggugugagccaccaugccuggccuauuuauucuauuuuuucguuguuguuuuugagauggagucuagcucuaucccccaggcuggagugcaauggcuugaucugggcucacuucaaccaccaccucccugguucaagugauucucaugucucagccuccugaguagcuggaauaacagguguguaccacuacgccuggcugauuuuuguauuuuuaguagagacagguuucaccaaguuggccaggcuguccucgaacuccugaccuuaacugaucugcccgccucggccucccaaagugcugaaauuucaggcgugagccacugcacuugaccuggaacuuuuaaauuauagcuauucuagguaugaagugguaacucauugugguuuugauuugcauuuccuaaugacuagugauguugaggaucuuguuaugugcuuauuguauguggcuaucuguauagauucuuuggagaaaugucuguucaaguccuuugccuguuuggguuguuugucuuucuguuguugaguuauaggaauucuuuauuuuugauauuaaacccuuaucagaucuaugauuugcaaauacuuuuuccuauuccauugauugucuuuucacucucuuauuuuuuauuuuuauuuuuauuuuuuucagauggauuuuugcucugucgcacaggcuggagugcaguggugcaaucuuggcucacugcagacuuaaccuccugggcucaagugauccuuccaccucagcaucccaaguagcugggacuacaggugcaugccaccaugacuggcuaaauuuuaaauuuuuuguagagauggggucuugccauguugccuaggcuggucuugaacuccugggcucaagcaguccuccugccuccacagccucccaaagcacugguauuacagaugugagcuaccaugccuggccucuugaugaugucuuuuuuuuuuuuuaauuauuauuauuuuuuuugagauggagucucgcucugaucuccgcucacugcaagcuccgccucccaaguuaacgccauucuccugccucagccucccgaguagcugggacuacaggcgccugccaccaugcucggcuaauuuuuuguauuuuuaguagagacgggguuucaccguuuuagccaggauggucucgaucuccugaccuugugauccaccaccuuggcuucccaaaguguugggauuauaggcgugagccacugugccuggcuuuuuuuuuuuuuuugagauggagucucacucacucuguuuccuaggcaggagugcaguggugugaucucagcucacugcaaccuuugccucccggguucaagugauucuccugccucagccuccugaguagcuggaauuacaggcauggaccaccauaccuggcuaauuuuuguauuuuuaguggagacgggguuuugccaugucgaccaggcuggucucgaacaccugaccucaagugguccgccugccucagccucucaaagugcugggauuauaggcaugagccccgaugaugucuuuugaugcacagaaguuuuaauauuaauuaaguccaauucauguauuuuucuuuuuguucauccuuuuuguaucaucucuaaauccauugugaaaucaaaggucaugaagauuuacccuuacgcuuucuucuaagaauuuuaugguuuuggcucuuuccuuuuuauuuuaguuuuucccuuccuucccucccucccuucuuucuuucuuucuuuuuuauuuauuuauuuauuuuugagaccgacucucgaucugucacccaggauggaaugcaguggcacgaucucggcucacugcaaccuccucuuccaggguuccagugauucuccugccucagccucccgaguagcuaggauuauaggcaccugccaccacgccuggcuacuuuuuuuguauuuuuaguagagaugggguuucaccauguuggccagguuggucucaaacuucugaccucaggugaucugcccgccucggccucccaaagugcugggauuacaggcgugagccaccgcacccagccuauuuuuuuuuuuuuaagugcuacugggccagugccagauuuuuggcccagggccuuaccucuuauauuuagaucauuuucuuuucuuuucuuuuucuuuuuuuuuuuuagauggaguuucgcucuugucacccaggcuggagugcaauggcucaaucucggcuuacugcaaccuccgccucccggguucaagcgauuuuccugccucagccucccgaguagccgggauuacaggcauacaccaccaagcuagguuaauuuuuuuuuuuuugggauggaguuucacucuuguggcccaggcuggagcgcaaugacucgaucuuggcucaccgcaaccuucaccucccagguccaaaugauucuccugccucagccuccagaguagcugggauuagaggcaugggccaccacgcccggcuaauuuuguauuuuuaguagagacgggguuucuccauguuggucaggcuggucucaaacucccaaccucaggugauccucccgccuuggccucccaaagugcugggauuacaggcgugagccaccaggccuggccuaauuuuguauuuuuaguagagauaggguuucaccauguuggucaggcugguuucaaacuccugaccucaaaugauccacccgccuugggcucccaaaauacuggaauuaacaagcgugagccaccucucccggccuccaccugauuuucuuauguugaaccauccuugccuuucugggauaaaucccauuagguugugguauauaauccuuuuaauacacuguuggauuuggucugcuacuauucuauuaaggauuuuugcaucuauauucaucuauauugcucuauaacuuucuuuuccuuugaugucuuuuuuuuuuuuuuuuuuuugagacggagucucucucucugucacucaggcuggagugcaguggcgccaucuuggcucacugcaaccuccaccuuccagguucaaacacuucucugccucagucucccgaguagcugggauuauagacacccgucagcacgcccggcuaauuuuuuuguauuuuuaguagagaugggguuuuaccaucuuggcuaggcuggucuugaacuccugaccuugugauccaccugccuuggccucccaaagugcugggauuauaggcgugagccaccgcacucagccugaugucuucuuaguggcuuuuugauugcuguuccagggucuuccucaucuuggguuugcaucugggcacugcacauuuacaaugugcacagacauuuuucugugaagaauugaagucuaggucaaagcugggaaggagcuuaggagccuuugguuuaaccuuuccuccucuaauaaggaaccugauauguggguugaaaucuaagacccauagucuugaauuaggcuggagugucugagaccagccuuuuagagucaaggguguuguguuuggagcccugcugugaaguguucuugucaccucagaacucuucaggaggcaggaggggaagucagacuuguugccaaagggguucucugugcaggguucucaaacuuguuaucaggacugggugguagaguacaguaaaggggucgucuccuucccguggccuuguacauaucugggaggugugagagucagguggcccugguuucuaaaguucuguccucuguccaccaccaggccugccugggucgcagaagaaacucuagucaguuggagcugugccaaaucugucucacugcagcagggucuccugcgugugugcucugugcccagcuugggacauacuaggugccaugugagccggaaccucagggccucugcucagcaaggauuuugacuguuucugaagcuguacuguugugaugcagccucugcccuucugucaagacucggggugcuagguggaccaaggagcugacugugaaagccacguucccuaaugugucccccaucacugaaauguccuggggugauccagagagagucugaugagugagagccaaaaaccucugcaguauguagccauuacucuuaaaaguggcuuuuaagagauggcucuuaaaaguggcuuuuaagagauggcucuuaaaaguggcuuuuaagagauggcucuuaaaaguggcuuuuaagagauggcucuuaaaaguggcuuuuaagagauggcucuuaaaagugauuuuuggcccagcacgguggcuuaugccuguaaucccagcacuuugggaagccgagcugggcggauuacaugaggucaggaguugaccagccuggccaacauauagugaaaccccaucucuacugaaaaauacaaaaauuagcugggugugguagcgcacgccuuguagucccagcuacuugggaaguugaugcaggagaauugccugaaccugggaggcagagguugcagugagccaagaucgcggcacugcacuccagccugggugacagagcaagacuucgucucuaaaaaaauaauaaaauaaaauaaaauauaaaauaaaauaauuggcuggguacgguggcucacacuuguaauccaagcauuuugggaggccaaggcaggcugaucgcuugagcucagggguucaagacuagccuaggcaacagggcaaauccccaucucuaaacuacccaggugugguggcacucaccuauggucccagcuauucagggggcugaugugggaggauggcuugagccugggaggcagagguugcagugagcaaggucucaccauugcacuccagcuugggagacagagugagacccugucucaaauaaaaacuaaaaauagaaauuaaaauuuaaaaauuguaaaaaguaauuuguguuaguuguagaaaaucuggaaaagcaaagagaaaaaggaauccaagaggacuggacugugcuugcagcucuccacaugacugcaggguuucagcagacuugagcucggguggcagggcuggguggacccccuugcucggguggcagcauggacccccugccaguugcaguggauagugggagcuucuggguggauuugugaguguggacaccugugggccuuugcugccugcuuccaggugcgguugcuucuucucuaucuuguguucugguggaucucgacuccacuugucccaagcagugccuauuugcugcccucuucucucuugagcuagauagggcagaauagcuguucucguaucuccaccuugcauugugguuuuggcaggcaacgguaggaacugagaaguuacaggccuacucauggccucacugccacgaagagcuugucuguugccucucugugcuuccugucucaccucucuggcaugauauuucuucuccacuuugcugccauauagaagaaaggaguaaaucagauggcuuuaccuuacuuucaccugugucauagcguaaauaauucccucuccccagcuccugaaauauauccugcaguuagaaaagaaggcccugguagagaaguguugggagcuaagcugcucuaucuauucuagucaccugcuccgggaguaaaagcccuuguugccgcccucccucccaggcugacccaggcagguuguaucugugaguguuucuagcauagccuggcccauuaccaacaaggaagcaaauauucaccuccuuucuccuugguaaucucaaguaaacagguguuuguuuuagauguccugagauccaggccuuccagaauggccucauuuccuuaccagauccugaugcuggaagauccuccaguguaugaaugaauggacaaagugggguugucccaucauccaccuucagccuccggcacugcgcucaggugcucguuugucugauccuguugaauggcugcuuugggggcucuccagccucaagguaauagcugauaaagcaggcucugagagcacaugggacaugccagugggcauguguugaacucaguggcagaggugagauuggagucuaggauuguaaacuguguuugcuccuuggagcuguguucugagaugugugugcguggcaucaaugccagggcuagagagcacagcuggagaauggcugcugcuaacucugacugagcacuuuggcuccaguauuuccaagugggucucagagaauugaccuuuccuuggugccugguugugcugggcagugucuugggcuucucuagcuccucccccacccaauaaauuaacuguguucuaaagagcacuugccugucuccacaucaucccacugcuccugucccacccuugucaucuuccaugggaaugacucuggaaguguccaguuuugguucuucaauccauuuuucaaauaucagcuguuugaucagcuguacccuuucuuuuuuuuagagacagagguggucuuguuauguugucuaggcuggucuugcacuccuggcuuccaaugaucuucccgccuuggccucccaaguagcugggauuauaggcugaagccaccauccccagcuuagccccuucuguggcuucccauuuaccucucaugaaguucagacuccuuaagcuagcaugcaggcugugcaugcacagcccauuuccagauccagcugucugucuuucuaggucugcccagacuguaacccagucauacuaaacuucucuuaguuccccaaccacguggcugcuuucuugccucuaugccuuuucacauucugcuguguuuuuuuguuuguuuguuuguuuuuugagacggagucuagcuuuguugccaggcuggagugcaauggcgcaaucucggcucacugcauucuccgccucccggguucaagugauuguccugccucagccucacgaguagcugggacuacaggcacccgccaccacgcccggcuaauuuuuuuauuuuuaguagagaugggguuucacuauguuggccaggauagucuggaucucuugaccucgugauccaccugccuuggccucccaaagugcugggauuacuggcgugagccaccgugccuggcccacauucugcuguuuuugaguggaccaugauccucuuucuccugucauuuacuuuaccaggccuuggcucagccuucacuuccugagggaauuccccauuuugagucagcacaccuugacucucuggcuugcccugacuugacauuagaacuguuggagggcaaggauugagcccaggcccccacccuuauguccccagcaucauacuggguacagggcauuuuuguugaugacaugaaugacuggaagaaccucuaugaaaagaaauuuaucacaccuguuuuuacugaauuacucaacguuagcaaggacccaagagcuccuaauaacucagccauauucaggugccugcagagaucaauagaggaaggguagugucaguggccuccuauggggauucuuccuguuccauagaugcaaagauacugcaguauguguacaggagaaugaguuugagguuuuuguuaugcccuuuccuuauuuauuuuugucucauucuuggcagcucaaaggguacaaagugguaucucgcuguguuuuuuuuuuuuuuucuuugagacaaggucuggcucugucacccaggcuggagugcaguagugccaucucggcucacugcaaccuccacccaccccaggcucaagccauccucccaccucagccuccugaguagcugggacuacaggugugcacuaccaugucugguuaauuuuuguauuuuugguggaaacaggguuucaccauuuugcccaggcugaucucgaacuccuggucucaaacaaucagcccuccuuggccucccaaagugcugggauuacaggcaugagccacugcgcccagacuauuuuuauuuuauuuuuauuuugagacagugucucacuuugucacccaggcucuggagugcaauggcgggaggcacugcagccucaacuuccugggccucaagcugugcucccaucucagccucucaaguagcugagacuacagaaaagcaccaccacgcccagcugauuuuuauauuuuuuguagagaugggguuuugccauguugcucaggcuggucuugaacuccugagcucaagcaguccaucugccucggccucccaaagugcuaggauuauaggcaugagccacugugccugcccucacuguaguuuugauuugcauuuccguaacgauagugauggugagcaucuuuucaggugcuugcuggccacauguacaccuucuuuagggaaacaucucaaggccuuugccacucucauuuuuuagagaugggguuuugcugugucgcccaggcuagucccaaacuccugggcucaagcgauccuccugccucagccucccacauugcuggaacuacaggugcacaucaccauuccuagcuaaaaguuuuaaaguuugaugaaguuuacuuuaucuauguuuucucuuguugccugugcuuuuguccaagaaauuauugccaaauccaaugucaugaagcuugcuaugucuuuuccugagaguugaaguuuuagcucuuaugauuaggucuuugauccauuuugaguugauuuuuauauaugguguaauauaagcaaaaaacuucuuuuuuuuuuuauuuuagacagaguuucgcucuuggugccugggcuggagugcaguggcgcgaucuuggcuuacugcaaccuccgccuccuggguucaagcgauucuccugcuucagccucucaaguagcugugauuacaggcaugcgccacuaugcccagcuaguuuuguauuuuuaguagcgacgggguuucuccacauaggucaggcuggucuugaacucccgaccucaggugauccacccacuuuggccuccugaagugcugggauuacaggcgugagccaccgcaccuggccaaacuuuguucuuuuguuugugauuauccagaugucccagcguuauuuguugaaaaaacugucauuuccccaucuaauggucuuagcauccuuguugaaaucaguugacuauacaugugaggguuuauuucugggaucucuauucuauuccuuggacuguaggucugucuuuaugcgagucuuaaacugauuuauuauuguagcuuuguaguaaguuuugaaaucagaaaguguaagcccuccaacuuuguucuuuuuaagauuguuuugacuguuucugucccuugagauuccauauggauuuuucuauuucuguggaaaacaucauugggauuuugauagggauggccuugaaucuguauaucacuuuggguaguauugacaucuuaacaauagugagucuucuaaucagugaacagaggaugucuuuccauuuauuugugucuguaauuuccuucaucaacauuuuauaguuuuuagugucuuuagccuccuugguuaaguuuuuuuacuuuuuuuuucguuuuguuuugagauggagucucgcuuugucgcccaggcuggagugcaguggcgcgaucucggcucacugcaagcucagccuccuggguucacgccauucuccugccucagccucccccguagcugggacuacaggcccccgccaccaugcccggcuaaauuuuuguauuuuuaguagagacgggguuuuaccauguuagucaggauggucucaaucuccugaccuugugaucugcccgccucagccucccaaagugcugggauuauaggcgugagccaccgcgcccagccuacuuuauuuacuuuuaaguauuuuuuuucuuuuuuuugggugggggacggaguuucgcucuuguaccccaggcuagagugcaaugcugcgguauuggcucacugcaacuuccaccucccggguuccugcaauucuccugccucagccucccgaauagcugggauuacaggcaugcaccaccacgcccggcuaauuuuuguauuuuuaguagagauggguuuucaccauguuggucaggcuggucuugaacuccugaccucgugauccaccugccucagccuccuaaagugcuaggauuacaggcgugagccaccgugcccagcuuaaguauuuuauucuuuugaugcuauuggaaauggaauuguuuucucaauuuuuuuuugauuguucauuauaaguguguagcaauacaacugaaaagugagaaauagaguaacuuauuaguucuuuuuuuuuuucuuuuucuuuuucuuuuuuuuuuugagacaaagucuugcucugucacccaggcuggagugcaguggcucgaucucagcuuauugccacuucugcccccagguucaugugauucuccugccuuggccucccaaguagcugggauuacaggugcccaccaccacgcccggcuaauuuuuguauuuuuaacagagacaggguuucaccauguuggccaggcugaucuugaacuccugaccucaggugaucugccugucuuagcucccaaagugcugggauuacaggcaugagccaccacaccuggccaauucuuuuuuuuuuuuuuuuuuuuuuuuugagauggaguccgugucuguuguccgggcuggagugcaguggccugaucucagcucaaagcaaccucugucucccagguuuaagcgauucuccugccucacccucccaaguagcuggguuuacagccauguuccaccacacccggcuaauuuuuuuguauuuuauuagagauugguuuuuaccauguuggucaggcuggucuugaaccuccugaccucaggugauccgccgaccucagccucccaaagugcugggauuacaggugugagcuaccacacccagcccugcaucuggccaauucuaauuuuuuuuuuuuugagauggagucuugcucugucucucaggcuggagugcaguggugugaucucggcucacugcaagcuccgccucccagguucaugccauucuccugccucagccuccugaguagcugggacuacaggcacccaccaccaugccuggcuaauuuuuuguauuuuuaguagagacgggguuucaccguguuggccaggauggucuugaucuccugaccuugugauccgcucgccugggccucccaaagagcugggauuacaggugugagccaccgcgcccggcaaguuuuuuguuuugugcaaucuuuagaguuucccuuucuuuucuuuccaguuuuuuuuuuuuuuuuuuuuuuuagacggagucucacucugucacccaguggcacaaucuugcuuacugcagucuugaucuccugggcucaggugaucuucccaccucagucuucuaagcagcuggaauuacaggugcacuucaccaugcccaccuaauuuuuuguagagacaggauauugccguguugccuaggcuggucucgaacucuugggcucaagcgaucuuccugcuucagccucccaaaguucugggauuacaggcaugagccaccacaccuggcaagguuuucuacguaugggaacaugucaucugugaacagagauaguuuuccuuuccaauuuggaugccuuucauuccuuuuucuugucugauugcaucaucuagaacucccaauacugucuugaauagaaguggugaaagcaggcaucuuagaugaaaggcuuucagucuuccaccauugaguaugauguuagcugugggguuuuuuuaaauuuauuuuucgaagcggagucucucuuugucacccagacuggaaugcaguggccugaucuuggcucacugcaaccucggccucuaggguucaagcgauucuccugcuucagcucccugguagcugggauuacaggcgugugccaccacacccugcuaauuuuuguauuuuuaguagagacgguguuucaccauguuggccaggcuggucucgaacuccugaccucaagugauccacccgccucagccucccaagaugcugggauuacaggugugagccacugugcccagccagguuuuucauauaugaccuuuguuguguuaagguaguuuccuuuuauuccuacuuucuugaguguuauugacauguaauuuaacaugcuauacaagucaccauuuaaaguguacaauucguguuuuuuaguguauucacagggucugcuuuguuucucucagauugguuggaugauagucuuuaaguuuaugaagaguuucuggaagauagaagagugcaucuuuugguagcuuuaaaacaccaugcuuuuggaaaagacuuaaugucacccaguauuugaagagugggggcuuauucgccuugaacccugacucagcugugaccucauuggaauaugcaaccugggcuccuguggggcugcucccugugucauugacaccuagagguggaauggugcccaaaugugggugucagcuuccucuggcugcucuccccuuagacaguccacucagauucucaagucgaggcagggguuuguacagaggcucccgagccauccacuaauaaacaccaucuuaccuguggagcagagucuguaggaagguguugagggcuagcugcuggagaagggagaggcgucuccuguggggaggccuaagcaaguuguguuuugagcacaggugcuuuagugauuccccauucccauagaauguuguggaaccagagcccuguugcagcgaccaagcauaacucuucuugagugaccuuugaccuccccguuugcacaugugcuccaaacauaaacccuuaccuagugucaggaagccuaugugcuggggaugggaugacaugugguguugggcauagccccaggccccucugaacagggcauggugaguggcuguugucuaaaucagggaaagcccugacuguugcacuugugccuguuggacugcugacugcagggcagcuggggucguuugcugcuuggucagcugagguacugaaggaauggagacugacuuuuggcagccucugccauguaaagucaggaagcugauuauuugggcugcaguuuuucuggaaaaaugugcaaguuuuaaucuaaugggaauucugccagcaggcuaagacagcuucugcuccugaugguccuugaagcuagccccucuggcaggaggaggcaggcaguuuguguguuucugggaaugacugagcaguccuguccagcuacaggcuauauugguucaugucuuugaccuuuaaggauccaacucugucucaaaugcugcuuaaaacaaagcagaagacaaguucccuucgaacuaugaaacucccucuuugaagugcuguuccuuuugcuuugcuccuuucccuucucuaccuuuuucccuaagccaugugggccacguuaucagggccauaugcuggguuguuuccuuuccuuguuccugcccagcaugauugggauagcugauuucagaggcaggugaguaggucagagccuucccucccugccugacccuuuauuuugguaguagaggcugcucccccaaauauaguggugcagcaacccagagaaaggcaaaagggcauuuacugccaauaaaggacuggcaggggcaguguauuagccuuuuuuauauuacuauaaagaaauaccugagacaggguaaagaaaagaagguuuauaaagaaaagagguuuaauuggcucacaauucuacaggcuuuacaggaagcauggugccggcaaaggccuggagaagcuuacagucauaguggauguugacuaggagccagcaugucacauggcaacaacgggaacaaguuggggggaggugcuauacucuuuuaaacaaccagaucucgcaggaacauagagcaagaacucguucauuacugugaggacugccccaagacauucaugaaggaucuauccccaugaucuuaacaccugccaccaggccccaccuccagcauuggguauuacaugucuacaugagauuuggagaggacaaacaucgaaaccauaucauucuacccuggccccccaaauuucaugucuuucucacauugcagaauacaaucaucccuucccacuagucccccagagucuuaacucauuccagcauuaacuuaaaaagucccaagugcaaagguaagaugguauuuauuaguagauggccugggagccucugccucaacuugagaaucugaguggauugucuaaggggagagcagccagaggaagcugacacccacauuugggugccauucuaccuccaggugucaaugacacagggagcagccccacaggagcccagguugcauacuccaaugagaucacaacuaagucaggguucaaagagaauaagccccacucuucaaagagugggaggagugagggggucucugggggccucacacaucauuacucccagcuuugugugguuugggaggccaaugugaauguaugcggggaagguaaugaauuuugagacccagagaacaagcucguuugagcagucuugauugaugauccuauguagauccaacuuggcuuuaccauguccuggucuuuggugcagacuggguucucccuguggaacaaucgugcauugcucuguaaagcacuaccuaggauugagaugcuuuaggcacaucuuaggaauagauucugugccuuagcuacagccagaaugccaaaggacuggaagccaugaauucaugacacuuuccucugaaauugaagccggugguucauagugacacaacacacgcaacuuucuguuuucucuagcugggugaggcacuaagaugcuuuccauuagcaaaucaaaaugucagguuucuccaagaaccauuaguauguuauaagagccucuacauucauugcuuuucucauuuuucugucuuuuaccaauaaauguuugagaagggagacgcaugagcauuugcuaaccaaaaauuuuguguuuuuuuuuuuuuuuuuuuugaaguuacaugggaauaggacucucggcucaaggcgucaacaugaacagacuuccuggugagucacuguuuaagagaacauuuguucugcucuccugauccaauugggguugagagucauggugguagcagagaggcuggggaggacuuuguuugcuagcugccuaccucaagccaugcuacugguuggaggauccugaaagguagcccuugggccaggauggugugcauuuccauuccaaaaauuaauugacaagugauugucauuaauggaauuugaacuguuugccaucaaagucaacugaccugaguuugcuccagguagggauacgcgucaguagcccuugcucccauuggccuugcugagcagacucaggcauguacugggaggaagacugcugccaaccuuggcuccuuuguuacuucaucguguuaaagaucaaaguuuuuggccgggcacagcggcucacgccuguaaucccacuuugggaggccgagguggauggaucaccugaggucaggaguucgagaccagccuggccaacauggugaaacccugucucuacuaaaaauaaaaaauuagucgggugugguggcacacaccuguagucucagcuacuugggaggcagaggcaggagaaucgcuugaacccgggagguggagguugcagugagcugagauugcgccacugcacuccagccugagcaacagggugagauuccgucucaaaaaaaaaaauaaaauaaauaaaaaagaucaaaguuuuuaagugaccucccacguggaaugugauugaagcaauuucuuuucuuuauuuuuuauuuauauauauauuugagacagggucucacucuguaacccaggcuggagugcaguggcucagucacaguuuacugcagccucgaccucccagacucaggugauccucagccuuccuaguagcugggaccacaggagcucaucaccauguccagcuaauuuuuuguaauuucuguagagacagaguucugccauugcccaggcuggucuugaacuccugggcucaagccaucagccugccuuggccucccuaaguguugggauaacaggcgugagccacugcacccagccuuauuuuuaucaucuauuauuuuucuuuugagacagggucucgcuuuucacccaggcuggaguguaguggcgcgaucuuggcaccaccuucucaaccuucugguuggcucaaccuucugggcucaaguucuccucccaccucagccccucaaguggcugggauuauaggcaugugcuaccacaccuggcuaauuuauaggcaugugcuaccacaccuggcuaauuucagcuauuuucugcccagcagcucauaccuagaccuggacuggcugcaacuggggagacagagcuucugccgugaacugauggguuccagaaaauggucuuaaguccauuggucccuugaaucagcagaagugacaugauccaggcuucccugacacgucauggggucaggaaaaguccuuguguuuuuuucuuggccuccugcucuuugugccuaugacacagagaaggcagcuggcuuuccccaaacagggaguuacacucagaccuuacgucuuuucuaaucaauguuuaaugugaaucacugauuuuuuucuaguagacugauuucuaauacuuucaaucuaggaugcuuaggauucaacuaauugucaggaaucuuacuuuuuucccccuuugauugaucugagugaaaacugguuuuucauuguuaaucagaacguguguggcaguuuucuuugcauacuguguggcuguguucuuuguuauaugagcaucuggccuuggcuaaguaguuguagcuguaguaucuguagcucuaccucuuaauguacaggaaaaauaauuuccugucaagugcaaacugauucuuaauuuuguuuguuuguucuaggugugcucuuucaacuuuugcacugaguugguaguggagaaaagagacuuuuaugagcuuuuuuuuguuuuguuuuuggagacaaggucucauucugcugcccaggcuggagugcaguggcaugaucauggcucacugcagucuugaccuuccaugcucaagugauucucccaccucauucuccccuuuagcuggcacuacagauacaagcuaccauacccagcuaauuuuucauuuuuuguagaggcggggucucaccgcauugccccagcuggucucaagcugcugcguucaagcaguccuucugccucagucucccaaaguauuaggauuacuggcaugagccagccugccugguaaggacucuuuuuuuuuuuuuuuuuuuuuuuuuuuuuuugagacggagucuugcucuuucgcccaggcuggagugcaguggcgagaucucggcucacugcaagcucugccuccuggguuggugccguucuccugccucagccuccggaguagcugggauuacaggugccugccaccacgcccggcucauuuuuuuguauuuuuaauagaaacgggguuucaccauguuagccaggcugguuucgaucucuuaaccucgugguccgccugacuuggccucccaaagugcugggauuacaggcgugagccacugcgcccagcacuuuuuuuuuuuuuuuuuuugagacagggucuugcuucguuucccaggguggagugcaguggcacaaacacugcucacugcagucuuaaccugcugggcucaagcgauccucccaucucagccuccuaaguagcugggacuauaaguacaugccaccacgcccagcuaguuuuuuuguauuuuuaauaaagacaggguuucaccagguugcccagacucgucuagaacuccugagcucaagcaguccacccaucucggccucccaaagugcugagauuacaggcaugagccacugcuccuggccggggacucuuuagguaccaauuuggaaucaucuguaggauauauugggaaauuaaaaauauaaagcauggaaauauaugaugugcuaccaaaugugcaaaaaaaagagaaaacaaacauaucuguauuuacuuguauauguauagaucaucuuuggaaagcuacagaaaaacuuguaauauuugcuguuccuugggaagggauggguggcgggagccaggacugagaaagaaaaauuuucacucacaagccuuuggaauuuucuuucuugugaauauguuaucuguuuuaaaaauauaaauguaauuaaaacaaaauaaaccaaagcaaauggcccuguaucaggaaauccucauguuugucuuuuagguagucuuaggauguggucuguuacgccauguguuggacuuaguauccuuugcuucauauguucuuuuuuuauuuaaagacagggucucacuuuguugcccaggcuggagugcaguggugcaaacauggcucacugcagccucaaccuugcaggcugaagcgauucuccugccucagcccccgaaguagcugggacuaccggcacaugccaccaugcucagcuaguuuuuguauuuuuauuuuuauuuuuauuuuuauuuuuauuuuuuuugagacagagucucacucugucacccaggcuuuagugaacuggcacgaucucggcucaccgcaaccuccaccucccggguucaagcuauucucgugccucagccuccccaguaguugggauuacaggcgcacaccaccacgccuggcuaauuuuuuguauuuuuaguagagaugggguuucgccauguugcccaggcuggucuugaacuccugagcucagucagucugccugccucagccucccaaaguaguaagauuacaacgugaggcaccacgcccggccguuuuuguauuuuuuguagagacaggguuuugccauguugcccaggcuagucuugaagugagcucaagcaguccacucaucucggccucccaaagugcugggauuacaaguaugagucaucaugccuagccguauguucuuuuuucuuuaauaaaaaccuuuuuuuuuuuuuuugagacaaggucuugcccuguugcccaggcugggguucagugacaugauaugguucacugcaacuuugaccucccaggcuuaagugauccucucaccuuagucuccugaguagcugggacuacaggugcacaccaccaugccugguuaauuuuuaaaauuuucuuguagaggcagggcgcgguggcucaugccuguaaucccaucacuuugggaggccaaggcggguggaucacaaggucaggagaucaagaccauccuggcuaacacggugaaaucccaucucuacuaaaaauacaaaaaauuagccgggcgcgguggugggcgccuguacucccagcuacucgagaggcugaggcaggagaauggcgugaaccugggagacagagcuugcagugagcugagguagcgcccuagcacuccagccugggugaaagagcgagacgccgucucaaaaaaaaaaaaaauuguagagacaaggucucccuguguugcccaggcaggucucuaacuccugggcucaagcaauccucucaucuaggccuccuaaaguacugggauuauaggcgcgaguuacagugccuggcuuuuuuuuuuuuuuuuuuuuuuuuuugaaacagggucucgcuguugcccagcuuggaguauaguggaguggucacggcucacugcagcccugaauucauaggcucaaaugaucuuccugccucagccucccaaguagcugggacuacagguguauaccaccaugccugccuaguaaaaacuguuuuugugucacccauugaguuugagauccauggaguggaguagacgaggugagagguguucagagucugcugggcugaucugagucucuuugagaugggaccauauggagccagccuagucuguuucucuuuuucacaauaugagacuuaaccucucugggcuggucugaagccagcuacuggucauguccuuugacauugcuaauacaaagcuguaggaaaaucuauuuuccucaugggugcacuucucuuuggcaagggaaaggggccuaacuguucaguggauauugcacuugucuuuguuucacucugccugccaacuccucaggguuuuccuuccugccauaucugaucaucucccugauugucuuuaagguggaaaggaggaaucagauugcaucuagauaccacuucucccugggaaggauggaugccccuggcuuuuccagaauacagggcuagcugaauguccggucagauccaguacagggcaggugggaggauggaguaaagggcaccccucucaggggugauagugggccuuuuuguuaguuuguguuccugucaaggaauaccugaggcuggaucauuuauaaagaaaagaguuuuauuuggcucaugauucagggcuguacaugccuagcuccagcaucugcuucuggugagggccuauggaagcuuaaaauuaugguggaauggaaggggagcugguauaucacauggcuagagagagcagugugggggcgggggguaccagacuccuuuucaaacaaccagaucucaugugaacuaauuaccgcugggagggcaccaagccauucaugaggaaugcuaguguaacccaaacaccucccacccaccaggcuccauuccaucauugagaaucacauuucaacaggagauuuggaggggacaaacauccaaacuguaucagcuugccguuauucauugcaguacuggguuuugaagucggaaucccuuuuggugcuuuccaguuucugggaucacuuuuuuauuucuggugaugagcauacauuuugcaaaaccgaaagcaucaucauucauaaacagagaugaagguccugguauuuugguggggaggugggauggaagacgacagcagcuaaagccuuucugccagccgcugcugauuuccaagaggcucuucguugagaugcaggucaauuggaugguucagaugugugguugguaggaggcaguaguggugguggccuaggcuggguccagauuuugagacuuugguguuuguuuauuuauuuauuuaucugagacagggucuuacucugucucccagacuagugcaguggcacagucacagcucacugcagccucaaccuccugggccgagugcuccuuccaccucagccucccaaguagcugguacuacaggcacaugccaccaugucugacuuauuuauuuauuuauuauaauuuauuuauuuagauggagucuugcuguguuccccaggcuggaaugcaguggcgcgaucucggcucacugcaagcuccgccuccuggguucacgccauucuccugccucagccucucgaguagcugagacuacaggcgcccaccaccacaccuggcuacuuuuuuguauuuuuaguagagauggggucucaccguguuagccaggauggucucgaucuccugaccucgugauccgcccaccucagccucucaaagugcugggacuacaggcgugagccacugcacccagccccgacuaauuuauuuauuuauuuuuuugagauggaguuuugcucuuguugcccaagcuggagugcaauggcacaaucucggcucaucggcaaccuucgccucccggguucaagcgauucuccugccucagccucccgaguggcugggauuacaagcacgcaccaccacgcccagcuaauuuuguauuuuuaguaaagacaggguuucuccauguuggucaggcuggucucgaacucccagccucaggugauucaccugccuuggccuccuaaagugcugggauuacaggugugagcuacugcaccuggcuaauuuauuuuuuaauguuuuuuuuuuuuuuuuuuuuuuuuuuuuugagauggagucuugcucugucacccagguuggagugcaguggugcaaucuuggcucagugcaaccuccgccuccugggcaagugauucuccugccucagccucccaaagugcuggguuuacaggcaugagccacuaugcccaucuaaguuugcuguuuugaccgguacuuacacaucuuugugcaaaguucuuguuuuugcuucucguacuauuuaugaggaguguuaauguuuuaauauaguuaagauguucaaguuuauagccguuacauuuuauuggacuagacuguuuuuggauuucauuagcaacaugccuguuucuuugauggccuuaucaaucagacuuuuauuaaauguuccaaaauguucuacuggcauuucagauugauaauguguugcauaaaaucuauggauuaguaugggaaaccucaaucuuacugaaaauuuagucuuccgaaccagaaaugacauaugucuguuuauuuuuacauugcuuuauuuaauuuauagacaggaucucacucugucccccaugcugggguacaguggcacgaucauagcucacugugacaggauugacaagcccuaugggaggugauucagcuggacuuggugucuucacaguagauuauuagacugcaagcuacgaggagugugccucuagaguguuccugauaauuuguuuuaagaaugcuuuuauuaauaaaauggccuggcaauggccauuuuauuacuauuuuuuucucuguucuggcuucucgguacaauggccauuuuagauacugagucucaguguuguuaggagcaagugggcaggaugugaguuaagcggcccuuaucugagucagcccaagaaaagagguuaacuuagaaauucuacccuuggccugcccagccgcugcugucuuagaaguacuuggucuuuagccuuuuaugagcccucggaagagaggcuugggacgaaggagaggcccaaguguggaacuaagccccuuuucuucugggaccugaucugguugaguguuugaaaccaacaagaacugaugagacuggccugagagagccucugccucuuucucucugaaguaaguguuucuugaauauagaggauaaucugcaucucccugauuuccaccuguacauuggacugcucuuuucucuguuccucuugggucuaguuccugauuaaaauauccaguacuugguuggacgcaguggcucaugccuguaaucccagcacuuugggcggccgaggcaggagaaucauuugaggucagaaguucaagacuagccuggccaacauggugaaacccugucucuucuaaauguacaaaaaaauuagccgggcgugguggcgugcgccuacaguccuagcuacucgggaggcugaggcaggagaaucgcuugaacccaggaggcggagguugcagugagccaagauggagccacugcacuccagccugggcaacagagugagacucugucucaaacaaacaaacaaauaaucagauaccugagugaaguggguuaugggggugguagggacaggacucaccuuccuugagggacccagaagacuugugaggccuaugaaugauggcugugcuuugccagacccugagaaagcagggaaggggcagcuggugcccucagcaggaguauucaagccacuccgcucauugcacccugcccuugagcagaucccacuuccagaaaccugaguucuuugcuccagguccaacagaggugaacccacuugccccagacugggguuauuuuccugcaaaaaccggauccucguguguuccccaucucugcugacagccacuguccaccuuggcccccaggugggacuccucagaguaaucucauguccucccucucccucagccgugguucugcugcuccacagauaucucuuuaaucuggcuucugucuccgccccauugccauggccucuccacuggcaguuuccaugaucugcgccacaggccucugcucuccucucuguaugcacugugccccuucccugcuuugggccucugacuccucugcccaguggacagucuccugcucagccucauuuuccuauaccucugcccucugcacaugccacacaccagcauggcuguguagggugccaaacaugcugcugacacucccugcucugccccuuggcagauguccuucuugcccugggacugcccuuccuccuugauccccacucaaccuugucugaccccuucagcccugaccaugucugggaugacacuugccacccugccuggugugugucuuucacauuuacccagaguguccucacuggauugugagcuccuugggacucccccauagugagcacagcaccuggcaucaugcacuugggcuuugggaugaguuguuucugcauuuugcugugcuuugccuaaguguguugggcuucaguaaauugcaucaggcuccaucagccugcggccugccuagagcuugaagcugucauuuggagcucagccucaccccacugcccuaaucauuauggcacugauuguguguaggggcucugcuaccacuuucuaccuggaggaguagugacugcucccuuuucuguaugucaggacuaagugucauugaauccacuccugacucacauuuggucauauggggaaauagacaucaagggcuguggucagcugguggagcagagcauggauucuggagcuauaccaccugcauuugcauccuggcggcuguguuaccuggagugaguuacuuuacugcucugccucauuuucccccucuguaaaugaaagugauacuaguaucuaacucauauauaggaugguuaugaggauugaguuaauuccuguaacaugcuuagacuagugccugacacagaaaagggguacauaaauauuaguuauucuuacuuuuuagagauugggaucucacucuguugcccaggcuggaguacaguagcaugaucauagcucccuuguaaccucagacuccugggcucaagugauuuucuugccucagcuucccgaguagcuggaacuacaggcacacaaccaccacaucuggcuaauuuuuguuuguuuguuuuuuauuuagagauggggucuugcuauguugcccaggcugaucuugaacuccuggccucaagcaguccuccuccuuuggccucccaaaauguugggauuacaggugugagccacuaugcucagcuguauuagcuauucuuauuauugggaaaagguguguguuuuuuuuuucuaccugaagaaggaaguaccuauauauuuaaaguucuuuuauaaauguuuauguauguccgggcacgguggcuuacgccuauaacuccagcacuuugagaggccgaggcgggcagaucacuugaggucaggaguucgagaccagucuggccaaugugguaaaaccccgucucuaccaaagauauaaaaaauuagcuggauguggugguaugcgccuguagucccagcuacucaggaggcugaggcaggagaauugcuugaacccaggacguggagguugcagugagccaagaucgugccacugcacuccagccugggugacaaagugagacucugucucaaaaaaaauaaaaaauaaaaaauauauaaauguuuauguguuagaguggaguuagguaucauugaaacuaccuuuucucucaagugcuuggucuucuguguuugaauaggcguguuuaguacgguagcuguagucaaauuauagaaaaagauggcacagcaaucaaagucaagauguugauguuuugaguguuuucuuguagguugcacuggcucagcaaggacaucuuugccaguagagcuguuagacgcagagggcagacacccuggggucuugcuuggaaccuggggcagaugauaacagaaagucccucuccagugaggcuguggugcucagacuuuccugggagccuaugggcaugucuuaguuugcauggucagagguuucugcuggaagauguggaaguuuugauguuuaucuuuugcaagguguuuuuuggccuucuuaggugugaaaccaaggaacggguguggccccaaaauaaaaaugucagaacucuuggcuaaaugacucggaagcagggcaggugaauccaacugcagccccacccuggugucggugagcuggcagggaagggcagaggccaggguacuggacuggggaagcaagaagacgaagucaggguuguugauggagagagugggguuugggcgucucccaggcuuggcacuuuaagggggugggagaaagacaaaucuugcuucugugucuugugccucagccagagccagggagacucaggcuguguugauaggaggcccagcugcaucagagcuggguaguugauaauuuccuccuugccauuucuguagugcaggcagcuguucgcucggugugacauacauuaccguaguuacuacaaugccucaaagcagcaucaggcccguugaagcauacuuuccuugacuguaacuguuggaaaaggaauagcuggaagaacuacagcagggauuggggauaggggacauaccuccugaaacauguggugccuggcaaccaggcccuggccuuugugggaggagagguaggggcugucugcuuugcuuccacaggaugguccugaucaagugagcaucuuuccuuccccuagagcuuaccuuaccaggcuugcucugagugagcuguuagaggcauaggcccaacaggaagcugcuucugcuggguaggacacguucugcaaacagcugauauuucacaucugcgugugccauggaagaggaaccacugauagcagagaucagggcagaacaccaggggucugugccagguucacaagggcagaggcuagucccugccugaguggcaagcaaugaaaagaaauaacaagguguuugauaucguuccucccuguccuccuaagaguacagcacauccagugaaagaugucucuguuuugagcaaauaccaguagcagguggcuuugugcgguugcugucuuagagauuauuggcauguagauggguuucuuuuuucuuuuuuuuuuuuuuugagacggagucucgcucugucaccuaggcuggagugcaguggcaugaucuuggcucagugcaagcucugccuccuggguucacgccauuccccugcuucagcgucccgaguagcugggacuacaggcgccugccaccacacccagcuaauuuuuuguauuuuuaguagagaugggguuucacuguguuagccaggguggucucgaucuccugaccucgugauccgcccaccucagccucccaaagugcugggauuacaggcgugagccaccuugcccggcccugacguaggugaguuucuaguagucuggaaaugcuguuugucuauaccugccaaauaggcaccacuucuuuccuguuccauauagccugggacccauguuacagcugacagucccugcaguguccaccauuaacaccaccucucucuggagcaucuuucaccuugggaucuacaguacuucacaggggucugcuguggggcagccaggucccucugugagggaagccaugcuucuuccgagcugggugaguugagccaucagggcccacuaugcuucugggugucacuccuucugggaacaagccucugcuccccuggcaugauugggcacucugucagccggugccugacugaggcugguagggggaagaaaccaacugauugucacccuguaguucaagccuauagggugccuccaggcagcccugccuggaaaagggcucaugacacaggagggucucugaauuagcuggagcagcuguucagcaccagggcugugggaagauagguuggguuuguguaccuggugcugccuugccccucucugccuuucucauucuguuguuucucguuccgagagaccccuggcacauggccuagaugggagugaaggaguagacgucccaggccuuguaguucugagcagcaacagguuuuccagggccguccagaacagagggugguuugguauuugggccccagagguacuuagcuggugauucaagcgguggcuaaugguguaagugcugcaggacgcugugguccaugcugagaagcuuguuucagauaauuugcucucugcuucccugccacuccucccugggcuggcagcacccucggcccuauggccagcaagugcguguuccuuuucugugggccuccucccugacccacaggagaccuguaucaccccggcacaccagggcugcucagcagccuuuucaagcgaggcagcucagccagaccuaaaaagucuuauucugggcaugggauuccuccucuauacuguccuguuuucgucuuccaaauacuagcccccagccucucucacagaaguaaacauucuaagacuggauuuuucagggcaaguuaaguccuuugauagaaaagguuucaucgacagcagagggccaguucugaaaccugaguuugucagugucugaaaacagagauucucaauuguacugggugaggcugaggccacauuagggugaagcagagcggagaccaguucccauucaguccccugccuuccuagugccagcagaggaucuguaucccgagacccugggaauguggggaugccacuccgggagcuccuuucgagaagggguuggccgucgcucaggacccaacgauguacgcagagccacaggcauauguuaccauaggucacccauccaaugacuuucccaggaggcucaaaaggagcucggggaaacaagcaaaagcuaaacccagcccuagaagagagacaccuagccuggcaagcugauguugcaccucaguuuugcaggauacugcaacaccuuuccuaguucaguauggguuacagagccagcuuguccugucgggacaagguguuggcagguagugcugccagauggaccagaugccaucugagccauguccuauccagacccagcuagacccagccuggccccccugggccguuccuggccaucaggaaucuacuucuucugaguggggagggugugaucugugcaaggccccuuuuucugcaggugcuagcuguauuguuccuugcccugcccaugacuucaagcugacaccuggguccuaucucaguggagggccuaggugcccaugggaaggcaugccccacuuggugucagccccugguaucaucaucuaccuguagagguagccuuuuucuccugcccccuuuaccauggcuuccaugcugagcuaccaugaagagaagacccugcacccagggcacugccagaccuuccuaccugcagugccagaggcaucaccuuaugguugcauugguccuguuccuugguucuaaaagcucaggggaacagccaugggagugcugugacagcgguguucucugaugccaccccacagcauuugcugaaugaaaaaaaaucucuuuugcuuucccauuauccauuguugagcugcuccaggccguggguccugccagauuuuuuaagauaguugagguuauggggacagcaucugucugcuggauuucuggagagugauggcucugugugagugaccacccuuguggagcagcccugccaugaugucccgcaauguaccuggacacggccccaugcucaggaagcacucuggccaagccagcgcagcacucaucccuccacagccagccucaagagugacauucugagagccacugggcauggcuguugaacccugccuggcgcugcaaggguuagauugcuuccccaggaggccagaaacaagaauggagcaggucuggggcugccgucgguggccauucauuaggagaggggcuagucaccagcuccaccccuacccgcucccuuugggcagaagggagcagaacaugugaagugcccagacucuacugcagagccaggguuuaagauggugaggaaagggaaucucccuggugagacuggagugcaauggcgccaucuuggcucaccgcaaccucugccucccagguucaagcgauucuccugccucagccucccaaauagcugggauuacaggcacgcgccaccacgcccggccaauuuuuaaaauauuuuuaguuaagacgggguuucucuauguuggucaggguggucucgaacucccgaccucaggugauccgcccaccucggccucccaaagugcugggauaacaggcgugagccacugcgccuggcacacauucucuuuuaaucuuccugccauccccgagagagagguucagccaagggaacuugggggcuaagaagugacagaauugggauucgagcucgagucuuucugacccacagugagugaugacugggacccauuuguugggaagagaugacuggcuuggugaucagugcucaggcuagcuuuuugggguguuuuuuguuuuguuuuuuguuuuuuuucugagacagagucucacucuuucgcccagccuggggugcaguggugcaauuuuggcuuacugcaaccucugccucccggcaucaagcgauucuccugacucagccucccaaguagcugggauuacaggcacccaccacuauaccuggcuaauuguuacauuuuuaguagagacgagguuucaccauuuuggccaggcuggucuugaacgcccgccucagcgucccaaagugcugggauuacaggcgugagucaccgcgccuggccucagguuaucuuugugagggagacguagcuggccccuguguccuggucagccgugggccaggaccagaaccugguggucaggcacagcccuagccccuugcaggguuccagacuaacuugcggcuucugaggaaaucuuuccauucagcaguaggaguguucuccauuccucacugccugggacugaggccuuggaucugcccuggcagaugguaguggcaugggugggcugcuggaacggucacgcuggagucccuggcacccuacaggagucuuccaucucuagggcacuguccagggauguuaccugggagugccaaggugauaaaugauuucugcagccacccuggcauuucugugacugugacuuucugucugagugacaaugcagggggaaguggguggugccagagcaucugcacuggccaccuggggccuccugccugcugguucaaauguggcuugguuucuccuugcaucacuggcauuucauaguaccugacauggccgggcauagacuuuuguguaugggugccaggcuaacugcccaucacuucucucugggcaagugacaaggcuuauucucuuuggagacagaagaaugguuaguugggugguccucucugucagaguguuguccccaucauguggccucaggcauccuucugacccagagccagccggauguaucucccugcagggccugacccaagcagccauguccacuuguccuuuuuuuuuuuuuuuuuuuuuuuugaggcagagucucauucugucgccugggcuggagugcaguggcgcgaucuuagcucacugcaaccuccgccucccagguucaagcaauucuccugccucagccuuccgagcagcugggauuacaggcauguaccacaaugcccggcuaauuuuuguauguuuaguagagaagggguuucgccaucuuggccaggcuggucuugaacuccugaccucaggugauccacccaccucggccucccaaagugcugggauuacaggugugagccaccgugcccagcccacuuguucuuuucuggcccucacaucccaguccccucugagacagccaucucuggccucauagugcaggucacaacucucacuucuaggcacaucuccauccucucucuagacccaccuagggaggggugcauguuuagaaaguugcugacuuuggcuucagggugggagugggaaaaggguuguccaguucugaagcagaaguugguggggcuggaggggcugcucacccaggcauaauugcuggacccccccuuaaugggaagggcagcacccuaggcauggugcuuggugguugggucgggaaggaggagguggcuucaccaucacaaguaccugcuuggugcuccccugggugucccucagaggaggggagaaguguuauuuacaugaccacaggccuccagucagccucuuagugccucaguuuccucuguccucugaugggauuuauaccugcaaguggguuggagucuuagaauguuuccuacaaguagacauccagggcccuuugacaaccaugccuacucccucuucucucauuuuguagagaagggaaccaggguccgaggucugaggaugagugacuggccagggccuaucacgggaagaacagugcuguggccagaaccagagagcagaagcacuucagccccacuggcuuuccuggcacccagggcuacagucucuuucuaacagaggccagucugccugugugaggauccuagccugaggcugacaacagacucacugcaaaauauggggccggggcuaagcccuggccuucugguuuccaguuucucaagacggcaguguagugccaguuccucuccacuguacaacuucucaaggccuggggagcagguucacaagggguggaugacugaauccaucaucuccucaacuccuuugggcuucuggugccuuuggugcauguuuguccuguccuuuguagcccuuagcuagccugaaucuuucucacaaaggaaaaacagaaaaccauuguauguaucaggacaacacaggaggaaaauccuccagugacuucacucaaaguuuucuguccacaccacuguuuaaugaguguuccccaucacggacuuucuacaucugagaaggagccacgaagucccuggaccugccaccaucuuaccugccuuguucagccgcuggcuacuuggaugucuaauaagacaucucaagcuuagcacuuccgaagggccuguuccuuccacccaucuuccuugucucuuuuuuuuuuuuuuuuuugagaaggacucuugcucugucgcccaggcuggagugcaguggugcgaucucugcucacugcaagcuccgccucccgguucacgccauucuccugccucagccuccugaguaacugggacuacaggugcccgccaccacgcuggcuaauuuuuuguauuuuuuaguagagacgggguuucaccauguuagccaggauggucucgaucuccugaccucaugauccgccugccucagccucccaaagugcugggaucacaggcaugagccaccgcgaccagccuccuuuucucuugauaaauggugccaccauguacuuguuugcucaggccagaaaccuggaugccauccuuuuuuccucucacauuagcugcacccacaccuggcgaguccugcccacucugcucugagucuuuccuaagucucgcucagcuccagccccacuggaugcuuuucuguuucucagacaugcugaguucauacccuuuaccccgaagguuuuuucuucuguuccucuuguccagcagaccucugcucaggagucacccucucagcaagaacucaauugacuaccccauuccagucaguccucauccccccucccauugcuagcccaucaucuggcuuugcauuuucuuuucuuuuauaaauagaaucuuuauugcccaggcuggagugcaauagcacgauuauagcucacugccaccucaaacuccuggguucaagggauccucccuccucagcaguacuacaggugcgcaccacagcgccuggcuaauuuuuuguauuuuuuguagagguggggugucaccauguuguccaggauggucucaaacuccugggcucaagcgauccacuugccuuggccucccgaagugcugggauugcaggcauaagccgcugcacacagccuuuuuuuuuuuuuuuuuuaagaugagauuucucucuguuucccaggcuagagugcaguggcaugauccaaucuucccaacuuagccuccuguguagcugggaccacaaguacacaccgccacacccagcuaguuuuuguauuuuuuuguagguauggggucucaccauguugcccaggcuggucucgaacaccuggacugaagcaauccuccugccuuggccucucaaaaugcugggauuauaggcaugagccacugcacccagcccagccuuguuuucuuuagagcauacuugaucuaccagguauuucuuguuuuccuauuuguuuauuuacauuuucccugucuuuauuccuuucacacuuccuacucccacuuugcaaacucccuggggcaggccuuuguuaguuauuugguggcaagcagauagugcuuguccuuuccagaggaugugaaggcaacacgguggccuuaaaccaugcugcugcagcagccagugauacuaaaugagguaugcaacauucuguuuucaaccuccaacugccuuuugcacacauccuuguguaaauauauauauauauaagguauauaccuuauauauacacacagacacuuauugugucuggaaaaaaauauugauagcuucaguugaagauauauuacagcucuguaauggcagaccccuuaccagaauagguucagauuuccuguugcuacuguaacaauguuggcuugaaauaaucauuuuacaguucuggagaacagaaauucuaaaauccagauauuggcagggcugcguucuuucuggaggcccuaggggagaauucauuccuugccuuuucuagcuucuagcggccuccuguguuccuugacucauggcugcauccuccaucuucaaagccagcagugaggcaucuuccauuucauaaagaacccugugauuacauuggcccaccuggauaauccacugucauccccuacuucaagggcuuuaacuuaaucacuucugcaaaauccuuuuuaccaugaaaggugacauagucacagguucuggggauuagaccauggacaucuuuggggugggggucuuauccggccuguaacagguacuguguauuuuuccccucugggaaaaucuguaaaaauugauaaaucauuugggaauuggaaaagcagaaaacuuaucucuuuucuagccaaacugaggugauggugaauccugaauugauucuuuuuuuuuuuuaauugagcucuuugguuuuuguuuuaauuuaaaauccauauuuauagccagaguuaaaaauuuuuaaauucuuucuuuuuuuuuucuuuuugagacggagugaaguggcgcgauuucagcucacugcaaucuccaccucccagguucaagcgauucuccugccucagccuccugaguagcugggauuacaggagcacgccaccacgcccagcuaauuuuuguauuuuuaguagagaugagguuucuccauguuggccaggcuggucucaaacuccugaccucagguggucugcccaucucagccucccaaaguacugggauuauaggcgugagccacugagccuggccuuuuuuuuugagacaacaucuugcucuguugcccaggcuugagugcauuggcacaaucucaggucacuccaaucuccgccuccccaguucaagugauucucaugcuucagccucccaaguagcuaggacuauaggcaugugcuaccacacccagcuaaguuuucuauuuuuaaguggagaugggauuucaccauguuggccaggcugguuucaaacuccuggccacaagugauccucccaccucauccucccaagugcuugggauuacaggcaaaaucuaaaaauucugugcucguuuugucaaaauaguuauauaguuuauuuuuaaagaaaaguguuuaaaauacuuauuuuaauuuuaggucuuugaaaauuuaagcaucuguuguuuucauaguggauauugaacucccauacacugagacaaaaauaucucccaaauauccuugaaucacugacuaaguagguucuuccuggugauuucaugagcuuucauaaaucaaaugaccaaauuguuguuagguuuucuagaguaucuacuguucuaaccugagaaagugaaaaaaggggcugggcgugguggcucacgccuguaaucccagcacuuugggaggccgaggcgggcagaucacgagaucaggagaucgagaccauccuggcuaacacagugaaaccccgucucuacuaaaaauacaaaaaauuagccaggcgugguggcgggugccuguagucccagcuacuuggguggcuaaggcaggagaauggcgugaaccugggaggcggagcuugcagugagccgagauugcgccgcugcacuccagccugggcaacagagugagacuacgucucaaaaaaaaaaaaaaaaaaaaaaagaaagugaaaaaaggaaaccuuccagcuuaugucuuauaccuccuggacaguaaaauuugcauaaaaaucugucauacaggaucauccuugugugagaaagaggcaggcugacagcuggggcuggucacugguggcacauaaacacacauaugugcuugugcacacaccuguaccacuugucagacuccugacaugcugggcacuggaggaacuuuccugagaucauuuggccccuguaccaaggagcucaugaucuugggggagggggcauggacagucccgggaacagugacuggugauugaagagguuugguaggcaccaggcaguggaccagggauaugggcagugugcaaggggagaaccaaaagauguuaugaaagacuccaggaggcaggaauuugaacuggaucaugaugcacuggcaagaggggaggacagaguggauaccacuaguucuugggcauaguucuaagaggaccuggaggagcagcaagcagccuuccugaaagacuauuuggggaggguggaaugggcaguggcuuugcuggauggggugugcccccauggccacauaagcaguggacuuggcuuuagggggcugugcaggucaaggagcauugaggagagccccaccuuaccuccuggcaucccagaccccuggcaacaucuguugugcugugccaaacacacaggguuaugggugcccuccuaacagguugccacauuguugucaguuacugccuugcagugggaaaucccugugcucuaucugagggaugaggggcagggguaggaggagggcuauuguggcugguguggcccaugguuguggauccugucagggcaagcuggugggcaugccuggggccaccacagucugagcuagaccuggagggaugauuuucacuuugcuccucacugcuguccagcuggccacccucaucuauagccugcuauagaccaggggaacagccgcugccaucaggagccauagugucucccgaguugaugccugagaaaaggccuugacugugacggccucaugagccugccucugguggggaaugggcauuguucugucccaaaagagcuauuucucugaggucaaaugauuugcauacccacuagcaaacagaaaggccucucccacugcugggccuggugagcuuaggagcugaguugaugcucagagcagcaacauguucccugagccaggcaguuccaaugucuuuggggaauucagaaggugagaauagagccuggauccagguagaggcuuuggcccuccuaaagccagucucaagcagcucucacacugguuuccuggugauggcgguggggagaugcaggaggcaccagcagggcugagggccuccaccaguuucugagagccguucagucuuggccuguuucccgcugugggugcuggagaaucuuuguuuaaauagaggcuuccuggauaaaaagaugugaaagcucaggguacacuaggcuugggaugggugcugugaccaaggggacaacuuccuuugugcucgcugauuuaaaugcugaguuuaggcuccagggucugggcugugucaccucuccagucacacucucugccucucuugucagcccuuggcccuguuauccuucuuuucucauucccacaccuuugcuugcugccuggccacacccugugcccucgccuauucacguacacaacaugugcugugaauguuugagccuugcccugcuuucuggcuacucagauccucuacucaggagagagccucuacccaugccacuugggaggagagggaugugcuuaagcauguuccuaugguaugcugcuuaggccccaaggaggaagcaggcagacacuggggaagcuaccuggaggggugccuggggaguagaccugccugucagcccaucaccuccccagccugugcagguccugggcuugucauggcucuguggguuccauuucuacuccuuagccaggcagucgaacccuucugcagcuccaccacuccugccccaccuguacucaugccuuugccugcacauccuccuuccuuuuucacuccccucuccccuuuucuaacaccuuggugcagaggugggagaauugcuugaggccaggaguuugagaccagccugggcaacauagaaagacccuaucuguacaaauaauaguaauauauauauuuuuuccuuccugaguaccaugcacuuuguuuuuuuuuuuagacggaguuucgcucuuguugcccaggcuggagugcaguggcgugaucuuggcucucugcaaccuccgccuuucuggguuuaagcgauucuccugccucagccuccugagugguugggauuacaggcgcccgccaccacgcccggcuaauuuuuuuuguauuuuugguagagacaggguuucaccauguuggcuaggcuggucuuaaacuccugggcucaagcaguccuccugccucggccucccaaagugcugggauuauaggccugagccacugcauccggccagaauaauuaguauuguuaagcuaccuauucucuccaaauugaucuagagagucaacacagucccagucaacgaucacagcccaccuucgaaaggcauuauuaagaaaaugagggccgggcgcaguggcucacgccuguaaucccagcccuuugggaggcugagguggguggaucgugaggucaggagaucaagaccauccuggcuaacauggugaaaccccgucucuacuaaaaaauacaaaaacaaaauuagccaggcaugguggcgggcgccuguagucccagcuacucgggagacugacgugggagaauggcgugaaccugggaggcggagcuugccgugagccgagaucaugcaacugcacuccagccugggcgacagagugagacuccgucuuaaaaaaaaaaaaaaaaaaaaagaaaagaaaaugaggccaagcgccauggcucaugccuauaaucccaacacuuugggaggccgaggcggguggaucauuugaggucaggaguucgagaccagccuggccaacauggugaaaccccgacucugcuaaaaauacaaaaauuagccugcugguaguggcgcgugccuguaaucccagcuacucggaagucugaggugggagaaucccuugagccuggaagguggagauuguggugagcugagauugggccacugcauuccagucuggacgagagagugugagacccuuucucaccaaacaaacaaacaaacaaacaaaaaugaugauaaaccauagacuggaagaaauacucacaaaacauaaaaggacuuguaucuaaacuacaucaagaaccuuuacagugcaauacgauaaacaagugcaauacaauaaacgacccaauaaaaaaugaguuaaaaauuugaaaaaacaguugaauaguuuuccaacaaauagguggcaaaugaguacaugaaaagauacucaguauauuuugucauagggaaaauguauauuaaaaccacaaugauauuaaaaccauuauauauacacuaaaaggccaaaauuaaaaaaaauaaacugagaauaguaaauacugaagaagauauggaacucauacauugcugguuggaaugcaaaauagcacagccacuuuggaaaacaguuugacaguuuguuaucaaauuaaacauacacuuaucuuauaacccaguaauaccacuuguaaguauuuacccaagagaaaugaaaacauaugucugugcaaauaccuuaaagcaaauauuuguuggcuuuauucauaauagcuaaaaauuauaacaacucaaaugucaucaacugguguaugaacagauagaaaaacugggguguauccauaacauggaguacuacucagcaauaaaaaggaauggaacacugcuucuccuaacaacauggauggaucgcagaugcauugugcuaagucuaagaagccaggcaagacaccucauguucuaugauuccauuuaugugaaauucuggaaaaggcaaaaccauaggaacacaucagauuaguguugccggggacugggaauggauggaacaaauugacucccaagaggccugagggaacuuuuuuuggaggagaaagggucucacuuuguugcccaggcugaaguacacuggcaugaucauagcucacugcagccuugaacuccugggcuuaaauaauccuccugccucagccuccuaaguagcugggacuauaggcaggcgccaccacacuuggcuaauuuauuauuauuauuauuuuugagacggagucuugcugugucgcccaggcuggaguucaguggcgcgaucucggcucacugcaagcucugccucccagguucaugccauucuccugccucagccuccugaguagcugggacuacaggcauccaccaccaugccuggcuaauuuuuuguauuuuugguagagaugggguuucaccguguuagccaggauggucuugaucuccugaccucaugauccgcucgccucguccucccaaagugcugggauuacaggugcgagccaccaugcccagccacaccuggcucauuuuuaaaauuucuuuauuuuuuauuuuuuugagacagaguuucgcucuuguugcccaggcuggagugcaauggcgcgaucucggcucacugcaaccuccgccuccuggguucacgugauucuccugccucagccuccugaguagcugggauuauaggcaugcaccaccaugcccggcuaauuuuguauuuuuaguagagacgggauuucuccauguuggucaggcuugucuugaacucccgaccucaguugauccacccacugcggccucccaaagugcugggauuauagacgugagccaccgcaccuggacaguuuuuuaaauuuuuuauagagaugaggucccacuauguugucccaggcugaucuugaccuccugaccucaagugauccucccaccuuagccucccaaaguguuaggauuacaagcaugagccaccaugcucagcuuuagagugauggaaauguucuguguguugaucgugguggugguaaugcaacuguauacauuuguuaaaacucauuugaaguguacaguuuaaaagggagaaucggccagguacgguggcucacgccuguaaucuuaacauuuugggaugccgaggcuggaggaucaccugaggucaggaguucaagaccagccuggccaacauguugaaaccccgucucuacuaaaaauacaaaaauuagcugggcaugguggcgcacaccuguaaucccaguuacuccagaggcugaggcaagagaaucacuugaaccugggaggcagagguugcagugagccaagaucacacuacugcacuccagccugggugacagagggagacucugucucaaaaaaaauagauaaauaaaaauaaaagagagaaucuuacuauauguaaacuaauccucaauauaaaauacauuuuaggccaggcacgguggcucacaccuguaaucccaggacuuugggaggccaaggcaggcggaucaugaggucaggagaucgagaccauccuggcuaacacggugaaacccccucucuacuaaaaauacaaaaaaauuagcugggcaucggcugggcacgguggcucacuccuguaaugccagcacuuugggaggcugaggcgggcggaucacgaggucaggagauugagaccauccuggcuaacauggugaaacaccgucucuacuaaaaauacaaaaaaaaaaaaauuagccgggcguuguggcaggcgccuguagucccagcuacucuggaggcugaggcaggagaauggcgugaacccgggaggcggggcuugcagugagcugagaucacaccauugcacuccagcauggaugacagcgagacuccgucucaaaacaaacaaacaaaaaaaacauuuuaaacaaccugccagauacacuuccaagguuacuuccagcucccacuccuucacaaggcuucccuugaccaccuccuuguuguaccacccucugguauguuccuuccgggucacugaugguuuugguuccuguuaaccgcagcaugggaucauuccucuguggggcuacaucagcuacuuuggcagucaccugcuggacucacagccagacucugucuauugguggcucugcuagaagccaagagugcugacagagguggggcaggcugaggagaggcugagagaccugggugggcuucugugacuugucuuguuccucccucaaguaccuacucaguuauugcugcucucuucccccacagguugggacaaacauuccuaugguuaccauggugaugaugggcauucguucugcuccucggggacuggccagcccuauggucccacauucaccacaggagacgugaucggcugcugugucaaccucaucaauggcaccugcuucuacaccaagaauggccacagccuuggugugugcauaagggaccuuggaggcucugcucuguggagccacuuugguuggugagaggcucaggggcaagugcucaaggcagugucgccucugcugagcucugggguaccgcaccauuuccaggcauuggagcccuuucaggugaauagaggguagcaggggcacgccuuuguucauccagccagucagcugcguuuauccagcccagggaggaugcugagaguacagcaguauccuggucgugaucuuggcuuugguggcacuuguuggagcaagguuuggcguuggaugagaaguuuggggaacccuugcauagguugcgugguggugguuugcgugccugugaccuggcccagacuuuggugcugguugcuguggagcagcagugaggguggcacuaguccaggagguaaacagacaggugggagucagauagggccagaccucuggucuguucuuggugaaugagcagcagccggggcaguuacauugaaaaaggcuucuggugaaaccaugaaggauggaccagaguaaagaccaggggaagaggcagauggccugagguaaggcaguggggaugggugcaggacaaaggcccagauguggcccugcagggcuuggugacagauggggugcacuugcaagaaggaaaggugagaaaauggcuggauuaguacuguuguuaaccaggagaagaaacccaggagaaauagcaaucaguggaagaggauggggcccgugggaucccuggaaggagcguuccuguacaugcguagacauuuaggauuagggcuugagaggaagagacuuuggcuauucugaugccgugccuaccaggugcuaacugguauuuggccacauuggcccugagguggugacuaacagccuggucugccugccuggguuugcagaaguccccgaucuacacacccuaguucuccagaauggaaugguauagugaggagaggacuggcagaacucuaccagcccagcugccagcagcucugccaggaaagggaguugggcauuuugcuuggaacccaacuccuagaagucccauuucccuugccuugagggucaguaaaaagguggcugcaacucuccacauccccucuaugacuucuccaggagaugagcacagcuaguaucaggggaccugagugggaauuggagugcugauggcuggggcugcaugccuaggagccagcauuccugcaacuggaugccccagccaagaguuggcaggaaagccuugguagcuaggcagccgagaacauagcacggacacugcuaagcugaccuaggugcacaucagagaaacccuccucugaaauugaugaccaccuggcugcaguugcuagugaccagauggugaggagcuaguggauagagggugggccagggccucaagacagcucuucacucuccacucugcacucugauuccgcuauuucuuggcucuggguucugcugucaaagucccaggggccacuauugugggcucucacccuguauccaagccccacuucaccugcccccuuguauagcugccuuccucacaucccuccagcuugcccacauuuugcucacggaugggggcagacucuacuguucccucugcaccugcaucucucuccuucaggccuuucauguacaccgggaccaccaaagggccaugaacucuuugucagucaagucccaaggucccauagagagcagauggccacuuuaaugucaccucaagcccuuaggcuguuuuuagacauccaucuccuuaguggaugcuuuuuauagacccccauccaagaccucacacaucuuguaauuaaauuucaucugguaguauuuugacuuuuuuuccagccugucaacaccuucuguguucuuacuuguuguaucucaaauauuugauacccuuuucaguguuguauuaaucuaaaauuuguuguuuguguuuauguuuucaugaaguuacuguuaaaaaauauaggaagaagagaagguuaagauuugagcccuucaguguauaguugagcuuguccuggaagacaucagccauuuaagaaucacuaaguuggccgagcgcgguggcucacgccuguauucccagcacuuugggaggccgaggugggcagauugcuugagcccaggaguucgagaugagccugggcaaguggcgagaccccgucccuauauuaaaaaaaaaaaaaaagaaucacuuaguuccugaagcucauauuuuuccauuuuuuccacauggauauuauugagaccuuacugaaaacgggauauggccuguccccugcauuuuuagauuacaaaauuuaacggaaaagcagugaaguuggagugacagaaugcauggugaaucuucuacugucucuguuuccuuuucccaagccaucuuaucaauaaugugcuucagaaucgaucccuuccccacuuuacagcagcggaaugaugucuucugccucuggccucccugcuccuuuccucugucaacagcccuugcacuaugugccauuggucaguugucugcauaauucuuagucaugugccaucucucuugcuggaaucugagggccagguuugcaacuguuucucuagucuugugacaacaaauacuugguagaaggaugaaggaaugagugaacggagauacugacugaugucucauuugcaagugguccaugugcucacagucauuuccacacaacucugugcuuucccacaaggucuuuauguucucagccucaguggucccugaccugugucuguuuggcucuggguacuccuuaucagcaaguucagcuaucccguuugcauccuggaucuuugccugaaccuucuucccgugggccaacucagaucuugccaucaaaaugauguugcaggcuggaggagcaguguugcccuuguccagugcaguaguggguggaguagcgucuuuccucauucuccuggaagcaccucaaggccuuauccuuccugggugccauugugaggcagaguugggcaagccuggguaggucauccccugaccaaaaguguggcaguugccucacccuguggcauuaccacagcugacuuauaccuagaccuuaggguucaugaaguagcuuucacagaaugucucauuuucucccuuuuuccuugaagucgagauaucgauauuaucucuuuuuuucagaugagcucagagagguuggguuacuugccaaaggucacacuauauauaauuuacggagcuuggacucccuuuuuccaggcuucuuggggacuccuccaugagcccuggaguaagcaauauccuggccaugcugagauccaugagggcagcuccggggcaggccuggaggguggacauuggggucuucuccuggguacagagagauuuccagauucaguccugccagcaugccagagucaugccgacugugcauguggggcccaaaaguggcuucagacaggcagaccaugcggcuuaugagcgucccucagugagaagcaaacaaaauagccgaacaaagaauauaaaccaucucucugcaucuugguuuuuucauaugugaacuagugucagagguaguauacaucuuccaagguuguucugaggauugaauagugccuuauaagacacucaguccagugcccagcauagaggaagcaugugguaugugcuggcuggcaugauuccggccagguuucugggagaccuguugucagacccaaaauagaauagacccuguucuauuuugcagggcuucaguuucuuuucugggcagggguuggauagcagacuggagaucucuaaggaaucagcaguuugaaaaccucaaaggccaaaagcucaggagcuucugggagauauaagacuuuaucugccgggcaugauggcucacgacuguaaucccagcacuuugggaggcugagacaggcagaucaugaggucaggagaucgagaccaucuggcuaacacggugaaaccccgucuccacuaaaaauacaaaaaaaaauuagcugggcaugauggcgggcacuuguagucccagcuacuugggaggcugaggcgggagaauggcgugaacccgggaggcggagcuugcagugagcugagaucacaccacugcauuccagccuaggggacagagcaagacuccgucucagggaaaaaaaaaaaaaaaaaagugugaaccugggaggcggagcuugcagugagccgagaucacgccacugcacuccagccugggcgacagaacuagacuccgucucaaaaaaaaaaaagacuuuaucuaaaaaaugagagggcuuugaguccuuggagagccuccacugguccugagucauuugucauuucucaguuugaagaacaugggugcucugguagccugcuuauauaguuguggucccacuccccucuacccucacuuccaauucagagcugaggucccuagaaaugcagccacuucucuuggcaggaggguuuuugacaggcuguuuuuuguuuuuguuuuuuugggacagggucuugcucuggcacccaagcuggaacccaguggcacaaucauacuagcucacugcagccucaaccugcagggcucaagugguccuccugccucagccucccaagucgcugggaccacagcuaauuuuauauauuuuguagagacggagccucgcuauguugcccaugcuggucuugaacuucuguucucaagagauccuuccacacaggccauuguuaaccugaacuuugccagcuuggaaccucugaggacucugacugcguauggacuggagauaggcagcugccacccucccuguuuccacuucucugucagcuuggggaugacauugaagcauuggacuaggaacaaauccagccccaccaccuuugcuagcuuuaugacuacuggcaaauugucgaaccucugaggcuuauuuuucuccuuuguaaaaugcaauaagccugcuucccagaguuggugugaggaucagaugaaguaauggauggaaaaggggcgaggugcgguagcucacaccuguaaucccagcacuuugggaggccgaggugggcagaucacuugaggucaggaguucaagaccagccuggccaacauggugaaacccugucucuaccaaaaauacaaaaauauauauuagccgggcauggugguaugugccuguagucccagcuacucgggaggcugaggcaggagaauugcuugaacucgggaagcagagguugaagugagccaagauugugcuacugcacuccagccugggcgacagagugaggcccuucuccaaaaaaggaucuggcaugcacaauaaguuuccauaaauauguguuaaaucaagagaaguaucaggucugaagggccgcaggggauagaucuuuuggauuuaguuccccuuagcaggcuuucuuugcggguggaggagcuaugcaccugccuaagcaucugauuucacuucuggccaggccgccagugaagagaaggccauggucuaauuaaaacuaccuagcccggggccgggcucaguggcucacgccuguaaucccagcacuuugggaagcugaggugggcagaccacaaggucaggagaucgagaccauccuggcuaacauggugaaaccccgucucuacuaaaaauagaaaaaauuggccuggcgugguggugggcgccuguauucccagcuacucgggaggcugagguaggagaauggcgugaaccggggaggcagagcuugcagugagccgagaucgcaccacugcacuccagccugggcgacagagugagacugcaucucaaaaaacaaaaacaaaaacaaaaaaaccuucccagcuggacacaguagcucaugccuguaauccuagcacuuugggaggcugaggcgggcagaucacuugaggucagggguucaagaccagccuggccaacauggugaaacccugucucuacuaaaaauacaaaaauuagccaggcgugguggugggcaccuguaaucucagcuacuggggaggcugaggccagagaauugcuugaaccaggaggcagagguugcagugagccaagaucguaccacugcacuccagccugggcuacggagggagacucugucucaaaacaacaacaacaaaccaaaaaaaacaacuacccggcccuagcacuggcuccaccauggggugcagaggcagaguagccccaggggcuggcccugaugacuguuccuuuccccccacagguauagccuucacagaccucccggugaguacuacuauugagucuuccccuccuggguuucugggggcugacugggauggggcacggugguaccugcaagugcaggguguggagucugguucuuuccccaaccagggaugugugccaugcugucagcuugaggguaccaggaggggcacuugcuggccuuccucucucuccagcaguaaggucuggucuuccuacgacucuuagcaggugacaguaauuuguggcacuuccaaaggcagcuguggggcuggggcggguagggugguggaaugaagauagcuccauggcucaacuggucuaaaccagcugugugucagcuggggugcagaguguagggaauuguuccugaacugugagggaaccuaguccuuguacauacccaucagagaucccugaggaaaguuagugcccuaggggaacucaucugcuacuaucuagggcacccccaagccagagaggugagcuuuguggggucuucucuucuuagaaaaggauggaguuuucuggccgggugcgguggcucacaccuguaaucccagcacuuugggaggccgaggugggcaaaucacgaggucaggagaucaagaucguccuggcuaacagggugaaacccugucucuacuaaaaauacaaaaaaaguuagccgggccugguugcaggcgccuguagucccagcuccucgggaggcugaggcaggagaauggccugaacccgggaggcagaguuugcagugagcugagaucgcaccacugcacuucagccugggcgacagagcgagccuccgucucaaaaaaaaaaaaaaaaaaaaaaaaaagaaaaggauggaguuuucugcuugcuuaguucaaaaaaaaaaaaaaacagaaaaggauggaguuuucugcuugcuuaguucagggcauauccucaccuccagccaucccgcaccuguacuccagucucuauuaugagucaucacaggccuaaucacaugcagggccuccacccaggaugcugggagccuggccuggcucuguguguucugguuagguucuggaaggaaggaagguuugcugacucugguggcugcuuugggaucccaaacaccccagugaugccccaggaaaugccuuugugaucuuaugggccucugaagcccagaccauagcacccaggguccuguuaaaaccuccaguccauggcucagaauccuucccucuuaccuggaagccccagagaggggcugugguccuaggcaaagagaacagaaucagguggagaaugcugacccuggcuagggaagggucuaguuauggggacgugacaugaaaugaccaggcaugagcauggccaguaugcagccacaugcaagaagguaugggggaaagacaugguaggcagugacggucaggaaggcuugcuggaggaggcgggccuugccugugguggaggaugguaggggaaagaaaggaagcgagagguccucugugugcagagcccauggugggcugaagccagcauacaggaaaaggucccauaccuugugcagguacaaaaaugcaugguuggccaggcgcgcuggcucacgcuugugauccuagcacuuugggaggcugaggugggcagaucaccugagguugggaguucaagaccagccugaccaacauggagaaaccccaucucugcuaaaaauacaaaauuagccgggcgugguggcgcaugccuguaaucccagcuacucaggaggcugaggcaagagaauugcuugaacccaggagguagaaguugcggugagcugaaaucgcgccauugcacuccagccugggcaacaagagcgaaacuccgucucaaaaaaaaaaaagugcaugauacucaggaaggaacauggccugagcacggaggugaaggguggacugagggcccugggaagaccaucugcagugacaguggggaggaggcuagcgaggcucuggacaguugcaguggggagccacaggaaccaccaagugagggagggaccgaacaaaagccagucaugguagaggcuagguggaaagcagggagccucacacccuacuggccagaagauccucuuagcgagccucuaacaggaaggguagcuucucuucacccuuugccagcaccaggggucuagaccaccgguucccuuuugccauguuccccuccucccuccuuuccugcgucaucccaucucugccuaccccccauguaucuaucuuuugguuuguuuuuuuuuuuucuuucugagacagggacucacucuugucaccaaggcuggguugcaguggcagaaucacagcuuacugcagccucaauuuccuggacucaagccaucuucccaccucagccucccgaguagcugggaccacaggugcauaccaccacaccuggcuaauuuuuaucuuuuuauuuuuuguagagacagggucucacuuuguugcccagacuggucuugaaaaccugggcucaagcgauccuccuaaauuggccucccaaagugcugggauuacaggcaugagccacugugcccagccucaugugucuuauuuuuuuugagacagagagauccuuggcccuggaucuuuccaagaggagccaugacccacuauugcagcagaccuucaugggcacgucugaagggucguggagcccagcccauuucuguaugcuuuggcugaguuccagaaagggcucuugggccuugaggacacaauggccucugauacagggcaggacacucuccaugaugugccuugcuugcuuuucuuuugcuuucuccccucaagcuuuggggcauaaugucucugcuagggagguggacagagguggcuccgcccugccuccuccagccuugcugcaacucucccagcccaagcaugggccagcagcagccauggaggugaggugaggccuuagaaccccacugcccucagggccugacugacauuucauucuccuccucaggccaaccucuaccccaccguaggccugcagacaccuggggagauuguggacgccaacuuugggcagcagcccuuccuguuugacauugaggacuacaugcgggaguggcgugccaagguccagggcacgguccacugcuuccccaucagugcccggcuuggcgaguggcaggcagugcugcagaagugagugcccugcuccugcccuuacccacucccaccccaccccagcccacuucacucuaggccccuguagggcuacaagcuguucuuacaaauuccagcggguggauccuuucugggaagcauucccagggccauucagccugcagcucuccugcuucucugucgucggauggacagcucccaccgaguucuccgggcugcuccuaauuaaaccuuugccucucagccauauuggaggcuccuguauauaagaucaccagcagggcuguuuuccuuccccaggucauuuugcagaggauuuugcagaggaugcccuguggucucuuccucuguggacccuuuuucuaccauagggaguauccauggugcugugacucuggccugaggccaccucacagggcccagcauccaacugagucucauucgucuauagcggugguggagggaagggaguucucccuaggaccagcugagcuagcuccuuggcugauuaauucccagacuguccuggaagccagugucgcugaacucccaagggaggccagcuuuggguuucucuuccacuugccaucugcaagccugagugaggcagugaccaguauccacucugccaggagguggguguuagcuuggcucucaaggaugggcagaugggcauggggaagggcugggcuuccacugccuguggucauugcccugcaaaggcaccagggugcuaggauuccuggggugggguugggguacacacugaguucuuugugcagccuuugucccuugaggcaggccccaaggaugggcugaggcaggggcuagguggccagaccuuccccaggaaaaacagcauugcugccucuuguucacagccccccagagcagaugacaaggacuuccuuggauggccaggacagcgccacucccagagcaggcuuggugggauugccaagaagaggggugaagaugccaagucuguguaggggaggaacugauacucucaguuuucagggccuaggcucagcacauggauguguuuuuguuuugggguuuuuaaaaaaauacugagauggggucgcacuuuguugcccagguuggacuccugggcucaagugauccucccaccucagccuccugaguagcuggcaucacaggcaugugcuaccauguccagcauagcacauagguguuuuuguuuacauguguguauccaugugcuuguauguguucauauguagcauuugccaagaccugcauauaauuuguguacugugguuuuacauaacuucauuuaaugaauauugauaauggcuauguuaucacagagacaaauuugucacaagccuuuuggcuggcuuccucuaguggaaggucagguaauuccuucucuuuuacuuguguagguaacccucuuguagauaaagacuuuuucauauuuacccuuguguuuauaauaauaauaugguguaauaauaauaauuauacuuacuuuacuuuuuucugagucaggaguuuacucuauugcccaggcggagugcagugacacagucauggcucacugcagcauggaccuccugagcucaagcaauucuucuaccucagucuccugaguagcugggacuguaggcaugcaccaccacaccuggcuaauuuuuuguauuuuuuguggggacaggguuucgccauguugcccagguuggucucaaacuucugggcucaagugauuuuccugccucggccucccaaaguguugagauuacaggcaugagccaccacacgcagccaauaauuuuuuuuuuuuuuuuuuuuuuuugagauggagucucgcuuugucgcccaggcuguagugcaguggcgcaaucucggcucacugcaagcuccgccuccuggguucaagccauucuccugccucagccuccugaguagcugggacuacaggugcccgccacuacgcccgggcguaauuuuuuuuuguauuuuuuuaguagagauggcauuccaccgcauuagccaggauggucuugaucuccugaccuugugauccgcccgccucagccucccaaagugcugggauuacaggcaugagccaccacgccuggccauauuuuuaaaguagagaugagaucuugcaauguuggccaggcuggucuugaacuccuggccucaagugauccucccgccuuguccucccaaaguucugggaugacagucaugagccaucacgcccagcugauaauuauuauuuauacuauaauauuauguaauauaucauuucauaauaagaagucuuauuuauggacuucuuccugccagguacuuuauguguauuaucucauuuaccccuuaaagcuugagggaacacacacccaaacuucugugccuuccaccugacaacccuucagacauuuguguuuagaguuacaguaaugacaucagacacauguacacaccaagguauucacuccuguacacaucagauuugaggguucagccucugcuuuauauguguacacacaugugccacuguucagccagcuucugcugggguuaaauggcuacagggagucagacuucuccagaccauuucccaaugacuguguucccauuggcccugcugcugccuaucucugccuggcaaaaucagccugauugcuuggcuucuugggccccugauuugugguguaucaugguguaacucuggguugugaguuagcuucccaucacucacucacuagagcuggaacugcugagggcagguucaccuggagggcugaaaugcuucucucagguacauggcacagccugcagaggggcuccugugucuguagaaggugugcauguggcaugcauccugucuggaaaucugccagauuaccuggcuagcugcaguuucgggaagcuaucagugagacuauuggccucuuaggcuugcugcauuucccaaagaggcagccaccugugaggagugugccuguguguguacuucuguuaucauacucgcuuacuugugggcagcaugucucagauaaacugcagccacuccucugaacugugggcacagauguggugaccagccccuccgaagccugacuucaugaccguggggcaccaugggggaaguuuucauuuuguuucagccccuuuauucucauucuguggagguuacaccuccaggacguguuuagggagaccucugggggagguaaucuguccugaguccauuggguagucagugagaagugcaguucuugagugucaccugaagcucuuccuuucuucuagcaugguuucaucuuaccucgugcaucauggguauugugccacagccacggcuuuugcucgaaugacugaaaccccgauucaggaagaacaggcguccauaaagaacagacaaaguaagguuuauucuacuuuccccuuucccuuccucaccugucccuaacucugcucucuggcucaugucaacccugguuaaccugucaggaguccauucagcucugguccucaugaccagcuugcagcucgaggccauguuccugucccaccuucaagauggcacugcccagauggacaguuggcaggauggagacgucucagggcagccucccuaaugcacauucugaaggcugggcgcaggccaggcccuggcauggcugguuccauuccuccauuuccucccugcuuguuuccuucccccugaauccuggauuccucucaaccuccuguucauggucuuccaggaaggcuguuugccugccuuaguaguucugcuuauuccuagccagagaggggacugaaguggucagauagggcaaagccagugcucaauggcugcugugggggcacuacccucugcuccccaccacugguccugcccuuugcagacaaccuaaaguccucccuuggccagagcucucccaguguugaugcuggccuggaugcugugugucuggaggcucuuucacggaaggagggguguuggaaaagaggaaaaggagcccagugaggagcuagaaggagaaaaggagaaugagggcaaguggguguggauaugcgugucugugagugccugccuaccccucuccaagccugcugucucuucuguaugugcacgugucugucucccagagaagcugugcucagccagacagacggaaagggaucccagacuugggaucuaugaaugagagccucagacucugaaguugcucccagcgagaugcaccaggccccacggcaagagcgaaaaggcagcagcaagaugcugauggcgugagaggugucaacaucagaggugccagcaugaggaggauggccuccucucccagcagggggcaugcugcagccccugaagaccaccagccagagcccuggucagaaaccagugugauuccauugccauuccccugugaggccuggaaggagaggagucugucugaagaggagccacucaggccgccaagcugccugggugcccauccccagaucauguugccccagcuggggcccuacccugcccccaggucccuggcaccaugugccccgcaggagcagaccuccacauuuacccuccugccuuugggcugagagucuccccuccaucuuccccauauucuugaggacucucugacacuuggcagaaaccaggaucuguugggcugggcagucagguucuuucuccagccuccucuccugugagcauuucaagcuggcgaggcacucugagccggacccuacccugaggcuggcagcaucccagguguguggcugugggagaggccuguagcccucgcucacugcuguguucuugcacccugcagagauccagaagcuggugcuggagggccgugugggcgaggccaucgagaccacccagcgcuucuacccagggcugcuggagcacaaccccaaccuccucuucaugcucaaguaagucuugggcacccccagcucccccagaguccagccccucucagcugguggugggaacgucaaccuggaccacaaccagagcauuauugcuccgcucccuccacaggugccggcaguuuguggagauggugaaugggacggacagugagguccgaaguuugagcucccgaagccccaagucccaggacagcuacccuggcucccccagccucaguccccgacauggccccaguaguucccacaugcacaacacaggucagccacucuccagagggcucugggaagaacugguguggaggagagaggccacuccacauacccuuuccugggcugggcucagggcucacugcuggauuugggagaagggaaaugggaccacugugguuguucuuggggcuucauuucaugggaagcugccccuccucuucugacugucacccuggcuucuaggagcagacagucccagcuguagcaauggcgucgcguccaccaagagcaaacagaaccacaguaaauacccugcacccagcuccucauccucguccuccuccuccuccucguccucuuccccauccuccgucaauuacuccgaguccaacucaacagacuccaccaagucccagcaccacagcaguaccaguaaccaggagaccaggugccugccuugcucugcuuccuccucugccuucugccuuaugccagcugggcccauugcagucuguccuuugagcgcccugcccuucacccccagccuccaucucaggucugugccuggaguccuaauuuuuggcccaccgggccagacaucagcucuggcuucuggcccuccccacgauuuagcugcacuuucuuuggccuuggcuuucuccagaggcuccaaugaugccaggcugaggauguggucuccuccaaagaggccgggccugugagaacccucaggguccaucaugagggagcuuucccuggcucuggcuuguagacagccagguugggcaggcaggggaagcuaagccgcaggcuagagcucuagguggcucucagcauccccagguacaccucaaggcugaccugaguuuggcuuccaaccaaggccacagagcugcccaugggggccauggggcccagucauuagguugggggauauguagaagaggugugugaacucagaggagggccagggaggggagaaucacagaggcagcacuggggcaagggugggaaucaggugacaggccucugaggauagcuggugucacaguaggggccaagugcugaagacuuggaagccugagcuguccuuucauguuccuggggguccucgguucacccacagcaacccauggcuacagcuugaaaggaggcccaaccaggcugcuccaaccacacccccugggccaacucccaccucaaccccuccccacagcgacagugagauggagauggaggcagagcacuaccccaacggugugcuaggaagcauguccacacgcauuguuaauggugccuacaagcaugaggaccugcagacggaugaguccagcaugggugagagccacggcccggugugcuauucuuugagggcagugugcagucugggugcccucuuccccugggaggggcugggguaggcaggcuuuggcaucuugagaagcuucagccagaccugguccacagccuccuuagccgauugugaauggguccuugagguggcuccaaauguacgaaggcccuggccugugccaagaccaccuauguuugaggcuggaggguguucgagagcaugggcacccuaaugagcacccugcgucugugcaggcugggaagagggacaacuuccaaguccucccuaaauccuagacugugcgccaggugaaugaagagaagaacgccuugacuguagcugccucaccuguuccucccagcccugccugccucuggcagaagcugcagcccacccgggguccuuccugccccacccuaguccugcccuucccucuucaccccuccuaacacguucuccacuggguucuggaugcagaugacaggcauccucggcggcagcucugcgggggcaaccaggcugccacagaaaggaucauucuguuuggccgcgaguugcaggcauugagugagcaguugggccgggaguacggcaagaauuuggcccacacagagaugcugcagguacaggaugagccgggccucaugcagagcaggccccauuugguguugggggcaggguggcucugggagaguccagggggcagcaggaaagagugggcuccagccaggucugcagagggaaguggggcaucugggcccacuggacaugugcccuccacaccuaggcucuggggagaguacagcccugcccgacccuacaccccacauuccaggcugggcaucaugcagggcccugucucccucuggagccacggguagcagggugagcuauggugugugccacaguccucucaagaaugcccuguccuguaggaugccuucagccugcuggcauacucagaccccuggagcugcccaguuggccagcagcuugaccccauccagagggaaccugugugugcugcccucaacagcgccauuuuaggugagugaaucuauuuauuauuauuauuagagacagagucugcucuguagcccaagcuggagugcaguggcacaaucuuggcucacagcaaucuccaccucugccuccuggguuuaagcaauuuucgugccucagccuccugaguagcugggacuaaggugcgugccaccacgccuggcuaguuguuguauuuuuaguagagacggguuuugccauguuggccagguuggucucgaacuccuggccucaggugaucugcccgccuuagccucccaaagugcugggauuacaggugugagccaccaugccuggccuaggugaguggaucuaacaaaaacagaagcuagcccauagcuaccugggugguucccaacccccaccccaauuggccccagaaagagcugauguuuauccacacuggggcagcaagcucuguacaggcccucucuggugacucauaggacuccugggcucccaugguugaaccuaaaccuugaccucugucugcccagcugaguucaugauggguccuaggccauggcaguaggcccaggccagcccagcgcucuacauggggcuaagguccucagguuccuggcaugacuucagggccauggccugguggcugggacacacuuacacagagguacugaacacucuguuccaagagaaucuguccacugcccccuccuuccacccccaagggaacuuugaccugggcccaagcccugggcaggccagugaccaggccuugucuuuccuccacagagucccagaaccugccaaagcagcccccucugaugcucgcccugggccaggcaucugagugucuccggcucauggcccgagcaggccuggguucuugcuccuuugccagaguugaugacuacuugcacuagcugacugugcuggcuggcucuggcuggcccuccacuggccccagggcuggagcugcccugcccuccauaggcaacuggugcagggacugggaaaccauagacagaguccacuccuccugccuggccuuucccccucucccuuuccuuccuuccuuccuuucucugcccaccaccccgcucagucucucucucucuccccuucacgugcagcggccuguaacacaguauuggcugguuacucucauguagcgccuucuauuuugaaagggggguuuuguuuugaggagggguugggguuuuuaaauuuuuuucuccugacugagccaccaguauuuaucucuggagaguuugugcugagcugguuucugcuaauuuagugaugaagccuauccaaguuggugauagcuuauuauuuucauaaguaaaaaacaaaugagauuauauauauauauauaaaaauauauauauuaaaaaaaaagacaguauuuaucguagcauuagugguccagcaccucuugggugaggcuguccaggcaccauguuuucuuugaguccaacucauuaaaaaagaagaaucucugucaccucagccaagugauuuauuuuuugcucccccuuuuuugagucacaggccgagcugcagccuaggaaacccaaauaggguuuggugggccacuuagugggcaugguuacauugguuuauagcaucccaagaacuguagaucccuaggccccugagagcuggacagagcagagaacuacagggccaaggguccagagaagugauaacuuggcccagggccacacagcagagguagaggguccuuggccagcacacuaucuaccacucuaccccaccucccacugccugccuugcuccccuuuccucccuuuucaauacccuaucuucccuuguuguuaagauggccaaauaauacauuuacucuaaauugauugccuggaaacuaccugccuucguccugagagcuucugugugucaggcugcuggaaagaagacuccauucccaggacagaggcccuugaguacaggggcugcuuucuuccugccuagaucuucaccaucucugcacagcucugagagaauggaugcuuucuguugagaaaccaguaccuuguggaggcagguucuugggcugcuacuccagggaguggauggaauccuugguccccuaggccagacuucacugccacugugccagacagcucccugcagcugggcccuagccacucuuaggaaagacuauugggaguauuugcuggccagagaaugggacucuaucagcuuuacacaugucccaccagcuguuucagauagauccuuacagcuggcagaguaaaaguggucccgcuaccauuggggaaucaggaaaggaaagacugagaugguugccaggacuugggguggcccaccuguggagaggacuggcugcccuggaggaggaaagggaggaagucuacacagaggagcaccaggacggcuggaauuuccauaugugcuucacauugugaggggagugcacaagccgcccaugcaaagaguagggucagccauggcaaggccggaaguugaacuuucagucccugccugaaucugggcuuugcaagcuccugcuccauauugguggacaugggaaugguugguguggccugagauacccauugcucaccaggccucacugggcccacagcugggcaacaagaaaaauguuugaauuggaccaacugcuggugauggggccagggcccugggcccugugcugucagaauucugccuugggaaaugauccuauagcugcugcuuuuucuugguccuuggggcuggcagacccauagaccauggccuguuaggaggcguccugucuguaaaggaaauucaucucuugugacagccuggggcuaccuagcucccaaacccagaaguuggagacaucaggcuguuuaaaugaucauagccuagcaggauuggauuaaaaccacaggcuuuugcagcuggaaugggguucagugaacaucucccccauuccucucuugcuacaaauaaggaaacaggcccaggagauuaagugacuuggcuaaagucacauagcaaauuaguagcagagccgggacuaucccuuaucccuguggguugggcaacacuauuuaguccugaaaccgaauggcagauaaaccccaugaggggucaggcugaugugcccuccagcaguaucugagaagcugcuaccuucaggggugugucagggaugaggacgggugccugagcuuagguuguggaguggcugagagggcccaggagggcucgggacagcugugugcugcaugggguugggugucugccuggcucgcacuugguacccauggccaccuccccauuuucugugccuuaucucacuguuucagcugaguccaaguuguuuacucuguuccucuccagaggggcucucugucccaguugggcagcucaccuuugggacauaagccuuugccccacaagcuguggagagggccaaaaccaagcugcuugagcccacucucuugcugagaguccaggccugccugccugccagccagaggugccccuuaugcacauccaguccuaccagccugcuuccaggagccuagagugggaaaggcaccugggggagcccuggugaagggcuggaccugacccauggaggcaggaggaagaccuggcuuucuugguuuguccggcccuggggagcagccuucccuacucacuuuccccuugcggcaccaaauggucacuccuuccagagcaaaaacuggcacucauagcaagccagaacccccauccccauccucaugggucuguggcugggugcaggccaucaaaauggacaccacgagacagaaguggggacugccuggccaccuagcgccuucccacuccuuaagcaagcacaaagaagaugaggcagagaauugucagagcugaaaguuccuuugguugcucacaacucagguaugcacccauguggcagccaggcagcggagcccuacuagacugccagucucaugcacccagaccuguggccagauuguggccucuggcugccucaggcauuuuccucuuugcauuggguuuuccugcauuaguaacuacagcugcaacagacauccuccacauugugcacacugguuuugccuuuguccucaagaguugauacuuggcauuagcaugaaacuugugggugugggaggauggagagagaacucuaacacaaaacaucuuauuaaaauuguacuugagagacaaaaaaaaaacucuguuguauuuugacagaauuauuuuuauuaaaauacacauccaugagcagucaugugugucuggucucuguuuugagucuuacugagguuggcaccccuucugugacacauccuguccuaaaggauuugggcccuucccagccucucaagugcccaggcccucaggugccuucuucaaggaccuuugaaacuguguauuuguaagaccccaaagaggacagguacuuaaaccucaguucucucuugaaacggcuuucuucuuauacaaggaaaaaguagcaaauucaacuaaag

SEQ ID NO: 15786 - RNA, 14480 nt, Homo sapiens
ggcgggugugugcggauuccugccgccuuccaaggcacugcgauagccuccgaagagcagauucuuuccccagcccgucuuguccccggcgggcgagagaggcguauuagguuggaacgcugucgccuggacugcuccucacgaggacccgaauccugauaggggcguggagcggggcggugcgcgccucaccggugcgcaagcgcgguggguauaugcccacggagacuacaaaucccgugaugccucgcgcugaacuaggcgccuucccuccgaagcgccgccuaagggaaagaucgaguuacugcggaccaggauucgggcgagguugugcuguuugccagaaccaguuccccagccccgagccccuuugagucgacggcauugcugcagcagagggagacgaaaccugggccucggcgccccgaagggucucaggagccccuuucuuugcguuggggacucucuccugauucagcugcugccugcguugacuaacugaucuaaacaaagucuccaguagacgccuacuauguggcugacacggugccgggaguuugcgggagucagaccgacugggcuccucucuuggagccugacuaccuagacggauaagcgucugucuuuuggauaauagaucugaaugcacgcgaauggaugucuacucacaaauaguaaucgcuccaaaggaauuaacaggagagcagagaaaugggggggagguggugggggccaggaauaaaaaaacgaacgaaagcuuggguagggagaaguagccaauucuugucccaggaaccagucuguaaggccacauggcagaaaagagcuaggcuccgccauuaaagagccuggaaagggguggcccggguagggccaagcguaggaaaauaccaaacugggacauguuaaggauuugggguuuuauucugcaggccacugagagcuauuaaaggauuuuaugggaaaggauuugcauuguaacaauacaccuccccccaccucaacuuauuugagggaaucuuuuuuuuuuuuuuuuuuuuuuuuuuuuguaaaggagucucacugugucgccagacuggagugcaauggugagaucucggcucaccgcaaccuccgccuccuggguucaagcaauucuccugccucagccuccggaguagcugggacuacaggcgcaugccaccaugcccggcuaauauauauauauauauauauauauauauauauauauguauuuuguauuuaguagagacgggguuucgccauguuucucaggcuggucucgaacucgugagcucaggcaaucugcucgccucggccucccaaagugcuaggauuacaggcgugagcuaggaucacggcgccuggcugggggaaaauguuuuaaagaacacaaaauguuguggaaagccagggaggggccaggcaguucuccaggugaauuaccugcaaacuagcccuccuuugccgaguucuuccuucucccaauuuuuuuuaaacuuuuacuuuagguucggggguacgugugaagguuuacuacauaggugaacucgugucaccgcgauuuguuguacagauuauuucaucacccagguauuaagcccaguacccaauaguuaucuuuucuguuccucucccuccucccgccccccgcaauuagaccccagugucuguuguugucuucuuuguguucaugaguucucaucauuuaacucacacuugugagaauaugugguauuugguuuucuguuccugcauuaguuugcuaaggauaauggcccccagcuccaugcauauucccacaaaagacaugaucguggucaccucccaauuuuucuuguccuuuuuucucuccugauagcagaucacaggcaugaaauagaaaccuaauauauauuauuucuuuuuuuucuuuuuuuauuuugagacggagucucgcucuguugcccaggcuggagggcaguggcgcgaucucagcucacugcaagcucugccucccggguucaugccauucuccugccucagccucccaaguagcugggacuacaagcgcccgccaccgugcccggcuaauuuuuuuuguauuuuuaguaaagacgggguuucaccguguuagccaggauggucucgaucuccugacuucgugauccgcccgccucggccucccaaagugcugggauuacaggcgugagccaccgcgcccggccucuaauguacauuacuucuaauuauauuauuggacauaaaaacaaaauggggccgguguagccccugguaaaagauaugcauucauuugggugaaucauuuauacaacgguauaaacgugaacacacauauugcauuuuuacuuauguauuuauuuauuugagauggaguuucguucucauuguugaggcugaagugcaguggugcgaucucggcuuacugcaaccuccaccucccagguucaagagauucuccugccucagccucccaaguagcugggauuacaggcgccaggcaccacaaccagcuaauuuuguguacuuuuaguagagacaggguuucgccauguugggcuggcuggucucccacuccugaccucaggugauccacccaccucggccucccaaagugcugggauuauaggugugagcuaccgugcccagccuauuuauuuauuuauuuauuuuuauuuuucuuagacgaugucucacucuguugcccaggcuggcguguaguggugcaaucuuggcucacugcaacauccgccucuuggguucaagcaauucuucugccuuagccucccagguaacugggauuacaggugugcacgaccacacccagcuaauuuuuuuugguuuuuuuuuuuuuuuuuuugagguggaguuuuguucuuggucaggcuggagugaaguggcacgaucuaggcucacugcaaacuccacuucaggguucaagcaauucuccugccucagccucccaagagcugguauuauaggugcccaccaccauacccggcuaauuuuuguauuuuuguagagcgggguuuuccucauguuggccagguuggucgcaaacuccugaccucaugcaauccacccaucucagccucccaaagugcugggauuacaggcgugagccaccgcacccgaccuaauuuuuguauuuuuagaagagauggaguuucaacauguugggcaggcuagucuggaacuucugaccucaggugauccggccaccuuggccuccuaaagugcugggauuacaagugugagccacugcacccggccaauauuacaugcuuaaauuuuuuuuuuuuuuuuuuugagacagagucuugcacucacacuguggccagggcuggagugcaguggcacaaucucaguucacuguaaucucugccucccgaguucacacgauuuuccugccucagccuccugaguagguggaauuacaggcccacaccacuacacccgacuaauuuuuuguauuuuucauagagacaggguuucacuauguuggccagacuggccuugaccuccugaccucaugauccacccaccucagccucccaaagugcuggaauuacaggugugagccaccgcgccuggccauuuuuuuuucuuuuuuuuuuuuugagacggagucucgcucugucacccaggcuggaaugcaauggcacgaucucggcucacagcaaccuccaucucccggguucaagccauucuccugccucagccucccgaguagcugggacuacaggcaugaaccaccaugccuggcuaauuuuuguguuuuuaguaaagaugagguuucaccacguuguccgggcuggucucgaacuccugaccccaggugaucagccugccucggccucccaaagugcugggauuacaggcaugaaccaccgugccuggccauguuuaaauacgugugcaguagagauaaaauucagcaaaagaucauuguaacuguuaugguucaaacucuaccugucucaggacucaccuugcucaaaaaauguugagaggccaaauugauguaauuucuuuaugcacagaauauugaaaauuaugcccaaugaaacucuaauuuccaguacauaaaaucaccugucaucuacacuuaaucuucuaccucaaagcauaucuggaaugcauggcuuucuccccaccuccacgauccagcucacucucugucuuaaucaccccuggagaaaggcaagaaccucaucacaugucucccugccuucaaucuugccucuccugcaaucuguucuucacaugacugccagagaaaaucugauaugucauaccucugcuuaaauuccuccacuggcuuccuauuccauuuagaauaauguccagauucuuucccagagcuugcaagaccccauauuagucuagcccugucauucucuuucgcuccucccugccucacuucaucccaguauuuuuuuuaaacaaguaauuauaacguuuaauuaugugaacaaacagaauacuacuguacaaagaaugaagcucauuguuuguuuguuuguuuguuuguuuguuuuugagacggagucucacucugucgcccaggcuggagugcaaucuuggcugacugcaaccuucacccuccaaguucaagcgauucuccugacucagccucccgaguagcugggauuacaggcaccugccaucgugcccggcuaauuuuuuguauuuuuaguagagacaggguuucaccaucuuggccaggcuggucuugaacuccugaccuugugauccaccugccucggccucccaaagugcuaggauuacaggugugagccacugcgcccagccaaaguucauguuuuaaucuuuuuugaaacauguuugaccagccugggcaacauggugaaaccccgccuguacguaaaauacaauaauuagcugggcauggugacucacuccgguaaucccagcuacucagaaggcugaggugggaggauggcuugaguccagaagguugagaucuucagugaccugugaucccaccauugcacuccagcgcgggugacagagcgagacccugucucaaaaaaaaaagaaaaaaaaaaggcaaggcacgguggcucacgccuguaaucccagcacuuugggaggccgaggcggaagaucaccugagguuaggaguuggagaccagccuggccaacagagcgaaaccucgucucuacuaaaaauacaaaaaauuucguaguggcucacgccuguaaucccagcacuuugggaggccgaggcgggcagaucacaaggucaggagaucgagaccauccuggcuaacacggugaaaccccgucucuacuaaaaauacaaaaaauuagccgggcgugguagugggcgccuguacucccagcuacucgggaggcugaggcaggagaauggcgugaaccuuugggaggcugaggcaggcggaucaccugaggucgggaguucaagaccagccugaccaacauggagaaaccccaucuuuacuaaaaauacaaaaucagccaugcgugguggcacaugccuguaaucccagcuacucgagaggcucagaaggcagagguugcgccauugcacuccagccugggcaacaagagcaaaacucugucucaaaaaaagaaaaaaaauacaaaaaauuagccgggcuuggcggugggccccuguaauccuagcugcuugggaggcugaggcagggagaauugcuugaacccaggaggcagagguugcagugagcugagaucgcaccacuacacuccagccugggcaacaaagcgagacuccaucucaaaaaaaaaaaaaaagauguuuguuuuuuuccauauuauucaauaguucaagguuuuacuaguaaaugaauaaauaauuuaaaacugcaggcuggggccggguguaguggcucacgccuguaaucccagcacuuugggaggcugaggugggcggaucaugaggucaggaggucaagaccaucuuggccaacauggugaaaccccgucucuacuaaaaauacaaaaaauuagccaggugugguggugggcaccuguaaucccagcuacuugggaggcugaggcagggagaauugcuugaaaccgggaggcagagguugcagugagcugagauugugccacugcacuccaucccgggcaacaaagugagacuccaucucaaaaaacaaaaaacaaaaacaaaaacaaaacugcagaccaggcgccauggcucacgccuguaaucccagcacuuugggaggcugaggcaggcggaucaugaggaguucgagaccagcaugaccaaaauggugaaaccccgucucuauacaaaaauuagcugggcgugguggugccagccuguaaucccagcugcucaggaggcugaggcaggagaacaucucaaaaaaaaaacaaaaacaaaaaaaaaacugcauuuagguaguaaccauggaaauaugucugcaaaaggauagcaaauugagucagauaacacagauaucagaucuaaaugacaaggaauaucgauagcuuuuucucuacaguucucuuauuuugagaagcaagaaucuaauuuuuugcuuaauuuuuuuuuuccgagauggagucuugcuuagucgcccaagcuggaguaguguggcucgaucucagcucugcaaccucugccucccaggguucaagcaauucuccugccucaguuuccagaguagcuggaauuauaggugagugccacuacacccagcuaauuuuuguguuuuuaguagagacagguuuaaccauguuggccagacuggucuugaacuccugaccucaagugauccgcccgccucagccucccaaagugcugggauuacaggcaugagccaccaugccuggacuucuuggcucagcuuuuuuaacacaagcacaaauaugcccaugcuugucucagguaucugauaauuuacacuugaucucagugcagauucugggaaagugaacuccacggaagacucagaaaccaaguucuaauucaguugccaugaaaacuuaaggugagaggauugucaaccagugaaaaauacggaggaaaacacuaacagaauaugguaagcaucucuagcauuaaaaauuuuuaauggccgggcgcaguggcucacaccuguaaucccagcacuuugggaggccgaggcaggcggaucacuugaggucaggaguuugacaccagccugaccaacauggagaaacccugucucuacuuaaaauacaaaauuagccgggugugguggugcaugccuguaaucccagcuacucgggaggcugaggcaggagaaucgcuugaacccaggagguggagguugcggugagccgagauugugccauugcacuccagccugggcaacaagagcaaaacucugucucaaaaaaaaccccaauuuuuauuuauuuauuuugcuagauguggugguaauggggaaaacauuaauagaacuuuugagagccggaauucaucucaaaauugcucguguuuggagaucauaauaacaucagugcuggaucacaaacagccuauuagccuuggagccugcuuccuggucucuucugauagagauaggcccuauagacagauuugcaaagcagaucuuuuaaaaaugcuuuuauuauuuuuugauacagggucucucucuguugcccaggcuggagugcgaucacgacucacuuaagucuugaacuccugggcucaagcaaugcuccugccucagccuccccauuaucugggacuacaggcgcgcaccaccaugacugaauaauuuauuuuuauuuuuuguagagaccagggggcaggggucucacuguguugcccaggcugcucucgaacuccugagcucaagcuauccucccgccucgguguccuaaaguauuggaauuacaggcgugaaccaccgccuagccugcaaaugcaaaucuaaccaggucauauguaggauaaaaaucuuuuuccuggcccaagugucucuccucaucuucggagagggagaugggaaugagagagccuucuaauaauagcaauugcuaguuaccagugcccuggcuuaucguguguuagacucugaguuaaacaucaacuccuugaaucauuacaagcuccuuaucagguggguaucaaccucaauuuacagaugaagaagccaagacuugggcugcuugcauuacauuaaccgagguuuacccgcagcgaggcugccuccaaagcauccggaguuugcaaccaucacuguccaccccgcgagcugcgauagugcgagaacuacaauucccguggggcugugcgggagcaucgcgagaguuacauuaacuguggcggcgggaaggcggagccugcagcuggcugggcgguuaggagggcccggggccgagacgauggcugaccacaacccugacagcgacuccacgccgcgcacgcugcugcgacgcgugcuggauacagcggacccgcgcaccccgcggcgaccccggagugcucgggcuggguaugugagggggcuccccgaguacuugagcaacuagagggaccggggaguggggucuggguggaacccagcgucgacucuguucgaagaggaaaacugagucucagagaggagcagggucuggguggaacccagcgucgacucuguucgaagaggaaaacugagucucagagaggagcagggccugggacucugagaacugguuccauugcucuagccgggcccgggccagcuguuugugccccugcccccagggcuccaggcagccagcccucgggaccacagagccugacugaucccgggucucugggggcucggccacuggagauggaggauagggguucagaaucucaccuucugcucuguucucuaggcagcuuuccccagaccagccagggugugccuaggcauuugcccugaacuucugcgucccgaggguucccacuguuccugcucauugucuuacuguccuuguagcucccagcugggaaaugggaaaggagcuagaggacagccugggcagaaguugggaggcagcaacuggaagaugcuuugcuaaggagcagggaauuuggccugagucagugggaguggcagugggugagggcuguggugagcucauggugcagaggaugcauacguugacaucugccagacugggacaguggaguuucuuuauagggaaugagaagccauucauuauagguuuuacacccaugagguaggagcugcgcccugggaacacuuauguggcucuggaaucugagagggacuggacuggagagacuaaggugucugggguacccaaguucuuaaaagauuuuaaaauacuuuaguauccaucauggauuguuacuuucaugucugggguggaugcuuuuccaauugccccucuuuucuguguggcuaaccccuacuuauccuuugugauucugcugaagucaccucugugaagccuuucccagccccuccugguugguucacucauaugcccucucuauucccauaccccaggggucuucuucgguccacacugcuggugacauagggcugggaacaggggcgaugguaggggcaagugguuucugggucccuagcccugagggaaaacggcuccagaccaagaccccugaugaaggcaugucucuauauucucuaucccuccucaccguaauucucggcauaauugcuggucuuuacacagagcccggagagcccugcuugaaacggcuucccccaggaaguugaguggccaaacaaggacgauagccagagggcguucccauggagccaggguaaguacccagcccacugaccccaaagggcccuggcugccucggggagggggguugaggucuagcucugcucuggagcccaccuugaggaaaucucaaggcagacggacagacugguugcuuggugcuuugccgauagucuguuggcagaucggcccauauucaggccagugggcacuuggaggaacagacaccucggacgcugcugaagaacauccuacuaacugguaagugagcgcuggccugccggucagaguuagguaccaguccaaccccagucuugugguaucuuuuauucaggguggccuguucugucagccccacccucuccuugguguuucugcagccccagaaucuuccauccugaugccugagucgguagugaagccagugccagcaccgcaggcgguccaacccuccagacaagagagcaguugcggcagguacacagaacucccccaccuuggauugugcuaugggcagcuuaguccgggaguuucuuggggguugcaaaagccagaauuggacuuccuggccugucugagauaagcuccauucuuauagccuggagcugcaacuuccugagcucgagccccccacaacccuggcuccaggucugcuggccccuggcaggaggaaacagaggcugagacugucaguguuucagcagggaguggaccaggggcugucucucucccaaggugaggcccuggacaccacuuuugcuacccucucccuccuguccucuggagaggcugaggaguccugagagagggcccucacaggccuggaucacuuaccaugguuuucuucuuuuacauucucuugccgguugcugacagagccucaagggaaugcugaugccucuucccucaccaggugcugcucuggguguuuccuguucugggaguggguggaggagagacuuggggagggaggugcugccugggauggaaucugcccauacuacuuccuaccaguuuuagccucacagcaucuguucuaagagaugagagccccagggcagauggagggaucugugggcaaacugggucucagguaccugacuuuccucugugccuccccaccucaccagaucccucaaccugaccuuugccacaccucuucagccacagucagugcagaggccuggcuuggcccgcagaccuccagcccgccgagcuguagacgugggugccuuuuugcgggaucugcgagauacuucccuggcuccuccaaguaagguuggguuuuccccugcuggccuuuggggaaagcucuccccgcuaugacagauaggaggugaugcugagucaggguugcaccccucucgguggggucaaggacagcgagcaacucuggucagugggucuacaaggaauuucugcuugcuuucuacagggggccucuuuccuuggucccucggugucucccagggccccauauccuuagacuauagggcuggagguuguaaagggguguggugugguggccaaaacuuguugagaggggccagguuucaggaucagcuggccaauucaaacugaccugggagccugauugcagaaaacaaguucaccagaguaagaagaggguuugggaagacggagcagaacaagcagcgaagagguauuuuaagugggcagcuggugggcgggcagcuauaggggccugggacugccaggcagaggaacaggaagguaagcaaggagggcuguaggcgauaaggccucgcgugcuaggucgucuucuuucucugaaggccacucaggguggacccaugcagcccacuguccaggcccuggcaacgcugaguagcagccggugggccuggaauacgcugagagccagcuggccccugaucuccaggugacagccucagaaccuguuacuacucugcccacagacauuguguuggaggacacccagccguucucucagcccaugguuggcucccccaacguguaucacucccugcccugcacgccucacacuggggcugaagacgcugagcaggcugccggucgcaagacacagagcagugggccugggcugcagaagaauagugaguguguggcacugguggccuggagccaaauuuagcuugggugagaguugacaaugguaguuuuccuuccucaagccccucugugccccuagagcacccuggcuguggcugccuccuucauccaagagcagaguccauguugggccaggagacuucagauccauguccuggugcugccucuggcuuugucuuuccucagugggcaggacugggucugcugguccaucuuuacccuucucugagcuaugcagccuuggccugcugcgucuccggccuguauucucuccccuucacucaggcccugggaaaccagcccaguuucuggcaggagaggcagaggaggucaaugccuuugcucugggcuuccugagcaccagcaguggugucucuggagaagaugaaguagagcccuuacacgauggaguugaagaggcagagaaaaagauggaagaagaaggugugagugugagugaaauggaggcaacaggagcacaaggacccagcaggguagaagaggcugagggacacacagaggugacagaagcagagggaucccaggggacugcugaggcugacgggccaggagcaucuucaggggaugaggaugccucuggcagggcagguaagaggcccagugcagggagugacuggugacagcuguguucaggcccuagcacacagaaaggccuugucuggguuguguuuccgggcacugguggugguagggggucagggagacacugaggggcaccugcuuggcuggagcuagguggggcccaccagaaacaggacagaaauacuguggcugugcuggccugggugagauggucaggccuggaaucccugugaccccacccuucuucuuuguagcaaguccagagucggccuccagcaccccugagucucuccaggccaggcgacaucaucaguuucuugagccagccccagcgccuggugcugcaguguaagaucccacaaccccauuccucaugggccucuugggaagggagcauuggguaugcuguguacauaggguccucccccuuccuacggguaugcagaugauuacccagcagggcagcuucagcugggcuggggagagcucaccaagagcaccccugccauccuggugccugccuccacggcuuagaggagccugggugaggggaaaguaugugguugguuuguagucagaaaaggcuuccuggaagacgauuagcagaaucgggaaaggcagcaguagaguaaggagagagacuauccauucuaaggccuggagucauggacccaagcagguaccaauauagauaauaagucugaaccaggaugucgagucgacuguggagggacagagccccagggaaagacuggccucuauguggcccccugacccaacugccccucagcagguggucagggcugcugguccuggcuggccaagggccacgugguccccagccucagcagaagccagcaagacuugcucuugaauaagagccuccuugaggcaaguucagcccccucuguccacuguugcccucagcuuaucuucagagccugcagagccucuguuggucaggcaucccccuaggccccggaccaccggccccaggccccggcaagauccccacaaggcuggacugagccacuaugugaaacucuuuagcuucuaugccaagaugcccauggagaggaaggcucuugagaugguggagaaguggugaguccugggcacaugggguagggagaggaaccccucgggucaugaucagacuguucagccugcucuauccccaccuucuugacagccuagauaaauauuuccagcaucuuugugaugaucuggagguauuugcugcucaugcuggccgcaagacugugaagccagaggaccuggagcugcugaugcggcggugagaaggcggaaggugugggggugcuggcugggggaguuuuggugcugauucugccugucccuucucuuccuccacugcaggcagggccuggucacugaccaagucucacugcacgugcuaguggagcggcaccugccccuggaguaccggcagcugcucauccccugugcauacaguggcaacucugucuucccugcccaguaguggccaggcuucaacacuuucccuguccccaccuggggacucuugcccccacauauuucuccaggucuccuccccacccccccagcaucaauaaagugucauaaacagaauauucugcauuuuggugcauguccuggggccagccaggcagggacugauucccccccacaacuccccagcacagucuggagaauggcauggauucagacaaacacuuuuauauuaaaagcuagggguuagcaggacuggaguacgcaggcugcccacaaguuccuagcuugcaggcucuggcucucgaggucccacacgccugaugucaaucaccugaagccgcuccagggcagucuggaggauuuccaccacggcuucuuccuucucgucacccuccucuggcauuuccgacucagggagcuggaaggccuggcucauguagguguucacugucugcuuguccaggcuggggucgauggucaucaggcccccucgcagcuugggcagagucacu

SEQ ID NO: 15787 - RNA, 1915 nt, Homo sapiens
agucucuuucucaggcgguccuucgcggcguccccggggcccacucccgagcgcaggcgggcagccaggcgggcggcgcggcgcgggccggcaggaagcguauucugggcacggggcgccgggcgggccggcugcgccgagcggcaguggugggauaccacccaaggccucgcgcggcgccgcccgucgaggggcgggcggcggcguagccacugggccgucgaagagcgcaggaggccggugggccgggccgggccgcgcggcgcagccaugccuggcuuuacgugcugcgugccaggcugcuacaacaacucgcaccgggacaaggcgcugcacuucuacacguuuccaaaggacgcugaguugcggcgccucuggcucaagaacgugucgcgugccggcgucagugggugcuucuccaccuuccagcccaccacaggccaccgucucugcagcguucacuuccagggcggccgcaagaccuacacgguacgcguccccaccaucuucccgcugcgcggcgucaaugagcgcaaaguagcgcgcagacccgcuggggccgcggccgcccgccgcaggcagcagcagcaacagcagcagcagcagcaacagcagcaacagcagcagcagcagcaacagcagcagcagcagcagcagcagcagcaguccucacccucugccuccacugcccagacugcccagcugcagccgaaccugguaucugcuuccgcggccgugcuucucacccuucaggccacuguagacagcagucaggcuccgggauccguacagccggcgcccaucacucccacuggagaagacgugaagcccaucgaucucacagugcaaguggaguuugcagccgcagagggcgcagccgcugcggccgccgcgucggaguuacaggcugcuaccgcagggcuggaggcugccgagugcccuaugggcccccaguugguggugguaggggaagagggcuucccugauacuggcuccgaccauucguacuccuugucgucaggcaccacggaggaggagcuccugcgcaagcugaaugagcagcgggacauccuggcucugauggaagugaagaugaaagagaugaaaggcagcauucgccaccugcgucucacugaggccaagcugcgcgaagaacugcgugagaaggaucggcugcuugccauggcugucauccgcaagaagcacggaaugugaacuggugccccggcagccugcuggacucccagaccccauccagccaggggaccgcaggccauuguugaacuccucuauacuccugggcacugguugacaguacugaggcuuaaggcagcuggacucucuugcuggugaccuggcauccucaauuguuuccuccugaaguggaagcuggggccuuagacucugcccuggugacaccagcaauuaugacuuugucuacccuuccuccccaguuauuguugcagauucugguuaagcagaggcuucagaaccacugaacuugaaacuuacccucuagggaugcaggugggauguccagggacuauagguuugggaaaaccauaccuuaagguuggucagcagucagacaacucuaauguguguagugauaagagauucaaguaacaucaguucuccuccuuuucaugcuuuuccuucccaggugcagccugugauucugauggggacugguaaaucugugccucugccuccuaggacuuauuuucccaggaggccauuuacaaggggaucuggaugaccugcugauggagauccagcuugccagggacuuagguuuauccuguuuuguuugcuacugguuacaaauucuauuuucuguacaauuagucagacuaaaguuuucacuguguuuguuuggcaaaacaaauuaaacaaaaaguaagguuuuuauuug

SEQ ID NO: 15788 - RNA, 1915 nt, Homo sapiens
caaauaaaaaccuuacuuuuuguuuaauuuguuuugccaaacaaacacagugaaaacuuuagucugacuaauuguacagaaaauagaauuuguaaccaguagcaaacaaaacaggauaaaccuaagucccuggcaagcuggaucuccaucagcaggucauccagauccccuuguaaauggccuccugggaaaauaaguccuaggaggcagaggcacagauuuaccaguccccaucagaaucacaggcugcaccugggaaggaaaagcaugaaaaggaggagaacugauguuacuugaaucucuuaucacuacacacauuagaguugucugacugcugaccaaccuuaagguaugguuuucccaaaccuauagucccuggacaucccaccugcaucccuagaggguaaguuucaaguucagugguucugaagccucugcuuaaccagaaucugcaacaauaacuggggaggaaggguagacaaagucauaauugcuggugucaccagggcagagucuaaggccccagcuuccacuucaggaggaaacaauugaggaugccaggucaccagcaagagaguccagcugccuuaagccucaguacugucaaccagugcccaggaguauagaggaguucaacaauggccugcgguccccuggcuggauggggucugggaguccagcaggcugccggggcaccaguucacauuccgugcuucuugcggaugacagccauggcaagcagccgauccuucucacgcaguucuucgcgcagcuuggccucagugagacgcagguggcgaaugcugccuuucaucucuuucaucuucacuuccaucagagccaggaugucccgcugcucauucagcuugcgcaggagcuccuccuccguggugccugacgacaaggaguacgaauggucggagccaguaucagggaagcccucuuccccuaccaccaccaacugggggcccauagggcacucggcagccuccagcccugcgguagcagccuguaacuccgacgcggcggccgcagcggcugcgcccucugcggcugcaaacuccacuugcacugugagaucgaugggcuucacgucuucuccagugggagugaugggcgccggcuguacggaucccggagccugacugcugucuacaguggccugaagggugagaagcacggccgcggaagcagauaccagguucggcugcagcugggcagucugggcaguggaggcagagggugaggacugcugcugcugcugcugcugcugcugcuguugcugcugcugcugcuguugcugcuguugcugcugcugcugcuguugcugcugcugccugcggcgggcggccgcggccccagcgggucugcgcgcuacuuugcgcucauugacgccgcgcagcgggaagaugguggggacgcguaccguguaggucuugcggccgcccuggaagugaacgcugcagagacgguggccuguggugggcuggaagguggagaagcacccacugacgccggcacgcgacacguucuugagccagaggcgccgcaacucagcguccuuuggaaacguguagaagugcagcgccuugucccggugcgaguuguuguagcagccuggcacgcagcacguaaagccaggcauggcugcgccgcgcggcccggcccggcccaccggccuccugcgcucuucgacggcccaguggcuacgccgccgcccgccccucgacgggcggcgccgcgcgaggccuugggugguaucccaccacugccgcucggcgcagccggcccgcccggcgccccgugcccagaauacgcuuccugccggcccgcgccgcgccgcccgccuggcugcccgccugcgcucgggagugggccccggggacgccgcgaaggaccgccugagaaagagacu

SEQ ID NO: 15789 - RNA, 870 nt, Homo sapiens
cagaccugagauuuaaaaaacagaagugugguccggucuuaccagccaucucuuggagggguagccugugggugggggaaggugcaaaacucuuguggaagaacaggaguacugagagaccuccggccaggaaggaaggcuaggaguugccuggagaggccuuguagccauuucccuuaccugugguaccccaaguuggcugcagaucucuuugccaagcacaggucugaccuagagacuggccuuaccacaaauguuuguguuaccaagaaaacaaaugggcguugaaaggaaagggcaauggguaggaagagaacuauuuacaaucuggucacuuaaaucacagcgaaauuuuggguaagucagucauuucucuuuccucauuaauaaaaaugaaacacuuagcugcucuaucugcugcaaaaaaaccuuacagaauguuuuggggggaccccugacuguagaaguuugaggguaaccucuccaaccaagccccaccugagggacauuugagucuccggcccaagaauagccuagccugcucgaaaccagcuuugggcccgacucgccgaggugcaggcgcacgaauguugggauugcaggagcugugcguuccgcccgggcugguuaaggccacacagcucggaagaguaacagcggcagccauagccccaaggggaggggguuucgugagcggaaacggcccaggggcccagggaggggcagcugggccagcuuggggccgggcugggcucccacggaggcggggccaacccccaccccagugcacagacugggcggggccgagccagcugagaccaggagacaacugagcccugacccuagccuggcgccaaccucuaguguucc

SEQ ID NO: 15790 - RNA, 1484 nt, Homo sapiens
gcucucagccagggaugaugcgcugcugccgccgccgcugcugcugccggcaaccaccccaugcccugaggccguugcuguugcugccccucggugagugcgggcauccggggcccgggccacacccccuucucgcccagccaagccaggcugggcauagggugugugggaacgcugggugccaggguggagaagaguuguaagggcuccaggaaggugugcuggugacuucaggacagaaagugagaggcacaaacagccccaguuaugggagaaggacuccaaaauuugcauccccucuuaugauaaagggagacaugccaauggcaggacuuauagaccagucguaggaucccuaaguccucucugagggucuggccuggaucccaauaccucugcauccugccuugucucuccaaaaauauuuaucuuuagagagaguucggagggccaagcaaagcuugucuaaaccgcagagagaugcaccugcuccugguccggggccucuggaccucccuccccuccacccuguccugacuccuuuacauggacccuugucaccccaccugcggccccagaagcucaaaggaagagcugaccugggguacacaacacccccuuccccuguacaaaucccagucuggguccuaccuugaagggggccuggguagguaauccccagacuugcccuuuaguucccuggggcacccuuuuuccgcugagucacauccccagagugcucccagguaaacaagccccugggggcugggggaugagccuggcucauccuaucuaccauuccuuccccaccccacccccgccccacuucuaguccuuuuaccuccccuggcagcagcugcagcgggcccaaaccgaugugacaccauauaccagggcuucgccgagugucucauccgcuugggggacagcaugggccgcggaggcgagcuggagaccaucugcagguaccggcgggugugaggcaguggcccaaccugugccaccauuggggacugaaccuuuuauuucccaagcuaaagucuccuugccucaccuaaucccccuaaucccacucccuuaacaggucuuggaaugacuuccaugccugugccucucagguccugucaggcuguccggaggaggcagcugcagugugggaaucacuacagcaagaagcucgccaggccccccguccgaauaacuugcacacucugugcggugccccggugcauguucgggagcgcggcacaggcuccgaaaccaaccaggagacgcugcgggcuacagcgccugcacuccccauggccccugcgcccccacugcuggcggcugcucuggcucuggccuaccuccugaggccucuggccuagcuuguuggguuggguagcagcgcccguaccuccagcccugcucuggcggugguuguccaggcucugcagagcgcagcagggcuuuucauuaaagguauuuauauuuguaguaag

SEQ ID NO: 15791 - RNA, 14407 nt, Homo sapiens
ggguaggcagcuuguugcccccaggcccuccuccacccaaaagucguuuuguucccgaggggccuugggagggagcccagaggcaggaagcugauggccucccauuggcccuggguguguuccccacagaccaucaagaacaugauggaaauugagaaggugaagggcuucugccagguggugguggccagcaaggugcgggaggggcuggcccaccucauccaguccuguggccugggaggcaugcggcauaacuccguggugcugggcuggcccuacggcuggcgacagagcgaggacccccgugccuggaagaccuucauuggugugugaaggccuggggccuggugggcaggggugaagugagguggcagugggcggagggccacagacugguggucagccgugcuccuccuccccagacaccgugcgcugcacuacggcugcccaccuggcccugcucgugcccaagaacaucgccuucuaccccagcaaccacgagcgcuaccuggagggccacauagacgugugguggaucgugcacgaugguggcaugcucaugcuucugcccuuccugcugcgccagcauaagguagaccagggggugggugcagaugagaggggcuaggcccuuggaggagcagcugugaccaaaccgcccaccuggucccuugccucaggucuggaggaagugccggaugcgcaucuucacaguggcccagauggaugacaacagcauccagaugaagaaggaccuggcugucuuucuguaccaucugcgccuugaggccgagguggaggugguggagauggugagcccucugcccugcccuggccccguggauaccaugucccgugcagcuggguccucacggccaacccuguccccagcauaacagugacaucucugcauacaccuacgagcggacgcugaugauggagcagcggucgcagaugcugcggcagaugagacugaccaagacugagcgggagcgagaagucagugcccuuugugguucacgccagggcggguggcagggucaggccuuuggagaccgcaucggugggugcggaggaaucagaaugacucaccgcagcccuacccaagcuagugcucauuucccggaggcaagguggucacauugggccagacaggccccaucccccuuuuccuaugggaccaaggcuaucuccugcaauuguccucaggcccagcuggucaaggaucggcacucggcccugcggcuggagagccuguacucggacgaggaagaugagucugcagugggggcugacaagauccagaugacguggaccagggacaaguacaugacugagaccugggaccccagccaugccccugacaauuuccgggagcuggugcacauuaagccgugagugcagcaaaaacagccccagcggcacuggaaucuagggguggaggugggguggggcagacaaguaguguuagaugggccagggguggggacccuccuugcaggauggcucauggcgaccugugacuggcuacacuacguguagggaccaauccaaugugcggcgcaugcacacugcugugaagcucaaugaagucauugucacgcgcucccacgacgcccgccugguucuccuaaacaugccuggcccacccaggaacagugagggcgacgagaacuguaucccuuuguggagaggcaggcaguugggagguggauagcaugggaggucaagccagcggcuucucuccugggcaccccugggugggcauggcccagguggcccggguugcccguugauucuguuguugccuccuugacuugaggcccugcagacauggaguuccucgaggugcugaccgagggccuugagcgggugcuguuggugcgcggugguggccgugaagucaucaccaucuacuccugagcccagugucaucuuguggccuggagucgaggucuuggccaggacauaacaagcuguggucugggguaacagccucuucccagcacccaccugccagcccugcuugccuggcccuguccuggacccagcuuugcuaggucuccuuggaaaccaggccugggccucaaaauggagauggaucccaggucuugugggacccugggauguuuggggacuuuacuaucuagcaccccaguaggccuguccuggccagagaagacugguaggggccgagugggguuugaaggcagccggcccggcccagcccaggagcgcuauuuauugcauauuuauuguuuggaugucaccaucagagacgaagggaaggguagccagggagggaguccagcccagcugccugcaggaagaucuggcucagucuacuaugggcagggccccccaccaagcugagccgaauggagacagcugagcugaggccugacuuuuucaauaaaacauuguguaguucugggccuccugcugccccggcucuguuuccccuggcgccaagagaagaaggcggaacugaacccaggcccagagccggcucccugaggcugugccccuuuccggcaaucucuggccacaacccccacuggccaggccgucccucccacuggcccuagggccccucccacucccacaccagauaaggacagcccagugccgcuuucucuggcaguaggcaccagggcuggaauggggccgcccggcuccccauggcagugggugacgcugcugcuggggcugcugcucccuccugccgcccccuucuggcuccucaaugugcucuuccccccgcacaccacgcccaaggcugagcucaguaaccacacacggcccgucauccucgguaagcccccaccaggccccugaugcaccacgccagacccuggggagccugggccccagccccuggcagcugaccuggccaaagcccuucugcccugcauaagccccgacauaaguaccugcccugguguggggaggggccaaaagcuugucccuuagaggaaugacgucccuucucccaccacacugugacucucaguugucuaacccagggggggcggagugggggacggggugugccugaggucuuggcuggggcaucacaagcuguggucagucacagccacaccagacucugggccaagccccaccacuccuuccuuggcccccacccaccaaggacaagaugcccagcccaggaucggugagcaggagaggcccauccaugcccggccccuauuaggcccagcccccaugcccccagaccuaucuguucccaccuuggacuuuggcaauaaaggagcgccagacuggguguuugcucugcagaggcaggggucagcggccuuggccucagcaccucagcgccuucccuuccucagggaagccugggcuuuggcuacuggggggacagcagggagaggggguguaagcaggggaggguaagugugcuuuguaccuggggguugaggguaugggagguggggggugggucuggucacugcagcaucuggggugacggggguaagggucacggggggaauccagaguccagagugagggcugcugcucacagugcccggcugccuggggaaucagcuagaagccaagcuggacaaaccagauguggugaacuggaugugcuaccgcaagacagaggacuucuucaccaucuggcuggaucucaacauguuccuaccccuugggguagacugcuggaucgauaacaccagguacagccaugugcuccacccuagccccaacacgcugccccuuggcuacuggcugcugaguggcacccccgccccgcaggguugucuacaaccggagcucugggcucguguccaacgccccugguguccagauccgcgucccuggcuuuggcaagaccuacucuguggaguaccuggacagcagcaagcuggcagguuugugucagagggcagggcuggggcuccaggccugggugcuggcccacagcaggcauggcccaagcccccggugcugcugguccccccacaggguaccugcacacacuggugcagaaccuggucaacaauggcuacgugcgggacgagacugugcgcgccgcccccuaugacuggcggcuggagcccggugagugucucugcggaugaccggcuugggguggggcaggugccccagaccccagcugcccugaccccuuccacccgcugcaggccagcaggaggaguacuaccgcaagcucgcagggcugguggaggagaugcacgcugccuaugggaagccugucuuccucauuggccacagccucggcugucuacacuugcucuauuuccugcugcgccagccccaggccuggaaggaccgcuuuauugauggcuucaucucucuuggggcucccugggguggcuccaucaagcccaugcuggucuuggccucaggugagaaggccucgaacacuuagguccagcgaugggugagaccaagcugauccugggccugccuucauugcggcuccugcucacaguggccucuaggggugcuaucuaccacuccugggcuggcaugcuugcugucacuggcccccagagcagugacccuggccugagcaauuaggguggcuccuuccagagucugugucagugauggcaaaggggcagugaacacagaaagugaaucccagcuaucugcucccaggguuuguucuuguagccccagagccugccugcccagcccuugccugccuuccacuugcucgcaggagugccuuugcccagggaugugcuucacugaggauggaucugccagagcuagggccagaccccccgaggccccaccugcucuucccuagggaguggcaccagggcccagcacugacacagcuaccaccuacuccccacccccuguacccugggagcuggucuggagagagaaacacagucuggacaagagaaacgcucaucagacaccaccaauaaacaucaaacagacaccaucuuguuucccccuuucuggagcacaacucuguggcccccauugcugcauaagccacacaaggagcagaaagacacaugcccgagggaggacagccagcaccgcccccaccauccccacacauccugggccucacccaccauccccacacacccugguccucaggaagccccgccuacuuuuuuuuuucuuuuucagacagggucauucugucgcccaggcuggagugcaguggcgugaucauagccgcagucucaaucucccuggcccaagcaauccuccugccucagccuccugguuagcugagacuauaggcacacaacaccacaccuaauuuauuuuuguuuuuuaguagagaugaggucuugcuauguugcccaggcuggucucaaacucuucaccuuaagugaucuuccugccucagccucccgaagugcugggauuacaggcgugagcuacugugcugggccuuuuaaaaaauguuuauuuguuuauuuauguauuuugagauggagucucgcucuguuucccaggcuggagugcaguagugcaaucuccacucacugcaaccuccaucuccccaguucaagugauucuucugccucagccucccuaguagcuaggaucacaggcaugugccaccacgccuggcuaauuuuuauauuuuuaguagagauuagguuuccccauguuggccaggcuggucucgaacuccugaccuuaagucaucugccugccucggccucccaaagugcuaggauuacaggugugagccaccguacccggcccuauuuauuuauuuuuuaagcuggaaucucacugugucacccaggcuacagugcaguggugcgaucauaguuuacuguaaccucaaauuccuaggcucaagcaaucuuccugccuuugccuccugaguagcuaggacuagaggugcacuccacuaagcccagcugauuuuuuuuuuuuuuuuuuuuguagagacagggucucacugcauugccuagucuggucacggacuccuggccucaagugauccuccugccucagccucccaaaguguugggauuacaggggugagccauggugccugucccugccauccuuuugaagcccuacagcuccacccaacagaggucuuaucagggcuucucauugaguaagcugacacugagcaucauugaauaucaggccugcucaagccuguggcuuagagucugugucuagauugggcagggacaagauugagcaucuggcugagccuacacucagcagguugugggccagggguagccaggccuggcucccugucccaccuugcuccauauccacaggugacaaccagggcauccccaucauguccagcaucaagcugaaagaggagcagcgcauaaccaccaccucccccuggauguuucccucucgcauggcguggccugaggaccacguguucauuuccacacccagcuucaacuacacaggccgugacuuccaacgcuucuuugcagaccugcacuuugaggaaggcugguacauguggcugcagucacgugaccuccuggcaggacucccagcaccugguguggaaguauacugucuuuacggcgugggccugcccacgccccgcaccuacaucuacgaccacggcuuccccuacacggacccugugggugugcucuaugaggauggugaugacacgguggcgacccgcagcaccgagcucuguggccuguggcagggccgccagccacagccugugcaccugcugccccugcacgggauacagcaucucaacauggucuucagcaaccugacccuggagcacaucaaugccauccugcugggugccuaccgccagggucccccugcauccccgacugccagcccagagcccccgccuccugaauaaagaccuuccuuugcuaccguaagcccugauggcuauguuucagguugaagggaggcacuagagucccacacuagguuucacuccucaccagccacaggcucagugcugugugcagugaggcaagaugggcucugcugaggccugggacugagcugggcacccuagauguacagcugcccacucuccuggucgagcuguugaggcagugugcaccgugccugccucugugcugggcgcggggacuggagcuggcuccacccacagcccugucagaggagcacggggcggugggggggcggugacaauuugagcugucucucccagcucccaaaagggcaggugagacgaccuuuugagugcugggugaaugacagggccacaaguguuuagaggccgggcacgguggcucacgccuguaauccuggcacuuugggagaccgaggcaggcggaucaccugaacucaggaguuugagaccagccaggccaacauggcagaaacccccgucucuacuaaaauacaaaauauuugccaggcgugguggcaugcaucugucgucccagcuacucaggaggcugaggcacgagaaucauuugaaccugggagguggaggucacugugagccgagaucacgucguugcacuccagacugggcggcagaaugagacugucucaaaaaaaaagagacugggucucaaaaaaaaaaaaaaaaaaaaaaguuagaauuaaaaucugggagugacaaccauuaaucagaucauuucacuaauggaaguuuaauuacuaaugaagcuaaaugcucugagaaaagcuuaggaagcacaagaggcugagccuuucaggucagcaaagacuucccagaggaggcagugccuacacugaggucagagugacaagaagaguaauggaccacuguaaagacuuggguucggccgggcgcgguggcucacgccuguaaucccagcacuuugggaggccgaggcggguggaucaugaggucaggagaucgagaccauccuggcuaacaaggugaaaccccgucucuacuaaaaauacagaaaauuagccgggcgcgguggcgggcgccuguggucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaagacuuggguuugacuugauugagcccaggaguucgagacaagccugggcaauauagugagaccucaucucuacaaaaauuuuaaaaauuagccuggugcgguggcucaugccuguaaucccagcacucugggaggccgaggugggcggaucacuugaggucagaaguuugagaccacccugaccaacauggagaaaccccgucucuacuaaaaauacaaaauuagccgggcaugguggcgcaugccuguaaucccagcuacucgggaggcugaggcaggagaauuguuugaaccugggagguggacguugcggugagccaagaucacacuauugcacuccagccugggcaacaagagcaaaacuccgucucaaaaaaaaaaauuuauuuuuaaauuagccagguguagccacagcuguagucaaaucuacuaggcaggcugaggugggaggauugcuugaaccugggaggcagagguugcagugagccaagauggugccacggcauuccagccugagcaacagcaagacccuguguccaaaaaaaaaaaaaaaaaaaaccguaaaauaggccaggcacagugguucaugguuauaagccuagcacuuuggaaggcugaggaggguggaucgccugagcucaggaguucaagaccagccugggcaacacggugaaaccccaucucuaccaaaaaaaaaaaaaaaaaaaaaaauuagccaggcaugguggugugugccuguggucccagcuacucaggaggcugagguggaagagugcuugugccugggaggcagagguuccagugaaccgagaucacaccauuguacuccagccugggcaacagaguaagaccccaucucaaaaaaaaaaaaaaaaaauuaagauaaacccuuuggcagcugcgugcugcucuuagccucaaacccaagucuuuuuuuucccccuuugagacggggucuauugcccaggcuggagugcaaugguaugauccauacucacugcagccccgaacuccugggcuuccaaagugcugggauuacaggugugagccaccaggcccagacugcugaaggguuuaaaccagagaaagaaugugaccagauuuccaauuuagaaagacccgcucucugcaggguaaggaguagccugggggucggggggcggggggcaagaauugcaagguaaccagggaggccagugcaauguccaggugggagaggaugcuagcugagacuagaagugcuaggaaaaggaugugugcagacaagaggucacuggggaggugaaauaacaaggcuuggccaugaguggaacccaacacccauggugcccucuugagagagggaagauggcaccugagauggaagauggaaagaccagggucccugugacugaggacugagccucuguuugagguuuuugcagaggaguaaaggcaacaaaagaggcaagaguuggaagaaaggugacaaggaacaaaagucagcuaugccugaugcuacuggguggccagcaacaaugcugacuuggccaaggcucugagagcuuuacuaugcugggacuggaggucagaguugaggcuaggguaagagcaaggggcucagauggagggggaggaggaccugaacaaguccagaagggaagagauuugucccucuauccaacagaguacccagugagcagcacagagggcacagcaagggacaucacccgguuccccaaaugcucagagccacaagugaagccaaaagugaaagacaagaugcagaaaaccgccacgggccuuugaggaaggguaaaggcgaaagcgaaagcaggaaguacagacgugaagccuagcagaggacuuuuuagcugcucacuggccccgcuugucuggccgacucauccgcccgcgaccccuaauccccucugccugccccaagaugcugaagccagcccuggagccccgagggggcuucuccuucgagaacugccaaaggugaagcgggggcgcggggggcggucacuccugagccgccucugcuugcucguggccuuuuuuccuggcugggggugggggaggguguguuggucgacuuggguuccaggcuuaccccggaagaugagggagacggggaccagguuaggggaagcaacaggggucuugaaagcagagccgaaacaugggcgcccuccuccguuuccagaaaugcaucauuggaacgcguccucccggggcucaaggucccucacgcacgcaagaccgggaccaccaucgcgggccugguguuccaagugagcagcggggagggacggggagcuggaggggagccgagaguaucgagcaggcacugaagcugcggucccucccucuccucaggacggggucauucugggcgccgauacgcgagccacuaacgauucggucguggcggacaagagcugcgagaagauccacuucaucgcccccaaaaucuagugagacucccgagcccaguucccguacgcaaaaaagaacggcccccucguucccacuccgguccccgcacgucccagcccugcccacaccgauccucccuuuugccucagcugcuguggggcuggaguagccgcggacgccgagaugaccacacggaugguggcguccaagauggagcuacacgcguuaucuacgggccgcgagccccgcguggccacggucacucgcauccugcgccagacgcucuucaggugcgggggcagggcuaacaggaccccggcagggguaguuacgggguuggggccauuggaaggcgggacagaaagaagggcgggaccgcgacgggccaggugaccggaagaggccggcccaagagaaccugggcuacaggaaaaggcgaugucagucaucgggcgccagcccacaggaaggggcggggauagcaccuaggagcugggcauagagagguggggccuaggccccagcuuguggccgaccccgcccauccucgagcagguaccagggccacgugggugcaucgcugaucgugggcggcguagaccugacuggaccgcagcucuacggugugcauccccauggcuccuacagccgucugcccuucacagcccugggugagcgcuucugucccuucuccucgaacucugccccugugaccuuggccucacuccaaacggcgucgcagcgguugacuucagaugcuucuccugccuucaggcucuggucaggacgcggcccuggcggugcuagaagaccgguuccagccgaacaugacggugagcggccucuguccccgacuuuguggucgcuggugggaugugcacccgggagcugggggagcacaggacccuggcccagugcggguggcuaaggcuugucggaggaggugaccacugaagggugaguggaguaagggcagagaagugcggucccgacauaacaccguccaauaccaaagccugcacggcugggagaagucgaagcucacagaggaucuuuaggagccgagggcggagagaaggaccaguaggguccuacuuauaucaacgucuggagccuagauuuuguuuggggugggauggaagcaggugauguugccucagagguggcuaaggcucagagggagaaacacaguggggguuuggagggcaagaccagauuggguaaguggacaggcaaguccccaggcuguagccuaaguuaacagcagagagagcccguuaggucucacacacccaucaccgcagcuggaggcugcucaggggcugcugguggaagccgucaccgccgggaucuugggugaccugggcuccgggggcaauguggacgcaugugugaucacaaagacuggcgccaagcugcugcggacacugagcucacccacagagcccgugaagaggugagagcuggagaucggggaccacagggauguguggggcuauagcaggggagauagggggcugcaaaaaggggaugggccacaugacaggcccauguucagaggcugucccuccucccucccaggucuggccgcuaccacuuugugccuggaaccacagcuguccugacccagacagugaagccacuaacccuggagcuaguggaggaaacugugcaggcuauggagguggaguaagcugaggcuuagagcuuggaacaagggggaauaaacccagaaaauacaguuaaacagauggcugugucauucuugaguggaauggggugggcaggcagccagcagggcucuguagcuaaggcgucccugcaggggccauuaccuaccauagcucuagugucuggccuaagagaugcccuucacccauaaccucaggcaccuacaacuccagaaccccagcccuggccagcauugcaggcuuggucuccacccaaaccuuccuucugacuccacacuugaaggcucccccaccacuccacugucuugcucuugcccucuaguccacuggagacuuguaaauuaugaaauaccccauguacuacccccuccuagagacuuuccauggcuccucaguggcccaggacaaagcucauaccuuucaaucaggcccccacaggccccacugagggcuaaagugcugacaagaggagccgcucccugacuccaaggcaaguucucaccaagcacuccucaaccucgcaacaucuuuaccugugacaccccuuagaugacgaggcaugccugcacugcucacgugaagcucgucuucugucugcacaugcugggcuugugacuccaaguuuuccaggcuaauaagggucacaggacucacauggggagagaugacacguuucuccaacaaaccuuugcugggccccugcugagucucaggccuggcugcugggugccagcaagagcauccuguccucagcgagaacggcugaacuccgcuggagcuucagaaaugucagggagagucuacccagggcccagggagggucuaugccgggcugcacauccccaggccgcugagugugcucccugcaccccaacauucuauuaaugaacauuuguaaauguaacagaaaaguagaaagaguuguauauugaauacccuuauacugucaggucaccacagaccugacaguauuuuguuauauuuguuuuaucaucuauucaucccucuauccauuaauucaucgcuccuuuuuuuuuuuuuuuuuuuuuuuuugagacggcgucucgcucugucacccaggcucuggagugcaaauauuuuguuauauuuguuuuaucaucuauucaucccucuauccauuaauucaucgcuccuuuuuuuuuuuuuuuuuuuugagacggagucucgcucugucacccaggcucuggagugcaguggcgcaaucucagcucacuggaagcuccgccucccagguucacgccauucuccugccucagccucccgaguagcugggacuacaggugcccgccaccacgcccggcuaauuuuuuuuuuuuuuguauuuuuaguagagacgagguuucuacugaaccuguuagccaggauggucuugaucuccugaccucaugauccgcccgcgucggccucccaaagugcugggauuacaggcgugagccaccgugcccagccaauucaucucauuuuuuggcugaugcuguuucuuugagauggggucuagcuccaucgcccaggccggaaugcaguggugcacucauggcucacugcagccuugaacuuaagggcucaagugaucccuccugccucagccuucugaguugcugggacuacagguguguaccaucauacccagcucauuucuuaauuuaaaaaaauuuuuuuuguagagacaggguuucaugauguugcucaggcuggucucgaacuccuggaaucaagccuccuacgucugccucccaaaguuuugggauuacaggugugagccaccacacccagcccugaucuguucuugaaucaguuaaagcccucacacucccagaaggccgccagccaaugcaccuguuggaacuuugcacacagggugucuucucccuucaagcuuggucugcagcucaguaacaaaugggcuacagacaccaggggcuugcccaugggagccccaaggccuaaagaggguggcagagauuugaugucugucacucuccaccugcagccucaguccacggucggccaggcaccaagagcucacacuuugcccuccuaaaugccaggcccuucauaaguaucaucucauuguuaagagcggaggcuucagcgccagacaaaugcgaguuuguguacaacucaaccacgugcuggugggagagucaccaucucugagcagaccugugacuccuguuccaaaugg

SEQ ID NO: 15792 - RNA, 2513 nt, Homo sapiens
caucuguuuaacuguauuuucuggguuuauucccccuuguuccaagcucuaagccucagcuuacuccaccuccauagccugcacaguuuccuccacuagcuccaggguuaguggcuucacugucugggucaggacagcugugguuccaggcacaaagugguagcggccagaccugggagggaggagggacagccucugaacaugggccugucauguggcccauccccuuuuugcagcccccuaucuccccugcuauagccccacacaucccugugguccccgaucuccagcucucaccucuucacgggcucugugggugagcucaguguccgcagcagcuuggcgccagucuuugugaucacacaugcguccacauugcccccggagcccaggucacccaagaucccggcggugacggcuuccaccagcagccccugagcagccuccagcugcggugaugggugugugagaccuaacgggcucucucugcuguuaacuuaggcuacagccuggggacuugccuguccacuuacccaaucuggucuugcccuccaaacccccacuguguuucucccucugagccuuagccaccucugaggcaacaucaccugcuuccaucccaccccaaacaaaaucuaggcuccagacguugauauaaguaggacccuacugguccuucucuccgcccucggcuccuaaagauccucugugagcuucgacuucucccagccgugcaggcuuugguauuggacgguguuaugucgggaccgcacuucucugcccuuacuccacucacccuucaguggucaccuccuccgacaagccuuagccacccgcacugggccaggguccugugcucccccagcucccgggugcacaucccaccagcgaccacaaagucggggacagaggccgcucaccgucauguucggcuggaaccggucuucuagcaccgccagggccgcguccugaccagagccugaaggcaggagaagcaucugaagucaaccgcugcgacgccguuuggagugaggccaaggucacaggggcagaguucgaggagaagggacagaagcgcucacccagggcugugaagggcagacggcuguaggagccauggggaugcacaccguagagcugcgguccagucaggucuacgccgcccacgaucagcgaugcacccacguggcccugguaccugcucgaggaugggcggggucggccacaagcuggggccuaggccccaccucucuaugcccagcuccuaggugcuauccccgccccuuccugugggcuggcgcccgaugacugacaucgccuuuuccuguagcccagguucucuugggccggccucuuccggucaccuggcccgucgcggucccgcccuucuuucugucccgccuuccaauggccccaaccccguaacuaccccugccgggguccuguuagcccugcccccgcaccugaagagcgucuggcgcaggaugcgagugaccguggccacgcggggcucgcggcccguagauaacgcguguagcuccaucuuggacgccaccauccguguggucaucucggcguccgcggcuacuccagccccacagcagcugaggcaaaagggaggaucggugugggcagggcugggacgugcggggaccggagugggaacgagggggccguucuuuuuugcguacgggaacugggcucgggagucucacuagauuuugggggcgaugaaguggaucuucucgcagcucuuguccgccacgaccgaaucguuaguggcucgcguaucggcgcccagaaugaccccguccugaggagagggagggaccgcagcuucagugccugcucgauacucucggcuccccuccagcuccccgucccuccccgcugcucacuuggaacaccaggcccgcgaugguggucccggucuugcgugcgugagggaccuugagccccgggaggacgcguuccaaugaugcauuucuggaaacggaggagggcgcccauguuucggcucugcuuucaagaccccuguugcuuccccuaaccugguccccgucucccucaucuuccgggguaagccuggaacccaagucgaccaacacacccucccccacccccagccaggaaaaaaggccacgagcaagcagaggcggcucaggagugaccgccccccgcgcccccgcuucaccuuuggcaguucucgaaggagaagcccccucggggcuccagggcuggcuucagcaucuuggggcaggcagaggggauuaggggucgcgggcggaugagucggccagacaagcggggccagugagcagcuaaaaaguccucugcuaggcuucacgucuguacuuccugcuuucgcuuucgccuuuacccuuccucaaaggcccguggcgguuuucugcaucuugucuuucacuuuuggcuucacuuguggcucugagcauuuggggaaccgggugaugucccuugcugugcccucugugcugcucacuggguacucuguu

SEQ ID NO: 15793 - RNA, 2513 nt, Homo sapiens
aacagaguacccagugagcagcacagagggcacagcaagggacaucacccgguuccccaaaugcucagagccacaagugaagccaaaagugaaagacaagaugcagaaaaccgccacgggccuuugaggaaggguaaaggcgaaagcgaaagcaggaaguacagacgugaagccuagcagaggacuuuuuagcugcucacuggccccgcuugucuggccgacucauccgcccgcgaccccuaauccccucugccugccccaagaugcugaagccagcccuggagccccgagggggcuucuccuucgagaacugccaaaggugaagcgggggcgcggggggcggucacuccugagccgccucugcuugcucguggccuuuuuuccuggcugggggugggggaggguguguuggucgacuuggguuccaggcuuaccccggaagaugagggagacggggaccagguuaggggaagcaacaggggucuugaaagcagagccgaaacaugggcgcccuccuccguuuccagaaaugcaucauuggaacgcguccucccggggcucaaggucccucacgcacgcaagaccgggaccaccaucgcgggccugguguuccaagugagcagcggggagggacggggagcuggaggggagccgagaguaucgagcaggcacugaagcugcggucccucccucuccucaggacggggucauucugggcgccgauacgcgagccacuaacgauucggucguggcggacaagagcugcgagaagauccacuucaucgcccccaaaaucuagugagacucccgagcccaguucccguacgcaaaaaagaacggcccccucguucccacuccgguccccgcacgucccagcccugcccacaccgauccucccuuuugccucagcugcuguggggcuggaguagccgcggacgccgagaugaccacacggaugguggcguccaagauggagcuacacgcguuaucuacgggccgcgagccccgcguggccacggucacucgcauccugcgccagacgcucuucaggugcgggggcagggcuaacaggaccccggcagggguaguuacgggguuggggccauuggaaggcgggacagaaagaagggcgggaccgcgacgggccaggugaccggaagaggccggcccaagagaaccugggcuacaggaaaaggcgaugucagucaucgggcgccagcccacaggaaggggcggggauagcaccuaggagcugggcauagagagguggggccuaggccccagcuuguggccgaccccgcccauccucgagcagguaccagggccacgugggugcaucgcugaucgugggcggcguagaccugacuggaccgcagcucuacggugugcauccccauggcuccuacagccgucugcccuucacagcccugggugagcgcuucugucccuucuccucgaacucugccccugugaccuuggccucacuccaaacggcgucgcagcgguugacuucagaugcuucuccugccuucaggcucuggucaggacgcggcccuggcggugcuagaagaccgguuccagccgaacaugacggugagcggccucuguccccgacuuuguggucgcuggugggaugugcacccgggagcugggggagcacaggacccuggcccagugcggguggcuaaggcuugucggaggaggugaccacugaagggugaguggaguaagggcagagaagugcggucccgacauaacaccguccaauaccaaagccugcacggcugggagaagucgaagcucacagaggaucuuuaggagccgagggcggagagaaggaccaguaggguccuacuuauaucaacgucuggagccuagauuuuguuuggggugggauggaagcaggugauguugccucagagguggcuaaggcucagagggagaaacacaguggggguuuggagggcaagaccagauuggguaaguggacaggcaaguccccaggcuguagccuaaguuaacagcagagagagcccguuaggucucacacacccaucaccgcagcuggaggcugcucaggggcugcugguggaagccgucaccgccgggaucuugggugaccugggcuccgggggcaauguggacgcaugugugaucacaaagacuggcgccaagcugcugcggacacugagcucacccacagagcccgugaagaggugagagcuggagaucggggaccacagggauguguggggcuauagcaggggagauagggggcugcaaaaaggggaugggccacaugacaggcccauguucagaggcugucccuccucccucccaggucuggccgcuaccacuuugugccuggaaccacagcuguccugacccagacagugaagccacuaacccuggagcuaguggaggaaacugugcaggcuauggagguggaguaagcugaggcuuagagcuuggaacaagggggaauaaacccagaaaauacaguuaaacagaug

SEQ ID NO: 15794 - RNA, 2311 nt, Homo sapiens
cauucauucaaacucucaauaaacacggauuaccagacccugcgcagggaacacaucugggaaaacagcugcaaccucggauaccagcacgggacaagcuaucucagggcaaugaggaacaacuaaagagaaucccaggaaccagguaaccaaucgccagaagcccuccgcccucaugguccauugggucaaggccccacugccgccucguaucgccagccuccaguccugccuccacgacgcgcccuuccccaaggcuggccgggucuggaugucgccauccccuauucggagcuacagaccucgcagcugaacucuuaaaaagaaccucgcuucuuccucacggugcuccagcuccacacaccguacugagccucgccagccaccguacgcgaggucgcggcgcguccgugacgucacugaugugcgcuucucccgcacuaagggaaacauggcucuaacgcggccggugcggcucuuuucccucgugacucgguugcuccuggcgccgcgacggggccucacgguccgcagucccgacgaaccccugccgguggugcgcaucccaguggcucuacagcggcaguuggaacagcggcagagcaggcggcggaaccucccgaggccggugcugguucgacccggaccgcugcugguuucggcgcggcggccggaguugaaccagccggcgcgccucacacugggccguugggagcgcgcgccgcuagccucucaaggcuggaagagucgacgcgcgcgucgggaccacuucuccaucgagcgcgcgcaacaggaggcgccagcggugcgaaagcucucgucuaagggcagcuuugcugaccugggccuggagccccgugugcugcacgcacuacaggaggcugcgccugaagucguucagcccacaaccgugcagucuagcaccauccccucacuacuucgcggccgccaugucguuugcgccgcagaaaccggcaguggcaagacucucagcuaccuccugccgcugcuucaacggcucuugggccagccaagccuggacucccuuccuauccccgcgccccgaggccugguccuuguuccuucccgagaauuggcccaacaggugcgggcuguggcccaacccuugggccgcuccuugggccugcuggugcgggaccuggagggaggccacggcaugcguaggaucaggcugcagcuguccagacagccuucagcagaugugcuuguggccacuccaggggcucuguggaaggcccugaaaagucgacugaucagucuggagcaacucuccuucuugguguuggaugaggcagacacacugcuggaugaaagcuuccuggaacugguggacuacaucuuagagaagagccacauagcagaaggcccagcugacuuggaagaccccuucaaucccaaagcucaguuagugcugguaggagccacauuucccgaagguguaggccaguugcugaauaaagucgccagcccagaugcugucaccaccaucaccagcuccaagcuccacuguaucaugccucaugugaaacagacauuucugagacugaagggagcagauaagguggccgagcuggugcacauccucaagcaucgugacagagcagaaaggacuggucccucaggaacuguucugguguucuguaauagcuccagcacugugaacuggcugggauauauucuggaugaccacaaaauccaacaccuaagguugcaggggcaaaugccagccuugaugaggguaggaaucuuccaguccuuccagaagagcucccgagacauacuucucugcacagacauagccucucggggccuggacagcacugguguggagcugguugucaauuaugauuuccccccaacgcugcaagauuacauccacagagcagggagagugggccguguggggagcgaggugccaggcaccgucaucaguuuugugacccaucccugggaugugagccugguucagaagauugagcuggcggcucgccgaaggagaagucuuccaggacuagcauccucggugaaagagccuuugccccaagcaaccugauuuugacaaaucugauuaaaaugugaugcuagaacagggaucuuucccaguaucuugagugggugaccacacuugucagugggaggcucugggcugcccugucggcuccuugagggcgggaugaacugcuuugugacuuggaaagguacgcugcuggccagcauuggagaagaagcugcugagcauggcuuucuguagucuuuagcaagacacaaguggauuuugacuuuguaucau

SEQ ID NO: 15795 - RNA, 2231 nt, Homo sapiens
ccaaaaugaacugaaugagagagaaaaagagguccagaguaguuuguggagcgauguuuccaucucuaaugccacucagcucaggagcaggcuucagacacugccuuuaucuuuacagaaagccaugggaagggaaaugucugagguagagcucagcguugggcaucauauggcuaaucacucagaggucacuaaucacucucccuuuucuuguuuuucagugaacgagauaauugggagagacaugucccagauuucuguuucccaaggagcaggggugagcaggcaggcuccccucccgaguccugagucccuggauuuaggaagaucugaugggcucuaacagugcuuacugcagccuuguguccaccaccaacuucucagcauguuucucuccuuggaccuuggguuuccaacucugcagccuucaggucuggggccaggagugggacccaccauuuguggggaaaguagcauuccuccaccucaggccuuggguagauuuggcaaaagaacaggagcagcauaggcuguuugagcuuuggggaaaugaacuuugcuuuuuauauuuaacuaggauacuuuuauaugaugggugcuuugagugugaaugcagcaggcucucuuguuuccgaggugcugcuuuugcaggugaccugguuacuuagcuaggauuggugauuuguacugcuuuauggucauuugaagggcccuuuaguuuuuaugauaauuuuuaaaauaggaacuuuugauaagaccuucuagaagcaaaaaaaaaaaaaaaaaaaaaaaaaagaaaaaaaaagaaaagaaaaaaagaaaaagaaaaaaauaucccaagcccacaccuaugccucagaaagucagcauguguccugaagacguucauagauuuauaggaaauaaagccaaauguagcucauaccucuuuauaaaacuaaacuguuguuagauaaaaugagaagagaccauuccaucauugaaguguuggaauauaaaaagacauuccagagcauagccuuuugguaacuuucuagguaaucuugcaaucucuccauacuggcuccauguugaaauugcuuuuucccucaggacccuggguaagauggcuacauuuaaggugacucugaauggugggguucuagcuuggucacuuucauuucuugccaucauaaaaacuaguaggcuguggagugcgcuuccuguuugugucaucuggucguagaaccuuuuccaaacagaagcaucugccuuuggcuguucugugaccuuugaagccagucucagugguuuaggcagcuuugcaguucuaacucuagcuagaggccaggcugugugcagagcuaaagcacaaaugagcaguacaucagcaugggcagagaaaauacaggacuccagaugggaagguuuuaagagucacacuggcauggaaggcuuaucugccauucuauuuauagccugaaaugauucuggccuacccuguccugucuguaugaucuaaaaaccagccuuuuccccagaaggcucugagcacauccagaagugauaaccugacccuccacaccaaagacacccuggugcugcugcuggugagacugguguccaaggcagggcccagcagaaacugcagccugcugucuaccaaaggagguacccgaguuggguacuuuaaaaaaaaaaaaaaccugcccuuaccccucucccuaaugggauuuuuuuuaccuguuccugggcccauuacagagccucugaaguuugcaguaugcuuucaaaugaaauaauauacuuccauugauucaggaagcagauuuuuugagugccuauaugugagacagugugcugguugaaggccugaugcuguuauuccaggagacugcaggcccuugaugccaggacucucucuacuaaggccaguucaggucugggaaagggagcuggccuauugcccaccaccuguugucaguagguuaggagcuguugacucaggaugaggaaguauggucuuuaaaaaaaacaaaauauauuuuagauuucuccccuaaaguuaguuagagaaaaaggucuauucuucagcagaucacuguggccccucuuggagcuggguguuuucaaauuuucuugaaaagugaguugugucacagaauguggauagugagauuugcuucugggccugugguuggacgcccacagcuuccuuuggaggggcaagaaguuggccucucgguugacau

SEQ ID NO: 15796 - RNA, 7136 nt, Homo sapiens
uguguucuuguacauuuuguauuuuaaaaccuuuuaugggagugcagugcuccuuacacaaauacaaagggaagaagagccagcaguugaggcuccucaguuuuagugcugaaauaauaaacagugacaggucaacaguauccuuaaucugucugaguguuccuccgccugggguugguguggagccccucacuuuggggcaaaguuaaggguccugugucuuuuaaaaaguccauuuggucaauaacuuuucauuuaaggaagagaagaucgaguuccaaauugcuuccgaggcuucaguucuguaccauuuaaugcgugcaaaggacauuccauggugucugcuggguucagggcaacuggcuuucccaaggcauacaagaaaaguuggcagaaaguccuccccuuuaaaauucaagccugaagguuuugugugggggccuacugcccccuaaugucuucuggugauacugcagcacaguccaucaaaauaguuugugguuuugccaucuguuacuccuuaugcccaccuggagaggggcuagcaucuuuaggugggaccaccccuggcacaacauggucucugagguccagauacucugaggguaggggcuggcucucucugccucccuauccccuacaagagggacagggagagguagaacauugggaucuuuacucagaggcucagauggacccuugauucucccaggagucauacauugaagguaccagagcuuccauuuuauaaaagaaagcaagccugccguggaccugucagccccacgauaucugucggcaugggccacagccaggacagacuuaagggcucuccaggugccagucaagaugccuggcucaggccaucaggagcugguuagccccauuccacccccagcccugcaugcaggguccagccauugucuuugggggaaacaggcagaauaaguggaggauggagcuggggcuugggcuccucuagguaccuucugagagcuuugacaagccagaaagaagcuaccagguugagggugcuggucuucuggacucaggagagacauguucgccgaggauaucagcuggcucuuaccuccuggcuuucucuccuacaaacacacccauuccuugggggcuuguaacacagugcgaggugggucaccaacaggcaucagacugguguagucaucagcggguagcuacagaagggacacagauuuagggcagagagcucagccagacccgccaggcccuccggccacacaaucucaccugguaggccuggaagacgcugagcagauccuucauaccagccguguaugggacacccugcaugcggaccaaggcuccugacugggacaacacugaggugggagcagaggccagggcagcaguggguguagugagguagcccacaguggugggggagacuggggggcuagggugggagagacaagguuuagucaugcaugccaccuguggccuagaccgagaccuguuucccuccucccuuguuucugccuugugcuuaauucaguuccucccugaagccccagccucuacagagucauuuucgaucuguuuuguagauggcauuagccagcugccaccuuacucccuugucaucucaagggaggaguuaucugguccagaaaggggaucgugaccuuuccccagauugggacagggagugggacugugauauucucuuagcugcaggguaccuuggguaguaggcuguguaguucagguagaguugaguggcuggcccuggauaguaggcaacaggggugggggcagcaggcacccuggcagcugggagcagugcugaagagggguauagagcugccgucuccgugggaaugagcguugggguggcuuggaaggugguguagguagguggugagaggccuagagacggaaguagaaagugcaugugcacggagcccagcacugcccugggugggguagccagaaaggaguccccgcuauagaagguaggggcuuacaacagccuggcuaccacaggccuccuccuccccuagccccuagggcacucacagggcagcuugcaggguggaggggacaugccacugcggcccaaggugccccccaucagcacucggcucaucuccucuguggaacaggggaccaccuccacguagcgcuccuucaucaccuucuuauggcaacgcugagcagcagcuagggcucgcucugcugaugucaucugaaugaaggcaucgcccgauggccggcccugugcacaccaucuugugagcaguuugucauguguaagagugccuuaccccuaacacacaccccuuccuauuuauguguucccccuaccaagcaguggcuucaccugcugguugagcaccauguguacaccguggggccgaaugucagcugcugccucccccagaaagcucaggaugucuucaaugguggccguguagggcaggccucggaggcguacacagucccucccagucccaggugccagugggaaggggaugggcagcaguggggcagucaguguaggaaggagugggccggaugcauagcgguucaagaccuaguaaggaaggcagcaacaggcuggucaugccaaguagggcagggacacagagggccgcccuggaguaacaguacaucuggggguggggagcccugggcgcucaccugcugcacuucggcugcagugcuccggaagaguucaauguaucgcuuacccagcaugcccuugugccugcgcagugcagccugugccagcuccucacaagcaaagagggcgaaggcaucaccagucggccggccaucaggauggcgcacaaagagcagccccucgguacccccagucacugggcacucuggccccaggaagccaagcacguccguuggcccagccgagaagggcaguccccgcagccgcaggaucacuuggucuucccgugacaagaaacgagccaccucuagugaugugccuguguaugagagucgccugcugacuucacucaugcuccuccagacacucacccaugcaggggagcaggcaggcaaggggugguggggaagugaaauggaucaagaaccaggggagccaggcccuguuugcaguauacucacccccugcaaucuuuacaaacuccuccccugucgcuuuauacaccuguggguacagagagcagcagcccaugggucucaggccugacucagauuggcccugcuccgcucccagcccaaagccccaccucaauauagcggacgcccauguggugcuugugucucugcagcgcuaggucccgcugcucgcuguccacaaagcggaugagggccucgccauuucugcggcccugggcguugaggcagagugcuacaccaccccuguggagccagugcuguuagugccuccuggguaggccuguccaauugggcccacccacccugccacacccaccuggccacguugagcccuuugaagaagcgagccacguccuggucugaugacugccacggcaacccacgagcccguaccacagucucacuguccaccacaucagccuugcugcuguaggggcagggcacagugcugucagagcuauucagcuguugucacccccagccccugcucccacacucaccaaggccccgucucguauuucugcuuuaucaccucgggcuucgaaaacaauugaccugagaaaagauggccugggggucagcagggucugguggagagggguguccccaccaaguucugcaaaaaguggacaauugagagagaugaagaaaugacaggccgagcacaguggcucacgccuauaaucccagcacuuugggaggccaagguggguggaucauuugaggucaggaguuccagaccagccuggccaacauggugaaaccccaucucuacuaaaaauacaaaaauuaggugggcaugguggcaggcgccuauaaucccagcuacucuggaggcuuagacaggagaaucgcuugaacccggaaaguggagguugcagugagcugagauugugccacugcacucuagccuaggcuacagagggagacugucucaaaaaaaaaaaaaaaaaagaaaugacaaagaggauucccccguggucucuuagagaaggucacaguggggaggagcaauaggcauuugucaucccugagaacaggugacaggcagugagggaaaccuuacugcugggcucuuugaguagauggaggauaacagcuaccauugucuugacuucccagaccccaaagucauccucuguggcaucugucuccaguccuaaaccuaugggcagagaagugacagugaagacaucuuagcauaagcacuaauccuguuuacuccugggcccaacuccccuccauagacacaugcuggagaccagcauacacauuuguuuuggcccaguucaugugugcacauacagauucccaguccagacauagacagacacauacccacauuccaaacucauccuagcacagacacgaagacacaguacacucagggacuuagcagauaacgcagucuuguauguguccauauuacccacccacagcaugcacauacucagacacauguacccacaguggcuucuccacccuaacccugcugggucacagauacccugugccaugguggccacagugaggucccuggcagggcaggugcuuggaugcugcauauggaauucucuucggaggucauagaaggagaagaacaugucggggagcaccagguucugggggcacauaggauugaggaugagcgcccugcccacccucaggacaagagggguucugggaaccuuacugaccaccccaccccacccgguuuuccuucaggagcauaccuuccuggaggccucggggugcaggaccugucgcaauagcugcugcccaucagugcagagcauguaggggcccccgcccagcaaagccacauccccguucaccagcugugagaacuggggauagggaauggggagagagaaacacacagauucacagcugggcaggcaggaagugaggguaggaggaaggaggcaggcugcaaagcugguucagccagauguucagcccuauccugccugggaauaagaggccacgccuguugagccuagcccuaugucccuuccccucaccccccaacccuguuccaguccacugucaccuccuccaggccaaaugagggcaaucacauauaaccgaagcccucaacacacacacuccaggaguuuggaguggggccagagcaaacaccuggagugggacaagcaggugggaaggggcggggcaaagcagguuaaaccugucuuugaccggguaccacccucagacaggugggggaggcccaggccugccugaggcccagaaggcucauggucaauggcagccccgccuccaggucugaccaaccgaggggcagagaaacuccaaggacagagcuccacacuuggacaucaggggcagcaugagcuuugacccacauccuauugaccggcuggcacugagcuguuugcucauagaggggguggcacuccugaggcugcccagcccucccccagccuccauccuugcuggagaaguauaaacacuaaucagugacccacgaacccucccugccaauucugugacacuuuacaacuuggggcugacagagcaaggcaacccagcucuccuccagcaaacuccccaagugaagggccgggagcccuucuggaacagacaaggaaucaucaucguggugccuccucaucaggaaccacaagaguuguuggaagaugaaagaacgugaguguauaaaaaggacuuacacuaauuacacucaagagucagacauagaaugagcgccguagugaagauaaggaaaagaaaacagcaauggaaaccaccucccacuucagcuagggcaggaggcaccccaggccuuugcacucagcaggcagauagucccccaggccaggccgggacagcgcccacgccuggccagccggccgggacaggccuagacgagcaguuuacaccuggcggcgucuaccucuagggccgacaccgcccuacgccuccgcuccagcagcucccaagcaggccgaagacgcgggccgcaaggacaggugaccuauaugggccccucgaccccuuucgcuuccggcugcggcucagggagaccugacccagcaggucucccaaaggcgucucggccucgcuccccgggcgggaacuggggauggaucccaaagccugcgucccgaucccuucgguaggaguagguuccugcaaugguugaaaaguaaggagcccaggggaauggcuggcacgcgcggaugaaaggggcacgcacacgcgagagucgcucaaaguuucaaacaagagcccaguccugccgccuggaccgguugguugcggcacgccaggccuagccuccggccgccaaucccgcccagaaauguccucacguccaggccaugccgccacccaccccggcgcucaccugcugcagcaccuuguccagcggcucugcccgcgccaggcugucggcgcucaggccgcucgccucgcggcacugcguacucagugcggccgccucggcacgaaccagcgauuugugcagcguccccaccugugagcggcgggggaaaccgaucagccgcgccccucgaccccggaagcucccuggggaccucaccgccucuuuuccacccuaccuggcggcuccgcggcucaaccacuugccaaacuaggaggauuaagucggucucguccgagcccaggucccgucccagcgcacccgccguagccccgaagaggacgaccagugauccgggccaggggcagggguccgcggcggggucggccgcggggucagggcccgggggagggggcggcggcggcggcggagucauggccgcagaggaagggggcucucggccagacacgcggaccgacgaggcgcacgcacgcaccgaccgaccgcagacgcggaucagcuugggcgggacaccguguaucgggggcggcaccugcggcccggcuggcucagugggcgcugccaagacccgcccguggcgccccgcggggcggggcggcuaccggcccacgcccucuccaggcga

SEQ ID NO: 15797 - RNA, 15779 nt, Homo sapiens
auuugcgggaggcgggcccugauuggccggggggaugcgggggaugcgggcggcgggguuaagcgcgucgccaccgcccccgccuaggcgagagcccagagagcugaaccugcaucccggaccugcggcgaccgucguacaccaugggccuccaccuccgccccuaccguguggggcugcucccggauggccuccuguuccucuugcugcugcuaaugcugcucgcggacccagcgcucccggccggacgucaccccccaguggugcugggugaggcacgggucucgugguggaucugucggucgggcgggacgggccgcgggcggggcugccuucccggucugcuucuguuccagucacgaaaugggggagcguauugguaucugucuugucacuuaggugaucuagaucugccggcucaccucccgccaugcugggcgcggguguggucagcuccccaccuccuguccugguagaaaaugggggugagugggagaguuaccaucugguuauucauaguuccaccuguccgcaucauucccaagccuugccuccccuuaucccauuuuuaagcuggaaagacaggugcuucagccccacuccugagggaugguggggguguguagaguggcuccugaguugacuucugcaucgaccugggccugguuaggaggcugucacccucgaccccuccaaugccacauaugccagaaggcauugcugaaaggaaccuccuuagggaaaggauugcuguccuagcuggccaccaacucccacaacuuaucagauguguggcauugccugagggaaaaggccuaagggaaacugaagacaacugaagucaggggaaaggguugggacaauggccaugaaccugugucaggcaacaugcuuguacucuuacccugccacacaugcuuggacuagacuauguggaggcucggugaccuccccugcucaccccgcuccuugaucacaacccuggcaacucuacaacggccacuguauuuccuugcagggaugggcagggaugagaccucugucuggggggccuugggugccucauugaggccgucacucccauccagagcugguguguccguggccagccaggauuccugaaagcagaggcaucugaggcaugaauuacacguggagucuagugcagcaugaucuccaugcucuuucugcugagaguacuuuaaauggggacgaugcaaaucacagaaggguagaguuggcagguaggguggugccaggcaggccccaccaggaguucccagccaggaaaagcuccagggggauacuaggcccagguucaccaugggauuugggcagacuuggcccugccuccccaaagcuugcaggauaggaauaacagugauccccagagaggaagucuguguggggcaagcacagagaauccaccaacccagccuggaugggugggugucaaguaaggcuuccuggaguauauagcuggagcuaaggccaggagagaguaaugggucggggagagacgugagcaucucaggcugccugggaucgagucacaggaggaguggacugcacaggacuugugacugguugggucaucugaacuuuaucuugagggccucagggaguccuggguuggccugcagaguucuaagucugaggggcguggcauuaggaagcauguggucuguggcacacaaaauggcacauagccauuuugccuggauugaugcuaaccgcacucaucaauucagucagucuguuuauccuuggucacagcagaagagccucagaccccacccagaaucacagagcagcaggaguccuaacaugcccagcuucucagggagugaggcugcuggccuuagcccugggagaccucacggugggcaguuggauaagcagcuccugggcacagagcagggaucugaccuugacugucagaagaucagaauccucuagggguggauccugaaauggugguggaggaaagagagaccagcgaugugauacagaagacccugggcaaggggaagggaccauaggcaaggccauuuccaccucuugcagccucagucuccccaucuguuaaguggaaauaguaaggcuguccccucccaguguuacuugaggugaaaggcauguggauggcucuuuuccuaguuccaggcgcagaugggcucaggaaguggccacugcuauuuuuaggggccacacagccugaccaggguaaggagcaucugagcaaagcagaucuggugacuuccucuuuuaccauuuccccuuugguagagacagugaccagggucucugcccugcccugcccaguccacaggcaugucauccagaggcugucaugacagggacucccucccucugcacccauaccaugaagggaggugaaggcaugugccgccccugccucucauggcacccugaagacacugggauggugcccagggagggcacgcccuguucaggguggauuuacggucaguucccagugaauguccaggagagccaagugcugguuuuucacucaaugaucauggacccuaaacggggauguguuugggaaguggcgagagcauggcaugugggggcaggugaggcccgaaaggucaaugggaguaacgagacugugaagggcuuugacgcaguggggagggauuugggugucaccagggccccagaguucugaguacacugaauaggauggcugggauggagagaagucacccuagggccuggacuguggugauaauggugcugguucaggguggcuguuuccaauacgggcucccagccaugcuagggcccuccagaugaucugcucucuggcaccuuacuggacucuggccuuuaguaaggccugggcccuugguaggcuggcgggugccaauguaagcuucucucagcuguguuucuguucauuucccucccaccagccuguccugcauacuuugucugguugaauuuuagcugaguggcccagggcucuguucuguuuccuucuuccucucucagggcgaacaggacccugucuucuauguagccugggauagcuauggguggaagacuuuuggguucaagccuccaggguauauaucuuuuuuuuuuuuugagaccgggucuugcucugucacccaggcuggagggcaauggcacgauuuuggcucacugcaaccucugccucccggguucaagcaauucuccugucuuaggcuccugaguagcugggauuacaggugugugccaccacaccaagguaauuuuuuguauuuuuaguagagaugggcuuucaccauauuggccaagcuggucuugaacuccugaccgcaagugauccacucaccucggccucccaaagugcugggauuacaggcaugagccccugcgcccugccucgaagguauauaucuaaugacaagggccuuggccaaacuuuggagguucuggaaugcaaaggggucuccaagccccuccucccaggcagagcucccaucgggguccauuaaccauagaaaccauguguagaggugugucuguguuugcugggggugauucagaccaagaucucauuuaacagauacggaaacugaggccuaguguggggagugacuucacccugaacccccuuccaauaaucugaauggcccaggaggauguuccagugaaaauccaggagacuuacuuuaucuggaguuggagacaauguuagggcccuuccccaaacaugucaggccucucccaagccccccacaggcaucucugcaccacacagcaguagcagcuuuucugcacaaagaugguucccuggccuuugggucaaggucccugcucucugaauuuccugccaccagcacugugcuuuaauuugagauguggaacugcacaggucugccauauuaucuguggcucuucagggggucugcugcagacaucaaaguucuugggagucuugaaccugccgggcugagggcucacacauguccugugcccccugcagucccuggugauuuggguaaccaacuggaagccaagcuggacaagccgacaguggugcacuaccucugcuccaagaagaccgaaagcuacuucacaaucuggcugaaccuggaacugcugcugccugucaucauugacugcuggauugacaauaucaggugggggcuggggcacacagaggggggugcugcucaccaacagugccugagaggccuccagagucuguuccuucuauccucaucucgaggucacugaccucucuccuuccccagguccucggucuggucuggucuggucugguuggcaccaccucugcacucccaggcagaacuaacuuucccuuccugcugcccuuguuccucuacucuccaguccuggccucucaugccuacacacaauuuuuuuuuucuuuuauuuugggauggagucuugcugugucacucaggcuggcgccaucucagcucacugcaaccuccgucucccagguucaagcgauucuugugccucagccucccaaguagcugggauuacaggugcccgccaccaugccuggcuaauuuuuuguauuuuuaguggagaugguguuucaccauguuggccaugcuggucuugaacuccugagcucaaguguucugcccaccuuggacucccaaagugcugggauuacaggcaugagccacuacgccugccuacacaaaauuucugugucccagccccuauucagagccucggcauggcccccaccccuuuccuugucugugccucggccuccccuaccucuccagcugcuuauucuucuugggacaugccaugucuuuguaccugcuguucuuuuggccuggaaucuauuucuacacccuuugccugauaaauggcuuccauucacuuuuuuuuuuuuuuuuuuuuuuggagacggaguuuugcucuuauugcccaggcuggagugcaauggcgcgaucucggcucacaacucuuuuuuuuuuuuuuaacuuuuauuuuuugagacagagucuugcucugucgcccaggcugggugcaguggcgcuaucucggcucacugcaagcuccgccucccggguucacgccauucuucugccucagccucccaaguagcugggaccacaggcgcccgccacagugcccggcuaauuuuuuguauuuuuuaguagagacaggguuucaccguguuaaccaggauggucuccaucuacugaccuugugauccgccugccucagccucccaaagugcugggauuacaggcgugagccaccacacccagccccauucacucuuuaaaacaugacccuaggccaggcaugguggcucugcuauaaucccaucacuuugggaggcugaggcagucagaucaccugagcucaggaguugaagaccagccugggcaacuuggugaaaccccaucucuaccaaaaauacaaaaaaauuagcugggcaugguggcaugcaccuguagucccagcuacuuagggggcugaggcaggagaauugcuugagccagggaagcagagguugcagugagcagaccacuguacccagccuggguugcagagcaagacccugucucaaaacaacaaaaaccugacccuggucccuuugugacaugucccuuuugacuccccagagcgguuugccucuccucccaggccccaugcuugcuuccucuaaacaucaucaugugcccgaauuugucugcaggcauguuugcccaaauugcacaggcacuguacauuuuauauacuuucuuucaguuagucuuacagcaaccccguuuugaaauaggugcuguuuucuuuuuuuuuuuuucaccaguguuacuugccaacaggugguuuuuaaaccugcuuuacaacugcgaaaucuggaggcucaaugagguuacaaaauugacugugcucacucagcuaauaagugguagaaucagaauucaaauccagaauguguggcguugagcugagguucccucccaggcugaguuccgugaagggagggagugugugucuguuuuauccuuauagcaguagaaccagaaacacaguuggcgccugauaaauguuugagcugaauggagucucccaaauuaaaaguuuuuccuggucgggugcgguggcucaugccuguaaucccagcacuuugggaggcugagguggacagaucaugaggucaggaguucgagacuagcccggccaacacagugaaacccugucucuacuaaaaaugcaaaaauuaaggccgggcaugguggcucacgccuguaaucccagcuagucaggagucugaggcaggagaaacgcuugaaccugggugguggaaguugcagugagcugagaucgugccauuguacuccagcccaggugacaguacaagacuccaucucaaaaaaaagaaaauacaaaaauacaaaaaugagccgggcgugguggcacacgcccaugaucccagcuacucgggaggcugagacaggagaaucacuugaaccugggaggcagagguugcagugagcagagaugggggcacugcacucuagccugggugacagagcgagacugucucaaaaaaaaaaaaaaaaaaaaguuuuucccagagacccgcuagcugcuccuccaggugcccuggccugccggcuguuugugaugcccauuuugaugacuccuuccuccucuguguguugugugacugggguuauuucugggcuguugaugugcauuucuauuuuuauacuggggacacagccucaggugcugccaguuggaggugccagcugauaccaagaggggccugucugccuucacugcuucucugacccguuuagauuuucacccagcgcagaacugcuuuggcuuuccagaacaguuuucugcauuuugcuguuugauaauuuauuuuuaguagcaacaagcuacuuugcuauguggucauugggauaaucuacaaauugcccuggagagaaugggccuccaggaccuguuaucugggucaguuguggggauccugucagcuucaguggcugauaucuaagugggcaagugggacucaggaccaccagaaacuccagguuccuguguuuugggggcacauuugcuucuucaguguguggcgaggccagagcaagguucccagccucgcacagaggcacaaggcuuuucuccugguauaaggugucuccccuggcccaucacccuguucccaucauuucuucaggccuugacaacccucuucccacaggagauggugcagcagcuguguacugagcccugaggcggggucuguccugucugguucuguuuggcacugcagcuacagaaacuaugagaucacgugugugguguuagaagcugcugagucugugguaauuuauuacacaguucuagaaaacuaauaggcugggugcaguggcucacaccuauaaucccagcacuuugggaggcuaaggcaggaggaucgcuugagcccaggaguuugagaccagcaugagcacauaguguggcccugucccuacaaaauaaauaaacaaauaaauaaauaaauuagccagaccugguggugccugccuagcuguucaggagggugagguaagaggaucacuugagcccaggagguuauggcuacagugagcuaugaucuccucacugugcugcagccugggcaacagagugagacccugucucaaaaaagaagaagaaagaaaaguaagaaagggcuguuagggaucuuaagucaguagcuggugguccauguccuaugucauggcgcuuaggaauuugcugggcaagcccugagccuuguggcugcagucugacaguugauacagcccugggguacugggaggucauaggagcaugguucauucccuuccuccauggaggauguguuuggagguuggcuggcugcuguguccaaugcgcagaggaagcgggacccaauuauaccuaccuggggccacacaaggccuuccuccugucucuccccaccagcucccaucauuucucugggccuugcuccuucuccuaccugccuacccacccauacagcagcccugaggcauggugccuuucuaggguuuguuuuuguuuguuuguuuguuuuuuugagacagaguuucgcucuuauugcccaggcuggagugcaguggcgcaaucucggcucacuacaccucugccucccaggcucaagcacuucuccugccucagacuccggauaacugggauuacagguacacgucaccaugccugguuaauuuuuguguuuuuaguagagaugggguuucacccuguuggccaggcuggucucgaacuccuaaccucaagugauccacgugccucagccuuccaaagugcugagauuauaggcgugagccccugugccuggccuaguguguuuuguuuuguuuuuuuuuuuuuuuugagacagggucuuacuuugcugcccaggcuggugugcaguggcaugaucacggcucacugcagccucaauaucccaggugcaagucauccuccugccucagccuuccaaguagcugggaccacaggccugcaccaccaugccuggcuaauuuuuuauuuuuaguagcaacaaggccucacuguauugcccaggcuggccuugaacuccuggccucaagcauuccucccaccuuggccuugcaaauuguuggaacuacaggugucagccacugcacccggccccugucugguucuguuguguacugcacucaccaccuccuucaccugggauacguugggcuggcaggagcuggaugcaaggagauggagcgauggaaagcugaaagaggguagacugccucuugggguccagugugaaguucacggcagaaucaggacugguacuuccuucucccaaccagguccaagacccucauucuagaguagggucacgggggagaggggaauguugcuuugacagggguccuggggucaguauuuggaguaaguaugccuuggugggguccucauuuggauguaauuacucugaucugugcuuuuuauuuuuauuuauuuauuuauuuauuuauuuauuuauuuauuuauuuuuuugagacagagucuugcucugucgcccaggcuggagugcaguggugugaucucagcucacuacaaccuccgugucacagguucaagcgauucuccugccucagccuccugaguagcugggauuacagucgccucccacgacacccggcugauuuuguaucuuuaguagagaugggguuucgccauguuugucaggcuggucucaaacuccucacucaggugaccugccagccucagccucccaaagugcugggauuaacaggcgugagccacugcaccugggcaauuuuuguauuuuuaguagagacaggguuucaccauauuggccaggcugguuucaaacuccugaccucaagugauccucccaccucagccucccuaagugcugggauuacaggugaucugugcuuuaucaaccugcuuuguuacuuuucggucucuccuauccaucugaccaaaccugggcaugagaagggaguaugacucaggacaugaugcacuguugggacacaccaagcucaguguccccuccgggucacuggcucaauauccucucacaacaggcugguuuacaacaaaacauccagggccacccaguuuccugaugguguggauguacgugucccuggcuuugggaagaccuucucacuggaguuccuggaccccagcaaaagcagcguggguauguagcccuuacucaaggccuccgggagcugggaugggguuucugccggacuggagcuggagcuggaggaacucugcugguuuguagggacagccugugagcugucucugaucagcgugggcacagagcccuguagcauucuuccaaggaccugcuagcugucacagucuccaugcugggcauaguguagguggccggcacuagcuguaucuuuucuuauccucuguauuucugucuacagguuccuauuuccacaccaugguggagagccuugugggcuggggcuacacacggggugaggauguccgaggggcucccuaugacuggcgccgagccccaaguaagcaggcacucucauucccucccugacgucucgggagguaggggugaggugaucaugggcaccacagaccuugggcucuccccuuguccuuggcugucuccugucccugggccucuggcauccagucuaguggucacagccaccaccuuuggucagucuuauccuguccuccauuucccacccugggaccucugggccugugagcccuggggagaaauauaaggcuuccucccuucauggaaggcggggggacccagaccgcucuguuugaaugugagcacccuccccucccccucucgucuugugucuggccugagaaaagcucagugguuccggcuccaggacccuucccaccugaccccugccuggcucuggccugcagaugaaaacgggcccuacuuccuggcccuccgcgagaugaucgaggagauguaccagcuguaugggggccccguggugcugguugcccacaguaugggcaacauguacacgcucuacuuucugcagcggcagccgcaggccuggaaggacaaguauauccgggccuucgugucacugggugcgcccugggggggcguggccaagacccugcgcguccuggcuucagguaagacccuaccuggcccagcguggggggcuguugccaggaauucugcccucucuucccuuccuaaguguccuccugggccagcaugccucgugucugucccacgguguguggggucuaugcaaaucuaccccuaaaaguccaaagaagaaagaggcugacaaaucuaguuucucagagaaaagcauuuaauagggacauacgaauagaagccacaucugugucucaggugggggcaagacaagaugguggauccccacacuauuagcccccagacccagagcuuauauucuguagggaaagggcgacuccgaugcgauguguugaacauugaaggaugauaacacagaggcuguuuugauuuaugguuaaguacgugcacaagaaacaguagauaaaguggaaaucucaguggccuuccuggaucugggguuaaucagaagccaacaugguggauuaguauccaaaauggaguugcuuuggucuccacaaugacuauucucuugggucagcccuguuuuuuuuuuaauuuuuauuuuuugagacagagucugguucugucacccagacuggaaugcaguggugcaaucuugucucacugcaaccucugccucccggguucaagcgauucugccucagccuccugaguagcugggauuacaggugcccgccaccaugccuggcuaaguuuuguguuuuaguagagaugagguuucaucauguuggccaggcuggucuugaacuccugaccucagauguuccacucgcuucggccucccaaagugcugggauuacaagugugagccacugugccuggccaucccucccucuuaccccauccuuacuucuucauccccaccuucaccgcagaggaggaaggcuagagcauuuuuuuuuuuuuuuuggaggcagggucuuucucacucugccauccagguuggagugcaguagcgugauuuugguucaugcaaccuccaccuuccagguucaagugauucuccugccucagccucccggguaacugggacuacaggcgcguaccaccacacccggcuaauuuuuguauuuuuaguagagacuggguuucacuauguuggccgggcuagucucuaacuccugaccucaagucaggaggaucugccugccucagccucccaaagugcugggauuacaagcaugaaccaccgcacccggccagauuuuuuuguauuuuuaguagagaugggguuucaccauuuuggucaggcuggucuugaacuccugaccucaaaugaucugcccaccuugaccucccaaaguucugggauuacaaggaugagccacugcaccuggccucuagacuacaguuuuuuauuuaugaguugcgccuccaucugugggcagcacggagccucuguaggcaacacagggaggaagcaggugcagaucuggcugggccugcuugccuggcaauugggaaagccaccccuuuuauggcuccucccccgucuuuucaugacuguugcagcucaccagcugcagcuguagaguagagcuucuuccucuagaagggagcuuuccucccucugcuaggacuugggggaggcuuauggacccucacuuugggagcuaugagccagggcugugccaagcaucucaugagcucaagugccugccacugcuugaccugcuuggucuacuggcauugugauugggucaggcccagugacucugaguuggcuggaagacacucagauuuagugaggacucauuauagccaccacuucggucuagccugggccuggagggacggaugugggcauacccugaguuuagacagguagccccggccccuuucagaguuucucugugaguccccuuagagcuuuguuucaaaggcugggaagcuguucuguccugccuuggcaguccaggacuggguguguggugcggggagguggaaguccgugcaccccuaggggcuuuccuugccucaggggucccccagccaggccacagcaggcagagcugaggcccuacagucagucugagaggccucccugcuuucagauacaggguggggugaugggugaccauggauccugaacaggccagaggccccuguucccaaguugcagcuuuuacuuccuggaggccucccugacugccggguguuuguguuguucacauuccuguguauagggacuccgccuccaucugcagccuccccucgugcccugucuccagcacgccuggcugcccaggucagcgcacaugcaaguggguggaaugaggccacggcuggcugaacgcuggucugagcuuaggaaaagaaaaacugguacacaguucagugucauaaaagggaaagcagaacaugucaucuccgaguugccaaccugcugacucacuuuagacuaggucagugcccacaggccugaucagcacuuggaggaugguagaguuuacaggcaaggaagcaucauaaaucacccuguggguaugugccgccuuacucccuggugaggaaagcaaaaaaaacaaaacauagcuuggaugugugguucccagauguagcaaaaauaaagagaaacaauaaaagccaaggcaagcaaacugggcaacauagcaagaccccaucuguauaaaaaguggaaacauuuuuagcccaggcguggugggacgugcuuguaguuccagcuaugcaggaggcugacauaggaggaucacuugaacccaggagguggagguuguagugagccaagacuguaccacugcacuccagccugggugacagaaugagacccuacuucaaaaaaaaaaaaaaggaaaaauuugccaggcaugaggcaugguggcgcauaccuguagucccagcuacuccaaaggcugaggcgggaggauugguugagccugagagguugaggcugcugugagccgugaucaugccauuauacuccagccugggcaacagagugagacccugucucaaaaagaaaaaaaaagagccaaggcagggaugggagucacagugauuacaaugaugauaaccggguagagaugcgggacuguggacugggccccuggcuggggucuggcaggggccugguggugaacaugcugcccaaccagcuggcauuccuaagcacagacugaccagagccuucucccugcaggagacaacaaccggaucccagucaucgggccccugaagauccgggagcagcagcggucagcugucuccaccagcuggcugcugcccuacaacuacacauggucaccugagaagguguucgugcagacacccacaaucaacuacacacugcgggacuaccgcaaguucuuccaggacaucggcuuugaagauggcuggcucaugcggcaggacacagaagggcugguggaagccacgaugccaccuggcgugcagcugcacugccucuaugguacuggcguccccacaccagacuccuucuacuaugagagcuucccugaccgugacccuaaaaucugcuuuggugacggcgaugguacugugaacuugaagagugcccugcagugccaggccuggcagagccgccaggagcaccaaguguugcugcaggagcugccaggcagcgagcacaucgagaugcuggccaacgccaccacccuggccuaucugaaacgugugcuccuugggcccugacuccugugccacaggacuccuguggcucggccguggaccugcuguuggccucuggggcugucauggcccacgcguuuugcaaaguuugugacucaccauucaaggccccgagucuuggacugugaagcaucugccauggggaagugcuguuuguuauccuuucucuguggcagugaagaaggaagaaaugagagucuagacucaagggacacuggauggcaagaaugcugcugaugguggaacugcugugaccuuaggacuggcuccacaggguggacuggcugggcccuggucccagucccugccuggggccauguguccccccuauuccugugggcuuuucauacuugccuacugggcccuggccccgcagccuuccuaugagggauguuacugggcugugguccuguacccagaggucccagggaucggcuccuggccccucgggugacccuucccacacaccagccacagauaggccugccacuggucauggguagcuagagcugcuggcuucccuguggcuuagcugguggccagccugacuggcuuccugggcgagccuaguagcuccugcaggcaggggcaguuuguugcguucuucgugguucccaggcccugggacaucucacuccacuccuaccucccuuaccaccaggagcauucaagcucuggauugggcagcagaugugcccccagucccgcaggcuguguuccaggggcccugauuuccucggaugugcuauuggccccaggacugaagcugccucccuucacccugggacugugguuccaaggaugagagcagggguuggagccauggccuucugggaaccuauggagaaagggaauccaaggaagcagccaaggcugcucgcagcuucccugagcugcaccucuugcuaaccccaccaucacacugccacccugcccuagggucucacuaguaccaagugggucagcacagggcugaggauggggcuccuauccacccuggccagcacccagcuuagugcugggacuagcccagaaacuugaaugggacccugagagagccagggguccccugaggccccccuaggggcuuucugucugccccagggugcuccauggaucucccuguggcagcaggcauggagagucagggcugccuucauggcaguaggcucuaagugggugacuggccacaggccgagaaaaggguacagccucuaggugggguucccaaagacgccuucacgcuggacugagcugcucucccacaggguuucugugcagcuggauuuucucuguugcauacaugccuggcaucugucuccccuuguuccugaguggccccacauggggcucugagcaggcuguaucuggauucuggcaauaaaaguacucuggaugcuguaaggug

SEQ ID NO: 15798 - RNA, 15779 nt, Homo sapiens
caccuuacagcauccagaguacuuuuauugccagaauccagauacagccugcucagagccccauguggggccacucaggaacaaggggagacagaugccaggcauguaugcaacagagaaaauccagcugcacagaaacccugugggagagcagcucaguccagcgugaaggcgucuuugggaaccccaccuagaggcuguacccuuuucucggccuguggccagucacccacuuagagccuacugccaugaaggcagcccugacucuccaugccugcugccacagggagauccauggagcacccuggggcagacagaaagccccuaggggggccucaggggaccccuggcucucucagggucccauucaaguuucugggcuagucccagcacuaagcugggugcuggccaggguggauaggagccccauccucagcccugugcugacccacuugguacuagugagacccuagggcaggguggcagugugauggugggguuagcaagaggugcagcucagggaagcugcgagcagccuuggcugcuuccuuggauucccuuucuccauagguucccagaaggccauggcuccaaccccugcucucauccuuggaaccacagucccagggugaagggaggcagcuucaguccuggggccaauagcacauccgaggaaaucagggccccuggaacacagccugcgggacugggggcacaucugcugcccaauccagagcuugaaugcuccuggugguaagggagguaggaguggagugagaugucccagggccugggaaccacgaagaacgcaacaaacugccccugccugcaggagcuacuaggcucgcccaggaagccagucaggcuggccaccagcuaagccacagggaagccagcagcucuagcuacccaugaccaguggcaggccuaucuguggcuggugugugggaagggucacccgaggggccaggagccgaucccugggaccucuggguacaggaccacagcccaguaacaucccucauaggaaggcugcggggccagggcccaguaggcaaguaugaaaagcccacaggaauaggggggacacauggccccaggcagggacugggaccagggcccagccaguccacccuguggagccaguccuaaggucacagcaguuccaccaucagcagcauucuugccauccagugucccuugagucuagacucucauuucuuccuucuucacugccacagagaaaggauaacaaacagcacuuccccauggcagaugcuucacaguccaagacucggggccuugaauggugagucacaaacuuugcaaaacgcgugggccaugacagccccagaggccaacagcagguccacggccgagccacaggaguccuguggcacaggagucagggcccaaggagcacacguuucagauaggccagggugguggcguuggccagcaucucgaugugcucgcugccuggcagcuccugcagcaacacuuggugcuccuggcggcucugccaggccuggcacugcagggcacucuucaaguucacaguaccaucgccgucaccaaagcagauuuuagggucacggucagggaagcucucauaguagaaggagucugguguggggacgccaguaccauagaggcagugcagcugcacgccagguggcaucguggcuuccaccagcccuucuguguccugccgcaugagccagccaucuucaaagccgauguccuggaagaacuugcgguagucccgcaguguguaguugauugugggugucugcacgaacaccuucucaggugaccauguguaguuguagggcagcagccagcugguggagacagcugaccgcugcugcucccggaucuucaggggcccgaugacugggauccgguuguugucuccugcagggagaaggcucuggucagucugugcuuaggaaugccagcugguugggcagcauguucaccaccaggccccugccagaccccagccaggggcccaguccacagucccgcaucucuacccgguuaucaucauuguaaucacugugacucccaucccugccuuggcucuuuuuuuuucuuuuugagacagggucucacucuguugcccaggcuggaguauaauggcaugaucacggcucacagcagccucaaccucucaggcucaaccaauccucccgccucagccuuuggaguagcugggacuacagguaugcgccaccaugccucaugccuggcaaauuuuuccuuuuuuuuuuuuuugaaguagggucucauucugucacccaggcuggagugcagugguacagucuuggcucacuacaaccuccaccuccuggguucaagugauccuccuaugucagccuccugcauagcuggaacuacaagcacgucccaccacgccugggcuaaaaauguuuccacuuuuuauacagauggggucuugcuauguugcccaguuugcuugccuuggcuuuuauuguuucucuuuauuuuugcuacaucugggaaccacacauccaagcuauguuuuguuuuuuuugcuuuccucaccagggaguaaggcggcacauacccacagggugauuuaugaugcuuccuugccuguaaacucuaccauccuccaagugcugaucaggccugugggcacugaccuagucuaaagugagucagcagguuggcaacucggagaugacauguucugcuuucccuuuuaugacacugaacuguguaccaguuuuucuuuuccuaagcucagaccagcguucagccagccguggccucauuccacccacuugcaugugcgcugaccugggcagccaggcgugcuggagacagggcacgaggggaggcugcagauggaggcggagucccuauacacaggaaugugaacaacacaaacacccggcagucagggaggccuccaggaaguaaaagcugcaacuugggaacaggggccucuggccuguucaggauccauggucacccaucaccccacccuguaucugaaagcagggaggccucucagacugacuguagggccucagcucugccugcuguggccuggcugggggaccccugaggcaaggaaagccccuaggggugcacggacuuccaccuccccgcaccacacacccaguccuggacugccaaggcaggacagaacagcuucccagccuuugaaacaaagcucuaaggggacucacagagaaacucugaaaggggccggggcuaccugucuaaacucaggguaugcccacauccgucccuccaggcccaggcuagaccgaagugguggcuauaaugaguccucacuaaaucugagugucuuccagccaacucagagucacugggccugacccaaucacaaugccaguagaccaagcaggucaagcaguggcaggcacuugagcucaugagaugcuuggcacagcccuggcucauagcucccaaagugaggguccauaagccucccccaaguccuagcagagggaggaaagcucccuucuagaggaagaagcucuacucuacagcugcagcuggugagcugcaacagucaugaaaagacgggggaggagccauaaaagggguggcuuucccaauugccaggcaagcaggcccagccagaucugcaccugcuuccucccuguguugccuacagaggcuccgugcugcccacagauggaggcgcaacucauaaauaaaaaacuguagucuagaggccaggugcaguggcucauccuuguaaucccagaacuuugggaggucaaggugggcagaucauuugaggucaggaguucaagaccagccugaccaaaauggugaaaccccaucucuacuaaaaauacaaaaaaaucuggccgggugcggugguucaugcuuguaaucccagcacuuugggaggcugaggcaggcagauccuccugacuugaggucaggaguuagagacuagcccggccaacauagugaaacccagucucuacuaaaaauacaaaaauuagccggguguggugguacgcgccuguagucccaguuacccgggaggcugaggcaggagaaucacuugaaccuggaagguggagguugcaugaaccaaaaucacgcuacugcacuccaaccuggauggcagagugagaaagacccugccuccaaaaaaaaaaaaaaaaugcucuagccuuccuccucugcggugaagguggggaugaagaaguaaggaugggguaagagggagggauggccaggcacaguggcucacacuuguaaucccagcacuuugggaggccgaagcgaguggaacaucugaggucaggaguucaagaccagccuggccaacaugaugaaaccucaucucuacuaaaacacaaaacuuagccaggcaugguggcgggcaccuguaaucccagcuacucaggaggcugaggcagaaucgcuugaacccgggaggcagagguugcagugagacaagauugcaccacugcauuccagucugggugacagaaccagacucugucucaaaaaauaaaaauuaaaaaaaaaacagggcugacccaagagaauagucauuguggagaccaaagcaacuccauuuuggauacuaauccaccauguuggcuucugauuaaccccagauccaggaaggccacugagauuuccacuuuaucuacuguuucuugugcacguacuuaaccauaaaucaaaacagccucuguguuaucauccuucaauguucaacacaucgcaucggagucgcccuuucccuacagaauauaagcucugggucugggggcuaauaguguggggauccaccaucuugucuugcccccaccugagacacagauguggcuucuauucguaugucccuauuaaaugcuuuucucugagaaacuagauuugucagccucuuucuucuuuggacuuuuagggguagauuugcauagaccccacacaccgugggacagacacgaggcaugcuggcccaggaggacacuuaggaagggaagagagggcagaauuccuggcaacagccccccacgcugggccagguagggucuuaccugaagccaggacgcgcagggucuuggccacgcccccccagggcgcacccagugacacgaaggcccggauauacuuguccuuccaggccugcggcugccgcugcagaaaguagagcguguacauguugcccauacugugggcaaccagcaccacggggcccccauacagcugguacaucuccucgaucaucucgcggagggccaggaaguagggcccguuuucaucugcaggccagagccaggcaggggucaggugggaaggguccuggagccggaaccacugagcuuuucucaggccagacacaagacgagagggggaggggagggugcucacauucaaacagagcggucuggguccccccgccuuccaugaagggaggaagccuuauauuucuccccagggcucacaggcccagaggucccagggugggaaauggaggacaggauaagacugaccaaaggugguggcugugaccacuagacuggaugccagaggcccagggacaggagacagccaaggacaaggggagagcccaaggucuguggugcccaugaucaccucaccccuaccucccgagacgucagggagggaaugagagugccugcuuacuuggggcucggcgccagucauagggagccccucggacauccucaccccguguguagccccagcccacaaggcucuccaccaugguguggaaauaggaaccuguagacagaaauacagaggauaagaaaagauacagcuagugccggccaccuacacuaugcccagcauggagacugugacagcuagcagguccuuggaagaaugcuacagggcucugugcccacgcugaucagagacagcucacaggcugucccuacaaaccagcagaguuccuccagcuccagcuccaguccggcagaaaccccaucccagcucccggaggccuugaguaagggcuacauacccacgcugcuuuugcugggguccaggaacuccagugagaaggucuucccaaagccagggacacguacauccacaccaucaggaaacuggguggcccuggauguuuuguuguaaaccagccuguugugagaggauauugagccagugacccggaggggacacugagcuuggugugucccaacagugcaucauguccugagucauacucccuucucaugcccagguuuggucagauggauaggagagaccgaaaaguaacaaagcagguugauaaagcacagaucaccuguaaucccagcacuuagggaggcugaggugggaggaucacuugaggucaggaguuugaaaccagccuggccaauauggugaaacccugucucuacuaaaaauacaaaaauugcccaggugcaguggcucacgccuguuaaucccagcacuuugggaggcugaggcuggcaggucaccugagugaggaguuugagaccagccugacaaacauggcgaaaccccaucucuacuaaagauacaaaaucagccgggugucgugggaggcgacuguaaucccagcuacucaggaggcugaggcaggagaaucgcuugaaccugugacacggagguuguagugagcugagaucacaccacugcacuccagccugggcgacagagcaagacucugucucaaaaaaauaaauaaauaaauaaauaaauaaauaaauaaauaaauaaaaauaaaaagcacagaucagaguaauuacauccaaaugaggaccccaccaaggcauacuuacuccaaauacugaccccaggaccccugucaaagcaacauuccccucucccccgugacccuacucuagaaugagggucuuggaccugguugggagaaggaaguaccaguccugauucugccgugaacuucacacuggaccccaagaggcagucuacccucuuucagcuuuccaucgcuccaucuccuugcauccagcuccugccagcccaacguaucccaggugaaggagguggugagugcaguacacaacagaaccagacaggggccgggugcaguggcugacaccuguaguuccaacaauuugcaaggccaaggugggaggaaugcuugaggccaggaguucaaggccagccugggcaauacagugaggccuuguugcuacuaaaaauaaaaaauuagccaggcaugguggugcaggccuguggucccagcuacuuggaaggcugaggcaggaggaugacuugcaccugggauauugaggcugcagugagccgugaucaugccacugcacaccagccugggcagcaaaguaagacccugucucaaaaaaaaaaaaaaaacaaaacaaaacacacuaggccaggcacaggggcucacgccuauaaucucagcacuuuggaaggcugaggcacguggaucacuugagguuaggaguucgagaccagccuggccaacagggugaaaccccaucucuacuaaaaacacaaaaauuaaccaggcauggugacguguaccuguaaucccaguuauccggagucugaggcaggagaagugcuugagccugggaggcagagguguagugagccgagauugcgccacugcacuccagccugggcaauaagagcgaaacucugucucaaaaaaacaaacaaacaaacaaaaacaaacccuagaaaggcaccaugccucagggcugcuguauggguggguaggcagguaggagaaggagcaaggcccagagaaaugaugggagcugguggggagagacaggaggaaggccuuguguggccccagguagguauaauugggucccgcuuccucugcgcauuggacacagcagccagccaaccuccaaacacauccuccauggaggaagggaaugaaccaugcuccuaugaccucccaguaccccagggcuguaucaacugucagacugcagccacaaggcucagggcuugcccagcaaauuccuaagcgccaugacauaggacauggaccaccagcuacugacuuaagaucccuaacagcccuuucuuacuuuucuuucuucuucuuuuuugagacagggucucacucuguugcccaggcugcagcacagugaggagaucauagcucacuguagccauaaccuccugggcucaagugauccucuuaccucacccuccugaacagcuaggcaggcaccaccaggucuggcuaauuuauuuauuuauuuguuuauuuauuuuguagggacagggccacacuaugugcucaugcuggucucaaacuccugggcucaagcgauccuccugccuuagccucccaaagugcugggauuauaggugugagccacugcacccagccuauuaguuuucuagaacuguguaauaaauuaccacagacucagcagcuucuaacaccacacacgugaucucauaguuucuguagcugcagugccaaacagaaccagacaggacagaccccgccucagggcucaguacacagcugcugcaccaucuccugugggaagaggguugucaaggccugaagaaaugaugggaacagggugaugggccaggggagacaccuuauaccaggagaaaagccuugugccucugugcgaggcugggaaccuugcucuggccucgccacacacugaagaagcaaaugugcccccaaaacacaggaaccuggaguuucuggugguccugagucccacuugcccacuuagauaucagccacugaagcugacaggauccccacaacugacccagauaacagguccuggaggcccauucucuccagggcaauuuguagauuaucccaaugaccacauagcaaaguagcuuguugcuacuaaaaauaaauuaucaaacagcaaaaugcagaaaacuguucuggaaagccaaagcaguucugcgcugggugaaaaucuaaacgggucagagaagcagugaaggcagacaggccccucuugguaucagcuggcaccuccaacuggcagcaccugaggcuguguccccaguauaaaaauagaaaugcacaucaacagcccagaaauaaccccagucacacaacacacagaggaggaaggagucaucaaaaugggcaucacaaacagccggcaggccagggcaccuggaggagcagcuagcgggucucugggaaaaacuuuuuuuuuuuuuuuuuuuugagacagucucgcucugucacccaggcuagagugcagugcccccaucucugcucacugcaaccucugccucccagguucaagugauucuccugucucagccucccgaguagcugggaucaugggcgugugccaccacgcccggcucauuuuuguauuuuuguauuuucuuuuuuuugagauggagucuuguacugucaccugggcuggaguacaauggcacgaucucagcucacugcaacuuccaccacccagguucaagcguuucuccugccucagacuccugacuagcugggauuacaggcgugagccaccaugcccggccuuaauuuuugcauuuuuaguagagacaggguuucacuguguuggccgggcuagucucgaacuccugaccucaugaucuguccaccucagccucccaaagugcugggauuacaggcaugagccaccgcacccgaccaggaaaaacuuuuaauuugggagacuccauucagcucaaacauuuaucaggcgccaacuguguuucugguucuacugcuauaaggauaaaacagacacacacucccucccuucacggaacucagccugggagggaaccucagcucaacgccacacauucuggauuugaauucugauucuaccacuuauuagcugagugagcacagucaauuuuguaaccucauugagccuccagauuucgcaguuguaaagcagguuuaaaaaccaccuguuggcaaguaacacuggugaaaaaaaaaaaaagaaaacagcaccuauuucaaaacgggguugcuguaagacuaacugaaagaaaguauauaaaauguacagugccugugcaauuugggcaaacaugccugcagacaaauucgggcacaugaugauguuuagaggaagcaagcauggggccugggaggagaggcaaaccgcucuggggagucaaaagggacaugucacaaagggaccagggucagguuuuuguuguuuugagacagggucuugcucugcaacccaggcuggguacaguggucugcucacugcaaccucugcuucccuggcucaagcaauucuccugccucagcccccuaaguagcugggacuacaggugcaugccaccaugcccagcuaauuuuuuuguauuuuugguagagaugggguuucaccaaguugcccaggcuggucuucaacuccugagcucaggugaucugacugccucagccucccaaagugaugggauuauagcagagccaccaugccuggccuagggucauguuuuaaagagugaauggggcugggugugguggcucacgccuguaaucccagcacuuugggaggcugaggcaggcggaucacaaggucaguagauggagaccauccugguuaacacggugaaacccugucucuacuaaaaaauacaaaaaauuagccgggcacuguggcgggcgccuguggucccagcuacuugggaggcugaggcagaagaauggcgugaacccgggaggcggagcuugcagugagccgagauagcgccacugcacccagccugggcgacagagcaagacucugucucaaaaaauaaaaguuaaaaaaaaaaaaaagaguugugagccgagaucgcgccauugcacuccagccugggcaauaagagcaaaacuccgucuccaaaaaaaaaaaaaaaaaaaaaagugaauggaagccauuuaucaggcaaaggguguagaaauagauuccaggccaaaagaacagcagguacaaagacauggcaugucccaagaagaauaagcagcuggagagguaggggaggccgaggcacagacaaggaaaggggugggggccaugccgaggcucugaauaggggcugggacacagaaauuuuguguaggcaggcguaguggcucaugccuguaaucccagcacuuugggaguccaaggugggcagaacacuugagcucaggaguucaagaccagcauggccaacauggugaaacaccaucuccacuaaaaauacaaaaaauuagccaggcaugguggcgggcaccuguaaucccagcuacuugggaggcugaggcacaagaaucgcuugaaccugggagacggagguugcagugagcugagauggcgccagccugagugacacagcaagacuccaucccaaaauaaaagaaaaaaaaaauuguguguaggcaugagaggccaggacuggagaguagaggaacaagggcagcaggaagggaaaguuaguucugccugggagugcagagguggugccaaccagaccagaccagaccagaccgaggaccuggggaaggagagaggucagugaccucgagaugaggauagaaggaacagacucuggaggccucucaggcacuguuggugagcagcaccccccucugugugccccagcccccaccugauauugucaauccagcagucaaugaugacaggcagcagcaguuccagguucagccagauugugaaguagcuuucggucuucuuggagcagagguagugcaccacugucggcuuguccagcuuggcuuccaguugguuacccaaaucaccagggacugcagggggcacaggacaugugugagcccucagcccggcagguucaagacucccaagaacuuugaugucugcagcagacccccugaagagccacagauaauauggcagaccugugcaguuccacaucucaaauuaaagcacagugcugguggcaggaaauucagagagcagggaccuugacccaaaggccagggaaccaucuuugugcagaaaagcugcuacugcuguguggugcagagaugccuguggggggcuugggagaggccugacauguuuggggaagggcccuaacauugucuccaacuccagauaaaguaagucuccuggauuuucacuggaacauccuccugggccauucagauuauuggaaggggguucagggugaagucacuccccacacuaggccucaguuuccguaucuguuaaaugagaucuuggucugaaucacccccagcaaacacagacacaccucuacacaugguuucuaugguuaauggaccccgaugggagcucugccugggaggaggggcuuggagaccccuuugcauuccagaaccuccaaaguuuggccaaggcccuugucauuagauauauaccuucgaggcagggcgcaggggcucaugccuguaaucccagcacuuugggaggccgaggugaguggaucacuugcggucaggaguucaagaccagcuuggccaauauggugaaagcccaucucuacuaaaaauacaaaaaauuaccuuggugugguggcacacaccuguaaucccagcuacucaggagccuaagacaggagaauugcuugaacccgggaggcagagguugcagugagccaaaaucgugccauugcccuccagccugggugacagagcaagacccggucucaaaaaaaaaaaaagauauauacccuggaggcuugaacccaaaagucuuccacccauagcuaucccaggcuacauagaagacaggguccuguucgcccugagagaggaagaaggaaacagaacagagcccugggccacucagcuaaaauucaaccagacaaaguaugcaggacaggcuggugggagggaaaugaacagaaacacagcugagagaagcuuacauuggcacccgccagccuaccaagggcccaggccuuacuaaaggccagaguccaguaaggugccagagagcagaucaucuggagggcccuagcauggcugggagcccguauuggaaacagccacccugaaccagcaccauuaucaccacaguccaggcccuagggugacuucucuccaucccagccauccuauucaguguacucagaacucuggggcccuggugacacccaaaucccuccccacugcgucaaagcccuucacagucucguuacucccauugaccuuucgggccucaccugcccccacaugccaugcucucgccacuucccaaacacauccccguuuaggguccaugaucauugagugaaaaaccagcacuuggcucuccuggacauucacugggaacugaccguaaauccacccugaacagggcgugcccucccugggcaccaucccagugucuucagggugccaugagaggcaggggcggcacaugccuucaccucccuucaugguaugggugcagagggagggagucccugucaugacagccucuggaugacaugccuguggacugggcagggcagggcagagacccuggucacugucucuaccaaaggggaaaugguaaaagaggaagucaccagaucugcuuugcucagaugcuccuuacccuggucaggcuguguggccccuaaaaauagcaguggccacuuccugagcccaucugcgccuggaacuaggaaaagagccauccacaugccuuucaccucaaguaacacugggaggggacagccuuacuauuuccacuuaacagauggggagacugaggcugcaagagguggaaauggccuugccuauggucccuuccccuugcccagggucuucuguaucacaucgcuggucucucuuuccuccaccaccauuucaggauccaccccuagaggauucugaucuucugacagucaaggucagaucccugcucugugcccaggagcugcuuauccaacugcccaccgugaggucucccagggcuaaggccagcagccucacucccugagaagcugggcauguuaggacuccugcugcucugugauucuggguggggucugaggcucuucugcugugaccaaggauaaacagacugacugaauugaugagugcgguuagcaucaauccaggcaaaauggcuaugugccauuuugugugccacagaccacaugcuuccuaaugccacgccccucagacuuagaacucugcaggccaacccaggacucccugaggcccucaagauaaaguucagaugacccaaccagucacaaguccugugcaguccacuccuccugugacucgaucccaggcagccugagaugcucacgucucuccccgacccauuacucucuccuggccuuagcuccagcuauauacuccaggaagccuuacuugacacccacccauccaggcuggguugguggauucucugugcuugccccacacagacuuccucucuggggaucacuguuauuccuauccugcaagcuuuggggaggcagggccaagucugcccaaaucccauggugaaccugggccuaguaucccccuggagcuuuuccuggcugggaacuccugguggggccugccuggcaccacccuaccugccaacucuacccuucugugauuugcaucguccccauuuaaaguacucucagcagaaagagcauggagaucaugcugcacuagacuccacguguaauucaugccucagaugccucugcuuucaggaauccuggcuggccacggacacaccagcucuggaugggagugacggccucaaugaggcacccaaggccccccagacagaggucucaucccugcccaucccugcaaggaaauacaguggccguuguagaguugccaggguugugaucaaggagcggggugagcaggggaggucaccgagccuccacauagucuaguccaagcauguguggcaggguaagaguacaagcauguugccugacacagguucauggccauugucccaacccuuuccccugacuucaguugucuucaguuucccuuaggccuuuucccucaggcaaugccacacaucugauaaguugugggaguugguggccagcuaggacagcaauccuuucccuaaggagguuccuuucagcaaugccuucuggcauauguggcauuggaggggucgagggugacagccuccuaaccaggcccaggucgaugcagaagucaacucaggagccacucuacacacccccaccaucccucaggaguggggcugaagcaccugucuuuccagcuuaaaaaugggauaaggggaggcaaggcuugggaaugaugcggacagguggaacuaugaauaaccagaugguaacucucccacucacccccauuuucuaccaggacaggagguggggagcugaccacacccgcgcccagcauggcgggaggugagccggcagaucuagaucaccuaagugacaagacagauaccaauacgcucccccauuucgugacuggaacagaagcagaccgggaaggcagccccgcccgcggcccgucccgcccgaccgacagauccaccacgagacccgugccucacccagcaccacuggggggugacguccggccgggagcgcuggguccgcgagcagcauuagcagcagcaagaggaacaggaggccauccgggagcagccccacacgguaggggcggagguggaggcccaugguguacgacggucgccgcagguccgggaugcagguucagcucucugggcucucgccuaggcgggggcgguggcgacgcgcuuaaccccgccgcccgcaucccccgcauccccccggccaaucagggcccgccucccgcaaau

SEQ ID NO: 15799 - RNA, 521 nt, Homo sapiens
uuuuuuuuuuuaaguucagcuuuuuauugaacacguuauaaaagagguuuagucaaaaagaccaaggcccaugucaucaucagacuccuuggauucuucuuucuuugcuuccacuuucuucuccucagcuggagcagcagcaguggagggggcaggacguccugcuggugcagcaccagcugcuggagcagguccaccagccccuacauugcagaugaggcucccaauguugacguuggccagggccuuugcaaacaagccaggccaaaaagguucaacauuuacaccggcugcuuuaaugagggcauugaucuuauccuccgugacugucaccucaucgucgugcagaaugagggccgaguagaugcaggcgagcuuggagacggaggccauggcacgggcgaguguagggcaggcgcugccggacgcggugcuagucgcaggaugaagugagggccuuaccccaacgcggccuuagcuuccucggaaggaccgagcagcuuggcggcagcugagggaag

SEQ ID NO: 15800 - RNA, 1382 nt, Homo sapiens
uuuuuuuucccaucacucuuuacaugguggugauguccaaaagauacccaaauuuuaauauuccagaagaacaacuuuagcaucagaagguucacccagcaccuugcagauuuucuuaaggaauuuugucucacuuuuaaaaagaaggggagaagucagcuacucuaguucuguuguuuuguguauauaauuuuuuaaaaaaaauuugugugcuucugcucauuacuacacuggugugucccucugccuuuuuuuuuuuuuuaagacagggucucauucuaucggccaggcuggagugcaguggugcaaucacagcucacugcagccuuguccucccaggcucaagcuauccuugcaccucagccucccaaguagcugggaccacaggcaugcaccacuacgcaugacuaauuuuuuaaauauuugagacggggucucccuguguuacccaggcuggucucaaacuccugggcucaagugauccucccaucuuggccucccagaguauugggauuacagacaugagccacugcaccugcccagcuccccaacucccugccauuuuuuaagagacaguuucgcuccaucgcccaggccugggaugcagugaugugaucauagcucacuguaaccucaaacucuggggcucaagcaguucucccaccagccuccuuuuuauuuuuuuguacagauggggucuugcuauguugcccaagcuggucuuaaacuccuggccucaagcaauccuucugccuuggccccccaaagugcugggauugugggcaugagcugcugugcccagccuccauguuuuaauaucaacucucacuccugaauucaguugcuuugcccaagauaggaguucucugaugcagaaauuauugggcucuuuuaggguaagaaguuugugucuuugucuggccacaucuugacuagguauugucuacucugaagaccuuuaauggcuucccucuuucaucuccugaguauguaacuugcaaugggcagcuauccagugacuuguucugaguaaguguguucauuaauguuuauuuagcucugaagcaagagugauauacuccaggacuuagaauagugccuaaagugcugcagccaaagacagagcggaacuaugaaaagugggcuuggagauggcaggagagcuugucauugagccuggcaauuuagcaaacugaugcugaggaugauugaggugggucuaccucaucucugaaaauucuggaaggaauggaggagucucaacauguguuucugacacaagauccgugguuuguacucaaagcccagaauccccaagugccugcuuuugaugaugucuacagaaaaugcuggcugagcugaacacauuugcccaauuccag

SEQ ID NO: 15801 - RNA, 1382 nt, Homo sapiens
cuggaauugggcaaauguguucagcucagccagcauuuucuguagacaucaucaaaagcaggcacuuggggauucugggcuuugaguacaaaccacggaucuugugucagaaacacauguugagacuccuccauuccuuccagaauuuucagagaugagguagacccaccucaaucauccucagcaucaguuugcuaaauugccaggcucaaugacaagcucuccugccaucuccaagcccacuuuucauaguuccgcucugucuuuggcugcagcacuuuaggcacuauucuaaguccuggaguauaucacucuugcuucagagcuaaauaaacauuaaugaacacacuuacucagaacaagucacuggauagcugcccauugcaaguuacauacucaggagaugaaagagggaagccauuaaaggucuucagaguagacaauaccuagucaagauguggccagacaaagacacaaacuucuuacccuaaaagagcccaauaauuucugcaucagagaacuccuaucuugggcaaagcaacugaauucaggagugagaguugauauuaaaacauggaggcugggcacagcagcucaugcccacaaucccagcacuuuggggggccaaggcagaaggauugcuugaggccaggaguuuaagaccagcuugggcaacauagcaagaccccaucuguacaaaaaaauaaaaaggaggcuggugggagaacugcuugagccccagaguuugagguuacagugagcuaugaucacaucacugcaucccaggccugggcgauggagcgaaacugucucuuaaaaaauggcagggaguuggggagcugggcaggugcaguggcucaugucuguaaucccaauacucugggaggccaagaugggaggaucacuugagcccaggaguuugagaccagccuggguaacacagggagaccccgucucaaauauuuaaaaaauuagucaugcguaguggugcaugccuguggucccagcuacuugggaggcugaggugcaaggauagcuugagccugggaggacaaggcugcagugagcugugauugcaccacugcacuccagccuggccgauagaaugagacccugucuuaaaaaaaaaaaaaaggcagagggacacaccaguguaguaaugagcagaagcacacaaauuuuuuuuaaaaaauuauauacacaaaacaacagaacuagaguagcugacuucuccccuucuuuuuaaaagugagacaaaauuccuuaagaaaaucugcaaggugcugggugaaccuucugaugcuaaaguuguucuucuggaauauuaaaauuuggguaucuuuuggacaucaccaccauguaaagagugaugggaaaaaaaa

SEQ ID NO: 15802 - RNA, 6314 nt, Homo sapiens
agguggaggagaagggggagaaaugcagccgaggguaaagcacuauucccaaagcacugggaaauccaauggccucgcuagugaggugcaacaacagcaagucacuacguaaagagaaaagguggcuguguaggaaaggaaugggauaacuacugagucccugccuguacaaaaauggcaucagaaacuccauaugguaacauucuaggaugaauaaagcccauguaugugugugugugauaaaacaaucacuuuuuuuuuuuuuuugagacagaauuucacucuuguugcccaggcuggaguguaauggcaagaucucggcucacugcaaccuccgccucccggguucaagcaauucuccugucucagccucccgaguagaugggauuacaggcaugcgccaccacaccuggcuaauuuuguauuuuuaguagagaugggguuucuccauguuggucaggcuggucucgaacuccugaccucaggugauccgccugccucggccuccuaaagugcugggauuacaggcaugagccaccgagccuggccuaaaacagucacuuuuauaauggcuucacugacacuugguuaaauacugauguguuagccacagaugagcauuguggauacuggguggugaauuauuaaugcaaauuuuccauaggaagucaacugggaauguguuuccauuaaaaucaagacgaaaauuaauuuagaggucgcucauucucagcacacauaugguuuuuuauauauauauauauguaaauauauacuuucuuccuguauuggccauacgcuggggagaaauccagccaaacccacuugaaggaggaagaaaauuuaauuuaugcagcaccuaacaugucauagauugaacucagcuagaaaggaaacaucuucaaugaggcccuuuaguaauucagcaugaacaaucaaaugagucagaaaggcaagucacugaaguucagggugcagaggcagggugaauguguucuagcuagcucaccuuggaacaaugaggacaaugccaggauucagggccucaaucuacaaccuugugcucugguuuuucuuaguauauaguuuggccaauauguuacugagguaauagagacauacaccgaagauacaaacaaggucauuuuccugcuacaaaaucccuguugauggauucauuuggaugaauccaucgaggaaagagguuugaggccuucccugguaaaaggaagauugagaaauagacaaauaaaagagguggagaaauugcaaagggcgagagacggacugaccucaguagcuuucuggcugaguccccgaagcagcagcacaaccacauguauggcagcucugcguacuugaacuucaccaucuguuuuggccacagcaaucaggcaagcuguuaccuaggaggaugaaggaagaugaaguugauaagaaucagaguugcacaauuaccuauaaccuuucaacuguguuccacuuacuacacauucaucaagagcaaucuggcuuagagagggcuggauaguugcuuaauccucaacaaagagggugagaucuagugggagagaucuugaugcagucugacuuuucugguagagggcaaaauccaguuuggaauucaagaacgagauuagagagugggaaggaauauguguacuguauauuauaugcauuuuguaaaagguaaggucaaaugcuaauauuuccacaaaagugagaacuguuaauugucccccuuuaagaacaucaaaucaaaggaaaaaagauggucccaaccauagcugcuucuagagacugaggaucauggggauuuagcuaaggagacuucagaguucacagccuggcaugaaugugaauguaccauugaugaaaguuucagccuagggaauaaagaguuacagaaauauucuaacugaucuucuucagcauguccagauauuccaguccuacaaauguaguguacaccggaugugagucagcaggggucacuuucagagacuuccugaauauggaauaggacuuucugugcucaauuacuuuacguauuuuuucuguuuuguuuuguuuuguuugagacagggucucacucugucacccaggcuggagugcaguggugcaaucagggcucacugcagccuugaccuccugggcacaagugacccucccaccucagccucccaaguagcuaggacuacaggugugcgccaccaugccuggcuaauuugauuauuuuuuguagagaugaggguuuuaccauguugcccagcuggucuugaaccccugggcuuaugcaauccuccugccuuggccucccaaggugcuaggauuacagguaugagccaccguguccagccugugcucacuuuuuuuuuuuuuuuuugagacggagucucgcucuguugcccaggcuggagugcaguggugcaaugucagcucacugcaaccucugccuccuagguucaagugauucuccugaguagcugggacuacaggugcacacaaccaugccuaauuuuuuuuuuugagauggagucucacucugucgcccaggcuggagugcaguggcgcgaucuuggcucacagcaagcuccgcuucccggguucacgccauucuccugccucaaccucccgaguagcugggacuacaggcauccgccaccacaccuggcuaauuuuuuguauuuuuaguagagaagggguuuuucaccguguuagccaggauggucucaaucuccugacauugugaucugcccaccucggccucccaaagugcugggauuauaggugugagccacugagccuggcccaccuaaauuuuuguauuuuuaguagagauggaguuucgcuauguuggccagguuggucucaaacuccugacuucaggugaucugcccgcguccaccucccaaagugcugggauuacaggcaugaguuacugugccuggccagcgcucaauuacuuuaaaagaccauacuaacacaggaaagaaagacuggaaauuacuugcaaaacugauauauaguuaauuaugucauaaaaucaaacaguugaauguaacagccacuguacccuugccuggcuccugguaggcagaaaaauguuuuaaaaucucaaugaagagauacaauuaacaagaaugacaacaaaccuuucugaggcauucauguaagcuuuaaaaagagaaaaaaaaauuuuugaaagugugaccaauggcagcaacaaucugaagguaugucuaacuuauucaacuggucucucauauacuuuuuuuuuuuuugaaacaggaucucgcucugucauccaggcuggagugcagugguacaaucuuggcucacugcaaccucugccucccggguucaagcgauucuggugccucagucuccugaguggguaggacuacaggcgcgugucaccaugcccgguuaauuuuuuguauuuuuugguagaggcaggguuucaccguguuggccaggcuggucucaaacuccugacccaggugaucugccugccucggccucccaaagugcugggauuacagacaugagccaccgcaccuggccucucacauacuuuuguuauuggacuuacugugugaauauauuucuuggccaguaguggaaggauaucuaauuaugauaggaaaauagccagacuguguuuagaaacacguacaaauacaaaucauguuuaaagaauggugaauaugagaacaagugaggaaauaggcuugugcagaaauuuuaacuauacagguuguauuuuucacagcuuucaaacaguugggcauaguucaaaguaucuaauuaaucagugauggcagagagauuagaagaacuagcuuguucuuaagcauaauugcgucugugaugcgcuggcauuuaaucaacuugugcaucuaucagacaaacaugcagcuugcaagugaaggaaaaucccagaggaguccaacccuuugggggcuguuuucaguaagacccagcaagcugcucugccuuugaccugggaccccccacccuaaggccagcaguggcuuccaugccuguggcauuaacaguagaagcaauucaguccuaagaggaauuccuugggcaaccuccaaauaggcaacaauauaauagcuaccuccacuuucaggcuuaguauuuacaagguaagagcugaaaccagagaaacaaguuagagauaggucugagucccucuugacacagggaaguaaaauuuauuuggucugauggcuaaauuauggaagccagcccaaggccauggaccgagcagagggucuuaggcauuauguuugcuccccucuacguuuagcuuugggccccugcuuccacguuuggaagaccaaggcucccuggccuagaaccauguuggugucugccuuugucaccucuguccugccucucuuugcugagcgggucaugcuuccaccucagcucucaguguaaggcuggcucucacaguugggcauuugugcauuaaucccacagcugggauguccaggcagaagcauccugccuggaaaagggcuuucccuucaagggcaauucuuuuuuuuuuuuuuuuuuuuugagauggacucucacucuguugcccaggcuggagugcaguagcacgaucucagcucacagcaaccucugcuuccagggcucaagcaauccucccaccucagccucccuaguagcugggacuauaggcaugcaccaccaugcccagccuucuucuuuuucuuuuuuuuuucugugagacaaagucucacugugucacccaggcuggaaugcaguggcaugaucucagcucacugcagccuucaccucccaggcucuggcacuccucccaccucggccuccggaguagcugggacuacaggcguguaccacuacgcauagcuaauuuguguaguuuuuguagagauggaguuuugccauguugcccaggcuggucucaaacuccuggacucaagugauucgccugccucggcuucccaaagugcugggauuccaggcaugaacuacugcaccccggucaaggccaauucuugaaucccugugccaccuugaagguaugacugagagaggagcuaguuaugacaagccuugcugagaucagcugaaauagccuccugcuugcuacgggcuguuagugacuuaugcgccagacuccaccaaacccaucugcagucagccauccaggacaaucaggaagaggcccgagaacagaagagcauuugggaaacuuccucaaccccucugucaccaggaccaaaucaugugaaauguauaauggucugucacgcaaaaugcuuucugagcaucggaauuuuaauauggucuuacggauaucaucuaaauauaagaacagucuucaguucaggucaagcacccauaaccagcuuguaaugcugcucuccagcagaccaaugggacagaccccuuguccaacacuagaaguggggaggauguaggccacucucuucuauguauccaggcuggaaaagucacuucacggcuagucucucaccuccaaccccaacgacauaaugaacacugaguucuaccucuaaaagccuuggugagauagauagaugaugaacugguguauuauuucuauacucuaaguccucucagagggcagaaauccauucuuuuuuuuuuuuuuuuuuuugaggcagagucuugcucuguagcucaggcuggaguacaguggcaugcucgcagcuuaccgcaaccuuugccucccggguucaagugauucuugucucagccuccugaguagcuacaugugccugucaccacaccugguuaauuuuuguauuuuuaguagagauaggguuuugccauguuggccaggcuggucucaaacuccugaccucaaaugauugcccaccuuggccuccuaaagugcugggauuauaggcgugagccacugggcccagccagaaauucauccuuuugucaccugcucugaguaaaccacacuauggaaagcuuucucuucacuggcuaaaucaguaaacuguguccacuucuaaaagccauccagagagaaagaugcugauugcuuuggaagcauuaaaggucaguuucagcaauuuaacacuuaacaggagccaagagaaauaaggaaaaacaucacucccaaaacagcuggcacacaccaagcauaaccagaacuauauaaauaaagauaauacaaauggcaagauuaccaaaaacugacuuuggaaaauuccaagugagaaguugccagaauugagguauguaucaaggaagcaugacuuuaauuuuccaacugcaucuucauccau

SEQ ID NO: 15803 - RNA, 83807 nt, Homo sapiens
uuucaggggcuuacuugucccaggauuugagucaggguccugagagagcagggccaaaaguguguuggaaaaggagcaguacuaggcuggggacagacccaagcugagggaagcugaugaacagcaaaaagucaaagccaggcccaggcagauggggccggccuucugcaaggcugcugcugcugacccgaaggagguaaaaugagugugcucucuucgucaauagcaccagagcccccucuuccccuuaccuuguauuucuugucacuguuucuuaauuugagacauaauuuauauaguauaaaauucacccuuucaaaguauauaauucugcaauuuuagcauauucauaaaguggugcaaugcucaucaauaucuaauuccacaacauuuucauugccccccaaaagaaacuccauacuccacuccccaauucuccucuuccccguucuccucucccccaagccccuagcaaucacuaaucuacuuucucacuauggauuugccuauucuagacauuucauauaaaugagucauacaauauguggccuucugugucugccuccuuccauuccuuuaguaucaugugguuaaggcucauccauguuuucuuucuuuaaaaauuuuuuuucuuucuuuuuuuuuuuggagacgaaguuucgcucuugucccccaagcugguguacaauggcgccaucucgucucacugcaaccucugccucccagguucaagcaauucuccugccucagccucccgaguagcugggauuacaggcacuugccaccaugccuggcuaauuuuuguauuuuuaguagagacgggauuucaccauguuggccaggcuggucuugaacuccugacuuaaagugauccaccaccccuccccgcccagccucccaaaaugcuaggauuacaggcaugagccacuaugucuggcuuuuuuuuuuucuuuuuuauaaagauggggucucacuauguugcccaggcuggucuugaacuccugagcucaugugauccuucugccucugccuccccucccaaagugcugagauuacaggcaugagccaccacacccugccuggcucauccaugguguagcauauaucagagcuuaauguuugcagcugaauaagauuccaucguauagguaugccacauuuguuuauccauuuaucaguugauggacauauaggauguuucuacuuuuuggcuauuuuaaacaaugcugcuaugaacauuuguguagaaguuuuuguguaaauauauguuuucauuucucuuggguauauaccuagaaguggaauuguugggucauaugguaauucuguguuuaacuuuugaggaacugccagacuguuuucaaagugacugcaugaguuuacauucccaccagcaaugcaugagguuuccaaauucuccauauccucacgaacacuuguuauuguccaucauacauucuagcauguaucaaauaugaacuccuaugauaagguuuagauuuugcaucucccucauggcuaaagauguugagcuuguuagguuuuuguuuuuguuuuuucugaaacggggucucauggucauccuggcuggaaugguguggcacgaucauggcucggugcagccucaaacuccuaggcucaagcaauccuuccaccucagccuccuaaacuaugccaccaugcccagcuaauuuuuuuuuuuuuuuugagacggagucuugcucugucacccaggcuggaaugcaguggugcgaucucagcucacugcaaccuccgccucccggguucaagcaauucuccugccccagccucuugaguagcugggauuucaggcauguaccaccaugcccggcuaauuuuuguauuuuuaguagagacaggguuucaccauguuggucaggcuggucuuaaacuccugaccucaugauccacacaccucggccucccaaagugcugggauuacaggcuugagccaccgcgcccggcccuaauuuuuuuauuuuuuguagagauggggucucacuauguugcccaggcuggucucaaacucgugggcucaaguaaucuuccugccucagccucccaaagugcugggauuacaggcgugagccauugcacuuagcuauuuguauaucaucuuuggagaaaugucuguucaauuucuuugcccauuuuuuaauuggguugucuuuauuguugauuuauuuauuuucuaauuuaauuuuuauuccccccaaauaaaaauauuauguaauuaaauuacauauuaaauugauugcauaauuuaaaauauaauguaauuaaauauuauuuaaaauaaaaauaaaauuacauaaacauauguauuuuuaaaacaauaguuuuacaaagcuuguuucucacuuaguguuccuauuccccaucagcaaccauuuuccacuuguuuuguuguuuuguuuugguuuuuaaauuuacuuucggcugagcacgguggcucacgccuguaaucccagcaguuugggagacugagguggguggauccugacuugaggucaggaguucaaaaccagccuggccaacaugaugaaaccccgucucuacuaaaaauacaaaaggcugggcacaaugacucacaccuguaaucccagcacuuugggaggcugaggugggcagaucaccugaggucaggaguuugacaacacggugaaacauggccaacauggugaaacccugucucuacuaaaaauacaaaaauuaacugggugugguauugggugccuguaaucccagcuacucaggaggcugaggcaggagacucauuugaggucaggaggcagagguugcagugagcugagauugugccaucgcacuccagccuaguggacaagagugaaacuccaucucaaaaaacaaaaaauacaaaaauuagccaggcaugcgccuguaaucccagcuacucaggaggcugaggcuggagaauugcuugaacccaggagauggaggcugcagugagccaagaucacgccacugcacuucagccugggcaacagagcgagacugucucaaaaaauuaaaaauauauauauauauuuuuuccauauuuacagaugguaugcuuauacugcuauuucuugauuuuccuuuuuucuuuucuuucuuucuuuuucuuuuuuuuuuuuuuuuagacacagucuugcucugucgacccaggugggaguggugcagugccaccaucauggcucacugcagccuugaccuccugggcucagacaauccucccaccauagccucugaguagcugggacuacagguguguaccaccacaccuggcuaauuuuuuaaauuuuuuguagagauggugucucccuauauugcccaggcuagucguaucaaacuccuaggcucaagcaauccugccaccuuggccucccaaaaugauguugggauugcaggugugugccauugcucucaggccuugauuuuucuuuucuuuuuuuuuuuuuuuuggagacagggucuugcucugucucccaagcuggaguguaguggcacagucucaguucacugcaaccucagccucccaggcuuaagcaauccucccacuucagccucccgaguagcugggacuacaagcacacaccaccacacccagcuaauuuuuguauuuuuuguggagacugaguuuugccauguugcccagacuggucaagaccugagcuugagccaucugcccaccucggccucccaaagucauaggauuacaggugugagccacuguacccaaccuugauucuucaguucacuugaccuccuaguauguauaaaagugggcccccucagcuucuguuccaaagguggaaaaacuggccuaugugggagguaugaagaaacaguccaguggcuuuggcuucaaguauggacucuggagcuggauguccaagcugaaaucccagcuuugcaacuugcuggcagugagacccugcacaaauuaguugaccucucuucuccucaacuuccucaucuauaaaauggaaauaauaauaauagugccaggcacgguggcucaugccuguaaucccagcacuuugggaggccgagguggguggaucaccugaggucaggaguucgagaccagccuggccaacacggagaaaccucaucucuccuaaaaauacaaaauaagccaggcaugguggugcaugucuauaaucccagcuacucaggaggcugaggcaggagaaucgcuugaauucgggaggcagagguugcaaugagccgagaucgugccacuguacuccuggcaacaagggcgaaacucggucucaaaaaauaaauaaaaauaauaguaccacuuuauagaguuguuauaagaauuaauugaacuuaucuaugaaaagcauuuagaauguauagguucuaaaagcucaauauguauucauuauuauuauuauuauuaacaugcucucacaaauauauauauucccccuccccauucucccuauuuaguuacauuacaguuuuuuaauaucagcauucaguguuuauguuauuaugacuguaacuguuaucuauucuaugaucacauuuccuuucuuguuugaauuuuaguuuucucuaaaguuaauaaauguuucauguuuacaucuguuacuuuucuaugaaccuaucauuaauucauccccaaucuuugcugaaaguuuauaaaucucauaaaagguucagacacaucagguaaucuaacagcuucaucuucuuggaggcaugucuccuauaagccuucauccacugcucuugucuggacugguuacuucuaagccuacugcaagauuuaagaacagagcacucaaaagcugaugauacucuauguacagguacuuauuuauggacuagaggacuuuauaagagggugaugaucuggccaggugauaucauugggagacuccguacugugacuauguugaagucuuucuuggggggcuuggcagaaaagaaucuuagucucggccaggcacgguggcucacgccuguaauccuagcacuuugggaggccaaggcggguggaucaccugagaucaggaguuccagaccagccuagccaacauggcgaaacccgucucuacuaaaaauacaaaaaaauuagccagguaugguggcaggggccuguaaucccagcuaaucaggaggcugagguaggagaaucgcuagaaccccggggauggagguugcaguaagcugagaucacuccauugcacuccagccugggcaacagagcaagacucugucucaaaagaaaaaaaaaagaaucuuggucucccauagaggauagaagccuggcuggaggguuccggaagaugaguggaaagagaaggauggaggucucaccauucaguguguagacuuucacuuauccuccuguuuuuaccaucgcacucucaucugugucucuaucuaaugucuaccuauccagagucucucugguaggacccuccaaaggguaaacacuccaggcuucugcugguuggggaggggcaguuaccuggaugcagagaguaguagaagagggcucaggggaccugauugcuacucagacauacucucaaccaggucuucuguucacccugauuuuaagaggcauggugccaucaacuccugaaauuuucugagauucugugguacguuaggccugcuucugggacucuuaggcuuaaugaaucaauuuaucauccagacugggacacuuuugagggugaaagaggauacuauuaauaauuauuaccagggcaucaggcauacaauauauuauccugggcaaaucaggaccaugacccuaggauucauccaacuacuuucuaguaucaaaacuuuuguugcuggccgggcgugguggcucaagccuguaaucccagcacuuugggaggccaaggugggcggaucacgaggucaggagaucgagaccauccuggcuaacacggugaaacaccaucucuacuaaaaauacaaaaaaaaaaaaaauuagcagggcgcgguggcaggugccuguagucccagccauucgggagccugaggcaggagaauggcgugaacccgggaggcggagcuugcagugagccgagaucaagccacugcacuccagccugggugacacagcgagacuccgucucaaaaaaaaaaaaaaaaaaaaaaaacuucuguugcuauugucuuguuaguucuuuuuguucugguaacuuaaagaugccaauuuuuuuuuuuuaucccucuacauaauuuuagugggguuucaagagagagcagugauguaugcauauguucaguccaccagcuuucaggagacaggcuucauucuucccucuuuaucaauggagaaaguagguaugaaggggcugugugacuguacucagaguuauuugguuuuaaguaaaagaaaccuugucuaaacaagcuuaagcaaagggagcguuuagccuguugcauccaaagaagggcugaacaaccacguugugggaaaagcagagauagagcuggggggucagcgacucagaaucacaaacuggaauacuccaucuccugucuaugcuucccuuucauuucaccuucaguccccuguccuggaaucuggcuuucuuccuguggcagcaacauaaccacugaugguggcccaguguuauauccaacacucagauucccuuucuagacccaaaugcaaaauucuagaaaggagucuuaauguuccaacuaagacuacauguucauccccagaucagccaacuuggcugggccagguguggugugugggguugcugguuuguguaaaaucagguucagccuccaccauagucauuugugcaaagucaggcuggggccagugccuaggacuauugccuaggacuagggaauaaucccauagauuuccucaacaguaacuuggccaaauccacgugauguuagugaugggcuugaaaaguaaagcugagccaggcgugcuggcgugucacgccuguaaucccagcacuuugagaggccgaggcagguggauugccugaggucaggaguuugaaaccagccuggccaacauagugaagcccuuucucuacugaaaauaccaaaaaauuagccgggagugguggugggcgucuguaaucccagcuacuugggaggcugaggcaggagaauugcuugaacccaggaggcggagguugcagugagccgagaucaugccauugcacuccacccugggcaacaagagcaagacuccaucucaaaaaaaaaagaaaaagaaaaaagaaaauuaaagcugaaaagaugaggacucaguaccuugcugggauugcuaaguuauaaauguucaaccuuugcuagugaugacauaagggacaguguagaaacucuaacauuuaaaacuauucccuuucugccucuucugcaaaaucauuuacauagaucuacauguguuagaauuugguuuguuuuccucuucugcaucagauuuacaauauuuuauuuucuguaggcuagcuuuugcuuuacucuucugauuguuauuuaaaauggccaaaaguuucucauuuaaacauuuaaugucacagaauuuuaggauguuagaaguggaagaggauuuagaauauuuaauuuauauuucacagaaaugucccuggcacacuaacuucaugagcugcuccuuugaaauaaggucuuccuggucaaauaagcuuagaaaaugcuguauacaacuagacauucuccucuuggagacucaguacauguuagccuauuaagaagucugcgaaguccugcagcaaaaaaaaaaaaacccacaauuuccuaaauucauuuaccaagaacccuuuuuucaucauaagcaggccaaguuccuugaaagauacuuugggaaauaaugcaaccgucuuauuuuaugaauuagguaacuaaagcucaugaagagacaauaguuuauaauuuuccaaaguuaaugccaggaagaauuagcacucauuagcaaugcaaguuaccaguuacaguaaccccgaguaucugggguuacaggcgccugccaccacgcccaacuaauuuuuuuguauuuuuuguagagacgggguuucaccguguuagccaggauggucucgaucuccugaccucuugauccgccugcccaggccucccaaagugcugggauuacaggcaugagccaccaagcccagccuugaauggccugauuuucuuuuuuuuuuuuuuuuuuuuuuuuuuuuugagauggagucuugcucuguugcccaggcuggagugcagaggcaugaucuggcucacugcaagcucauggguucacgucccagguucacgucauucuccugccucagccucccgauuagcuggaacuacaaguucccgugaauggccugauuuucaaaaaugguaaauugcucuuuguaaaaucccaaagaaauaaaaauacucucucaguuuauaugguaguuguguuucugaaaaauagaguauaaauuaaaacuacacaaaacacuuuuauuuaggcauuuacuacaugacagcacuuauaucugugugcuuuacauuaauuaauucaccagauccuuauaguaaccccauuucaguaugauuacuaucacucuuuuuucuuuuauuuacggccagcuuccuaagccaaauaggcucacagaauucugcuaucccuauuuuaaacaugaggagacuaagacgaagaagcuaaguaacuuguucaacaacuauuaaauggcaggccaauagaugaacccaggcagugcagcuccagagcucacacaccauuuucuaugucccugucaccugaagaacuccaauucugagucaccugggcauucccuacacagaucauggccaacagaaggcugcuuccaaucccagaaaccaugaaauccaaaaggaaaagaggccagaccacaucccuuuggcguauuuacugcuagcccaggagaaugaugagacagugaugggaaaguguucaggcacccggguuuccugaccucccgggaccugccaacaggagcucuguaagagagcaaaagcaggaaacaaccuuggcuucuuucuuuacccuuccucaugcuccccuaccucuugccaaaagcacaguccaaccacagacuacgcgauucagcaacuucccacaauguacacagaacugaaaaaagcaugggguagagaaaaacugaaagagaccagacaccuucagggcugccaagcuggggagucaguccugggacuuuuccuccuugucuacaaccugauucggggauuauuucuucccagagagugauuauucugauaaucagaugggccuacagguugcaaaacccauuuaucuuugcuccauccucugaaagggaggaguucugacuaaguguacccuccuuggggugacgcgaaaugacagccuggauugaugcucugggguuuguuccagcucauugcucaucaccccauggauuguuugcucauagcaaaucugcgccaaauaaauuccauguccuccaagguuugauacuuaauaguaauauaacuaauccuguuuaaggguuuauuguaugccaggcagagugcuaaauucuuuacauuauuaucucacugagucccccuaacaaccuugugagagacauaugcuuauuaacucuauuuacagauaagaaaauucagguccagaagguuuacauucggaugccacacagccaguaagcaggagaacugaaugcaaacccaggcuaucuuauugccagcuuggcuguucugaaggaacuaauuagaacuggcuugagaucauacuugaggaagaggugaaguauuacaaguguauuaggacaaaccuggguuccugagacuucugcuuccuuaaccauuggacuuuucucuuuuuuuugagacggagucucgcucugucacccaggcuggagugcaguggcgcaaucucggcucacugcaagcucugcuucccguguucacaccauucuccugccuuagccucucgaguagcugggacuacaggcgcccgccaccacaccuggcuaauuuuuuuguauuuuuaguagagauaggguuucaccguguuagccagaauggucuuuaaccacuggacuuuucuacucuuuuuuuuuuuuuuugagacauaguuuugcucuugucacccaggcuggaauacaaugcugcgaucucggcucacugcaaccucugccucccaggucuaagugauucuccuuccucagccuccuaaguagcugggauuacaggcacccauuaccaugcccagcuaauuucuuuuuuuuuuuuuugagacggagucuugcucuguugcccaggcuggagugcauuggcgcuaucauggcucacuacaaccucugccucccggguucaagcaauuaucccaccucagccucccaauuaucugggaaguguacgccaccacgccuggcuaauuuuuuguauuuuuaguagagaugggggucucaccauauuggccaggcuggucucgaacuccugaccucaagugauccaccugccuuggccucccaaacugcugggacuacaggcgugagccaccaugcccagaaauuuuugcauuuuuaguagagaggggguuucaccauguuggccaggcuggucucgaacuccugaccuuagguguuccgcccgccucagccucccaaaguucugggauuaaaggcgugagccaccgcgccuggccacuuuucuuuuuucuuuuuuucucuuuucuuuugagacggagucuugcucugucaccaggcuggaguguaauggcauaaucucugcucacugcaaccucugccucccggguucaaaugauucuccugccucagccucccgaguagcugggacuacaggugcacaaccaccacacccagcuaauuuuuguauuuuuaguagagacgagguuucaccauguuggccuggccacuuuucuacucuuuaauucuccugggucaacagguacuuaguuacccagggaugguaagggaacuauagccagagagaucuuccugagaugcaaaucugcuaagucuggucccgacuaauaauuuuucagugguuucuuguggucuaucagaugaaggucagacuccuuugcaugacauacaaggcccuuuguaaucuggacccaccugccuucuaugacuuucugucccaugcuugccuucuuaugcccugagaagcucauggcagccccagaauaaucugccauccugauuccugccuccacaucuuggucacaucuugguccauacuguuucuuaugccucgaaugccuuccuucccccagcuauccaucugaugaguuuguauuaauccuguaggacuccgcuacauguuauacuuuuuaugaaaaggcuuuuuuuucuuuaaguuuaauuaaaguguaauagagaugagguuucaccauguugcccagguugcucuugaacuccugggcucaagugauccgcccaucucagccucccagaguucuaggacuacaggugugagccacugcccccagccuccauucacuuuuauauucccaaaagcuagcacuuugcccuguuuaugagugaaugaaaucauuucuguaagaggccuggccagccugggcaacauagcgaggccucaucucuacuaaaauaaaaaauguagcuuaguauaguggugcaugccuguagucccagcuacuuuggaaacugaggcaagaagaucacaugagcccgggaguugaaggcuacggugaauuaucauugugccacugcacuccaccccaggcaacagagaagacucugucucuuaaaaaaaaaaagaaaaagaaaaaaaaaagaggcauggaacauugcucuuaaauuccuucguacccaccuuugcaauaaaugacuuuuuagaucuugaucuuuaaccgggaauucuaagccaggcaugguggcucacaccuguaaucccagcacuuugggaggccgaggcgggaggaucacaaggucacgagaucgagaccauccuggccaacauggugaaaccccaucucuacuaaaaauacaaaaauuagcugggcgugguggcgcacgccuguggucccagcuacucgggaggcugaggcaggugaaucacuugaacccgggaggcagagguuacagugagccaagauagcgccacugcacuccagccugguaacagagggagacuccgucuaaaaaaaaaacaaaaaaaacaaaaaaauaaaagacugggaauucugggacuuccaaaaucuaguauucagguuucccaagagcaaaaguugccucaacaaguuuucuuaagaucucuuaaggagggaauuuugccuccuuacuuggaaacaccuacaggguuuuuuuguuguugcaguuggguuauggaccugcuaucaccaaaucagcugagugaaggaguccugaggcagagugacagaaugaauacugauguucggcuagaaucacucugcuuuucaaaauuuggcuucuggcuggacgcaguggcucaugccuguaaucccagcacuuugggagggcgaggcagguggaucaccugagggucaggaguuugagaccagccuggccaacauagugaaaccaucucuacuaaaaauacaaaaauuagcggggugugguggcaugcaccuguagucccagcuacacaggaggcugaaagcaggaccugggaggcagagguugcagugagccgagaucgcgccaccgcacuccagccuaggcgacagagugagacucugucucaaaaacaaaaaagucaucuucccauuauauuuauauuuauuuauuuagcugucaaaauuuuagcauauguauuuccuuuaguucauccccucugggcagagguuuuugccauaaugcuugcucccagccaaggaggaaacugcauuuaucuuaucuuuucaucuuccuacagaaugcauuuccggccgggcgcgcgguggcucacgccuguaaucccagcacuuugggaggccgaggcgggcggaucacaaggucaggaaaucgagacaauccuggcuaagacggugaaaccccaucucuacuaaaaauacaaaaaauuagccgggcaugguggugggcgccuauagucccagcuagucaggaggcugaggcaggauaauggcgugaacccaggaggcggagguugcagcgagccgagaucgcuccacuggcacuccagccuuggcgacagagcgagacuccaucucaaaaaagaaaaaaaaagaaugcauuucgguagccugugacuuucucuaucuucagacucauacuucacauacauauguuuaagaacaaauuuuuaaaaauauuuguggggaaaagaugcaauuuuaauuugugggucaaaacuuauucugaccgccugccuucuggaaaauaaaaucauuguggauaauucagaaaauuccaagaagugcaauaaguuauguccaaaucacuuugccuguaccugaggcuuagacuuuucauaggcaaagucuauaaaaaagugaccucuccuuuugaaaccaugguaucucucuugcagucuccuagccaguguuuuugccuaccauccugcauccuuauuauuagauuguuaguuuccuggggagcaucuuauuauuauuagauuguaagaguuaccuggggagcauaaaaggaaauuuaauuuuaauuuuuauuuauuuauuuuuuuugagacggagucucacacugucacccaggcuggagugcaguggcgugaucucggcucacugcaaccucugccucccggguucaagcgauucuccugccucagccucccgaguagcugggauuacagguaccugccacugcgccuggcuaauuuuuuuauuuuuaguagugacaggguuucaccaugugggcgaggcuggucuggaaccacugaccucgcgugauccacccaccucggccucccaaaguucugggauuacaggcaugagccaccgcacccggcccauaaaaagaaauuuaaaaaaaaaaaaaaaaaaaaagaaucagccaggcgcagugccucaugccuguaauccuagcacuuugggaagccaagguggugaaucacgaggucaggaguuagagaccagcauggccaaauggugaaacccugucuguauuaaaaauacaaaaacuuggcugggcgcaguggcucaugccuauaaucccagaacuuugggaggccgaaacaggugaauuguuugaggucaagaguucgagaccaaccuggccaacauggugaaaccccgucucuacuaaaaauacaaaaauuagccagacauaauggugcgugccuguagucccagcuacuugggaagcggaggcaggagaaucgcuugaacccagaaggcggagguugagccaagaucgcgccauuacccuccagcccgggugacagagccagacuucgucugaaaaaaaaaaaaaaacacuggggccgggcgcgguggcucacgccuguaaucccagcacauugggaggccaaggcgggcggaucacgaggucaggagucaagaccauccuggcuaacacagugaaaccccgucucuacuaaaaauacaaaaaaauuagccgggcgugauggcaggcgccuguagucucagcuagucaggaggcugaggcaggagaauggcgugaaccccgggggcggagauugcagugaaccgagaucgcgccaccgcacuccagccugggcgacaaagcgagaccccgucucaaaaaaaaaaaaauuagccagugugguggggggcaccuguaaucccagcuacucgagaagcugaggcuggagaaucgcuugaaccugggaggcaaaggcugcggugagacuccaucuccaaaaaaaaaaaaaaaaaaaaaaaaaaacaaaguucuuugggggauuuuuaaugaguagugaggauggagaaucauuaacuagaaugaugguaucauucagaggcaaugguauucacucugggcagcguagccauacuuuucuucuucuucuucuucuucuucuucuuauuauuauuauuauuauuauuauuauuauuauuauauuauuuuguuuugagauggagccucugucgcccagacuggagugcaauggcacgaucucaacuaacugcaaacuccgccucccggauucaagcaauuccccucccucagccuccugaguagcugggauuacaggcaugugccaccacgcguggcuaauuuuuguguuuuuagcagagacgggguuucaccuuguuggccaggcuggucucaaacuccuguccucaaaugaucugcccgccucggccucccaaagugcuggauuacaggcauaagccaccacgcccagcucuacagccauacuuuucuggugugggugggagguuguuuuuuccagucugguccaugccaugcguauauuagcacauaauacaaacccuuaccagagccucugaugugucagggacucuggguuuuuuggccuuugauccuacuguagcaccuuauguuccugaagcaucuugcacagagcauugaauuccagugagcaaaugcccuaaggauugcagucugcacuuccccuauccacagaggcaugaccugaggcugugugaucagagcaagccugaggugauucagagugcccuaaagcaaacuggcauccuaaaggaagccuaaaccauggagucagccaccagccuuucugcugcucccuaucuucucucaccagccaggcaccauccaaauaaacaacuuuugauggugcaggaggaagaucaaauucucugcaugguguccucaugcauauuggauuuccuaguaaugcacauaugaaaaacaaaguuugugaacuuagaucugacagaugcagauuugaauucuagcuauuuguccuugagcaaaucucuaaaccucccuaaccuccugugcccuaauucauaaacuggggcuaauaauaccugcuucauaggguuaaaugagauaauguguguccagggcuuagcacaaugacugaaauguaguaaacacucaaucagcaguaguagugagccuuuuucagaugcugucuaaucccacgugggaggcuuuccaugcagaaaggaaauagaaguguggugcccucagcggggugucugcauggagaucuugaaggacuggaaacaaugaagccuguucccccauaugugaucacugaguacaguuugaaagcugggguuguacucacccucucaggacaacacucccaaucucuuuucucguaagcaguagccugcugccuuugcacacacuucgaccauuuucccugcugcuuugugcuauuucagggcuuguggggguguaggaaagcugccgccuuccucagguugcuauuuaaagacauucugaaacauuuugccaccgcugcuccugccaccacagcugccacuccugucccagcugcagggagcugcauggucacugaccacuccagcccuugggcagcaugccucagcauaagccagccagggagcacacacaguuagguguugggaguucugaccgccuauuuuuuguuuaggacuccugagcuaucaucccucccaaggguuaacugcuacccaccaucuuggucuuugucccuaaacaaccuaaacuguccaugucccuguagcauuuuuggcacuugaccaguuaaauauuucucccuuuuucucaggaaaaaccacacaugauacccgccucaucuccuuuccaccccaucuccaauuugcacuuuagaugcucuccucauuuaguagccagaaaggguaaaagugccauuuaucucuaggucuagcagagaaaaauacucuuaaaauaaaagguuuuugaaaagcucaguaaccuccaguuaauaauaaugccacugugaacuucaguguguuugagauuuucuaucugucaggcauggguagaaaucucuuagacauuaguaauccugccuuucuuuacugaccguccugacgcuuucagugaagugucucaaaagccuggucuuucagguuugaauuggcccuaauuucuuuuucauagacccaucaaagugaaaguuuggguuuuaucaggaaagcauuauucuucuucaguccagagcuccugaaugagguccagauugucuguguccauucugcuuccccaauuuauuuguuuccugcccauuaucuuagagaggccacucgccucaaagaccuuggagucuggccccuuucugcuuccccggcagaauucuuccugaugcuuuccauucugcagcauagcuugaucagagcuuccagugugccagcuaccaacaucaucugaccugcgcuggccugauacuguguucagacuacauuaaauucauuuccccgcaucuacgccaccucccucuuccucucacucgccuucauuuauucaucugcccagccacucugccuuuggcuucuccucucuagucuuuguuuucagagcugugccuuucccccuccuauucauucauucauucauuuguuuauuuauuuauuuauuuugagauggcgucucgcucuguugcccagguuggagugcaauggcgugaucuuggcucgcugcaaccucugccucccagguucaagcaguucucuggccucagcuucccaaguagcugggauuacaggcacacaccacaaugcccggcuaguuuuuuuguauuuuuaguagagacaggguuucaccauguuggccaggcuggucuugaacuccugaccuaaagugaucugcccaccuuggccucccaaagugcugggauuacaggcauaagccaccgcgcccggacuuccccuccuauucuuauuccuuggugguaaacccaauuuucuuaauguggugguaauaauaacaauacuuugaauuauuuaucacuuugcugaugauagugaaauacucucacauacauuaucuuuuuugauccccacaauauacucguaagguaggugguuauaugugccuuaugccucccacuccaugguagugaaaauaauaaccacuuugagaggcugagguggggggauugcuugaggccaggaguuuaagacaagccucggcaaaauaucaagaccccgucucuacaaaaaauuuguuuuuguuuuugagauagggucuuucuugcuucguuacccuggcuggaaugcaguggugcaaucacggcucaguauagccucaaccacccaggcucaagugaucuucccuccucagcuucccaaguagcugggaccacaaaugcgugacaccaugcccgacuaauucuauuauuucuuguagacaaagggucuugcuguguugcucaggcuggccucaaacuccugggcucaagcaauccucucaccuuuaccucccgaagugccgggaucauagguaugagcuacugugccuggccuacaaaaaaaauuuuuuuuuuauuagcugaggcugggcacgguggcucaugccuguuaucccagcacuuugggaggccaagacggguggaucaccugaggucaggcauucgagaccauccuggccaacauggugaaaccccaucucuacuaaaaauacaaaaaauuagccaggcguguuggcgggugccuguaaucccagcuacucaggaggcugaggcaggagaaucgcuugaaccuggagaccugggaggugaagguugcagugagccaagauugcgccacugaacuccagccuaggcaacaagagcaaaacuccaucucaaaaaaaaaaaaaaaaaaacgcugggcgccguggcacacgccuauaaucccagcacuuugggaggccaaggcgggcggaucaugaggucaggaguuggagaccagccugggcaacauggugaaacccugucucuacuggccgggcacaguggcucaugccucuaaucccagcacuuugggaggccgaggcgggcggaucacuugaaguugggaguucaagaccagccugaccaacauggagaaacccugucucuacuaaaaauacaaaauuagcugggugugguggcacaugacuguaaucccagcuacucgggaggcugaggcaggagaauugcuugaacccaggaggcggagguuguggugagccaagauugcaccacugcacuccagccuggacaacaagagugaaacucugucucaaaaaaaaaaaaaaaaaaagaaaauaaaccccaucucuacuaaaaauacaaaaauuagccaggcaugguggcacaugccuguagucccagcuacucgggaggcugaggcagaagaauugcuugaaucugggaggcagagguugcggugagccaagaucacaccacugcacuccagccugggcaacagagcaagacucuugucuugaaaaaaaaaaaauuaccugagcauggugaugcacaccuauagucccaacugcuugggagccugaggcaggaggaucaccugagcuucaaggcugcaugcagugagcuaugaucgugccacuguaccccagccuggguacagagagacucugucucaauaauaguaauagucauaauaaaaaccgcuuugagagacgguacaguauagugauuaauaaagaacacuacucuggagucaggcuaccaggguuugaauccuggaucuacccauuacuagcugugugaaccugggcaaauuggaaaugauaauuguguuguggggauugaguuaauguagacaaaaugccuggaaucauaccuggcauauaccaaguacuauguaaggauuagcuaccguugccauucauucauucuucaaagauuuacugcauguuaggcucucuuccaggccucagugauguaagaguuacaggauggacauaguccuggcccucacagaggucacagucuucacugacaaaccaucacuucuuuagcacccaccauuugcaauuccuugugcuuggaucuuuguuuuuguuguuguuuugagauggagucucgcucuugucgcccaggcuggagugcggugacgccaucuuggcucacugcaaccuccgccucccagauucaagcaauucuucugccucagccucccguguagcugggauuacaggugcccgccaccacgcccagguaauuuuuuuccuauuuuuaguagagaagggguuuugccauguuggccaggcuggucucgaacuccugaccucaggugauccacccgccucagccugccacagugcugggauuacaggcaugagccaccguacccagccauguuuuuggaucuuuagauacauuaauucuuauugcaaccuucaggaggcaaacuuauucccauuuuauagacgagaucacugggguuccuagaagugaaguaguuuguucaagauucccuagcuaauaauugggagcucuaggguccacuucacucaguuugccugccuccugaccauuaggcuuaauucugugugucugccuccccaacagggugugagcuccugggugugggagccauucagcagaauacuuagccuagucuccugcacacaaugugggaaauuuugcugaguuguucucuacugacaauucuugacucucugccccguaauagucucaucuguucccucucacaucucuuagccacaaaaucacaucuugggcaagaugaaggugcuuagaaguuggacuguugcuuucugacagauucauaccacaccuaaugcuuauuccaacauguuuuuaaacagaacuagucggauucuggagucuucucuucuggaccucaaucuagagaaucuuuuuuucugccaggacaaucuccagccaccagcuccaguucaccucuuuccccugucuucaccugucuuauuauuucgguguauaacuugcguguuauuccucuguuuuugucuuugugccucuuauuuauuucucaaccacaaagggagucacaauuggugguugauaggauuguguggaauguagccuucuuucuuuuugaucuuuguuugcuucaucucuuguuucuauagaauauugaauuucuaaauacaacuguuacaaggaaaggggucuccauuccagaccccaagaaagggaucuuggaucucgcgcaagaaagaauucagggcgaguccacauugcaaaguaaaagcaaguuuauuaagaaaauaaaguagugggccaggcacgguggcucaugccuguaaucccagcacuuugggaggccgaggcgggcagaucacaugaggucaggaguucaagaccagccugaccaacauugcaaaacccugucuguacuaaaaaaaaaaaaaaaaaaaagcuagguguggcaugugccuguaaucccagcuacucaggaggcugaggcaggagaaucacuugaacccaggaagcggagguugcagugagccgagaucgugccacugcacuccagccucggcgauagagcgagacuccuucucaaaaaaaaagaaaaagaaaagaaaagaaaguagugaaagaauagcuacuccauagacagaguagggcauuccugaaaguaagaggaggaacacguccacccuagguacaaugcuuauauauauaggauagaaaaagaucuuggggccaggcgcaguggcucacgccuguaaucccagcacuuugggaggccgaagcggggggaucaccugaggucagaaguuuaagaccagccuggccaacauggugaaaccccgucccuaauaaaaauacaaaaauuagccaggcauggaagugcuugucuguaaucccagcuacuugagaggcugaggcaggagaaucacuugaaccugggaggcagagguugcagugagccaagaucacaccacuacacuccagcccgggugacagagggagacuccaucucaaaaaaaaaaaaaacaaaaaaacacacacaaaagaucuuggggagaugugcucugcuacaaggguuugugauaaaugauuaauuuucuuaauugcuauaguuugcaagaaucaauauuauuauuauuauuauuauuauuauuauuauuauuauuuucugagacggaauuucgcucugguugcccaugcuggaauguaaugggguggucuuggcucacugcaaccucugucucccagauucaggcaauccuccugccucagccucccaaguaacugggauuacagguacccaccaccaugcccagcuaauuuuuguacucuuaguagagacgggguuucaccauguuggccaggcuggccucaaacuccugaccucaggugauccacccaccucuggccucccaaagugugauuacaggugugagccaccauaaaauuaggaaugccuuuguuaaagcaaaauuuaggaaugccuuuguucccagauacugggauaucuggacacuuccaagucugagucuguuugguaaacauuaucaaucuauucccuuaaccauaaacaccuagaaguuaggaaugccuaacuucuggaaaugcagcccagcaagucucagccucauuuuccagcccucacucaaaaugcagucacucugguuuuaacgccucugacacaaugaguguaugcuagcauuuaacguuuuuguccuuuuauauuuagcaacucauuuuccuauuaagaaguuauagauggaaaaaccucugcuagaucaccguguccagaguccuuuuucuguaaaugucuuauuuuugaccauucauguuguguuuuguugaucucacacaauaagaacagaauagccauuucauucaccaaguuccaguaguaaaaaacaccuugaaauguaaaugaccuuuaaaauauuaaaauaauuuuuaaguguaaaugaaucuacucauuaccgucuuuacucauggagcuuguguuagagagguagucuaacuagagccuuuuuucuuccucuauuuucauauauucuggauugugguaauaugguuuuuauaaucaaacaaaucaauuuaggaaguaaagagaagaaagauauuugccauuuauuucuucuuuugaucuuaaagauacaaccacuccgcaaauguuccaggucaagcucauugaaagagucaaacacugucuuccugcuuuuccauugaaugugcaccugugugcccaaggcagucuuuuacucacaccuucccuuuucaguuugccaagccucuucugguccuuucugagccacgucuaacccuaaagacugcccuugucccugaagcuucagcuuuguguguuucaggccaacuggcgccuggaaagagggagggugaagagagagggagaccguguguguguguguguguguguguguguguguguguguguguagagagagggagaccguguguguguguguguaugugugaagagagagggagaccgugugugugugugugugugugugugugugugucacaugcgcucucuaaauucuuuugauaaagaaucugaacgccacucccuuccaaagaguuuucagaccaggagucuggguacuucuuuaagauauccuuggccuaagcuucucagauggugaaaguguuuguuucaaccacugacugcaagcagcuaaacuagcuuuccugugaaugagacgcacccagccuacucacagccauacccacuccaccuugcccuggaguccuugggccugauacaguugggggaugaacagcaggugugcugaacucauaaugagagguuuccgcugugggauugccuauauccugcccccgacagaggcuccuguaacuuuaccuuugaacucuccuuguauucagccccugauccaugggauuuggugacaaucccuggcuggcaggaagcuuugauccuuggggaguccagaggaaguccuaugaugugugggaucccuagagucacagggauugggaagaagcucuauaccaggauggguugcuaagauagacccauuaauuaagcaggaggcuuugcuuaacacucaguuacuaaaaacagagauccgguaacugauaacagggagcucagcaccccucaaguguggaguggguuuugcacaggcaguauuguuauuuuaaggacacagaagugcccagggggaaauuccuacccacacggagaaagagcagaauaccugugaguaucccuuuuuaacaaguaaaagcugacuuuacuuugaauguuaggaggcucuagcaaaaaaaucucaaagauauuucuaagugaaagauuccucuaaaaggaaaaaaaaaaaaaagaugaccuuguaacaaacacuggaggauggggcacaggaagccaggagagcagccugggugacagagugagaccuucuuuaaaaaaaaaaaaaaaguggaagcucuagaauuucuauauauagagaugcuuugggcuauaauccauuggagagaguguugggagauuugucuuuaggcuguaccugcauagcaagcaugcugguuuugcuuggaaacugccuucuuuuugugauggccugggagcuggaacuuacuaaaguucccccaagccauuuccuuggugccacccacuggcugggaauaaaugucagagugaaggcacuuucacagagcagguacagguuccucuuccuccacccaccuccaaaggcggaaaugacuuccuuugcuuccagagaauugccugcguuucucucuuagaacggagaucacuccaugugggguguguguacugccuccccacagggcuguagcugccaccugggaggguucgugccuuauucaucuuuuuuaucgccagcacagugccugggcaugacagaggcccauaguacugauuauugaaugagugaguaaucaugaggcaauagcgguggagagucauccucugccgggaauuagcucauuuucaugcggccagccucaggaaaaauaagacuuccuugcccaaagacagguuagaaagggcacucgaagccaggccugguggcucacgccuguaaucccagcauuuugggaggccgaggccggcagaucacaaggucagguguuugagaccagccuggccaauauggugaaacccagucucuacuaaaaauacaaaaauuagcucggcaugguggcgggcgccuguaaucccagcaauaugggaggcugaggcaggagaaucgcuugaacccaggaggcagagguugcagugagccgagaucaugccauucacugcucuccagccuggggggcacagagcaagacuccaucuuaaaaaaaaaaaaaaaaggcacucgggugaggccacagagucaggcccccgaccuaggagaccugacuguggcucagaagcucccugagaaagcccaggagguaacugcccagcagggaccaggcagcaucuuccugagguuugcucacaggacucaggugcuucacguggugacacugggcuaggagcauugaggguuguuugcaggcugaccguauaauaugugggucccagugcagauuaaaaugcagggcuccuugcuagggaaaacaaauaacaacaacaagaagaaaguaccauuagugcuguguguguguguguauauauauauauauuacagaaaaggagucccgauccagaccccaaaagaggcuucuuggaucuugugcaagagggaauucagggcgagucugcaguggaaaguaaaagcaaauuuauuaagagaguaaaguagugaaagaacagcugcuccauagacagaguaggacguucccgaaagaggaggaacguguccacccuagauacaauacucguauauauggggcgaugugcucugcuacaaggacuugugauaaaggauuaauuuucucaauuacuauacuuuacaaguaucaaauuaucaucuuuaaagcaaaauuaggaaugucuuuguucuccagauaucgggauaucuggacacuccuaagucugagucuguuugguaaacauuauuaauucauucccuuaaccauaaacaucuagagguuaggaauaccuaacuuucugggaaugcagcccagcaagucucagccucauuuuccagcucucacucaaaauggagucacucugguucgaaugccuguguguguguguguguguguguguguguguguguguguguauaauuauuauuauuauuuuuuuuuggaggcagaaucucgcccuauugcccaggcuagugugagguggcgccauucuuggcucacugcaaccuccgccucccagguucaagcaauucuccugccucagccuccugaguaucugggauuacaggcaugcgccacuacgccuggcuaauuuuuuaguagagacgggguuucgccauguugcucaggcuggucucgaacuccugagcucaguugauccacccagcuuggccuuccaaaagugcacagauuacagguauaagccacugugccuggccugaaauauaauuuuuuuccuuccaaagucugcuuuuuuuuuuuuuuuuaagagauggggucuaagucucucucucaacuugucaugauguuuauuauuugcuggagaaaaauuaaaauguuaaauuauuagcaugaauuuuacuguucaucuuuacauugugcaaugccaauucuaaaugcaaauauaagagcauuagcuccuacacagaaucacugaaauuacacaauuuguauuucauaguuuacacaugcauauguauuuccuucuuagcagaacaguagaaacucuacacaacacgaauucaacuuuuauuuuuuuuuuuuuuuugagacagggucucacucugucacccaggccagagugcaguggcaagaucauggcccacugcagccucagccuccuggguucaagcaauccccucaccucagccucccgaguagcugggacuacaggcacaccccaccacaccuggcuaauuuuuguacuuuuuguagagaugggguuucaccauguuguucaggcugcucuugaacuccuggggucaggcaauccuccugccuuggccucucaaagugccgggauuacaggcauaagccauugcacccagcugaauucaacuuuuuuuuuuuuuuuuuuuugagacagagucucacucuguguuacccggacuggaguacaguggcucagucucagcucacugcaaccucugccucccggguucaagcgauucccguuucagccucccaaguagcugggacuacaggcgugcaccaccgugcccagcuacuuuuuuguauuuuaguagagacgggguuucaccauguuggccaggauggucucaaucuccugaccucgugaucuucccaccucgcccucccaaaguguugggauuacaggcgugagccaccgcgccuggccugaauucaacauuuuuauuucauuucuuuuuuuuuuuuuuuuuuuuugagauggagucuugcucugucucccaggcuggaaugcaguggcacaaucuaggcucacugcaaccuccaccucccagguuuaagugauucucgugccucagccuuccgaguagcuggaauuacaggcacccaccaccacgccuggcuaauuuuuguauuuuuaguagagacgggguuucaccauguuggccaggcuggucucgaacuccugaccucaggugauccgccugccuuggccucccaaaaugcuaggauuacaugcgugagccaccgugcccagccucauuucuugauacauuuacauucgaccaacacugucuaccuuugauuuacugauaagaaaggacugaaaggaacaagaauaauggguugcccugcugugccauuauuuucaguguaaaugacuggcuaaaacaaggaagugaaugaguaagaaagaugcagucggguuccaugguccucuguguuuuuuagaaagccauugccuucuuucuguguucgaagcaacgcauggaaagugcaugaaaagugucgccucuccaagcuguuggggccuccauuugcccacucuuaaauguaacagccaugccugccuuguacuugcuucuagccuuguugcccucccccauauggugaguccaccagaauccugugcuuauggggcacagugaacuccagaugcaaaugcucuggcaaagaggagugaacacaaucuuaccuccuccacugacauucacgcucccugucccauuggaguucauuuacaaaacacagguucacaggaggcugaggcaggagaaucgcuugaacacaggaggcggagguuguaguaagccaagaucgcaccacugaacuccagccugggcgacagagcacgacucugucucaaaacaaaacaaaacacacacacaaguugaaaaauaagauuauuacgaauuuuuuuuuuuuuggagacagggucucacucugucucccaggauagagugcaguggcacgaucacaguucacugcagucacaaacuccugagcucuagggaucuuccagccuuagccuccaagcccuagacugcaggcgugugccaccaugccuggcuaauuuuuauuuuauuuuauuuuauuuuuuuuuaguagagaugagguccugcuauguuacccaggcuggaagaauuuuaggauggcaacagcagaucauuagaccaagcaaaccuggcccucuugagcaugggaccuugugugacugcaggucgcaacccuaguugucuggcaguguuucagucgacauucuuaggaguuucugcuuuuaccaguugagagacuagccaggaguggcacgcaugaaugccuuuauucacucauacuuuuuuuuagguaugagcaauguaccagucacuuucugaggcauuggggcuauaccagauugaaaaaggcaaggcugccaggcaugguggcucacgccuguaaucccacccagcacuuugggaggcugagauggguggaucacuucaggucaggaguucaagaccagccuggccaacauggugaaacccugucucuacuaaaaauacaaaaauuagccgggcgugguggcacgugccuguaaucccagcuacucgggaggcugaggcacaagaaucgcuugaacccaggaggcggagguuggcagugagcugagauagagccacugcacucaagccugggcaacagagcgagacucuuucucaaaaaagaaaaaagaaaaaaaggcaaaacauggccucagugucaauaguacuuaccaucuagagaggaaaaccuuuuaaaguacacaauaaauauuuauuuuauuuuuuauuuguuuauuuuuuauaccaccagccugccccacaacaaauauuuacauuacaguccugauaggggcuacaaacagaacuccgggaagggcaggaagacuuaccuaggugcggggguuagggaaagaaucccggaggccaaggguauaagaguccuaggaagaggaagcaaaauauuaauagccucccaggcugagggacuagcauaugcaaaggccuugagaggagcuuuguucaggcaagaaaagaaagaaggccggcacagcuggagcacaggcggccagagggaggcccgcuguggggaagggucggccuggggagcuuguucuauguagcccuuuccccugacuuccugccuucacuccccaguguccaugcugaucaggaauaucgaaagauggaaaggcucuugcucucuucuuauagcaaguccaagacacguggugcuagacacagucuacuugguggaaugcucaggggacucugggcccagaccaugugcuuguuacccgcugaauuaacuauuucccaucauuuccauucgccaucuccagugaacuuuccuauuccuaaaauguggccucucuuuucucugaugucucaucacucucucucugcucccugugaccuuuaccauguucuauucuguauugucugucuuuacgugacuaucuucuuauucauccccacuagaccagaagccuuuuaaaggcaagaucuagauguuuccauuguuaaauggccuuacaaagucuuugcguagaguugacuaaguuaaauauacguuucuguauuuuauuuuauuuuuauuuuuauuuuuugagacagagucuugcucugucacgcaugcuggagugcaguggcgcaaucuuggcucacugcaaccuccagcuccuugguuccagugauucucccaucucagccuccuaucucagccuggcauuacaggcaugcaccaccacgcccagcuaauuuguguauuuuuaguagagacaggguuuugccauguucgccaggcuggucucgaacuccugagcucaggugaucugcccgucucggcuacugcacuccagccugggagacuuggucucaaaaauaaaauauaggcugggugcaguggcucaugccuguaaucccagcacuuugggaggccaaggugggcggaucaccugaggucaggauugcaaaaccagccugaccaacauggcaaaacccugucucuauuuuuuaaaaaauucaaaauuagcugggcaugguggcgcaugccuguaaucccaccuacuccggaggcugaggcaagagaaucgcuugaacccgggaggcggagguugcagugagccgagaucgcacauugcacuccagccugggcaacaagagcaaaacugucucaaaaacaaauaaauaaauaaauaaauaaauauaaaagaaaauaaagaaaccgcauaguauaauggcuaaaauuauaggcccuauuucuuuuaagcaaaacacaaaauccagaaaccacaaaggaaaacauuugauaaauuuaacuacaucaaaaauggaaauuucuucaccagaauaaaaaauuucacaaagaaaaaaugccaacugggagaaaaauauuugcaacucauaugacagauaauggacuuaaaaaaaaauggaguuuuuacgaaucauuaaggagaagcugaauuauacauaccagaaaaaaauacaaauuuauguuuauauauuuguuggaaguaugcaaauucauaacagcaaaaugcuauuuuuuucuacuggauuagcaaaaauaaggaguuuacaauacauggcacugauaagaauauggggaaacaggaauuuucacaguguuugaggaaaauguaaauucuuggaaccucucuggccauaucuaucaaaauuguaaugcgcauuacccuuugagccagaaauuccauuucuagauauuuguccuacagauauacuuguacaugucuguaaugaccuaaguaucagaaugcauauugcacugggcacaguggcuuaugccucuaaucuugacuacucaggaggcugaggugggagaaucacuugaggccaggaguucaagaccagccugcgcaauauagcaggaccccaucuucaaaaaaauguuuauugcagcaauauuugcaauagcaaaagauaaaaagaauuuaaauuacuuucauuggaaagaugguuaaauaaauugcauuacauucauccucugcagcuauaaaaaauaaguuauuuccauaugugccaauuauacaaaggaucuacaaaacauguuaagugggggaaaaaauaugguacacaacagagcguagaauauaauuuuguacuuuaaaaagguaagggaaggcugggcuugguggcucaugccuguaaucccuaccucugaggugggaggguugcuugagcccaggauuucaagaccagccugggcaacauagcaaaaaaauaaaaaugccaagcauggugguguaugccuguagucccagcuaacuugggaggcugagauggaggauugcuggagcccaggagauugaggcugcagugagcuaugauugcacuacuguacuuuagccuggacaacagagugagacccugucuaaaaaaacugggggagaggggacaagaaacagaaauauacacaugugugcuuguaaacacuuagaaaaugucuucauaugaaugauguccucugagaagggaaacagcuaggagucuggaguagaacagagccuuaccuuuuaauauguacucuuuuguacuguauuaucuuuucaauaaaaauaaaaaauaagaacacaggcucuggauguuggaaaccuggcuccaucauuuuuuuagcugaguaaccucaacccucuaacccucuguuucugcaaauauaagauggggcuaauaaccuuccucuaggccgggcgcgguggcucacgccuauaaucccagcacuuugggaggccgaggcgggcagaucaugaggucaggagaucgagaccauccuggcuaacacggugaaacccugucucuacuaaaaauacaaaaaauuagccaggcgugguggugggcaccuguagucccagcuacucgggaggcuaaggcaggagaauggugugaacccaggaggcggagcuugcagugagccaagagugcgccacugcacuccagccugagcgacagagcacaauuccgucccaaaaauaaauaaauaaguaaaaauaaccuuccucuauaggacuggcagaaaaauuagaucauauauagaaaguaccuaaaauaguaccugacccaaaaaguaguaguauuugaggcaaaaagcccuggaccagaaguaacuuuacaaguagcugcagacaagucacaugacccccuguggcccaauugccuccuguaccuaguuggacgaguuggucccuaaaucuccuuacuuuuuuuuuuuaauuuuauuuuuugagguggagucucacucuguugcccaggcuggagugcaguggcaugaucuuggcucacugcaaccuccgccuccccagcagcugggauuacaggugcgugccaccacaccugcuaauuuuuauuuuuaguagagaugggguuucaccuuguuggccaggcuggacucaaacuccugaccucaaaugauccaccuaccuuggccucccaagugcugggauuacaggccugagccaccacacccggccucaguucccuuauuuuuguuucccuguuccguugaaaccuguuucuugcuagaaguucuagcucccaagccaggaggauuuuuuagggaaguaggagcuccugugaguagguacuuuugacacccucccaauuccauaucagaccauaaaaucggagcauuggucaugaaaaauggaaacuguaguagcagacuuuuuuuuuuuuuuugagacagagucucacucacucuguugcccaggcuggagugcaguggcucgaucucggcucacugcaaccuccgccuccuggguucaagugauucuccagccucgcccucugaguagcugagauuauaggcgugugccacuuuuuuaagauggagucuagcucugucacccaggcuggaguucaguggcgccaucucggcucacugggcucacugcaaccuccgccuccuggguucaagugauucuccugccucauccucccaaguagcugggauuacaggugccugccaccacgcccagcuaauuuuuuauauuuuuagcagaaacaagguuucacuguguuggccaggcuggucuuaaacuauccugaccuugugaucugccugccucggccuuccaaagugcugggacuacaaauggcaaauuuuuguauuuuugguagagacaggguuucaccauguuggccaggcuggucacuaacuccugaucucaaguaaucugcccauuuuggccucucaaagugcugggauuacaggcaugagccaccgcaccggccuggugacagauuuuuaaaguaggggcaaggaaagguaugacugcucaagaaauagccuccuaggccaggcgggguggcucaugccuguaauagcaauacuuugggaggccgaggcaggcagaucacaaggucaagagauugagaccaucauggccaacaaggugaaacccugucucuacuaaaaauacaaaaauuagcugggcgugguggugcgcaccuguagucccagcuacucaggaggcugaggcaggagaauugcuugaacccuggaggcagagguuacagugagccgagauugugcaacugcacuccagccuggcaacagagugagacuccgucucaaaaaaaaaaaagccuccuggguuucauaagauaauugcccguacugugggugccagcagagggcuuuauggggaucuggggaggaaaaugcugguaaucauuugcucugggagcaaccauaucugggcagucuugccugucugugguccugaggucucugccaugcuuugggacugaauaaaggagucugggaacuaugauuuggccugggaguaaaggggagcagaagccccaaggccauguagcuaggcauggggugagugagaaacacaaugggaaaccuaucucaguacgagggcuagcgccaccccugccuccuucuccaacccaagauggccaugcauuaucuucuuuuuuuuuuuuuuuuuuuuucugcaccgucauggcucacuuuagccuugaccucccaggcucagaugauccucccaaccccagccuccucaguagcugggacuacaggcaugcgccaccacacccggcugauuuuuguauauuuuguagagaugggguuuugccacguugcccacgcuggucucaaacuccuggacucaagugauuugccugccuuggccucccaaagugcggauuacaggcaugagccacugcacccagccacauuaucuucaggaagucuguggauguccucacagaucuccucaggcaggaggagagggcaguucagucguacugagaaaugccggcacaguagacaggcggucauggcugucucucucaugcaggugcugagcgccguccucaaggaucucuaccaccugcugaagcacguagugugucuggagcccgaugacguggccaagcuccaugcccaguuggcccuagaagagcuggaugacaucaugaaaaacuuccuguucccuccacagaagcuggagaagaagaucaugguccugccguagaccuggcuccaaggacguggaggaggcaggcagggccaggcacccagagccgugcccaggucuuccagcagguggcccugcugccucuugagugcuggcagcauggcugacccucggggugguuuuauggugcaggucacuugggucuucagggucccuuccgagggcauguguucagcacucccgcguucagccugagggguguacaguuaagagaagacaguuacagaucucauuaaucuacauuuuucacuguccucuagcauugaaagaaggaugucuaccuggugaaaguauauuuuaacaugacugauggaauuucacuaauugcccacucucuuggaacuugaggagaagcgguuggccacccauaugucaccuagcucuauauucuuucaggcugagauucuucuucaggaaaaugaggagcagaacuggccacccuuggcugcucaagaggcauuucagaguaggagaugcaguuggagguggggaggggaaggaaauaguuaucaaauaaugcaaaauggaauaaaguuaucuuggauggaaagaacagggcuaaaucugguccucuggugucgagauggaaaacuguggaguugaagaggcucugaugcccagaaaggacaaucaagcugguugacucuuccagagaagaaggguaagcccuguauuuauccucccaggccauucuucuucacuccugcugcuguuugcagagaguugcccugauuaucaggagaaaagaaccacgagcauccagagaguuuacauccugccuucuguccucugcuccuucagaaagaugaaugccuagacaauggguucacacugaaugcaggcuggaaagaaugcaugcugguggccuaaugccagggcuguugaaacaauuucagauauagcacuguggucuccacuuuauuucuuuauauguuuuggccgcugcauuuugauugcagcuaaaagagauaacagaaaggagauacuggcuggcugcuucauauuagcccucucuguugucaacaccuugaugaggccaacccagagaugcuugaucaguccucagcuuugcagggcuagguacagaauuuuaucacaggauuuuaucacgcucucuggggugacuagauccacaggaaccaaaacgcaguuuccaaaagcucgagugacugaaggaucuauacacaaacauggcuauuugcuaguuaacaacaggauauuucucucuggccagaucacagacaugguucugagucagaucuuccuugguggcaucccuuuaaagaggccaucuuaugaacaggaucacaagugagcuuagugagcagagaguuagaacaaaucuagcuagguguguuuaaggaauauuuccauucagcuaguguagcuggauuaauuucuauucuccaaaucaaggaugucuagaaaaugggcauuguggcuuucaaaucuaagaagaaucuccuuugggccagcuggauguacaauaaaaaugcuuguuucuuggccuuccuuuaacuagacuccacgcaacccacuucagaccagcagaucgaauguguugcacaauccauuuuacuuacaacuucauuugcauuaaccgcauuccaguucugaggacagauccugauugaccaccuugauuagucuaagacacuaucuaguccaaaauccucgagugccucaugaagcauccuaguaccuuuaucucuauuuauagaucaccucuuaauuugaacuauuuggcaaguggcugaaaacaucuguucuuuauugauuuuuuuugagguggggucucacuacguugcccaggcuauucucaacuucuggacucaagcaguccuccccccucagccuccugaguaccugggauuacagguaugugccauuaugccuagcucuuuauugaucuauuucuucuuucuuucuuuuuuuuuuuuuugagacagagucucacugugucacccaggcaggagugcauuggcacaaccuuggcucacugcaaccuccaacuccuaggcucaagcaucagccucccaaguagcuggaaccacaggugcgcaccaccaugccuggcuaauuuuuguguuuuuuaguagagacaggguuucuccauauuggccaggcugaucuugaacuccuggccucaggugaucugcccaacuuggccucccaaagugcugggauuacaggcaugagccaccgugccugaccuuuauuuuaagacaguuuugcucuguugcccaagcugguauggaguagugcagucauggcucacugcagccuugaccuccugggcucaaggaauucucccaccucagcacccccgaguagcugggaucacaggugugcaccaccaugccuggcuaauuuuuaaaauuuuagcagagaugaggucucgcuauguugcccaggcuugucucaaacuccuaggcucaagcaauccuccuuacucgguuuccuaaaguguugggauuacaggcaugagcuaccaugccuggccaauuuuuuuuucuuuuuaacagacagggucucacuuugucacccaggcuggagugaaguggcauaaucauaccucacugcagccuugaccuccugggcucgagcaauccacccaccuuagcaucccaaguagcugggaccacaggugugcacuauugcaccuggcuaauuuuuuuuuguagagacagggucuugcuauguugcccaggcuggucuugaacugcuggccucaagcaguccucccacauuagccuuccaaagcacuggguuuauaggugugagcccccacacugggcccuaauguaauccucuuaaacaugaccaaauuauuaaaaauuuucagauuuucuauauuauguguguguguguguguguguguguguguguguguguguguaugaaugauaguccuugggaaagaauguuaaaacuuuaggauaauaaaagcacaaaaacggccgggcacaguggcuuacgccuguaaucccaacacuuugggaggccgaagugggcagaucaccugaggucgggaguucgagaccagccugaccaacauggagaaaccccgucucuacuaaaaauacaaaauuagcugggugugguggcgcaugccuguaaucccagcuacucaggaggcugaggcgggagaaucgcuugaaccugggaagcagagauuguggugagccgagauugcgccauugcacuccagccugggcaacaagagcgaaacucugucccagaagauaaauaaaagcacaaaaacuuaaacgaaauacacgggaacaaaagugacacuucccuacauggacccugugaggugugucuugccucccauccccacccugcucuucucccucagagaccaccuucccaccucccaccgccccuucugcugccgccuccaccuggcuugcugaggcucugcuggccccucaccuucggcguccuccaccacccagcagccuuucuccuagauuccucuguggcacucacucagccuugugcuuggucccgugcugccuccucuccuuuuuccccuucuaggcucuuccuccucuucccaggcccgccauccaccacccccuugcucuacaggggauggcucagccacaggagacaugcagaggccccacuuguggcuacagccaaaccccaggcuucugcccaagcuucaacugcuuuuucagguuagacuuccugaacauucuggagaguuuccccucucugcuuuguuuuucuuccuccuuggcacaaacuugcccuucuccaaguucucuguuauuuaaucagaaaucucuuaacuuuugcuuugcuccuuaucaucucuccacacucauaauuucccauauuucccaaucuccucuuccacgucccuugcuuuguuguugcuuuuuuuuuucuuuuuguauuuuuaguagagacaggguuucaccuucuuggccaggcuggucuugaacuccugaccucaugauccaccugccuuggccucccaaagugcugggaugacaggcaugagccaccgcacccggcuuuuuuuuuuuuuuuuuuuuuuuugagacagaguuuugcucuguugcccuggcuggagugcaauggugcgaucuuggcucacugcagcauccgccucccagguucaagcaauucuccugccuuagccucccaaguagcugggauuacaggcaucugccaccacgcccaacuauuuuuuuguauuuuuaguagagacaggguuucgccauguuagccaggcuggucuccaacuccugaccucagguguucugcccgccucggccucccaaagugcugggauuacaggcaugagcuacugcacccggcccuugcuucguuuguucaccccucuccuccacuucuuugcuuuccuauggcucugccugcucauccacauguaagagccagugugccagggacugggguguaggaaagcaaaccacaagcaacgacaacgauuuaucgagcaccuauuacguaccagaugcugcacugggcccugagaacacaacagugaacaaaacagaacucuuacccucggggagaguuuaugaggcaguggagggagacagauaacaaauaagauaaacaaugucaaguggggccgggcacaguggcucacaccuguaaucccagcaauuugggaggcugaggcaggcggaucaccugaggucaggaguuugagaccagccuggccaacauggcgaaacccugucucuacuaaaaauacaaaaauuaggcaggugugguugggcgcgccuguaaucccagcugcucaggaggcugaggcgggagaaucacuuaaacccaggaggcagagguugcagugagugagacugugcuacugcccuccagccuggaugaagagcaagacuccaucucaaaaaaaaaaaaaaaaagaaaagacaagaaaaaaaaguaaaguggugagagaugcuauggagaaaauaaagucaggagggaggagcgugggaacaguaaguugagauuuguuguucagagguagccucgcugagaaguugcuauuugaauaacgaucaggugaauuaaugagcacuaaaauaauggggaaagaguguuccagguaaugggaacagcaagugccaaggcccagagguaagagcaggucucaggaggaaggggugcugaaguaagaggaucgcuuguguccaggaguuugaggcagcagugagcugugacugcaccucugcacuccagccugggcagcagagugagacccuguccccaaaauggaaaaaauaaaagaaaugcauauaaccauacccagccaguuuuuuccccuccauaaaaaggaagcagugauccccagcccuuuucaugccaccccccaacuuggccucgguggcucuguuguuucagcuccucuucucugguagcagcaguuucuccucuuuggcucaaaaaggagagcaagcguguugaucuacccuggguccauccaccuguuuugucucuuugucugcgagggugacugaaugaagugcugccugccaccugacugugccucucacccaacuguuugccgcauuggagggcuggcuacaacaugugaaaguggaucaauugauaagucgagagaugagucaucugaccugugcaaaaccagauaagcuucugcagucuuugcacagaaaucuaaaaucucggccagaauuucuguggcaaagggagagagucagaaaccggagcugugagaggugccacauuucccugacuaugaggggucuucuuccccaauacgccccuucccccagcagcagcuuugaccucagagggccuggcuguguccucagcaagcucugcagcuacagacaugcugcagucacaugcagcagccacacugcagugcgcggcaccucugccugccaugcuccacucuguuggaacugaaucaccgcuuggggguugggaaccuguguugcuccuuacaauacccggugcugccucuuuccugcaggcagagcucagggcugugcucagcgcccucugcacaggcuggcaaggugagaggggaaugcagaccccaccuucggcccuggaaagcugaaacaucauuagggaggucauccccuguuguccuccccaguucuucauagggaguccguagcuccacgcuaccaggccucaguuuuugugccccuccuccagagugcccucugcgguucuuuguaacacaguguugcaagaucaguguuugcauuuccuuuauuuuggaaagucauuuuccauccauaagcuugucugauucucacaacaaucuugaagaacagggaggcaggcucuugacauccucccuuggugggauuuggcuccaagucugcugggucgcagccaggagccuguuuacuacaucggaagacccuccaugaaauguuuugaacaucuguugaauacaauggagcuucuucccacaaagugaguacagaaguacaagccuuucaagcagaguagaguuugagaugcaaacucagguacucacauauacacaugaaucccaacacguggggcccaccaagaaggcguuugugcuccacugacacauggucggcgcugccuaccaccucccccgugcuggcccucugcccuccagucugaggagugguacagcccgcagguacaaugccuggcugcugugcguauuuguguacauuuucagaugauacgugaugugacuuagaacaaguuuaauguaucuguaguuuguaauaugugcacuuggcacuuuuuuuuuggagacagucucucucugucacccaggcuggagugcaguggcacaaucacagcucacugaaaucucuauuucucaggcucaggugauccucccaccucagccuccugaguagcugaaacuacagacgugcaccaccacacugagcuaauuuuuuuuuuuagacggagucuugcucuguuguccaggcuggagugcaguggugcaaucucgguucacagcaaccucuaccucccggguucaagcaauucuccugccucagccucccgaguagcugggacuacaggggcgugcuaccacgccuggcuaauuuucguauuuuuuaaaaaguagagacaggguuucgccauguugcccagucuggucucaaacuccugggcucaaaagauccaccugccucggccucccaaagugcugggauuacaggugugaaccacugugcccagcacgauacauauuaauucccuugacccucacacucugagauaggucuuacuaugacuacagaugggaaaacugaggcacacaagaggcaaauuacuugcccagauuacaugaccaguaaggaguagccaaaccaguauuuggacccagguagucuuucuccaaaggcugugcuuuuuacacugugcauugcugcugcccaagagauaccguauuuccaaagaaagaaaaauucccacgaucucaccucaacuccugcccaagauuaccacugacaacuggugcaaaaucccucuagaucuuuauuuauuaccauauuuuauuaccccaaauagugccccgcaucauuuuuucugagucauauaccuuggagacacucauaucaguacucacagaucucuuccuuugugaugauggcauggcuuccauuguuuggguaaacugcagcuuaaucauuuguuuauugaugguuccauugacuuguuucuaauuuccaaugguuuuucaaugauucucagacauaacuuugcauaccgaaacguuucuaugcaauaggucuuaaaagguuggagugccagaucaaaagcguauaaccauuucaaauguuaguaccaaauguccccccaaaaguuuguaccaaucuacauucccccacccucagcugacuuugcuuuaacacccaugaaaugcaaguucagucucaaagcaguguugauaccauucucuaaauaauucaggacuaggaagccuucagggcuggaguuuucuguguaccaaaaccaacaacagggacacgcuaauaugcuuugcaaguuacacccaccagcagccgugucccaggugcaaauacuaauuaguggcuuauaauuacuaguucguggcuuauacauagucauccgggagagaaaucuugagccccugcaggucuauuuaaaagagguuucucaucucugagacucugcccuugguguauaggguaugccuucucaugggguuuggaauggcccuagaauaaugacuauauuucccaaaccagauucaggacauaaggucugauggccccuuaaaguacggguucaucuggaaagcccagguugaaugguuguaccucugcaucacuguaugucaagaucacaguuacaguuaacacuaaaaagcuuauuaugcccuucuguguacuuaacacauauuaaucccguuagcccucacacugggccugugagauaggucuuacuaugacccuguucuacagauaggaaaacugaggcacacacgaggcuaauugccucagauuacauagccaguaagaagcagccaaaccaguacuggacccaagcagucuggcuccaaaggcugugcuuuuucccaccgugcuugcugcuaccgauacauagauacuguauuuccaaauuguuaaaaucuguucuuaguauaaguguggauaaagaaagugguucccacgugguggucacaccuguaaucccagcauuuugggaggccgaggcagguggaucucuugagaucuggagcucaagaccagccuggccaacauagugaaacaccgucucuacuaaaaauguaaaaauuagcgagguguggugguaugcaucaguagccccagcuacucgggaggcugaggcaggagaaucacuagcccaggaggcagagguugcagugagccaagaucgugccacugcacuccagccugggugacagagugcaacuccgucucaaaaaaaaaaaaaaaaaaaagugauucccugcuuguuuaaauggaacaccuaugucaacuuaagcuuuaacccaaauagccucaaaagaguguccuaguacaucaaaacccaaccucaagccaggcacggugguuuguaauccuagcuacucaggaggucuuggcagaaggaucauuugagcccaggaguuugaggccagccugggcaacauagcaaaauaaucucugggaaaacaaccacagaaacaaccucagacaccaaaauuuguuauaccucuugaguuugaccuuguaguuugcccagaagcugggaggaggugugugaaagcuccgcagcccaccugcuccugcacuuuggcagcuuugguaaauugcuuauggaaaggcuucuuuuguagaguggccaagauaguaaacaucuaagacugccuuccugggagcagaggaggcagaaagccauguggcaaaugugcaacauagaaaauguagcaagucuucccaugaacuccagaaaugucuucuuugaagauuguugcuuucccauccauuuccuauaagcagggcuucaauuuucagauaccauucucagaauaacauuguaucauuuuuguuuguuuuuuguuuuguuuuuugagacagggucucugucacucaggcuggagugcaguggcgcaaucucggcucaccugcaaucuccaccucccgaguucaagcgauucuccugccucagccuccugaguagcugggauuacaggcgcaugccaccacacacagcuacuuuuuguauuuuuuaguagagaugggguuucaccauguuggccaggcuggucuugaacuuccgaccucaagagaucaguucaccuugaccucccaaaguacugggauuauaggcaugagccacugagcccagccuacaguguaucuuuuuuuuuuuuuuuuuuuuuuuugagacggaguuccacucuuguuguccaggcuggagugcaaugacaugaucucggcucaccgcaaccuccaccucccggguucaggcauuucuccugccucugccucccgaguagcugggauuacagacaugugccaccacacccggcuaauuuuguauuuuuaguagagacgggguuucuccauguuggucaggcuggucucgaacucccgaccucaggugauccgcccaccucagccucccaaagugcuaggauuacaggcauaagccacugcgcccggccuacaguguaucauuuuuaacaguuauuccuugcaagaagcucaaagcauaaauacauuaauagcucuauucccauaccauuccuugagagaggaaaaagaagcuggguuaauggcccucuuugaagaagggaaaaauaagguccagagaggucaauuauugcaaauaaaaaaucagucaguuggccagccccuaacuccagcacagagcugcaggaggcugagggcaggagcugcugauuucaggagagagugguuugcagaguggguguggugccggagcacaggagcaccucuucuggggaacuaggaaagcuacugggccuuuaagugguuuauuaaaugaugucagauuucgucuuuacugucuaccuuaagagcaggaggcagcucaggagagcuccugggugggguuuuucuaauguauuaucacacacacagguagccaccuggcgcuggggagaacaaagcagccugcucugcacucccagagucucuagagccacccccaccacacacacacaccuucacuggaccacacaccaccuucaaaacuucaaaacuuggcgaccauguuaauccuagagaaaggccagccugaaaauaggcugucuaugaagagaagcgaaugggaaugcuaauguuucagagaccugagguuuuugcuguuccaagauuucaaaggacaggugcuaaguugugugucuuucucuguggacaagaccagggcggugugauagacagaguaauggggacuccauuccccaaaagagagcagcucagaccccucaugagucucuagagacuauccuuccccauccuuuggguggggaaauccccacagugcagaaguucuguccuuuagaaaacaaagugaauccaaguuguuuugacaguucuguccuccuacagacaagggcuggcuggguuuuucccaguucuggaaaaaggcagacagcaaacugagugaacaaaacgguuguugaaaucuaauuccagguguaucggagagaccuggggacucaucucguccaucugauccuguuccucuguuucuccccggcucuccuuccuaauuuccagcucaaauccacauccuuccuucuuuuauuuuguuccuucuggcuugacagcucacuaguccauuguuaacuuuuuuuuuuuuuuuuuuuugagacaguguucgcucugucacccaggcuggagugcaguaacacaaucucagcucacugcaaccucugccucccagguucaagggauucuugugccucagccucccaaguaguugggauuacaggcacgcgucaccacaccuggcuaauuuuuuuuguauuuuuaguagagagaggguuucgccauguuggccaggcuggucuugaacuccuggccucaagugauccaccagccucaaucccucaaagugcugggauuacaggcuugagccacugcacccagcccauugugaaguuuuuaagguuaguaaauuaaacaggugccaacaccguggcaggccuggugcuggaggaaaauggacagacacucuucuuacgugcucuagagcucaccgccugacuggcuggcucuugacuggccucucggugccagaaaugcacuuguaagucuccgcugaggagaacccucgggcuguguucucaacccuggaugcagaauagaauugccuggggaauuuuuuuuuuuuuuaaucaagccugggguccacccccagugauucugauuaaauugaucugggauggguuccaggcauucaugauuuuuaaaagcucuacagguuuucaaagucuacugugcaacacccugccagacaugggaaucacuacauuggcuuaucugaugagaaaagaaaaucagggaguggggguccuagccaaaaaaaaaaaauuaacugcugcaaguaggacauauuuuggcaggggguccccuccaacaaaggcaccgaugggaauggccccuacccucagcuucgcucuaacugcuuuuauaaagggucuaacuuuggaccuccugugugacagugacuaaugaugucuuucaucaagaaagaagacaaagcagaagugccagcacaauuaagaauuguggggccauggcugggcgcgguggcuuacgccuguaaucccagcacuuuggaggcugaggcagguggaucacuugaggucaggaguuugagaccagccugaccaacauggugaaaucucaucucuacuaaaaauacaaaaaauuagccgggcacacuggugcgugccuguaaucccagcuacucaggaggcugaggcaggagaaucgcuugaaccuaagaggccgagacugcagugagcagagaucaugccacugcacuccagccugggcgacggagucagacuccgucucaaaaaaaaaaaaaaaaaaaagaauuguggggacauggcugggcacgguggcucacgccuguaaucccagcacuuuggaggugaggcagguggaucacuugaggucaggaguuugagaccagucuggccaauguggugaaacccugucucuacuaaaaauauuuuuugacaauuagccaggugugguggcacacgccucuagucccagcuacuugggaggcugaggcaggagaauugcuugaauccgggaggcggagguugccgugagcaaagaucacaccaugcauuccagucuggaugacagagggagacucugucucaaaaaaaaaaaaaaaaaaaaaaaaaaaaaagaauuguggggccaggcuugguggcucacaccuguaaucccaacaccaauuuuuuuuuuuuuuuuuuuuuggagacggagugucgcucugucacccagguuagagugcaguggcgccaucucggcucacuccaaccuccgccucccggguucaagugauuauccugccucagccucccgaguaacugagacuacaggcaagcaccaccacgcccagcugauuuuuuguauuuuuaguagagaugggguuuuaucauguuagccaggaugggcucaaucuccugaccucgugauccgcccaccucagccucccaaagugcugggauuacaggugugagccacugcgcccagccuaaucugaggugggaagaucgcuugaucccaggaguucgagaccagccugggaaacauggugaaaccccaucucuacaaaaaaauacaaaaaguagccgggcaugguggcacguggucccagcuauuuaggaggcuaaggugggaggaucccuugagcccgagaaguugaggcugcagugagccgugauugcaccacugcacuccagccugggcaacagagcaagacugagaaaaaaaaaagaauuaugguugauuuuauuguaacaagagccaaacaagccgggugugguggcucaugccuguaauccuagcacuuugggaggccgaggcagguggaucacaaggucaggaguucaagaccauccuggccaagauggugaaaccccgucucuacuaaaaauacaaaaguuagccagggaugguggcaggcugaggcagagaauugcuugaacccaggagggagagguugcagcgagccaagaucaggccaucgcacuccagccugggugacagagcgagacucuuucuccaaaaaaaaaaaaagagccaaacaaauucggaacaagcuuaccuuaaguguagacagggauuguguuccaccacucugggaaggagugugcacuuguguguccauuuugugucacguaacuacauguguguggugcagacacuugcgugggaguaggcuuacaaugcgcacaggagagaaccucucccugggacuucccugggugggaggacauugcugcugacaucaccaggcuuggaaauccuuucuucagggaaaagccuccuucuaggggaauccuagagccguauuuagcaugugccucccccucuugcccaggaccacugugguccucaaugaggaggugaguguggacugccccagcuggggugugccagccaagccaugugccuuuuuauaauucccucaaaggugcccaaagagcuggcauagcucugcagacuccgccuuucccugcuacauucucucaaaggaacagugggaggaauuuacauaaaggaaaucacucugguuuuggcuaccacuaauccuaaauccuggcccucccacuuuauuuacugcuuucacuguaaacugagguugugaaaccuuuuucacaugaauccauguaugauagagacugcaccccacccugcccgggcuuauaaggaaauccugccaggcgcgguggcucaugccuguaaucccagcacuuugggaggccgaggcgggaggaucacgaggucaggagaucgagaccacagugaaaccccgucucuacuaaaaauacaaaaaauuagcugggcaugguggcaggcaccuguaguccaagcuacucaggaggcugaggcaggagaauggcgugaacccgggaggcagaguuugcagugagccgaaauggcgccacugcacuccagccugggugacagagcaagacuccgugucaaaaaaaaaaaaggaaauccugugaacucagaauuuaucuucauuuuuuuuuuuacaacauggggucucucuguguuguccaggcuggucucaaacuccuggacucaggcaauccucccacuucagccuccugaguagcugggacgacaugcacauggcacugugccuggccuuaaaauaccuuuuuauuacaaaauuguuuuacuuauuaauagaaauuucagagaaaaaaaauccauuguucuaccacuugauuuuaauaucaaaccuauuaauauauuaucaaaccugauuuuuuuuuuuuuuuuuuuuuuuuuuuaguuucacucuuguugcccagacuggagugcaguggcacaaucucggcucaccacaaccuccgccucccagguucaagcgauucuccugccucagccucccaaguagcugggauuacaggcaugcaccaccaugcccagcuaauuuuuuauuuuuaguagagacaggguuucuccauguuggucaggcuggucucgaacuuacgaccucaggugaucugccugccucugccucccaaagugggauuacaggugugagccacugcgcccagccugaaccugaucuuuuuuuuuucuuuuuaagacagagucucgcccugucgcccaggcuggagugcaguggcgcgaucucggcucacugcaagcuccgccucccggcuucacgccauucuccugccucagccuccugaguagcugggaauacaggcuaauaaaaaauuagcccagcuaauuuuuuguauuuuuaguagagacgggguuucaccguguuagccaggauggucucgaucuccugaccuugugaucuacccgccucggccucccaaagugcugggauuacaggcgugagccaccgcgcccggccaaaccugaucuuaaugaucaaaccugaccuugauauuugggugaacuucucaccugccuuuaauucauuuuuuuuuuagauggugucuugcucugucgccagguuggagugcaguggcgcaaucucggcucacugcaaccucugccucccggguucaagcgauucuacugccucagccucccgaguagcugggacuacaggugcacaccaccaugcccagcuaauuuuuguauuuuuaguagaggugggguuucaccauguugacccggaugaucucgaucuccugaccucaugauccacccaccucagccucccaaagugcuggcauuacaggcgugagccaccgcgcccagccuaauucauacgauuuuaaagaaaacaacaacauaaaugcagguaugcauacauaacgauugugucuccuguucguuacuuaacacugcaucguaggugucuggaguauuccuccauuguccucaugaacguguuuuuuuaguagcugcacaauauuccacuaaaaagauaaguguugaaaauugccuucuggguuuuuuuuuuuuucuacacucaccuaggggagggagagaaaagaaagauggcugggaagagcuuuuucuguuuaggauucugagaaaagcaucuccaggucugauuugauauucgguuaucggucuagugugccccuccuaauccugaccuucaagccagcauaaaagaaccuggccccuuagcaggggcugaccgcuuugccuccagcagagcagaggccccuuaauuugaaaugaaacgauucuuccaucaaaggagagggagacuggaguuaaaaucgaaccauucuaacggcagcacaggaaaguccuuaagccugcuucuucaaacauagcaccuggaaaugguccugauuacacagugcuugucaguaagaggggaaaguuaugaaagaauaacuuuguuuggugguagcugccuugcuguagucaaggcacacacuuuccacuuugaauuauguauuaacuagcauugcagcugaagccgccuugaagagaaagcccuguuugggcagcugcgggaacauaaccugcuacuauucgggagccauuuucaguucgcccuccuuagcuucaagagguuuucaugguggucagcccagggaaaguggauggggaugaaacuuggaggguuggaggcagccuggguagcuuggcugccauccuccauucuguuuugcuuugcuggaagugaugggcuggaugccagggaggagcagugaagcguuaagggcagagggugagggggcagccuauagagcuuggaugccccuccucccgccuccccugcucaagccacucacuaggagacagcggagcagaaccgugggacgauggagcaccuggguccuggcaagguugcucugcagcuuccggcacuggugaugacagagagguuacgggugcaggauauuugagcauuucgugaguuuggauuuggaauuucauugaaaggugaaaucuuuguggaacugucagcuucaguuaccuccaaccugcuaaagcuuugagaaaggccccuugaacucucugcaccgucgaguacuuuucucuugguuaugccuccaguguuggaggauuauuccuggcgugcaaggcacucauuuaggauuauuccuugucacugccugugcucaccuccaccuccagaaggcagcacccacacuucucaucguggcuucuccucagccuuuuauuguugcaucugccuccuaacagaucucccauaccccauuccuaguccuuaccccaaaaugcugccagcccaaccuuccccaaacaguacuugcaaucuacuccuaucuugcucagacauguucgguaauuccccauaaccuacuggauacaauucaaacuccuuauuuggucacuccaaguccuccacuccgguccuagcauccuccuccucacagcagcuagaggguaacaggcacuuccuacacagcaggcccggcuggaacaggcccugcuggaagcuccuuuauuuuuauuuuuuauuuugaggcaaagucuuacucugucacccaggcuggagugcagugguaugaucucggcucacugcaaccuccgccucccggguucaagggauucucgugccuuagccucuugaguagcugggauuacaggcaugugccaccacgcuuggcuaauuuuuguguuucuaguagagacggguuucaccauguuggucaggcugguggaacuuuaguguagauuucuucuuccacccuggccucucuuggcuguccucuaaacacaugucccccauuccuacaccuggucuuguacuuaagcuauccuuccuaccuaaaauguucuucccuuucuacauagcagcucagguuccccaugaaacugcccagccuguuccagcucacagagaccuuuccugaaauccucaaacuccucauguuggauucucucaucaauauuuaauuauaaacugccuuguacaguuuauacuuguacucuuuuuuuuuuuuaugagacggggucucgcccugucgcccaggcucgagugcaguggcacgaucucggcucacugcaaccuccgccucccggguucaaacgauucuccugcuucagccucccaaguagcugggauuacaggcgcaagcugccacaccuggcuaauuuuuuguaucuuuagcggagacaggguuucaccauguuggccaggcuggucuuaaacuccugaccucgugauccaccugccucggccucccaaaggguuggaauuacaggcaugagccacugugcccggccuauacuuguacucucaagcacauuugucuucaaaauggguaacguucuagauggcagggaccagcccgagaucuccaggugccaaagcaguguucucuacucagagcagggcuucagcguuuguuaaaugaguguuguaagugcagcgugaaucuucuacuacugagccaaauaggaaggcuuauuuauccucuggaaccuguggaaaagccaauucagcaacaucugaauucauguuuuuaagugauuggguguggaauuagcccuauuucuaaauccccagugguaagcagagauaaacucgagcuugauuguagcagccccuuaaagaaaccccuccccaccuccccgugaagggaugaaugcaaauaggacaccacaaacuggaugcuaauuacaggcaaauccucccuggcauagacugccauaaagguaaagacucucuuaucugccugauaacaccaggucccuggcccugcagaucagaaaaaaagagagugcucccuagggcaggccauuuagggggcaaagccaauuaauugguacaggcaggguguuuguuguccucaugagguucuaucuggacccacuguugguuaaggagguuuucauggacucgugagguugugcugaaccagccccaccaccuggaaaacuccguggagcuggcggcgugagaagggcaauaagccuugggacacaguuggagucuaagaaacuaacuaggcaugagaugguccuggcccagccccagggagacaaacuugcacccagagaagucauguugcugcugagugaggacggaagggauccuuccaaacuggcuucuccauuccuugggcuucuaaacaggucacuuacaagcagccaguuggcuggauaugacucagacacauuaugucuggccuguggagugugcauguguguguguguguguguguguguguguguguguguguuuccuucaacauuugaauuaccaaugcuuaaaaaaauuaggagauuucacauacaaaaucuggauuucuggcuucucuugacaacagagcaccuggccacaugaggcccucccuccacagggagaugagccucuaaacggagcguuugcucuccaccaggcugaugcacucauuuuugcccuugccaagccccugcuuauuuucucugauguugcagauugcaaaucugggaaggaggaaggaucagagauauccucaucugcagcaacuccaggggucugugaugccucugggugugcaggagguagcccagggcuccaggguucauaaugcaagagagacaagacauuuuucuuucuuucuuucuuuugagauggaguugcccucuuguugccuaggcuggaaugcaguggcacgaucucggcucacugcaaccucugcuuccuggguucaagugauucuccugccucagccuccuggguagcugggauuacaggcgccugccaccacaccuggauaauuuuuuguauuuuuaguagagacaggguuucaccauguuggccaggcuggucucaaacucccgaccucaggugauccacccgccucagccucccaaagugcugggauuacaggugugagccaccacacccggccaggcaguuuucuuuuauucaaacacugauccuugaacuugcugucacugagugcucuagagggauggccauguagaacccguggcaugggcaaaggaugcugcugucugguuuacuaacacuugcugagcgcuuacccucagccaaucucuucaaacuuccuaucaguccgccuagcaaucccaucugugggaugaagacacuggggcuuacuggcagacucuagagcccuccccuccaccaaccuaaggcuucuucuccaucuuuguguaaguaggaauggcucugguagggccccucaggccaucugaaguucaaaacacauuggcagcugggcuggauagcaugccuauaggacuagcuccuagggaggcugaggcggaagggcugcuggaguccaggaauuuguuuuugagacagcgucuuguucuguuacccaggcuggaguguagugguucgaucauagcucacuguugccuugaccuccugggcucaagcaauucuccugccucagccucccuaguagcugggacuacaggcacacuccaccaugccuggcuaauguuuuuuuuuuuuuucuuuucuuuucuuuuucuuuuuuuuuuuauuuuuauuuuuugagauggagucucacucugucgcccaggcuggaguacaguggcauaaucuuggcccacugcaaccucugucuccuggguuuaagcgauucuucugccucaaccuucccaguggcugggacuacaggcacgugccaccaugccuggcuaauuuuuguauuuuuuaguagagauaggguuucaccauauuagccaggcuggucucuaacuucugaccucgugauccgcccaccucggccucccagaguguugggauuacaggcgugagccugcacccggcccuggcuaauuuuuuaauuuuaauuuuuguagagacgggggaagucucgcuuuguugcccaggcuggucuugaacuccuggccucaagcgauccuccaucuucagccucccaaagugcugggacuacaggugugagccacugugccuggccaauaauguaagaugggauuguguggaguaggugugccuggggucuuugcuugccugcggggacugaggugugaggucuguggcccagacugagcaauggugggcaggcaagucccugagccccuaaaacuugcgagaggagaaguuuauagacugcagcucaggugccuauaaauuuguugcagcuugggaagaagugauagaaauuauaucagguguauuuggaaaacagguaaacucuguuuuuugguuuuuuuuuuuuuuuuuuuuuuuuuuuuuuuuggagacggagucucgcucugcugcccaagcuggagugcaguggugcgauuucagcucacugcaaccuccaccugcgggguucaagcgauucuccugccucagccucccgaguagcugggauuacgggcauggugcccguaacgccgaaagugcugagauuacaggcuugagccacggcgcccggccacucauuuuuuaaaaacuaguuauuaauuauaauuucucuucaaguuuuccugagauguaaaaacucaucgccuucagcugguucuaaacuucuugucucugcuaacaacucuccccccuccucgaucucaccccaccccagugcaccccaacucacuucaucucacuuuacucgagucuagcacuaucuuuuagggaccugaaaacuacugucgauaaggucaguugggaauuuaggaggucauggaugucggaaauaaaggugugaaaaagaagaggaggaauuguuuuggcuuuaagacaccggaaccuccaagguuccuacaaaaccguuugcagcuuuugcaaaccgccuuaaagucaucagcgccccacugcggaauucaaagcuaagcugucacaauuguuaacaccuucuuugaccagccuuuuuacauuugacaauucucuucagcgccucuuuccugccagcaggaagguuuugcugccuuggcuuucgggagcccccuagacagcgaacugccccuucgcgugcagaagucggggaagagugcucucagcucgccuuccuugcagggugaguagguuuugcggguuagagagcggggcgugggggcggggagggagaguaacaauuuuggaagucccugcgugguaucuggaaaguuaacgacgcuucagguucuagguugagcccaaugaccgucuugccuuggcagcuggucccagggcgauugcagagccgcguggccuucggccccacucgggggacccagcuucggagagggcgcaggggcugcgagucuugcgagccggagccgcguccacccgggacuaggcguccccgccgagcgcuggcuuguggcgcucccugggaccgcgcggggucgggggugcgcccgcgggggcccucccacucuggucaacuuucccggccccagggccgggggaggcgccucuccuggcgggcacgcgccggguacuuaagggcggcucggcugggcaggcggcagucggagcgcgcggcggcgcggagcggagcgggaggaggggcauggagccgccgcgggccugcugagcuccggagcgcggcagccggcggcacggugagcgcgggccggccggcacccaggaggggagggccgcgcggggcugcgccgaggccggggcgcgccggguggcaggggugccucucgccgagccccccgcacccggccagcucccagcccugcgggcgccgcguccggcgcggggaggcggguugggggcggcggcagccccgggcuucccggcggccguuccugcagcccccuccccacugaccccuccucccuuucuuccugcauccucuccucuuccagccucgccucccuccuccccggcggcuccuguuuugugaaugaauuaggaggcggacgccggugcggggcuccaggcuggcugggguaccccucccccgcaccuucuacgaccucccggggguuugcaccuguccgggcaccaagguaccaggcgcccacguuccugcggguuagccgggccgcggcagcacguguccgggggagugggcuccccuccccuggccggccuggaggggcccggagggcggccgggcacaagaggaggagccccguugggcgcacaaguuuccaugccgcugcguguggcccugccgcggggcgcaccugucagcgggagagacgcugcacaccagcagccccucaaaguuucggaggcuugauggagaagcgugcguccuugacuggggguucuccuuccguaguccugggagccggacuugagagcgcccccaaccuugugcccuugaaagccgagugcgcguuaguuugccugggcugggcucccguggaugagcgaagggcaugaggaggcggcgguccaggcuguaggaucaccccacagccucugccggcuuggggugacacagccccccgccccaggucugggcaggagaaccucgaccacagccugcaccagcgccugauugcacgugggguaucuggcugagggacauuuugggggccucuauuuggggguggggguaguaaccuggguaaugccucuaauuccugcgggggaggggucccgcccagggaaggagagggccggcuacaccggggaugcgccuuugucuacaggcacacuuugccaagguagcugggguaccaggaagagcagggccugguccgacugggaucccuuggguuuuccguuccuucccgguugggucgugggaaagcggcacguggguguggccggcgccgccuuugccaagaggcgaggcucgagcggggaugagaagcguggcgagugcguucgcggcugcuuugaccuggugggcgccgccuccggcacugcaccgaggcggggcgccagcgcccagguugcugggcuggccuuggcgcccccuuccccuacccagagcgcaggcaggcaggggggucccgccgcgccccuucagcauguaagcuccggaggggaaugggggcgcuccuaggcugcggaugcaggccuggggacuccugggccgcaggcgcgagcaguaggguggcaacagggagggcugggaguccugugaaggaagcacacggcgggcuccccgggacgguggggcagagcgcccggaggccgcgcuucccggagaggcuaggcugccagcagcucuuuucgggccaacgcugcuggaaggcugcuagugccggagucucaggucgauuuaggcagugacugcguguucuucgucccuucuacgugagaggcgucccgacaggaaaguguguuuguuuugggggcuccguuuccugagaccuaagaguuggagcaagcuuggaagcgaggcaucauugucuguagaccucagugaacaugggguucucuagaucaggcagguggcagagaggagauagugugggucagaaugggaaggccggcagccauccuugccaccuuuucuuuccccucccucacaucccccuccccaccugcucuggaggaaaccacagucacccucaccacuaggguagcucuucggggccggaaguguuuccauuuuuagggaaaugacuuaccugagacaugaggcaggaauccauuagaacucccauugugcuauggggagaccaagucucagagaacuggggcaaggucaggcagccaggaggcagaagugcugucuuaaacccaauucucuagugccaaguccugggcuguuauaaaauacagcuguuuccaacaggggagauguuaggagcccugacuuaguugcaaauggaaaccgggcauuguuuccaggaguggcugggcagggggacacgcacagagacgcaugcugcacgggcacuaggaccaagcggaugggaugcccaggcagccacuguggaggcugcugcagugguggcugcaguucccugugcuuucuucagcccugggcucuaggaggcuguccacuccccagcuugcauuuccuggucugccucucccccugcuuucccuuucuuuccugccucucaaguaaaaggugagaaaguggaggacacagggaaaguuucucuaauaacugucuugagaaagggaagcugcugcuuuuucccaaugccccuuuguuugcuguuucuuuugcuccugcacuuucuucuugggucuuacugguggcugcacuuuacuggugaauauccccuccaggagugggugcaggguagggggaagcucuuaggccacuggcugccucccuggcccucaggugcccagagcugccucaggcucacccccuugaagcuuaccucuucagcgcuuugggccagguagagcccaguucugccacccaccagccagaugucacgugacccucugggccuuggcuugucuaccccagugcuacacuaagggcuuuguaugugucgcccauuuaacccucaaagaugccuugagguuaguccugcaacccacauuuuacagaugacguaagggggcacagacaucaaguggcagagcugggaucugaaccccaguagucuggcuucugagucuaccaagucuuaugcucaguaagcgguaacgguuuugaucagugggucauguccacuaguaacagagaacacccaugcucccacggacuggaaaugcugccuccugccugacccuucaucuccugccuucucucgccagaugccggugcagcugacgacagcccugcguguggugggcaccagccuguuugcccuggcagugcuggguggcauccuggcagccuaugugacgggcuaccaguucauccacacggaaaagcacuaccuguccuucggccuguacggcgccauccugggccugcaccugcucauucagagccuuuuugccuuccuggagcaccggcgcaugcgacgugccggccaggcccugaagcugcccuccccgcggcggggcucgguggcacugugcauugccgcauaccaggaggacccugacuacuugcgcaagugccugcgcucggcccagcgcaucuccuucccugaccucaagguggucauggugguggauggcaaccgccaggaggacgccuacaugcuggacaucuuccacgaggugcugggcggcaccgagcaggccggcuucuuuguguggcgcagcaacuuccaugaggcaggcgagggugagacggaggccagccugcaggagggcauggaccgugugcgggauguggugcgggccagcaccuucucgugcaucaugcagaaguggggaggcaagcgcgaggucauguacacggccuucaaggcccucggcgauucgguggacuacauccagguaagggcgccucccuaggagcguguguacauggggauaagucuggacagccuggcaaacucuccgccaagaaucugaggucuggucuaggucccuuggguugugcacacaccugugcacuuaagaaggcaacaagguggccgggcgcgguggcucacgccuguaaucccaacacuuuggggggccgaggcggguggaucacaaggucaggagauccagaccauccuggcuaacacggugaaaccccaucucuacuaaaaauauaaaaaauuagccgggcaugguggcaggcgccuguagucccagcuacucgggaggcugaggcaggagaauggcuccuggggaauaaggcgugagccaccacacccggccuuauuauuauuauuuuuuaaagacaaagggucucacuauguugcccaggcuggagugcaacggcuauuuaaaggcaugaucaauacgcacuauagccucaaacuccuggccuugggcaguccucccaccucauccucccuaguaacugcgauuacaggcacauacaccaccgcacccagcuccauguuagcccuuuuaauccucuuaacacucccagggagaagugcuauuaucuccacucauagaaggugaaagcaaagcacagagaagcuaaguaacuugccuaaugucccauugcuaguagggugcagagccaggauuugcgcccaggccgucugucucaagucuucucuuaccugugaugcagcacugccucagcaauggcaacguggggcugaaccucuucauaagaaagcguggugaagagcaaaagaaaccauccucaaaaacacucaaaauauucuaguuauggccaaaaagucccauucuuccuagugucaaagucaugucugggcggugagagacacaggugcgaaugacuagcuucauuuuguaggagcaucggcaggggcgggacccugauuaaacccugcccagcuuuggucaaagcaaucacugacauaagccuggaaauuguacuagguugauaugguuuccaucuucaaauaaaaaaaacucaagaguugaaaagauuaaagaccacaucuuucaguacaaaguagaaacccuaggacccuggauuucuaggccaggauuuuuuuuuuuuuuuuuuuuuuuuuuuuuuuugagacagaguagcugggauuacaggugugcaccacaacacccagcuacuuuuuguaguuuuaguuagggacaggguuucuccauguuggucaggcuggucuugaacuccugaccucagcugacccacccaccuuggccucccaaagugcuaggauuacaggcgugagccaccgcaccuggccuaggccaggauucuugauggcauccaugcugccucucuuccugacucuguucucugaccuccacgccugccagagcagggugcugcccaucacuugaucagugcuugaaggugcaguggcuguccugccagcccaccuguguaccaacucagucugcugacagcauuuugaguccccuaauacgauuuuucucugguguacacaccuaaaauuagcucacucagauugcgugucuggcuuuuuugacaguugucucugcaugaggguugauauguuuaucuuuuucuggcuuccuaggcccaggaccuccucagucauggagggaguuaggagagcuuagcaggcuguuuugacugcaguucaccuggggucgugggaccuugugaaacuuuccuggggacccaaaugcuuagggaaaagcccuugagcccuggcacaggcucaagccacagugacuuugucaucuauucccuucaagcacaggaucucacccccaccccacccugccaucucccuuuccuggccaucuggguucugguggaucagcaaacaggcucacacaccugagcugucucuuuacagcccugggaucacugcauaagguugcccugggccagagccagugagcgcuugcuggaucucagccugucuucuaaccgccugcugcggagguaucucucccuccuaggcagaacucugcccgagccaguggggaaacccaggcagcacgagagcucuucuuucccuaaccuugcucaguuagaaagacauccaagacaucccuggacugaaggaagcaaagcagcauauaaagaaugggcuagggcaggggcagggaggagcagugagaccagcagaacagcagcagugcugggagucuuggccuguaaguggaggaggcucugcuagucuggccugaggcuuccugggcccuucccaggcauggaccaggauguaaggauaugccugguggggaggugggaagaagcacauaugagggacucagccuggugcugaugcuguucugauucccccuuagccuucuacugcuuaucuguggccacccugucuuccaacauagagaaagcugggugggguuguggugucagaggcagccuccuuuccugcaggaaucuuacucagcaacuuuaauacaaggaucuuaggcuucuacagaacaggguuuugguuuaucuguggaucucuuuguugcucuccuaacagugaccacagaguaaaucaggucuguaaaccaguucuccuggccaaugcucacuggauuuguguaccacuucacuaauuuuuuagaaaccagaaaaggagucagccacuagggcaacuaguggccuggguucaacucauaaugagaccaccuguuagaaucaggccauaagccucccaagagcugggcagaguuggcccuggggucugccuggaggcagcugcugcagcuuccaugccuauucagagcagccuccagggggagcccucagccauaccgugcccugguccgagaggcucggccaagggagucuguugagggcgcagaggccagcagccuuauuacuggucucauagaggugccugcaaguagguagucugguaaccaccagugggcugcagguuguccaaggggucagaggcugacacggggaccccugugguuaauucuguggggucacuuaaggccauaugcagccuguuaguccugggcuacccuacugugccugccaucugauuucagugacguuucccuucugccgaaggaccccagagcaauuuuuugcguccagugcuaagcaugucucucuccacgccuggcaccuacugucuucaggguuucucccucucagccuaguggcugucaagucugguagcuguacacuuuuacuagcuuucauuuuaccucuggcaccuucugguagcgcagaucucuuagcuagaggcuggaagugagucaugugugaaggggucaugucucucaggcagugagcagccuggcaguggggugggggacagggugugcaggucugaggucagaaugggcugacgacgcacucccucugcaggugugcgacucugacacugugcuggauccagccugcaccaucgagaugcuucgaguccuggaggaggauccccaaguagggggagucgggggagauguccagguaagaugagaccagggauaucuguggggaggggucuggacucuuuuuccuaauccaauuggauaugccugggaaaugggugucuugacuuccuaguauuggggggagguuccucgcuggcaguuuucacugacaccaaagagcucgccccccucacugcccaaccccuuucuugcucuucuuccacaugaggggaagucacuuaaacagguauggagcagagucuauacugcaggaggggcacaguauuuugaggccauacauccuagaagguacuuccuuuuuggccggugguacagcaaguagcuccaaagucagauccuugagcagcccuugcucuuaggagaugggcugaagagcucuggucaauacgguaagaauaagggccccaaucugccagagauacugaagcagcaucccagguccccuacaacuuuccaaccacagaaaucucaggacaggugguuguggugguguuuugcauucuucccaagcccccuucucugccaccaccacaggcugccuccugagaccgaagguggcuuugacugcuagagccacuuaguggggaaaaucucugcagauaagaugacacaguagggagguagagcuggugcuggggacagggauugugugugguuggcuccucugagccucagguuucccagcuccaaaggaaccgauggccaggaaucuaagcagcgggccacagaagccaugguaaggaggccucguggucucugaugucuguccuccggacgugcaaccuuaggaggcccagcaucucuauucccuugcagauccucaacaaguacgacucauggauuuccuuccugagcagcgugcgguacuggauggccuucaacguggagcgggccugccaguccuacuuuggcugugugcaguguauuagugggcccuugggcauguaccgcaacagccuccuccagcaguuccuggaggacugguaccaucagaaguuccuaggcagcaagugcagcuucggggaugaccggcaccucaccaaccgaguccugagccuuggcuaccgaacuaaguauaccgcgcgcuccaagugccucacagagacccccacuaaguaccuccgguggcucaaccagcaaacccgcuggagcaagucuuacuuccgggaguggcucuacaacucucugugguuccauaagcaccaccucuggaugaccuacgagucaguggucacggguuucuuccccuucuuccucauugccacgguuauacagcuuuucuaccggggccgcaucuggaacauucuccucuuccugcugacggugcagcuggugggcauuaucaaggccaccuacgccugcuuccuucggggcaaugcagagaugaucuucaugucccucuacucccuccucuauauguccagccuucugccggccaagaucuuugccauugcuaccaucaacaaaucuggcuggggcaccucuggccgaaaaaccauuguggugaacuucauuggccucauuccuguguccaucuggguggcaguucuccugggagggcuggccuacacagcuuauugccaggaccuguucagugagacagagcuagccuuccuugucucuggggcuauacuguauggcugcuacuggguggcccuccucaugcuauaucuggccaucaucgcccggcgaugugggaagaagccggagcaguacagcuuggcuuuugcugaggugugacauggcccccaagcagagcggguaaagugcaauggguaagggagggaaggggaauggaagagaaaagacagggugggagggaggagggagugcuguguuuuagucucuuaaugguccaaaggacaaaucuaaaaugcaaagaacggugauguaguauggccugacagcucuguuuagaggaggcaacacugaucccccagaugcagggcugcaggggauucuguguuuucagacugccugucugcuugcaucugcacauaggcaguagccuccuccugggcuccagagggcacucagaaguugugcuaaaccaaguuaagucccauucaguggcaacuugugauagguaccugagugacggcaaccugcggaaggagguucucccagcccaucugaacacaaccagagguggcaggagaauuucuacugagcgagcugggccgguuaguguaugucacccccaccccaccccuaaguagucaucaaugcaauaagauugcgccugagauacaaggcccagaagccugaucuuugggcaucagaaaacaggguccaggaauggugcuuuaugugagauaccccacuccacaucaacauuccagggaugagccaaaccagcagggaguuagcacugaacugcuuuuaaaagugcacauuaaaaaggaaaguuugccaggaggaacaaagagauugugguggugcuaaaggaggccauaagcuacacagaggccuuggguguuccaccuggaaacugcucagacgucuagauggguucuuagcuugucugugaucucugcuggggagauaaaaagauuaagccccaacauguucagaaaagaagugaagucuuggguauuuuaaccuguauacucuugaauuccucucaaauucagcucugaucugaggcuaagacacacuccccacuucacuuucuucaaagccacauuuuuugagguaucacugcagucaccucuucuacccucaucaucauagguaagguuuucaagguggcaauuggggcggagccccggcucuuauagaagcuucagcaggaggcaagcguguucucagcacauaugggaacuaugaggagccucugaucaaauuggcuacaaucuuggagcugcuuggacggauuccuuggcagccggguuagcaugugugacuuucaggcuacuguucuugacaaucaucuccaauggaaagcuuuucaguguucccaaagugaacucucaaauccaaaaugguuaucuuugagaccauccauucuccucaguggcuucuccagggaauucuuacagccaaguugugacagucacugcauuugccugcuucuuuccagaaaccaaacuaggagaugaaacugguuccuacauccuaagguucuugcuuucucucucaugccuccugaggcuguuuuuggcuguuuucccucugcugcuuuuggggaaugaggggaagccauuuuccagugacuugcaauccaggcuguucucagcguuuugaguuuaaaaccugggauccugacuaagccuuugacuuaaggguugcuugcuugcccuccaaauguccuuucucagaggggccagcuaacccgugcagaaccagcacuaagguggacagcagacaagagggcaagccucuaguguaccaagugcuuccuacaaagacgcaaggugugcucugagccacagaugggcaaacccuggugcuuuccuucaucucccacgaacucaaggguuuuccagguguagcuaacaguugccacaucacacagaccucgaguuucugguaagacugcugguugacaucagacccaacccaugaaggcuggaaggcagcaggcauuugcuaaggcagcugauccaggcaaucguucugcuggccaagaaguuaaacuauuuugagcauuagaauggaggaaauccggucagccaagugcagaguucagacuucgcuaagggcuuguuuuucuucagcauuuacuugaagauuaauguaggaugacaggcucuccuggcuguccuaccaucagcucugccuugcacuguggucgucaacuuuccucaaaucaaaaacaggcagguacagguagugggcucacaacguuugaccucgacugguuuuucuaaguuauuuuguacauuuuucagcagcaaaaccaaacugggucuucagcuuuauccccguuucuugcaagggaagagccuuuauacaauuggacgcauuuugguuuuuccucauugagaauucaaauccucuuuuguauuguuucuacaauaauuuguaaacauauuuauuuuuaccugcuuuuuuuuuuuuuuuuaauuuucaggucaaguuuuuuauacugcacuuauuugucaaaauaaagauucucacauaugccgguuaucucgaaacuacuacuuuguauuuaaugaaagcuagcucuuuauuccaguuuccaaagagggacuuaaaauagaaaguuuagucaggugggacucaagaccugggcaauauguccauccugguaacuacacccaugggggcuuaacuuuuaguguagagggucuuuggugaaauaacuaacuggcagaugaaugggcccuugcuaagacuaaaaaccaaagcuugcuuccucuuggagcaaaagcauuuuagccgacaugauguaagacuguagccaagcugaaacaaugaaaagcagaggaaacuuccuucccuaugaaacagguaacaaaacacagugacaccagcagcccucucaucccauuuauuaaagaaacaguaagaaaagauacaaugcaggaaaaccaccaaccauccuugcacaccaggccgaacaaagcacagugauuucuucccuucaucccccacccccacccuaauucccauauucccauccacaucaguuuaaauuuugagguucuuugauugauugggaguaccagugaagagggaguuggaugaguagaggggccuuaaaucuggccaccucuaagucccaggagaagggagcugcaggcccagucagucaagcagaaacugcauucggugggucuuucuuugaagugguuguccaucucccuguucuguguucaagcccccagggaaagguauggcaguagaggaugaccagguccaagcugcccaggucagagcuacggaagcaugguccguucaccaacgccacguuucuagagagcagugagcugauucuccaauggugagcaggggacuacaugugaacugggaccugcaggccaauguaucccugaggaaaaguccacaagaacaauucaagaaacuaguaagaaacaaugggcagaaagcugugggacgaaagcacagcaggcuucugggaggcuggagauccuuucucucaagggcaggauuauucccaccugccacaguucacaugccacaaauaacaucucaccuucagucaagaaaaacgcaaaggaaaaagauggcucauuugaacuugagcccaagcuauguucuucagacuguagcuccacaacuacccuuuuaccuaagacagccccugccaagaaccacagugccuagaaaccaaggugguccuggagggaaaaugguguuuaagggggcaacauuccauuuggguacauugcagccauuggacccccuggucuggggaaagcagcuggguuugugccagggaggcuccccacucuaggaaaugggacgaaacucuugccugcagggccauucauccuuggaaaggaagcuggguugagacccagggucccaguuggccuugugaaaggagcuggguugauacccacagggccagcuggagaagggcccagaugcccggcagcuggccuggggaaaguaacuugaccagggccuaaugggccaguagaccuugggaagguaguuggacuuggacccugcaggccaguggcccuugggaaguuagcuggguuggggccaaguggcccagaggcucuugggaaaaugguuggauuugagcccuggaggccagcggaccuuuggaagguagcuggguuugaugccaaugugccagaagacugagaaaaggcagaugaaccugcuccccugggaaagggauuggcauuuacccccauggggccaacuggccuugagaaaugagcugaauuagggccuauggggccaggagcccuugacaugggagauggauuuggcccuggaaggccaauuccccgagagcuaggacccgaguuugggcccauggggccagguacucuugccauggaggaugggcuugugcccauguuuccagaagccugugagaaagaagcugaauuugcuccuaaaagaccugcugcucuuagaaugggggcaagaucgaggccuugagguccagccauucuuaaguuaagaccagauccugugcccaagaggccaccugcucuggcaucuagauuagggccugggcccaggccacuuggucuuggguugggcccaaggccugggccuggaaacacaccugaccugggggcaggguuugucccuaaaaagccugaucucagauugggguuugguccugggcccaggccaacuggccuaggauugggaggaccauucccagagguuaacagaacaccggcucucagguuagguccagauccagggcccaugggaccaccaccucuggggucaggaccugcucccaggagaccaccugcccuuggguuggacauaggaccugguccugggagacccccuaaccugggguuagacagaggcccugggccuggcagagccccuguccuaggguuuaggguggggccugggccugggccuggccccaagaggccaccaggccuugggaaagaaacugcaccugugccagugggauucaucccucuuggaaaagaagccauacuugggucacgagcaccagccgggaaaggugcuggauuugaagccaaugagccugaugaagcuggaaaaggagauggguuccuuggaaauggggucagauuuccaccaagagaaccggccgccauaaggaagggauccgaguucacacccaguggguggccuguguucagaacaggaccccccuguggucccagggaaccgucgagccguccucgagguggcagcggagcacgaguccaaggaguuggccgcucucuagggaaaauccgagguucuuucauacuuucuuggggacgcuggugauaaugggcuuggggcggguuuugaaaaggaucuugucuuugaugagugcugucaccagguaccgggugccagucucgcggccaagcucaucacaguccugauccccaggaguguguuugacaaggacugcaaaagguuucuccagguggaugauuuucccauacaggauaugaugccccacgaucagcacagggauucccuuuggcagaacaagaacgagauuccugagguuccggggcaaggccauaacacucaggcgccuccuaaagcugcucuuggcaggcuaugcuggcaccuccaaucccuggucuggcucugccauuguugagcagccacacuggaccacccacccaugugcccuuuuuacuuucuagccccacauaggagaauuuccacuuucagaaaugugagcuuuccagauuccccaaaauuaaauuucccugcuacugcagagguagggggagaacaagcagagagcaucgcagauuagcuaggccuugaauaacaaaccugaggcaguccucacucuggguccugggagcaccaccuugguguagcuugcuuuccugaggcauuaggcagggaaagaaaagcccccucaccucagugguguaauguaggucucccaggagguuuccagcuaauccagugcuguagcgagccucgaucucccccuguagcuccaucagcacccauucugccaggccuccagcccucgcacugcaagcaaagggcuggcgguuacaauauuuuugaggggugaaggaugaauaguguccucacaccaccauuugaggcccaaaggaccucuuuguuggaugucaaguucuugggaaauugggcagugcuaggcauggaacuagagaucagaaugcaaggauuuguacaagaugcaccuaaggacccugauucuuccagacacauggcacaccucuauagcccucaucauuucaagccaaauuuuaaaaucucaaaauguacuuaccuggaaauaacaauuugcaccaugagcuuucugucuuuaaaaagcaagugaaaacaagcuguagagagaaaaaaagagauuuaggguaauaacaacaacaacuaauaaugacaccuaaugcaaccuccaccucccggguucaaucgauucuccugccucagccucccgaguagcugggaauacaggcacccaccacuauggccagcuaacuuuuuguauuuuuaguagagaugggguuuuuuuuuuuuuugagacggagucucacucugucacccagguuggagugcaauggcacgaucucagcucacugcaagcuccgccuccgggguucaugccauucuccugccucagccucccgaguagcugggacuacaggugcccgccaccacggccggcuaauuuuuuuuguauuuuuaguagagaugggguuucaccauguuagccaggauggucucgaucuccugaccucgugauccacccaccuuggccucccaaagugcugggauuacaggugugagccaccgcgcccggcccuagagaugggguuucaccauguuggccaggcuggucuugaacuccugaccucgugauucacccgccucagccucccaaagugcugggauuacaggugugagccaccaugccuggccgacaacuaauauuuauuacuuacugugugcuagguacuuuucuaaguccuuuagacacauuuuaucuuguuccucuaacaaugcccuaagugggaauuguucuuuuaccaauauuguacauaugagauaggguugcuuaaaaucaccaauggucaacuguaugugcaaaacuaauuaagaucacauagcuacuaaggaaaagaugauaugaaccgaagacauacauugcaaagaccauacucuugcucacuaugcugaugugccuuucuuaaggauauucuuuuuuuuuuuuuuuucuuuuucuugagaccaaguuucacuuugucaccaaaucuggagcgcaguggcgccaucucggcucacugcaaccucugcuucccggguucaagugauucuccugccucagccucuugaguagcugggauuacaggugcaugucaccauacccagcuaauuuuuuuuuuuuuuuuuuugggagggagucucacugugucacccaggcuggagugcaguggcaugaucucaggucacugcaaccucugccuuccagguucaagugauucucgugcuucagccucccgagcagcugggauuacaggcacacaaccaccaugccuggcuaauuuuuguauuuuuaguagagacgagguuucuucauguuggccaggcuggucucgaacuccugacuucagguuggccacccacuuuggccucccaaagugcugggauuacaggcgugaaccaccgcaccuggcuuaauuuuuguuauuuuuaguagagaugggguuucaccauguuagccaggcuggucucaaacuccugaccucaggugauccacccaccucagccucccaaagugcugggauuacaggcauuagccaccacacccggccuugaucucuugaccucaugauccgcccaccuuggccucucaaagugcugggauuauaggcuugagccacugcacccggccucuuacuuuuuucuucuuuugagacagggucucacucugcugcccaagauggagugagcaaaaucauagcucacugaggccuuuacugcccgggcuuaagugauccuccuaccucagcuucucaaaguguugggauuacagaugugaggcacugugcccagccuaggguagucuauuuccuacucugcauguuucuuaaaaaagccuauggaguuucuuaagauuuuacuuuuuucuuugguaaugauguaagcuucaagucuaccuccuugguuaucaagguucaaagggucucccuuuaaaaauaaagccaagggggccaggcgcggugucucaggccuguguucccagcacuuugggaggcugaggcggugggucacuugaugucaggaguucgagaccacccuggccaacacggugaaacccagucucuacuaaaaauacaaaaauuagcugggugugguggcaggcacccauaaucccagcuauucggcaggcugagguaagagaaucacuugaacccugggaggcaaagguuacggugagccaagauugcuccacccugggcgacagagugagacugucucaaaaaaucaaucaaucaaucaauaaauccaagggaacugagaaaguccuccaacaucuuuagugaaugguaagcugacuucugaugugauucuuaucaaaagcuuucaccaccuuucacuuagauaugaaaauaucuuagauaauuagauaacagacuuuggccgggagcaguagcucacgccugcaauuccagaacuuugggagaccaaaguggguggaucaccugaggucaggaguuugagaccagccuggccaacaugaugaaaccccaucucuacuaaaaaaaaaaaaaaaaaaaaaacaaaaaauuagcugggugugguggcgcacgccugcaguuccagcuacuugggaggcugaggcaugagacucaguggaaccugggagauaaagguugcagugagcugagaucacaccacugcacuccagucuacacagaagagcaagacucugucucaaaggggaaaaaaaaaaaaaggauaauaugcuuucauuuuauacaacagcagcaccaccugguggcaaacuuggaguacuuuguaagaacuggacauuuuugccuaaagacaauuggcuucacuuucugugaugcauagauucauggggggcugauaggaucggggauaaaacuacagcuucuggcuaaguacugucaauguauuaugcaguuuaguggaagguuauuaguucaauguuuaccaccuguaguauggaaaguuaauagguauuauaauugugcucaagcuuagcaaacacccgauuaaaauguuaaacagauuuuuuuuuuguuuuuuugagauggacucucacucuguugcccaggcuggagugcaguggcaugaucucggcucaccacaaccuucaccuuccagcuucaagugauucucuugccucagccuccugaguagcugggauuacaggcgcccgccaccacgccaggcuggucucgaacuucugaccugaggugauccacccgccucagccucccaaaguacuguguuuacaggagugagccaccacccccagccgauuucuuuaagagacaggucuuacuauguugcccagguugguuccaaacuccugagcuccagggauccucccacaucagccucccaaaguggugggauuacaggcgugagacacugugcaagcuugagauuucuuuacugguauguuaaucuuccuuuuggaucugcagccuuauaguaugacucuacuccuagagcaccaaacacuuugggaacaugaaauuggucaacucacuagacuuuuuuugagacagaguuucgcuccuguugcccaggcuggagugcaauggcgcgaucucggcucaccgcaaccuccaccucccgaauucaagcaauucucaugccucagccucccgaguagcuaggauuauaggcaugugccaccaugcccggcuaauuuuguauuuuuaauagagacggggcuucuccauguuggucaggcuggucucgaacucccaaccucaggugauacgcccgcguugcccuccaaaaguacugagauuacaggcuugagucauugcgcccggccaacucacuagacuuuuuaaauucaaauauaaguagcagcuaacauguuuugaauuuuuacuguggaauuuuuacugugcauauauauuggugguuucucauucaaccaucaucacaagucuaugauauagguauuuauuccuauuuugcagaucaggcuacugaggcacacacagaugaagucacuugcuuguauguuggacacacacagcugcuaugugacagaguagaaaucugggccaucugacuaucuacacucauaaucacuacacaauucugccuucccaaaggaaaaaaaguauuaaugagaacgaaaaagaaucaaggcaucaggcaggcauggaguauaugcaauagcuggucagaagggcaauauggaaucaagagagcauccuugaauugagucagaccuucugcaccagcacagauugugggaccacuggaaaagggguaauacccaagcucagaacccaaacauuuccaaaagaggccccaccacuacucucaacagaacuaaaagcacuuuaaaaauccuuuuauaagguuucuugaagaaggauaacaauuuaaaaucagaaggccuaaauuuagcucuccugccuguaaguguggaccucuuuacuguguagucaagaacaagucacuuugugacuaugacaccuagauuauguccuaugaaacuauugcaaagaccaaauauaacaucugcugaggugcuuuaaagaccccaaguucuauugagaugaacuaaguuuuuugagacagugagauaagaaaaucagcauucugacccauaauuuugacaauuuaaggaaugguacauuuuagccacgaaucaaaaaaaggcucaauaaugcacacagagaaggggcucuugcaaauaugcuuuugaagaugauguaguauauuuuccuggauggguacaagugacaguaaaauacaggugguuuuagagaagcaauaagguguucacauagguacacgguauauucuaggaagaucaaggcagggaaggagacagagccuacuuccugacaaccaaaaucaaucguuaagcacugugaccaugugcuugagaaaaaugccgaaauauuuucagugcauucuccauuuccuggacagucuccuguucugaacaggaauucagaacaauggugucgaaaacacauuugguugcugggauggcacagcuguacuugcauaccaaucccccaugccucaauaacaaugcacaccuuuacacacugaugcaggaggcucugccuguguacaucuauggcauuaccagacaucuagcaaugcuccugcaaauaguucuguggcccacaggccucagcaucuuaccaccaugcucagucaggcugguaaaaacuugucuuauccuagaacuauugggaugcugcagauguauguagaaaugaaguucgagcccagcuucuaagaguuuaguucacaggaacuuacagacugcucuggcuacaguuagguaauuuauacgcacguggguguauuuacuacuagucaggaacguagaggagggcauccuuuagugaauuuuaaaauucuacuuuagcaccuuaaaauauccuguaacaccugaauucuguuauuucuuuucuugcuccuugagauucuacuccacacaacuguuucuagggcacaguagguagggauuccugaguacuccccugaggacacaccugauggagguggcagggaguauauauuucauucaguguagaauugauuaaaaaguguaugaggccgggcgcgguggcucaugccuguaaucucagcacuuugggaggccaaggugggcagauaaccugaagucaggaguuugaggccaacauagugaaaccccaucucuaccaaaaauacaaaaauuagccgcgcgugguggcgggugccuguaaucccagcuacucgggaggcugagacaggagaauugcuugaaccugggaggcggaggcugcagugagcugagauugcgccaccacacuccagccugggcaacaaagagcaaaacuccgucucaaaaaaaaaaaaaagcauaugagaacaugcaacccaaugugcccccauccccuugagaguagacagagugaguagaaaaaagagguggggaagaaguacaauacaaauaaaucccuauuagaaaucacaagcauaacaauggaaauuaucuguauaagaagaauaugucuaagucuucagucucaauucauuccagcaacacugaaagacgacuagagcaauuucuaguuguuuguucuaagauggggcuuguuuagaaauugcagcucuaucaagagcaucugaaggcacgauuugaugaauacgcuauacaugaagucaagaaacuaaaagagagucaguggaagagcucucccggcaacuuuuuuuuuuuuuuuuuuuuuuuugugagacagugucucccucuguugcccaggcuggagugcaguggcucgaucucagcucauugcaaccucugucucccagguucaagugauucuccugccucagccucccaaguagcugggacuacaggcgcccgccaccacacccggcaacuuuuuguauuuuuaguagagacaggguuucaccaucuuggccaggcuagucucgaacuccugaccucaagugaucugcccaccuuggccuuccaaaguguugggauuacaggcgugaaccaccgugcccggccaaauuucucuuucuucuuuuuuugagacagagucucacucugucacucaggcuggagugcaguggcgcaaucucggcucacugcaaccuccgcugcccaggaucaggggauucuccugccucagccucccgaguaacuggaauuacaggcaccugccaccgcgccuugcugauuuuuguauuuuuaguagagaugggguuucacccuauuagucaggcuggucuugaacuccugaccucaugauccacccgccucggccucccaaagugccaggauuacaggcgugaaccacagcgcccggcuaacuaucucuuaagagcagaguucaaccccagauuuggcuaggacuaacaugucuuucguuaggaacaauaauucuagguugacaagguuaacugcagagccagggagagacuucugugauguagcuuuucaaaaagauuuaaauucauuauauuacagugugguaucagacucacaggccacaacucauguguagccuuggaaagauaagaagguauaaagaaaaccaaaccuuucccugcaauaaauuauguauccuguccccaaucucaugaggagggaaaaaaguuuucuacuugaucuuuaugggccuucacgcagcuaaaugaacuaaacaauacauaaauucuguauuccuaaguuagucaaacgacuuuaucucaguaaaggaaacuuuuuuccccucaaaaaggcaccagcauucaaagaaucaauccugacccacaaugggaacccuacccaaaacuaaaaagcuuuggcuguaaucagaccacucuagaauauaccuuauuuaaccagcauuuggcuucucucucucuuuugaaauuaguaacuauuauuauaaaaaacccgccaggcacgguggcucacgucuauaaucccagcacuuugggagcccaaggcggguagaucaugaagucaugaguucgaaaucagcuugaccaacauggugaaacccaguuucuacgaaaaauacaaaaauuagccaggcaugguggcgcucaccuguaaucccagcuacucaggaggcugaggcaggaaaaucgcuugauccugggaggcgguaguuacagugagccgagacugugccacugcacucuagccugggugacagagcaagauuccaucucaaaaaacagacaaacugaaacaaaacaaaaaaaaaacuggcaaaucaaagcaccaccaugauuucuuaagaaaagcccaggcagaggccgggugcgguggcucacaccuguaaucccagcacuuugggaggccgaggcgggcagaucacgaggucaggagaucgagaucauccuggauaacacagugaaacccccucuccaguaaaaauacaaaaaauuagccgggcgugguggcaggugccuguaguccuagcuacucaggaggcugaggcaggagaauggcgugaacccaggaggcagagguugcagugagccgacaucacgccacugcacuccagccuaggcaacagagcgagacuccgucacaaaaaaaaaaaaaaaaaaaaaggaagaaaaguaaaguccaggcagaacauuauuuuuauaauacaaaaggcuucauuucucacaagcuagccucguucacuuaucuguauccucuuauuucacccugacacccuaugcuuuuagcaaggucuucucacucccauuucacaaaugaggaaacaggcuuagaggagcuaaauguuaacuggucacacagcuacuuaaguggagagcugggauaugaacccuaaccccuccacaaucuggccccucuugcaguucuccucacacagcccccuccuguaaagcaccucuguaugauaacuucccuugcuuuacaaauauuagccucguucucacagcaucucuuacaaaauggcaaaguaaccuauggaaagaccuuguaacuugccaccaaaguauuauaucugugggguaggcagcuaaaaacaaagaagcagcuugcuuuuuaucauacccaauugagauguuucaguuuuugaaacuuuuagaaaaaucuacucaaugccaccucuaggacgcaaagcuuuacccucugcuccugaaugugaaagucaagagaauagaggacauucuuugucaaguauucauuuuaaucuuccacagaauuuaauucuuacccucuggucucugaauuguuaaauauuaaauuguuaaaagauuacugucuuacagagaacagaacagccugagcaaugauccucauaauccuucaaaauaaaauguggcagaagaaagugugauauguauccaauuaaaccgaacauauggcuuauagcaaaaaagaggcuuugacucaacgguuuaaccucaauacaaauaacuaaauuuuaauaaagcuaaacaacguuuuagaaauuuuguuuuuuuuucaaacaggaaaccaagccuuuaaauucucaacccuuaaacauucuuuucuaaacuggggugaaaucaauuauuucagaguguaaauauucacaauuuucuauuuuuugcuaggccaacaguuggcauuuauugagcuuuuguuuuuugaucccaggguggauacuuuguuuacgaauauagugaagcacucacuugucauacagaccuggauucugugauuuugccaccuaucccauaugugacaguggguaguuuaaccucacguguuuuccuaacaauacacugggcauaaacaccuauuuugaaaggcuguugcaagaacgaguaaugaauguaaagcuuuuagcacauugucugacacaugguaagccuucagggucaagcuaucgauuucccagagaaagguggcauuuucuuaguauucaucaaauagaaugucuuaauacuacacuguguuagcauauuaauguuuauaacggacuaaagcauucuacgaaagcagcaggucaucagaauaaaaucaaguuuucauaacaguagaauucaaacauggcaguugugguucaccaaacugcuucagggauuaaguucuggaagguaauuucucuaaauaugaugacuaugucucuaugugccuuucuaccaagugaacaacucagaacguuuuacauacaaccgaauacagauuauuuuuauuuguaguguuaucgugguuuuguaacugaaggggacaggucuauacuuuugaaggggaucuugucucuugaaaggcuuauguuacuaagucuaaaauccuguuuccaaaugagaaucuugcuccccuccaaaaaggggcuuauggaggguugguggaauugaaugcuuccaaacuuuacauuagugaaguguguucaaaaacguguguggaugcuaugcauacacgugauacuucccaucacauuuuaggauucccacguuggagggaaucaauuacugguauuuguagcaauggguggaaaagauggcuucagucgaucugaguuacugcaguuuucuccaucuucugcuacucugcagccccaucuuagccuguccuccucuuaaugguacggcccccuguacucccccaaacccuuuccuuucuagcccggcguagagucucccucugugcucuuccucccacccacccccaucuucuccacccacucccucucggcccccucccacccuuucugcuagagcuacaaacacuuccuauuucuagucccacccacuuucugggacuucucaauccgcuuccccccucuucuccaccccccuccaaauuacaagcuguuuuaaccccuuuuccugccucccagggaaacuauucuuuaaaccgccuuccuccacaccacccacuggaguggucuuccaaaccguucacccucuucccaaagauuacucuuuaaacguccuuucucuaccacccucguucuccaaauuguucccgguucucaaguacuccacuccuccaggaccccaccccacucgucucucggcuucccucccacaaaagaaccuggaaugacucuccaaccacccuuccaauuaccucucccagaagccuccccccuccacgauuacaaauguuaccuggaacaaaaccucacgguccuaacccccaccccgaacuccccuuucugcucuucccgcuacuuccuagguuccaguucuacuccgcucccgcaagcauagcgggcugggcucccucccaaccccgggaagagccccuucccgcacguaccucgagauuccggcccucgccgcccccuucuccguccuccgcccgcgcucggccacccuuuccgcccuucucccgcuccgccccgcucgcucccuuccuucccuccgccuuccgucuccacaccgcucccuucccccacacuccuggcccucccaccccggaggccccuccgggcuugcccccaccuccgcgccgcccucccgccgcccucccccuucccggccaccccucccccgcccgcgcuccccgccccucggcucgccauucuucucuccgagccgcgcgccccgcccggccccggcucccuagcuucccgcucccucgcgcccucgcccccaaucccggcucggcccucgcuccccgcagccucccgugccccccgcccgcggccugaccugcaauggcggccgccgagcgcggcgccgcgcggccaacgggcgacaaccgaaccucccgccgccgucgccgccgccgcgagcacugccugcgcacuuccgacuaugcgccaggagcacuucc

SEQ ID NO: 15804 - RNA, 13790 nt, Homo sapiens
gagaggugccugcagugcgagccguggacgcuagggggcagccgcucggcucgggcccgaccgcucugggcugcgcuccucgcuugcccucggacucggcucccgcugcgagcggccgcccugcccgcgcaccgcgcucagcgcccaccgccgggcuucccgcgccggacccaguaccucggcuccccggggccggaccgaggccgcaagcagcgccgcgggguguggggcggacccaggagaugaaaugacaacgucaacccuccagguacuucgugcggcccggcccgacuucggaggccgaaggcagcggggccugcgggccgcagagccgggcggcgggcggguggucaggugggcgccucccagccccggccucgcgaccccgcuccggccgcccccucgccgcuuccgcccgugucuguuuccacgcgcucggagccggguggcaucuccacccucaggccuuccggcccugcccggcuggcccagccccagggccgcuucguguagccggcgccccgguaccgccguggggaucagccucacccgagccgcacaggcacccucaggaagcucggcccgggguccggcugggcguucagacagcgaugcucgcucccuccucuccugucucgcucccuccucuccugucccggguccuggaagucccucgaccucacuucgaacaagccccggccccuuccccaaucuucgacuuccucuucucggccagcgacccuucauucauucccuagauccugcaggguggugcugggauggcgccaccugggugaacaacugacccacccucuaggugcugucaguccugcggggccagaagagaucaacaugcucaggccucauuccgggguuugaaucucagcucugccacucaccagcaagugaccuugggcuaguuuuuuuuuuucaucuucgggucucgaguuuccuggucuguaaaaugggguaaugcccucuagguuguugugaugauagcuuuaaauugaauaauuacgguaaagcauucuuguaugucuggcacauaguagguguccauuaagugacagccaacaaagugccugggagaguuaggcaagacuucauggaagaagggacaucagaguuccaguagcauucagagaccuggagguggaggagggcagaaguaggagcagacauggaaugaguugggguaccagguuaggaauuaagaguccauagccagaucccaccguaccaccagcagaagccgcagaucccgucugcccaggcagguuuuuuauggcccgugaaccgagaauguuuuucaguuucaaacacagguguauuuauuuauuuuuaaauuuuauuuauuuauuuuuuugagauggagucucacucugucacccagacuggagugcaguggugugaucuuggcucacugcagccucugccucucagguucaagcgauucuccugccucagccuccugaguagcugggauuacgggcacccgcaaccacgcccggcuaauuuuuguauuuuuaguagagaccggguuucaccguguuggccaggcuggucucgaacucccgaccucagaugaucugcccacuucggccucccagagugcugggauuacaggugugagccacgggucuggccuaaacacagcuuuauuaagguauaacuugcgugcuuaccauauaacucacccguuauauauuuuuguuuuuauuaauuuuuuuuuuugagacagucucauucugucacccaggcuggagugcaguggcacaaucucaacucauugcggccuccgccuccuggguucaagugauucuccugccucagccucccaaguagcugggauuacaggcaccucccaucacacccagcuaauauuuuuuuguauuuuuaguagagacgggguuucaccauguuggccaggcugguuucgaacuccugacuucaagugugaucugcccaccucggccgcccaaagugcugggauuacagaugugagccacugugcccagcgcaacucacccauuuaaaguguauaauucagugcuuuuaguauauucaugguugugugaccaucaccauaaucacuuuuuagaauauuuucaucaccuccaaaagaaaccccucacccacaaccccucucucucccagcccugggcaaccacugcuaaucuacuuuuuuucucuguggguuugccuacagagaaacccacuuuauauaaacagagucauacaauaggugguccuuuguggcuagcuucuuucauuaugacuuaacauaaugucauagguuuuuacauuuuuuaaauggcuugaaaaacaguauuucaugacacaugaaaauccuaugaaauucacauuucagggucuauaaauaaaguuuuauuggaacacaucccuguucguuuauugauauacugucuacagcugcuuuugugccaucaagguagaguugagucguugcuacagagauuaucuggcuggcaaauccuaaauuauuuaccaucugguccuuuacaguaagcauuugccagcccccauuagcacucuuuucuuucauccucaucuuuugccauacguguuacuagagaugcggcggggcuggcaguuucucaccuuacccuccuguucuguaaaacuguuucucuccauugaaacuuggacccccugugugugaaaaacuguauguggcugccagaaaaguccagugcacucuuuuuuuuuuuuuuuuuuuugagauggacucuugcucuggugugaucucgguucucugcagccuccaccuccuggguucaagcaauucuccugccucagccucccaaguagccguaacuacaggcacgcgucaccacacccggcuaacuuuuuguauuuuuaguagagauggugcuucacuguguuagccaggauggucucaaucuccugaccuccggugauccgcccgccuccgcgucccaaagugcugggauuacaggcaugagccaccgugcccagccccagcacacucuuagguguauuacuagaauuuccaaaaggagggaggggaugggucagugcugcuccuuaugggacaaagaauaccuucaguauuguucuaaggauagacccaagcaugaagcuacagagagugaaaaaguccaagguacuggggguguguguucuggagacgagaagccaccagggagaggagcgcugccuuccugucucaucugaaggaacaucaugcagaagagggcagacaagggcagccugugccuaagcucauuuccaagaagguuuggggcucccagccauucauuguagguaguagagggagcagaggcuugaaaauaauggccagcacucaccccucuucucaucucuucaauccgcugaguucauuucacaucagccuggcccagccuccccuggccugucuguuuugucgagcugucuguguguguuucuuucggagacuucuuccuugcagauaagagagggcugaacaaaugccccggcccugccaagagccggucaggagguuuauuguuugcugugccuggaaccgugggucugcggugggacugccugccugguaacuggugccggaucugaggaggagaauucuggucaugcuucgugcaggcguuggugaagcugcgguuuuuaaaaccaggcuuuaaaaccauguaggugcuuuacugaccggucgcgguggcucauuucuguaaucccagcacuuuggaagccaaggcggguggaucacuugaugucaggaguucgagaccagccuggccaacauggugaaacucugucugcacuaaaaauacaaaaauuagccggauguaguggugggcaucuaucacuugaacccaggagguggagguugcagugagccgagaucgcgccagugcacuccggccuagaugauagaguaagacucugucucaaaaaauaauaauaauaaauaaaaccacguaggugcuuucaguucagccuaaggcacuggccuacaggauuuaugagauucccaaagacacucauucucacagagcucuuagaagguuccagagggacacaguucucuucuguuggcagcagggagcaagcaaguacuuuucuuacuggagcuacugguauguggagcauuguguguaagcgucccuucccagggugucacuuuagacagcgaaggaaacugucuucucucugcagccuggagaagcaagcugcauggagccaggaggaggaggagagaggccuuucaguguauccugugcaaacuugcaguccgggcaggacuuuccuucuggcuggcucuucucuggcccugaggccgggugcaauuucuggucuccuugcuaaacaaaccagcagucacuugcucccgcgugucccuucugccaggcucucagcucgggucuguuucucuuucccuugaggcagcagaauagaaagucccaugaacuugccccuugagcccugaccugagauauuaggucagguuuccacuugcugaaauccagagcguggcuuuuaaccgucugagcuuauugugaagauggccggcugguuuucaaagccuucuuugaaggccuuucuagccgauguugaaaaaguaggccaaugaaauggcccgcaagcaauaaauccacaggcccagcggcaucccucgucacguuucauccccaugccugugaccccagggacuuuccaccucuccgaggaagcacugagccauuugcuuugccuuuccagaaagccauugaucuggugacgaaagccacagaggaggacaaagccaagaacuacgaggaggcgcugcggcuguaccagcaugcgguggaguacuuccuccacgcuaucaagugugagucacacgagggguccucaggcugccgcacuccagaggggagcggaggagaggggguggcgcacgagccucacaggggccccucuguguucccuuucacagaugaggcccacagcgacaaggccaaggagagcauucgagccaagugcgugcaguaccuagaccgggccgagaagcugaaggauuauuuacgaagcaaagagaaacacggcaagaagccagucaaagagaaccagagugagggcaaggggugagugucugcagcguccgcccaggaaccugggcccuccucacggcucccuaucauuccuggcgcucaugcugccuuggacuucccugugggaaugguccucauagugcagggaugacagugccagcagcugcuuucagggagcauggccuggagcacuuccauguucaccgucucauuggaucugacccacaagccauggggagagggggagcuuggugcagaugguagagccucucaggacgggaccccagcucugucaccucccagccuagugccaggaccccgugugccuaccaucuccacaucuuggaaguggggaggucguggaacucaccuccgagcguugccacagggagcagugagaugacgugggcagugcccuuggagcuuggcacacgagagcaugcaaugagugccagcugcugugacugucaaagagucaccugccuccaacagguggggcggccggcucggguuaggagcccugccgagguggcacaggauggaacuuggacccccaaagcagggcggguggccccgauuccccagccaggguccucuccacagccucucaccucagguacuggguucgcccaccacggugaucccagucauaugaacacaaaugcuggugguaucucggaggcgugggaggggaagugagggggucccccaggcaggagagggguggguggugucagcugccucaccagaggcgaggccuccuccuggauggagggucugcaccacguucccauccgcagagggagaggucuggcgaggcagggguggaggccagggaucuccaauaaggauuaaaucaaguuuugaggaugacagauuccauccagggaggaaguagcccuggggugacaguggcugcguucuccccaggaguucccuuucgauuucgguuuugcuuucuccucuguccuucggcaguggcugcuuuggagucaggggcacaugcugucccugagucucuacaaaaagcuucuggugcggggcaugguggcucacaccuguaaucccagcacuuugggaggccaacgcgggcagaucacuugaggucaggauuucaaaaccagccuggccaacauggugaaucccgucucuauuaaaaauacaaaaaaauaggccgggcgcgguggcucacgccuguaaucccagcacuuugggaagccgaggcgggcggaucacgaggucaggagauugagaccauccuggcuaacacggugaaaccccgucuccacuaaaaauacaaaauauuagccgggcgugguggcgggcaccuguagucccagcuacucaggaggcugaggcaggagaauggcgugaacccgggaggcggagcuugcagugagccgagaucgagccacuacacuccagccugggcgacugagugcgacucugucuuaaaaaaaaaauuagccaggcauuguggcaugugccuguaaucccagcuacucgggaggcugacgccagagaauucagagaauuacuugaacccgggaggcggagauugcagugagcugagauggagauugugccaucgcacuccaaccugggcaccaucucaaaaaaaaaaaaaaaaaaaaaagaagcuucuggcagcugcauuguuugacuggcuuuuuuuuuuuuuuuucccccagacagggcuucacugucucccaggcuggagugcaguggugcgaucuugguuaacugcaaccucugccucccaaguagcuggcaccauaggugcgugccaccaugcuuggcuaauuuuguguuuuuuguagagacaagaucucgcuguuucccaggcuggucucaaacuccugggcucaagcgauccucccgccucagccucccagagugcugggauuacaggggugagccaccgcacccagccugggcugugagagccacugcagguggccucccagaguaugaggugugagucaccgcaccuggccugggcugcucuuuaaguccagcugaagcacauuucccuuacggccuucaggagagggccgacccggauucccaucugcuccgcgaagaaacagggcggguuauaggaguguuugcuggggggguccugaagugagcugcugagagcauuggcccaaaugucccugaaguacuugcuugagucacacggcacuguuaagccaggaaggcuucguuccuuaaccagugugcaggcagcggagccuggacuugcugggagcaccucugugcuccaggcugaagggccagcuugugacuuuccgucucccuucccagcagugacagugacagugaaggggauaauccggagaaaaagaaacugcaagaacagcugauggguaaguggcucgcggcccuguggcagcggcaggggaugagaguggguccgcugcuggguuggcucaugccccuuggccgggcccgggcccgggccggccucccucucgcaggugccgucgugauggagaagcccaacauacgguggaacgacguggccgggcuggagggggccaaggaggcccucaaagaagcugucauuuugccaaucaaauucccacacuuguucacaggugagaguugagccauuucaaaccccaauguaaaaauuccaggcuuccgcagggcuggcacuccgaggcacccgggagucaguggcgacucagcccccggggccugcagagggccaggccuggcugcucgcugguguccacaacacugcuguggcuggagcuaugagaugacgaucacgucacagggugggggcaggaucaggaagcagugccagccggugucacugugcaaggucauggggucauagcaggggcacugugcaaggucauggggucauagcacagggcacagcagggaauguagcucccaucacuuguuugccaguagaguccguuguuucacagaaugcccuguuuuacuguauguaugggacucgagacccucugcuuuuccuauuccuuuccccagucaggaggccuaacuucugugguucucuguugcaggcaagcgcacccccuggcgggggauucugcuguucggacccccuggcacagggaaauccuaccuggccaaagccguggcaacagaggccaacaacuccaccuucuucucuguguccuccucagaucugauguccaaguggcugggggagagugaaaaguaagucggccaccaggccaugcucugccagcagccccggcacugcuagugacccagcggcccacccuguggagucaccucucagaggagugguuugguuuucagggaggguacccaagagcagugugucgcuagcuuaucggcugggacacagucccaacaaagacaagugaagguggaagggaccugggagaggugaagugcuccacaagagaagggaaaggaagugaggauauuuuuggggucuggguugcggucccuguuggggcagugugugggggacaugguuccccacacugacuccuguuuugcgugugaugagacgggcucggaagaaggggacugacguguuguaagugcagagcuagcgcauggggcuccugggauugaggcucugcguuuggggcugacaccaaggugugcuccuccucuuggugcaguguggcccgagggcuccucaccaccacguuuuccgcaauuccggcaugaccguggccugcgccucccugugggaagggugagaagagggaagugccgggagcccaggcgggcacggacgugaacgucuuguccucacccccuuucucaccuucacaggcuggucaagaaccuguuugagcuggccaggcagcacaagcccuccaucaucuucaucgaugagguggauucccucugcgggucccgaaaugaaaaugagagugaggccgcccggaggaucaaaacggaguucuugguccagaugcagggugugugccgggcccagggcccccuugguucuuguugcaccugaagccaacccugggcuuuauucugagcugcggcuggauuugguuguucucagccucggagaggcacuccccagcuccagccccucagggcacggguggacuucaauucccaagaggugccugaggccucugccucacgggccacuccaccccucccauggcaggcagugccauaggucucaccuggcacagccagaccaagaugugguuuaaucucacuugggacccugccagugguggguggcacagggauggcuucaauugcugacacacaaagcccccggggucuguccccagguuucaacugacccgugcagguguccagagucugagucuuugucucccuuucuccacagggguggggaauaacaaugaugggacucugguucuuggagccacaaacaucccauggguguuggauucggccaucaggaggaggugagucuuccccaggagaagccagggcuggaggcuuccucccaccauggucacgguccgccugcugcuggcagcccgggugcagccuggccccuuuucccuggagucuucccgucugccugccaagcagagcccuuugugaggcuggcuuguugaggaugugccgccagcaucacuggcccaugaaaugcguccguuucacucaaaucuucgugccuccccuuccgugaauaccauuccaucauccgcugucaacuccugccgugugcugggcucucuagguuugaaaaacgaauuuauauccccuugccggaggaagcugcccgcgcccagauguuccgguugcaucucgggagcacuccccacaaccucacggaugcaaacauccacgagcuggcccggaagacggaaggcuacucgggcgcggacaucagcaucaucgugcgggacucucucaugcagcccgugaggaaggugcagucggccacacacuucaaaaaggugagugcccgcggccacugcugagaaaaaucucauaguaagagcgggauguucgguuuuuuuuuucccagcuccugguccugcuccccggcugcucaggugacacagucucugaggccuccuggagagccgagggccagugccaugggggcugcacccacuguccccucccugcagcucuucuggaguguggccaucucagggugugugaaagcagaggacagggccacuuuacugucuuaacccugcugcggccuccuccgucagcacugugugcucuugugcgggguggacaccaaaucaguguuuggaaaguguuggauauaaaaugaccaggaagaccugucuauucauucagcagaucucugcugaguauuugcuguggguccuccugugugcccggcccuguccuaagugcugggaagauaugagugaccaacagacaaaaauccuagaccuuccguuguugguggggagacagucaacacagucagugagugucucagaggauggagauggagcaggguuaggagagaggugucucgggcauggagggaagggcagauggcacuggggugaugccugagacaggaggugaaggugugagggaaugagccuuguggacauugggggaauguuuugccaaggcagcggacuucaguuggaaaaccacuuuguguuaaucuauuuucaugcugcugauaaagacauacccgagacugggaagaaaaagagguuuaauuggccuuacaguuccacauggcuagggaggccucagaaucaugguaggagaccaaaggcacuucuuacaugcugguggcaagagaaaaugaagaaacaaaaguggaaaccccugauaaacccaucagaucucgugagacuucaccaucacgagaauagcacgggaaagaccagcccccaugauucaguuaccucccccugggucccucccacaacaugugggaauucugggagauagauacaguucaaguugaaaugugggugggggcacagcuaaaccauaucacacuuuuaaugucacuguauuccuggugagacgugacaguguuaaugaggaagacaucaaggcauuggggcuacagauugccagagucccaugcaaaucaugagucgcucggaccacccagcccgaguucugaaggagcccguccuccucagaugcuagggacccacagagcauucucuuugggacuuccuuagagaccggaggggucgagccccucugacacugaggggcagcugccccagucagauccauuugguuucaggucuguggccccucucgcaccaaccccagcaugaugauugaugaccuccugacuccaugcucaccaggggacccaggagccauggagaugacuuggauggaugucccuggggacaaacucuuagagccugugguuugcaugguaagugacuugacaggggagggaagagggcugcacagagcccagaaaauugaggguuuggguccagaauaaaaacggucuucuccaggccaggcaugguagcucacgccuguaaucccagcacuuugggaggccagggugggcagaucacaagguuaggaguucgagaccagccuagccaauauggagaaacccugucucuacuaaaaauacaaaaauuagccgggugugguggugugcacuuguagucccagcuacucaggaggcugaggcagaaggaucgcuugaagccgggaggcagagguugcagugagcagagauugggccacugcacuccagccugggugacagagugagacuccgucucaaaaauaaaaaauagucuucuucuauguccugggcuguugagaauggccuuuguagcucagggaagcuggcauuacacucacugggggcccagaaugcagguggcagcauuagcauuuuguacauacagagaaaggcuagaugcaguggugcagugauagcucacugcaggcuugaccucacgagcucacacaaucuucugaccucagccuccugaguagcaacaggcacacaccaucaugcccagcuaauuuuuccuuuuuuuuuuagaaacggccucacaguguugcccaggccagucugaaacugcugggcucaagugauccucucagcguggccucccaaagugcugggauuacaagcaugagcugagccaccacaccuagccugcauuuuauauucuuuagcaaguaaagucagguccagauaauaugacgucaauccauggguuuggcuuugcggugcagugaggcagugaaugugucaagacugugacgcaguugcaaaggcagcgccucaccugcauagccuggcccgugccauccuggcaagggucugcccuuguggcugguguugggggugugcagcuaagaaggcuccuggccgggcgccguggcucccgccuguaaucccagcacuucgggaggccgaggcgggcagaucgccugaggucaggaguucaagagcagccuggccaacauagugaaaccccgucucugcuaaaaauacaaaaaucagccaugugugguggcacgugccuguagucccagcuauuugggaggcugaggcaggagagucacuugaaccgaggagguggagguugcggugagccgagaucaugccacugcacuccagccugggugacagacuccgucuccaaaaaaaaaaaaaaaaaaaaagaaagcaaguucguaaggggaguuaugagaugauggagcuuagauucucagaccaggaggaggcccaucugagcugccucgagagggaagagggucccugccauaggcagauucaagcaggccucugggguggccuugaaggcaaaccucuucccacccucagcugcgccuguugugugcugaggggagguuggggaccuggagccuggcuccugcucaggcacauacuguugccuucacagucggacaugcugcggucucuggccaccacccggcccacggugaaugcagacgaccuccugaaagugaagaaauucucagaggacuuugggcaagagaguuaaaagcugcuucacuugggcaauggugaaggugggagguugauuggggcaaauccaggcacuccccaugucaacagccagacagggcuccagggcuugucccagucaauacagaguucccucugcugucuggccgucugccagggagccagaaggaagggccuugcagccacagagacacuccacugcccuggggcacacaguggacacugcucuuccuacuuccuccucuccuggaugcucaucagcuccuucugccucccccccuuuuuuuuccaucuuuuguuccccuaaauuaaugcugcuuggauuuucaucuuauuuauaaagauaaaaucaccuggaagugucaaggaguggggcgggguggcgggggagaagcagccgugcugccaggucacccagaccuccagacagccggcuagccccacugcccguuccuuuuacgcccaaguuuugcuccuugagagcagauuggcugaugccccugcaaccccagcccaagcucugccucaaagaccgagugacauaagccauucccacccuccuagguucacauccagggcugugucuuccuugggggaggagauggugucguuuagaucaggguaaggcagucaggcggguguucaccacugccuuuucuuccucugagcgugagaacacugaacccagccacugccccugggucccuguccuggaaauggucuaauaaauccuuuucccuucuugagcuacccaagugauc

SEQ ID NO: 15805 - RNA, 576 nt, Homo sapiens
uuuuuuauuuuuuuuauuuuuuauuuuuuucauagguauauaaacuauuuauuaacagacaaggccuacagacuuauuucuucuuggacacacccacggugcggccacggcggccaguggucuuggugugcuggccucggacacgaaggccccagaagugacgcagcccucuaugggcccgaaucuucuucagucgcuccaggucuucacggagcuuguuguccagaccauuggcuaggaccuggcuauauuuuccauccuuuacauccuucugucuguucaagaaccagucugggaucuuguacuggcguggauucugcauaacggugaucacacguuccaccucaucaucagugaguucucccgcccucuuggugaggucagugucugcuuuccucaacaccacaugagcauaucuucggcccacacccuuaauggcagugauggcaaaggcuauuuuccgcugcccaucgauguugguguugaguacucgcaaaauaugcuggaacuuuucagggaucacuagcgacauggcggcagcacaagcggcggcguguaggccuccuguggaggagc

SEQ ID NO: 15806 - RNA, 9508 nt, Homo sapiens
uuaaaaaucaagccauuuaauuguaucuuugaagguaaacaauauauggagcuggaucacaaccccugaggaugccagagcuauggguccagaacauggugugguauuaucaacagaguucagaagggucugaacucuacguguuaccagagaacauaaugcaauucaugcauuccacuuagcaauuuuguaaaauaccagaaacagaccccaagagucuuucaagaugaggaaaauucaacuccugguuuuagagauaaaugaaugaagaguaccaaaauauuuguugacuucucuucauuuuucucauacaaucugaagccugagcugacuaucauauccccaacucacagcagcgaaagcugcaguucagauuugagaucagucuccauucacuuccacguagcaccacagcaagagugaccggaggcagagagcucuuguugggucagcuuucuaauaagcaugucaagugaaaaagaacccucuagcagcacacugauuuaguuuguaagauuuuaauuuacaaauuaaaaaagcuauuuaauacauguuuuacuuuuucuccuuuuucuccucuuucuuuacaucacucuuuuccuuaucuuuaucuuucuccuuguccucuuuccuauccuuuuugcucucuucuuucuccugcccuucuuucuucucugcaucccgguuggcaaucuuguuguugaugagguugugcagggcgaccacggaacggaucagcgaggccaaguacacuaccaccaucuggucauuggucuucagguaaaaggccuugacgaacuccugcaggcugacaucuggcagcagguugaagacguccugcagcugguagaugaucuggugguugaugggcagcuugccuguggcgacuuuuuccagguagcuccugauauccagaagcuuggaguucagucccuucaaaccauggaccugguuugugauccgcugggacagagugcccaccgucgugucuuugauaucucuguaauaacccacaguuaaaaagggcaggaaaaggcaucaggguaccauguuaucaggcaaguucuuacauucuaagaaaauuccuagcuuuguugggugaggcaaguuuuuaaaagaaaaaugucacuuccccauuugauaaagauuucguuaucaauuaccuuaauuucguuaucauuuggaacacauuuuaucuuucucaucacaggacauuuuucaaaaaacaauuauaaaagggagcuaaaauaaaaccauuuccacuuaaggaaaaaaaaauugcuuaggucaacaguucagaucuaccaauaacuuucuggguaaccuuguacugaagcugucucucucagcuuuccuguuccuaaaaggauggcauuuucucuacaugcaucuccagaauauugagaagcuuaacuaagaugguaauuuuuagaacuagaaggaaccucauugacugauaaaacuauaaccuuuuucaaauaaggauuauaauagauauaggauuuuaaaacaaaagcuacuccaagaugaagauucucuccagaaaaugggcuacauuuguugagaaggacaccuaguggagagugcaggccugcauuuauuucauaccucucuucccgucagucaacauuauaguuuccagacaagguaugcuauccacaaagucauaaauuguaacucaagacauuuuacaguugauguaguucaaacacuucaauuuacagacaauaaaacaaaggucuggaaagggacugugauuugcucagaauggcagacuuguuaguggacggccaggacgagaccccaggucuccauauucccgacacagaccucuuccuuacacugugugaccucucgggcagugaaugauuuugaugcuguacuagggucucaccguaacaaguguucaacuccaacuuccucagcuuccucugcuccaauuucacuggucacguguucaaauguuuucgagguuggaguuccauccugggagaggaagccuaacuauaauuauuuauuuuccacaaacgaacugacauguguuccuuuucgcacccugagucuuuugcuuuaagucagcucauuuaaugagugcaugacugagaauuuucuauggcaaggguggguaaggcuuacuuugaaagcuuagccuucaaagcuaacaucacuguggugcugcucagugaugcagucugcuggggcacugugcguugagaaaaaucuggaaauucccucaagcccacacuuggcaugaacgcacagggaggucucagguugauucuuaaaaguauaccgcuuuggccaggcacggaccuguaaucucagcacuuugguacgccaagaauucgagaccagccugggcaacauggcgaaaaccccucucuacuaaaaauacaaaaacuagccaggugugguggcgggcgccuguaaucccagcuacucuggaggcugaggaacgagaaucacuugaaccugggagguggagggugcagugagucgagaucacgccacugcacuccaaccugagcaacagagugagauugucuuaaaaaaaaaaaaaguauauaguucuuucuagaauggacaauauacagaauaucuguacugaagcaaguucaugccagaaaauaaaacuuuuagcccuuuuuugucucuuggaucaaacgauuccacagugcccaaaccaaugcaaucagaauaguuggcuuucugguggucugaauuaaucaaaggauccauuggggacaugguucaugguggucacccagugacauccugaagggacuucgaagauacuuuucucagaccuugugccagaagaggcuguacgucuccugucaaaaggcuguaaacugucuguaagggaggaaggacagcauagugguaagaguacaggcuccacagccaggcuaccuggguucaaauuuggcucugccauguauguaauaggcgagcuccaagaccuugggaaagucacucaacucacacuaaguacuauaaaaguuagccgugauuauuuuauuuaggauaguguuaauccugcaaggggcauucuccucuuugcuuuggaugccaggauggucagaaccuuuaacaguguugugggauuucuugguaaccuuuacaggcacuaauucuucuugagcuucaccuuguaacaugacccauauguccccuuuauccccuacuaaaaacaccuugcuucacuggggugcauguguacgagcaaccucaauuccuuuucuaaagaggcaggagaaaaauucacuaaaaacaacugggucaaaaccagggaugaaagcccuacugcaauuaggcaauacauuuggcucuaagcucccugguagccaggcaaagagaaaagccccaggaagacagagcucgaugcaaggaacauuugcacagagcuauccuaaaauacccuuuucuaaaucuuaaaacugaaaguaaggauaaauacugcauaucuaaauucaaaaggagaccguaauucaucccuuaaacuuuucauuuguaaaaggggaauuuggauuucuugguuuuuugggggacagcgucucaacugucgcacagguuggaaugcaguggugugaucauugcucacuguaaccuugaacuccugggcucaaacaauauucccgucucagccuccugaguagcuuggaauacaggcauggaccaucaugccuggcuaauguuuuuauuuuuguaggugucuugcuauguugcccaggcuggucuucaacuccuaggcuuaggcaauccucccaccucggccucucaaagcacugggugagccacugugccugguuggaauuuagauuucuauguuccucuccauuuccaaaauguggugauuaaaaaagucaaagggaaaaaaacuaccuucuuuuguuacggagacaaaggauuuguugaccugaaaauugaaaaaaaaaagcuaaucacccaauaaguagcagucuaaccucccagguucauagcaagaugacuuacaucauggacuucuuccacugaaauguacgcuucuguaggcagcccuagguccuucggcuucacaucaaugaugaccaauaccuggcagagaaacacaucuuagcaagucaucucacgcccagcacaaaagggguaauuucaggcauucuucucacaauuacuaaagcuauuucuuguaaucaauuagaaaugaaccagaauauucagcaaaaaugcauuuaugcuucaaaugaucucaucauuucuucugcuuuucgauccccuucauuaauaagcugaggggcaguacagugccuagcacaaggacauuagagucaacacagccaaaauuucaaucccagucccaccccuuaccagaccuuccuaaccauucugaaccucaguuuucucauuuguaaagaggauauacaguuaccgagaggauuacgaaacucauacaccugguacuuagcagguauaaacuauuauuuaucaaauauauuaggucacaguauacuucacagagcacuacaaaucaacagaaguuuauggagauaaagcaguaagcagauuugcuacucaaauucuucccaggaugcucuuacuugagcuggcuggcaaaaaaaaucauucaagaguuuuaaaaauagacaccacuuacggaauuaggacaguaucuuuucaugaguucguugauggcaaugucauucuuguguaguuuagggccugugugguaccagccaacuauucuuucccuggcuaggaaggaaaaaaauuagcaggcuuuaacuauuucaugaagaucuauacaacucccucaaaaaggauaagaacaucaguaguuauguccuuuaccucuuugaaaauuccagacauauuuacccuggugguacuaaaacucuaauggaagacugacuuuacuggauaguucuucacuuuucugccgcaaugagagguuauuuccccuuguacccaaacccaggucgccuauuuggccuuaaauugcuacucuaguuuuucauguauucuaccuuauuccucuacuaccacuagucuuacugaaguguagcuaagugaaagggcccuugauguuaaagaaaagcgaacagaagacccccauacacacaguucaauucuaugcuguaacaccuuagaacaucaagacauaccauugacuuucuuaaacauuccauacauguuuuccaaauaaucauggucuaaaaaccauacagaaucgucuuugucaucuucaucaaaaggaacuaaagaggaaaaaaaaaguuaguuuagggugcuugauagaaaccuagaacacaggucacaauugaagaccccuaggccaguucugauucacuuacguguuucacuugcccagcaaaguauuaaaaaauuuuuuuugagcugccccaaaaacugggagaauucacauaaaaauccagacuuccagcuucucuuaaaaaacuggaauaccuggcaacuaccagcuacagccagguaggggcugcccccuuuaaaaaagacacaugcuuuucaguuuucuagaaguccaguuacuuccugauauuuuucaauuuggcaaaugacaugacuagcuggucauuuuagacacuagaguuagugaucucuacuccagaggucauccaguaucaucuucuuuauuguuguuccuuuaaucauuaaaguaauacauggguacguucuuguaaggauucacauaaagggguaaaguuccccaucucucuccuuacuguaccuauaagaagcgugguuaaacaguuuagugcaggggcugacaaacugugccagcugccuguuuuuauagagguuugcuggaauacugccacuuuuguuuguuuacauguugucuauagcagcucuugcacuauaauggcagagaggagcaggugcaguggagaccacauggccugcaaguuuaaaauauuuacugucuggucuagugugcaaucuucagguucucuuuucuauacuucagcaauuuuaagacaaucucuggguuguagucaaaagcgguaacaaagguuuauauuuuuaaaggguaaacugacauuuuaaucaugcucggaaaaacauaaaauuugucuuuuaccugcaaaacuguucgauacaucaaguacuuucuuuugccaugaccccaaaagcacaccaacaacacgcuucugguuuccaaccuugccgauucugaaugagaaaacagauggucaguguggauaggcucgcacagaaacaugaacccaacaauaagauacucaaugggaaauaucaauggcacagauacaauuuaguuuaccugggaacuaaucucccuaaaccaauguaauaggguuagguugauauuaacuauaagggguaauucauaaacuugguacugacacccacuggcaguuuuuaccuaacauugacugugaaguaauacaugcuugggaaaauuucaaacuucacagaaauuuaaaaugaagaaaaugaaagcuucccagaucuuagucugaaaacacauuuaagcuuugcuaccacauuuaacuuuacuuuuucuuugcagcuuuccuucaccuuuaaacuuuucccauccugaaaucuuuuuuggaauaaagaugauggaguaggccggaugcaguggcucaugccuguaaucccagcacuucgagaggcugaggugggcagaucacuugagcucaggaguuugagacgagcaugggcagcgugggcaacauggcgaaacccugucuacaaaaaauacaaaacuuagccgggcauaguggggaugugccuguagucucagcuacuuggggcugggggacugaggugcagggacuacuugagcucagaaggucgaguuugaggcuagcuacagugagcugagauugugcuacugcaccccagccucggcagacccugucucaaaauaaaugaaugaauagaggaggacugaaugagaaagauuuuacuugagaauuuuuaucuccauuucaaaccuccucagucauuuucuccuaaggaguuacaagugcaucacuuacacacucucauuuccuuggucuucaagaaguauuuuuuaaccacuagcaaaugugugacacagaaauacaacccuaugcuaaggaaagacaaaagccacuguuaauuacauuuucuuaacagcugcuaguuucacauugguuuaacuguaguauuuuucuuagcauauaguuggcaaaucuauaaaugguuacuagguuugggguuugaaucaaacaaaguuaaugauucuguauuucuggugccucucauuuuuggggguggggggguaagggggaaauugaauuuccaacuucaagggaaacuuccauacucgugggcuuuuguuuuggucuaccaaaguccauuuguguuuuuuaaaacccuacacuuacuugauagagaagcuagugcucuucuuuguuuuugagacagggucucacucuguugcccaggcuggaguccaguggugugaucuucgcucacugcagccucuaccucucagauucaagugaucuucucacuucagccucccgaguagcugagacuccaggcacacaccaccacaccuggcuaauuuuuguuuuuuuguuuuuuuuuugguagagaagggguuucaccauguggcccaggcuggucuugaacuccuaagcucaagcaauccgcccaccucggucuccgaaagugcuaggauuauaggcaugugcuaccaggcuagccugaaagcuagugcucuuaacaagugcuugaauagcacugaaauagugccugccccuaguaucccaugggagaaaaauaguaauuccucuccuguagaaaagccaacauauccuaggcugaggguccuuuuccggauccagcugaauuaguugcacacagcaaguugcgggagaauggacacuuugcaagaauggcuuuauagcagaugcucugaacugggucuuuacauuugccaauucaacuaacaaucuuguaaaacuuagaaacaugugcaacaggucuagcaggaugaacaacuccaaagccaagaggugguggauguacacccucaaacaaugagcuuacuagaugaccuuugagauguuuccuuaccuuauucauuaagguucaaaucuccaacuggucuuuuuuuuuuuuuuuuuuuuggagacagggucucacucucacccaggcuggagugcaguggcaugaucucagcucacgacagcuucgaacuccugggcucaagcgauccucccgucucagccucccaaaaugcugggauuacaggcgugagccaccaugcucggccucguguuuuaaauaaaaacugaaaccucaucuauauauacauuuuuuuuuuugagacggagucuaaucagauucccauuuaaaaauguuaauggguuaaaaccacagcugauccaggaagcccuucggggugcugagcaucauccagauuucgauaacaggaacucggucaaaugaagacaaacauagauacgacccugggggcgggggucagggccaaauugaagcuagcccccuuagccccacuccggcaucauccaggcaucauucacuuugcaucauucacauuucggugaaaucaacuugguuaaacgaggauaaacauaaauacgacccuggggccggggucagggccaaaugaagguagccacccugcaccccacuccagcaucauccauauuucggugaaaccaauucggucaaacgaagauaaacauagccuuggggcggggcuaaauggagcuagcccacuccgccccacccaagcaucauccagacaucagucacuuugcauuauucacauuucagugaaaucaacugagucaaaugaagauacgacccuggggucgggggucagagccaaaugaagcuagcccgccuccgccccacccuggcuuuauccagauuucggcaaaacgaacuucaaaacgaagugacagacacgagcuugggggcgggggucagggccaacuaaagcuagccgcaucucccgacccccagcaucauccagauuucgguaaaacgaacuucggcaaaacgaacucggaaagggaacucuguaaaacaaacaggcuaaacggaacaggcagccaaggccccgaaguggcggcggcuggggcaggggcgggaggcuggaugacuccggcaucgugagccgacgcuggucuggacucgugaacaaguaagggucaccagccgcccuaucugcguccccagcucguccgcggccgccgcgccaucuccagcgugcccgugacucagcagcggcugcgccgccggcccagcuauagggcgcucgcucaccgguugaaaugauccaccacacugagcagcaccaggggguggaccaccaccuucugcacugccagcuccggcaucgcgacacaccccgcucgccaggccuggcucccugccacacgcaaacaccggcagcaguagcggucaccgguacccuuucaggcccaguuccucuucuuccgguucgucagcccucgcgcggccuccuucuucc

SEQ ID NO: 15807 - RNA, 9508 nt, Homo sapiens
ggaagaaggaggccgcgcgagggcugacgaaccggaagaagaggaacugggccugaaaggguaccggugaccgcuacugcugccgguguuugcguguggcagggagccaggccuggcgagcggggugugucgcgaugccggagcuggcagugcagaagguggugguccacccccuggugcugcucagugugguggaucauuucaaccggugagcgagcgcccuauagcugggccggcggcgcagccgcugcugagucacgggcacgcuggagauggcgcggcggccgcggacgagcuggggacgcagauagggcggcuggugacccuuacuuguucacgaguccagaccagcgucggcucacgaugccggagucauccagccucccgccccugccccagccgccgccacuucggggccuuggcugccuguuccguuuagccuguuuguuuuacagaguucccuuuccgaguucguuuugccgaaguucguuuuaccgaaaucuggaugaugcugggggucgggagaugcggcuagcuuuaguuggcccugacccccgcccccaagcucgugucugucacuucguuuugaaguucguuuugccgaaaucuggauaaagccaggguggggcggaggcgggcuagcuucauuuggcucugacccccgaccccagggucguaucuucauuugacucaguugauuucacugaaaugugaauaaugcaaagugacugaugucuggaugaugcuuggguggggcggagugggcuagcuccauuuagccccgccccaaggcuauguuuaucuucguuugaccgaauugguuucaccgaaauauggaugaugcuggaguggggugcaggguggcuaccuucauuuggcccugaccccggccccagggucguauuuauguuuauccucguuuaaccaaguugauuucaccgaaaugugaaugaugcaaagugaaugaugccuggaugaugccggaguggggcuaagggggcuagcuucaauuuggcccugacccccgcccccagggucguaucuauguuugucuucauuugaccgaguuccuguuaucgaaaucuggaugaugcucagcaccccgaagggcuuccuggaucagcugugguuuuaacccauuaacauuuuuaaaugggaaucugauuagacuccgucucaaaaaaaaaaauguauauauagaugagguuucaguuuuuauuuaaaacacgaggccgagcaugguggcucacgccuguaaucccagcauuuugggaggcugagacgggaggaucgcuugagcccaggaguucgaagcugucgugagcugagaucaugccacugcacuccagccugggugagagugagacccugucuccaaaaaaaaaaaaaaaaaaaagaccaguuggagauuugaaccuuaaugaauaagguaaggaaacaucucaaaggucaucuaguaagcucauuguuugaggguguacauccaccaccucuuggcuuuggaguuguucauccugcuagaccuguugcacauguuucuaaguuuuacaagauuguuaguugaauuggcaaauguaaagacccaguucagagcaucugcuauaaagccauucuugcaaaguguccauucucccgcaacuugcugugugcaacuaauucagcuggauccggaaaaggacccucagccuaggauauguuggcuuuucuacaggagaggaauuacuauuuuucucccaugggauacuaggggcaggcacuauuucagugcuauucaagcacuuguuaagagcacuagcuuucaggcuagccugguagcacaugccuauaauccuagcacuuucggagaccgaggugggcggauugcuugagcuuaggaguucaagaccagccugggccacauggugaaaccccuucucuaccaaaaaaaaaacaaaaaaacaaaaauuagccaggugugguggugugugccuggagucucagcuacucgggaggcugaagugagaagaucacuugaaucugagagguagaggcugcagugagcgaagaucacaccacuggacuccagccugggcaacagagugagacccugucucaaaaacaaagaagagcacuagcuucucuaucaaguaaguguaggguuuuaaaaaacacaaauggacuuugguagaccaaaacaaaagcccacgaguauggaaguuucccuugaaguuggaaauucaauuucccccuuacccccccacccccaaaaaugagaggcaccagaaauacagaaucauuaacuuuguuugauucaaaccccaaaccuaguaaccauuuauagauuugccaacuauaugcuaagaaaaauacuacaguuaaaccaaugugaaacuagcagcuguuaagaaaauguaauuaacaguggcuuuugucuuuccuuagcauaggguuguauuucugugucacacauuugcuagugguuaaaaaauacuucuugaagaccaaggaaaugagaguguguaagugaugcacuuguaacuccuuaggagaaaaugacugaggagguuugaaauggagauaaaaauucucaaguaaaaucuuucucauucaguccuccucuauucauucauuuauuuugagacagggucugccgaggcuggggugcaguagcacaaucucagcucacuguagcuagccucaaacucgaccuucugagcucaaguagucccugcaccucagucccccagccccaaguagcugagacuacaggcacauccccacuaugcccggcuaaguuuuguauuuuuuguagacaggguuucgccauguugcccacgcugcccaugcucgucucaaacuccugagcucaagugaucugcccaccucagccucucgaagugcugggauuacaggcaugagccacugcauccggccuacuccaucaucuuuauuccaaaaaagauuucaggaugggaaaaguuuaaaggugaaggaaagcugcaaagaaaaaguaaaguuaaaugugguagcaaagcuuaaauguguuuucagacuaagaucugggaagcuuucauuuucuucauuuuaaauuucugugaaguuugaaauuuucccaagcauguauuacuucacagucaauguuagguaaaaacugccagugggugucaguaccaaguuuaugaauuaccccuuauaguuaauaucaaccuaacccuauuacauugguuuagggagauuaguucccagguaaacuaaauuguaucugugccauugauauuucccauugaguaucuuauuguuggguucauguuucugugcgagccuauccacacugaccaucuguuuucucauucagaaucggcaagguuggaaaccagaagcguguuguuggugugcuuuuggggucauggcaaaagaaaguacuugauguaucgaacaguuuugcagguaaaagacaaauuuuauguuuuuccgagcaugauuaaaaugucaguuuacccuuuaaaaauauaaaccuuuguuaccgcuuuugacuacaacccagagauugucuuaaaauugcugaaguauagaaaagagaaccugaagauugcacacuagaccagacaguaaauauuuuaaacuugcaggccauguggucuccacugcaccugcuccucucugccauuauagugcaagagcugcuauagacaacauguaaacaaacaaaaguggcaguauuccagcaaaccucuauaaaaacaggcagcuggcacaguuugucagccccugcacuaaacuguuuaaccacgcuucuuauagguacaguaaggagagagauggggaacuuuaccccuuuaugugaauccuuacaagaacguacccauguauuacuuuaaugauuaaaggaacaacaauaaagaagaugauacuggaugaccucuggaguagagaucacuaacucuagugucuaaaaugaccagcuagucaugucauuugccaaauugaaaaauaucaggaaguaacuggacuucuagaaaacugaaaagcaugugucuuuuuuaaagggggcagccccuaccuggcuguagcugguaguugccagguauuccaguuuuuuaagagaagcuggaagucuggauuuuuaugugaauucucccaguuuuuggggcagcucaaaaaaaauuuuuuaauacuuugcugggcaagugaaacacguaagugaaucagaacuggccuaggggucuucaauugugaccuguguucuagguuucuaucaagcacccuaaacuaacuuuuuuuuuccucuuuaguuccuuuugaugaagaugacaaagacgauucuguaugguuuuuagaccaugauuauuuggaaaacauguauggaauguuuaagaaagucaaugguaugucuugauguucuaagguguuacagcauagaauugaacuguguguaugggggucuucuguucgcuuuucuuuaacaucaagggcccuuucacuuagcuacacuucaguaagacuagugguaguagaggaauaagguagaauacaugaaaaacuagaguagcaauuuaaggccaaauaggcgaccuggguuuggguacaaggggaaauaaccucucauugcggcagaaaagugaagaacuauccaguaaagucagucuuccauuagaguuuuaguaccaccaggguaaauaugucuggaauuuucaaagagguaaaggacauaacuacugauguucuuauccuuuuugagggaguuguauagaucuucaugaaauaguuaaagccugcuaauuuuuuuccuuccuagccagggaaagaauaguuggcugguaccacacaggcccuaaacuacacaagaaugacauugccaucaacgaacucaugaaaagauacuguccuaauuccguaaguggugucuauuuuuaaaacucuugaaugauuuuuuuugccagccagcucaaguaagagcauccugggaagaauuugaguagcaaaucugcuuacugcuuuaucuccauaaacuucuguugauuuguagugcucugugaaguauacugugaccuaauauauuugauaaauaauaguuuauaccugcuaaguaccagguguaugaguuucguaauccucucgguaacuguauauccucuuuacaaaugagaaaacugagguucagaaugguuaggaaggucugguaaggggugggacugggauugaaauuuuggcuguguugacucuaauguccuugugcuaggcacuguacugccccucagcuuauuaaugaaggggaucgaaaagcagaagaaaugaugagaucauuugaagcauaaaugcauuuuugcugaauauucugguucauuucuaauugauuacaagaaauagcuuuaguaauugugagaagaaugccugaaauuaccccuuuugugcugggcgugagaugacuugcuaagauguguuucucugccagguauuggucaucauugaugugaagccgaaggaccuagggcugccuacagaagcguacauuucaguggaagaaguccaugauguaagucaucuugcuaugaaccugggagguuagacugcuacuuauugggugauuagcuuuuuuuuuucaauuuucaggucaacaaauccuuugucuccguaacaaaagaagguaguuuuuuucccuuugacuuuuuuaaucaccacauuuuggaaauggagaggaacauagaaaucuaaauuccaaccaggcacaguggcucacccagugcuuugagaggccgaggugggaggauugccuaagccuaggaguugaagaccagccugggcaacauagcaagacaccuacaaaaauaaaaacauuagccaggcaugaugguccaugccuguauuccaagcuacucaggaggcugagacgggaauauuguuugagcccaggaguucaagguuacagugagcaaugaucacaccacugcauuccaaccugugcgacaguugagacgcugucccccaaaaaaccaagaaauccaaauuccccuuuuacaaaugaaaaguuuaagggaugaauuacggucuccuuuugaauuuagauaugcaguauuuauccuuacuuucaguuuuaagauuuagaaaaggguauuuuaggauagcucugugcaaauguuccuugcaucgagcucugucuuccuggggcuuuucucuuugccuggcuaccagggagcuuagagccaaauguauugccuaauugcaguagggcuuucaucccugguuuugacccaguuguuuuuagugaauuuuucuccugccucuuuagaaaaggaauugagguugcucguacacaugcaccccagugaagcaagguguuuuuaguaggggauaaaggggacauaugggucauguuacaaggugaagcucaagaagaauuagugccuguaaagguuaccaagaaaucccacaacacuguuaaagguucugaccauccuggcauccaaagcaaagaggagaaugccccuugcaggauuaacacuauccuaaauaaaauaaucacggcuaacuuuuauaguacuuagugugaguugagugacuuucccaaggucuuggagcucgccuauuacauacauggcagagccaaauuugaacccagguagccuggcuguggagccuguacucuuaccacuaugcuguccuuccucccuuacagacaguuuacagccuuuugacaggagacguacagccucuucuggcacaaggucugagaaaaguaucuucgaagucccuucaggaugucacugggugaccaccaugaaccauguccccaauggauccuuugauuaauucagaccaccagaaagccaacuauucugauugcauugguuugggcacuguggaaucguuugauccaagagacaaaaaagggcuaaaaguuuuauuuucuggcaugaacuugcuucaguacagauauucuguauauuguccauucuagaaagaacuauauacuuuuuuuuuuuuuaagacaaucucacucuguugcucagguuggagugcaguggcgugaucucgacucacugcacccuccaccucccagguucaagugauucucguuccucagccuccagaguagcugggauuacaggcgcccgccaccacaccuggcuaguuuuuguauuuuuaguagagagggguuuucgccauguugcccaggcuggucucgaauucuuggcguaccaaagugcugagauuacagguccgugccuggccaaagcgguauacuuuuaagaaucaaccugagaccucccugugcguucaugccaagugugggcuugagggaauuuccagauuuuucucaacgcacagugccccagcagacugcaucacugagcagcaccacagugauguuagcuuugaaggcuaagcuuucaaaguaagccuuacccacccuugccauagaaaauucucagucaugcacucauuaaaugagcugacuuaaagcaaaagacucagggugcgaaaaggaacacaugucaguucguuuguggaaaauaaauaauuauaguuaggcuuccucucccaggauggaacuccaaccucgaaaacauuugaacacgugaccagugaaauuggagcagaggaagcugaggaaguuggaguugaacacuuguuacggugagacccuaguacagcaucaaaaucauucacugcccgagaggucacacaguguaaggaagaggucugugucgggaauauggagaccuggggucucguccuggccguccacuaacaagucugccauucugagcaaaucacagucccuuuccagaccuuuguuuuauugucuguaaauugaaguguuugaacuacaucaacuguaaaaugucuugaguuacaauuuaugacuuuguggauagcauaccuugucuggaaacuauaauguugacugacgggaagagagguaugaaauaaaugcaggccugcacucuccacuagguguccuucucaacaaauguagcccauuuucuggagagaaucuucaucuuggaguagcuuuuguuuuaaaauccuauaucuauuauaauccuuauuugaaaaagguuauaguuuuaucagucaaugagguuccuucuaguucuaaaaauuaccaucuuaguuaagcuucucaauauucuggagaugcauguagagaaaaugccauccuuuuaggaacaggaaagcugagagagacagcuucaguacaagguuacccagaaaguuauugguagaucugaacuguugaccuaagcaauuuuuuuuuccuuaaguggaaaugguuuuauuuuagcucccuuuuauaauuguuuuuugaaaaauguccugugaugagaaagauaaaauguguuccaaaugauaacgaaauuaagguaauugauaacgaaaucuuuaucaaauggggaagugacauuuuucuuuuaaaaacuugccucacccaacaaagcuaggaauuuucuuagaauguaagaacuugccugauaacaugguacccugaugccuuuuccugcccuuuuuaacuguggguuauuacagagauaucaaagacacgacggugggcacucugucccagcggaucacaaaccagguccaugguuugaagggacugaacuccaagcuucuggauaucaggagcuaccuggaaaaagucgccacaggcaagcugcccaucaaccaccagaucaucuaccagcugcaggacgucuucaaccugcugccagaugucagccugcaggaguucgucaaggccuuuuaccugaagaccaaugaccagauggugguaguguacuuggccucgcugauccguuccguggucgcccugcacaaccucaucaacaacaagauugccaaccgggaugcagagaagaaagaagggcaggagaaagaagagagcaaaaaggauaggaaagaggacaaggagaaagauaaagauaaggaaaagagugauguaaagaaagaggagaaaaaggagaaaaaguaaaacauguauuaaauagcuuuuuuaauuuguaaauuaaaaucuuacaaacuaaaucagugugcugcuagaggguucuuuuucacuugacaugcuuauuagaaagcugacccaacaagagcucucugccuccggucacucuugcuguggugcuacguggaagugaauggagacugaucucaaaucugaacugcagcuuucgcugcugugaguuggggauaugauagucagcucaggcuucagauuguaugagaaaaaugaagagaagucaacaaauauuuugguacucuucauucauuuaucucuaaaaccaggaguugaauuuuccucaucuugaaagacucuuggggucuguuucugguauuuuacaaaauugcuaaguggaaugcaugaauugcauuauguucucugguaacacguagaguucagacccuucugaacucuguugauaauaccacaccauguucuggacccauagcucuggcauccucagggguugugauccagcuccauauauuguuuaccuucaaagauacaauuaaauggcuugauuuuuaa

SEQ ID NO: 15808 - RNA, 1228 nt, Homo sapiens
gggcuuucccuguuccccugcaccagugcgaaaagcagagugugccaagcggcuggcgucuguacccugugggaaaaguuaacuguaauucuucggcuuuuaaaaucaauuaacccgaguguuaauuaacgucaagucgacgggaggaggagaagaagaaggggagggagggagaaaagaaaaaagcugcaagggcggauggcagaagaguuggcaccgugccauccauucaggggcaacgccacaguuucgugugauagcagcagcggguauaugauacggggcccuguaugcgggccagacagugcgguaaagccaagggagauuauccagacccccaggagcgaacagcaagcagcaaccgaaggcgcaagugccaggauuacagccuaggcugcuccaacuaugagcccuuccucggacccugggacucggcuacuugggguuugggggucuuccacaccacagaggcacaaagcugacuuuaaucacuuuuuuuccuuuaaacuugauucugccgcaguggagccagcacagcggauguuuucacacccagcaagacaaaggccgucgucuccgccaugacacuguuccguuccaagcagaggccgggauucuggacuccucgaaaaaucaaaaagaaacaaggaaaacaaacaacaaauacagcaacaaacagaaaaaacugaaaaccaccaaaaucguuugcccguuugcccgugccaggggugaucugggcaucuguugcagcagaaggcgcuuguguggggcuaauuuuucuuuuggugggggggacaagcuguuggcuuguuugcuauuucaacuucguuuauaauuaacuuaaaaaaaaccccaccauucagccuagucaacaacaaacaaagaaaaagcagacaucggaagagaaaugccauaggaagcggcaugaauacaugccacagccggugccacuugccacucggaaaaccucagggaaagaugccaauucuacagcugcgaagaaggcagagaaaggaggauaaaggucuacaacuagaaaucauaaggaaagaauacugcuuguauaauccuggauugcaauugcacacagccucugcugggagaagagagggaauauuuaaauggagauauagauggguauaaauuaaaagauaggcaccuaucgauugcguauaaacacauguguaagguuguauguguauauaaauaugcauauuuucagacaaac

SEQ ID NO: 15809 - RNA, 19343 nt, Homo sapiens
agaguuccaggacgacccaugcaaaggaagucagggcaggcuucugcaccccccaccuuuauuacaugauuuaagagggugaaggaaaaagucagacaugcagucauguuuuacaaauaauaaauuuauuuccaaauccugaauuauaaccaaauuacaauucccuuuaggucuuuuuugcugcuuuacacaaggauuaaaaaagacagccacagccaagucacgcauacaccaaguguccugggccaguuuuagaugcgauggguccagccaccucccgcugccccggcagcaccucggauacucugcagccccgcucccgccaugccgugcuccugcauggaagaacuccaccuccucugccagagagucugguccagcaggaacugcccuggggggccgugauaugcacagaugaaaguccucagaugaaagggcuuuguccgcagccucagggcucccgccagaaggcugaggacccaauaccugcugccauccucucuggggacagccucagcucacagaccaaagcgggcuggcgugcggcgaggggucaugggcuccccuugcucuuuccggccuggaguguagaucuucguagaccuggagacacagcaggagagaucaggaaacaccgugcccucacccacagccaggagggcaggaggaugcagagccccaggacuuacuguuccuaacccaugguggggagcucugggccgagggaucuccuccccggcacauucucacuccucugccguccccauguucgacuggcgauguaaucaaggaagcucacucauuccgauaugcuuuagaucggauuuuaacaacuccucccacagucccuaggggagcuacaaaagcagcuucccuccaccucacgugcgccacuccaacuguguagcagccugccuuuguccccagugccuaggagccaacucuaaacccuuggaauuucccaagugacuggagugucugcuauucaugggggccccucagcccucguuugagagauuaugcuaaugaggugacucuuggugaaccccuugaguuuaucuaacaacaugacucaaggcaggcuggccucucugccccgggguuagcacuggugcucugagccacgugcuaucagccucaccucuggggaggaggggggacuggaggcugagcucuaccacaugacaaugauucagucauucaugccuaaguaacagaaccccaaugauaagaacucuggacacugaaguucaggugagcuuccuggcuagcaauaaccugucauacugucaugcaucagugugccacggggggacgugguccugaggacaaacgaggcuucgcauuugagacccucccagaccuugcucuaugcaucucuccuuuuggcugguucuaauuuguaccuuuuugguauaauaaagcuauaaugguaaguacggcacucuccggaguucugaaagucauucuagcaaauacugaaccugcagggguccauggggacaccaguaaggauggugucuacaccugcagcugguaucugaagugagggcguucucacggaggccugugccugcgaccugucaagucuggccuaacuccagggaccagcacagacgcagaagcccaaggcgcacuucucaccacugcacugggguuuccaacccccucgcucaugaguaaagcugugaaacccauccugcuacuccaggcugccucaggcccugaaucccugcagguguacugucgcuccuuuaaagcugucaggaacuccucccacacauccaugugaccaccaaaugcacaagcaacuucugucaccaguuugccuucacacaugcaccuucccauaaauccugacccugcaucagggccuggucucuggcagccuccugggaugggugccaccccagccagagcccgaaggccggagcucaccugacacugcccagggggcugcgcuucuccugcuccugccgccgggcucgcagcugcuccucggccagcgccaucuccuccuccauggcagaggcuuccucuuuggcccgacgacgguucuccuauugaagagggacagaccuggcugagccuacuggggaccacuaaggaaggaggccucgucggcacccaagucccugccacaaaccaggugcugcauccaccaggccagugcuccacauggcugccugccccaguaccaaagccgccuucucuucugcagcugaggccugcuuuuuucacugacucaagacacuggacaaucaguccuaacucagucaucccucaguccaggaaguacuuacauuuccuucuuuuuugaaaaaucaaguucacaacuaugcuaggaaguacagaaaaacagggaagaugugauuaccugcuggcuggaagagacaggcauaagaugcaagggagccugguauggggagaauuaugcuacgaaaagggguaagccaaagcccagcaccauuuugcaacccuaaauauggaucuaggcaauggccaucaacagacgcuaaaaccucaagauggaggagcaguggaaaccuaucagggaagaggcaggcugccaccacuggggccccucauccauccucccaucagcaaagguggggccaccagaccucacaugccuccugaaggcaucuaagaggagguucacagugccacaugcaggcaucucugccacacgcagcucagccgggaucuaauugagcgguuggacucaucgccagcuuacagcaagugcacgaaacacaggcacagguuaaacaccgcugugagcaagcaaugaggcaaauacaucauauggacuauucgacaggacaaaugaccuggcugcuccaauaaaucaaugucaugaaaaaaagcgugggguggagccuguucuagaaugaaacaguuaacacacauaagcaguugcaaugccuggauccuaauucaagcaaaucgaucauaagaaguuaucuuugagauaaauggagaaauccaaaugcggacuggagacuuaggugacauuaaguauucauuuuuuuaugagugauaacggcacagagguuauauuuaaaauuuuaaguccuuuuagucagagacacauacucaaguauuuauggaugaauaauguaugagauaagcuuuaaaauauuccagaaaaaaaaaauggauguguguggagugggguaggaauagugaaauugaacaaacguugacaauuauagaggcaaggcaacgaauucaugguggccuguuguacuguuuuucccacuuucaugaauauuuggacuuuucaauaaugaguuuuuugguuuuguuuuuaaaggcucagccuaccaaacaacuggagugggugguggggaaucagacagacccagccugcuggaucacagccuuuauguuugcagagagaaguaaguggguuggaugaccgcaagucuucaauaccaagcggagggaacaccgaccccacaggcaaacagcaccccugcgaagagcacagaauccucaccugccgugacuugcccgccuguuucacgcuauagaacauggggcccagcuccgccagccacuccccguccacagcggucacacacugcauauacuccugcgggcagaagggcagggaggcgagggucacaggagggccaaugucccucccagagugguuccacaauuaggagccacaugggaagggcccaaucccuggcccugcaaggcugaaaaaaggaaaggaaaaaccccagauacucccauccaaacuccuccacacuugagaaaaugcccccaguaucuaaaagaaaaggcccaaccccuccgaaaauccuucuaaugacaccaagagggguugcucaucccaagcagcaaguggggaacaaucgugcccaugcagcugaggucaaugcagucuagaggucaacccugugcagagcuuccccaaguccccaaaugaaaaccaaccucacaugccccgcaaaacaaugcauguggccucaaggcucccaggcuaaaagcucaugccagaacgcagugaaggguuucaaagccuggccagacagggggccugcauuaugcaagugccuuggaaaagacucaccuugguggucaugaccaacucgugauacacuauguaaucugggguguagcccauuccaaaaagggagcugguggggugcaaguggcagggcaucccugugcggauguucacguacuccccgauucccuagggaggagacacaacaggcagccacaucaggaaaacaacacccauuugggcagcgaccccaucccuuaacacucuugacacagccuuuggcggaagcccagaucugcagaaccacaccaggacaaaggaagaacuuugcccuuauacagguaucaggcugggaggggcucacugggcuccuggguucaccuugagcuuggcugcuugguggaaauaggcagcacagaugcacuuccugacgaugucccagucagugccacacgaggccaggcucauccgcugcugcaccaugauguccuugaguugagcucgcaccucccggaccuagggcaggagacggaggcaccaggagggagcccuccuuuccucucgacccuccccucaucccaacauccugcucauccaccacucuaccuuccgcauggccuuagcauggaugaaaugaucguuacaccagaugguggaguaauuauuguucuuccacugcagguaaacauucagguaggucaaaugaucgcucucaggaacagcgaacuucucccggauuugaucacucuccuccucucgacccuaggaagggaaaaagaaccuucacucuaaguacagggggguccaggcccacugagcacaucccagagguucuaacacuaccaccuacccacacauagaacuucaaacaugucaauagguugcccugacaauuugagaaaaauuaaaauaauuuuuaaaaaggucuacucuaaaacaugagggcucaagagcaaccauacuagaagauaaaaaaugcucuugcaaauuuccaaagcauucccugagaaccacuggcccagcccuuccuuuccccuaccccaaccugcuuaaccgagaacagcaaaaucauucuucagaaacucugauucugcccucuguuccauuucaguaauacagagagaagccauuccccuccccaacacuuccucgagcccuccggggagaggggagccagccgcugccccaccuugggccuguagaagauggcugggaccgagagcauggaaacgaugagcaggaucucggagcugcagcccaugucacaggacacgaugagcaucuuggacagggcaggguccagcgggaacuccaccaucagccgcccgguagaggucagaccaccuaggagagaugagcaaacccggauauuugacgggacaguagaggaaagaaggaagucaagcgccagcacccaugaggcucccggggccgccucaccuguguuguccagggccccgaggauccagagcugauacauagaguugagcauguuguccuccgggggcggguccaugaaguggaacugcagcagguccugcaccccgagggacuugagcagcagcaccacguuggccagguuaguccucuggaucucgggcacugugguggucaggagcucauucuuguaggcgcucuggguguagagccugccggggagaagaccccaucuucucaccacaaggaaaccccacagcagccaguacagaugaaaucccacagggagggaggaaauucucauuucuucuccccacccacuacuucagugaaucacugacuuccaccuauucaaaacuccaaucugccaauuuagcccuucuucuggagccucuuacauguuucauuucuuuuuuuuuuagacagagucucacucuguugcccaaccucugccucccggauuuaagcgauucuccugccucagccucccgaguagcugggacuacaggcauccgccaccacgcccagcugauuuuuguauuuuuaguagagaugggguuucaccauauuggccaugguggucucaaacuccugaccuugugaucggcccgccucggccucccaaagugccaggauuacaggcaugagccaccacacccagccaucuguuucauuucuagaaccaaugggccugggacuagaaucauggcuggguuuuauuuucuugauauuuuucuauauucacuaacgcucuauagugaauacauuaauuuuuuuaauuggaacaaaaaaggggaagagagccaggcagaguggcucacaccuauaaugccaacaguuugggaggccaagacagaagaaucgcuugaagccaggaguucacaauaccagccugggcaacauagcaagaccccaucucuacaaaauaugaacaaauuagccaggugugguggugccugccugcaaucucagccccuugggagucugaggugggagguucacuugagugcaggagaucaaggcugcagugagcugugauugcaccaccacacuccagccuggggugacagagcaagacccugucucuaauuggaaaaaagaaagaaagaaaauggggaaagagaacaauagaaauaaaaagaaccaauggcaucaucuguccagaccuacccucugaagggaggcaggcuguaauuaccugcauguguaccuacauccacguagguuggccucagaccucugaaaucccuggaaagccacuccuuccuuccacucaguagcauaggaugaaaggacuaacaaguggcagcccugccagcagcuuccagccuuggggaccagcucuagagccagcauccugcccgcccccgcccgggcuccacgcucagcaaccccagcgcugccccagaaagcaggcuagcacagggcuccuaccugaaacacugaccugggcccguccugccggcucgcccugaccgcugguuggcauuggccuggcuaaugggauagaucugcagagcauccaugccaauccugggguugaagaccuaggaggggacggcaaagagcugacgaaggacagagugaggggaaaguggaaguaggccugagacaaaggcaagcccugguugcuacacauggcagaggaagagccaggaggcucuagaaauguucucaugaacaccugaagaagucuuccccacaaacaccagcucucugagcucuacuguuaaauuaucuaccucaucgaguauuacaaggguuaaacaaaccaagcacagugagucaaugugagccucccaccaccaccaccacuuccacgcgcuccccacaucccagggccaggagcgaggcccuggcuucccaccccgcagcuaaguuagcuucuggugaacacccaggccuugccucccaugucuucucuuaccuuuaauuugcaauaaccagaaucgauaacaaacaugaugccgucaacagugagagacgucucggcaauauugguggcaacgaugcacuuccgaacgccaucuggagccuagagcaggacauacaggaagggaaaaaugagucccucgagacaggaaaggcuccgcgagggggaaaagccuaccuccuagcccacccccugccaggacagucacauccccucucgcuuccuuuagagaacuccaagagccacuccuggacauuccugcugacacaccuucuggaagauuuuggccuggaggucagaaggcagcugagaguagaugggcagcacagccagggcaggcgcguucuccaguuccuccagaugcuccacaaucuggucugaggucaccugagagcccagggaggagcugugagacacuggaacccuaaccucucauaugcaagacacacccgcucaucacagucgugaccaaggcacgcaccucaauguccucuuggccaggcaugaagauaaggaugucuccaggggcccccgacaggugcaccugcaaggacugcuucacugcagccuccacguaauccuccuguggggucugcaacagcaguggggacacagucagagggagguacuagaagcgcaggccgggcaucuccugggagcccaguggcccaggcacugcucuggaauggagccauggacuuugagggccaccacaccuccacaugggccugacugcgaggccucuacaagagggcacagugccucccugggcccuguacuucagccucaaagaaauaaugaaacaaaaccucacccagagcagaguccuuuguccccgagucccagagcugcaggcugccccauuugccccaugguccccaggaaaucuucuccaacccaguccccuacccacccuccacccuccagccggcuucgcaucagagaagugcguggcauggaagggucaguucguaacaugguggccucaauaccuugcugaagaggaugucaacagggaagguacggccagggauguggaagauggggacauucccaaaaaaggcagcaaacuucuccgcauccaucguggcugaugugacgaugagcuucaggucugagcgccgagccacuaccugagagaagaggcggcucggaggcccccaugguggggacccuuggcuccugucccccagucccaucagcaccacccccgaggaaacacaagccaaagcugacaaaugggccuauucaauucuuaccaaucaugaagacugaagcaauggagccacugcccagaaaaccccaagccacccucagcagagcaagaacagcaugaacuacaacccgagucugaacugcaaccagaggccucaggaaccucuggccuaccagagacccccucagcccaccuggagcaacccacuagcuacugguggugcacuggucaacaccccaugcgcagagagaccaaaccacacagcccucaccucccggagcagcccaaagagcacgucaguguugagggagcgcucgugggccucguccaugaugauggcacuguagugauccaggucggcuucccggagggacucucggagcaggaucccgucagucauguauuugaucaagguguucucugaagugcagucuucaaagcggauggcauagcccaccuggaggucagagagauggcucagaugcccuggccaccggcucaccaccagcacaccccguacugggguccgagucuuagcagaucacacccuuuagcaaaaauggguggaagcuacuagggaauaacuacauggcucagcccccacgcccacucaccuccucgccaagguuuccccccaucucuucacugacucucuuggccacugacauggcagcuacacgccggggcuggguacacccaaucaucccauaguccguguaaccaucuucaugcagguacugcgucagcugaguggucuuaccacuccccgucuccccaaccacgaucacgaugcuguugucucuacaaggacaagcaggcaaagggcuuaucagccgaaguggaaggccaacacccagccuccaagaagacuccgcuaccuccuauccccaugacuagcuauccagggagcaugccgguuuagaagggagaauuucacugggacaacagccucuuacugagauaacaccugaaacaucuggaauacggugagguuuaaacaggugagcuaaaacaaaauggugccaucccguuacuuugugcaguguaccccaggcaugaggucagaggaaaaaaguauuucccuucuccacugggugcaaugcacaaaagaaaaagagcuccuggguaaacaugggagaccaagggcaccccugacuugacacuagauuccugggccccgggugaaguuaccugauaauagugagcagcuccugcugcacugcaaagaugggcagguacugccucugcuccaggauggacuucuucuuugcaaauucacugcuggcuucgcucuuucucuucaugugaucugcaaacuucugcucuguccuaggaacacacagcagccuaaacacccugcauggugccccaugcuguccuuccugauuggguugcugcccuccuuccuacgcucaggaaugaggacuucggcaagagucugagacaccaaagcagccagggaaucugagaugguucucaucgaccucaggacugaaacugcuacuugagaauccaucauccacaacacacucgacaccacaggguccaacagagcuagcugaacauggaucggaggauuuacagaucaccauauuagcaaacccucuaaccaaaacagagugagcagaagaggaguggaaaucaauccccaggucacuaacuuguagaaaauacccucgggcaauuucagcacaacgucuaaagggcuaaaauagccacacaggccuugugaggagguaagggugcagagcacgggacaugggucaaacuuccucccuccucuuggcaggacagcaggaaagcauagucuguacgguuuuguuuucaaagaacugugaaaacagccccacuaaacaguaaccugcaaccucuacugaaagcucucaaugucugacacauguacacacccgagaugcagagcacugucacuuucucaaggcugccuggcaaaaagacaccaguucagugcuccacacaguccacacaccccuccccaacccccuccccagagacuuccugucugaugugccgccccaugcucugcugagcuuccuauuucuaauuucacccagucccuccuggucacccaauaacuaauaccugaggaauuaaguuaacuagagaagaauaagggcugaucaauaguaccaacuucucguauggacauuucacacaggaguggagagaauuauuaacucagaugaccguucaguagaacauaagggcauucgaaggaugaggaucuuaagggacagauaaguccagccaccugcccaaugcaggaaucccaacucagcaucugcuuagaugccucuaugagcagagaagucacuggccaauaagauaacccuuucuauuuuggaaccucuuuuaaaaauaguucuuauagugaacucaaaucuaagggacuaaaacccagcugcccaugcugaacaccugggagguacuucagcagaguggcucugaugugagacggccugggucugauccuaacucccucacugacaagcugggugaccucagacaaguuacuuaaccucccugggccuccuuccucucacaacaccagcaccagaggaagcagugugagggaggaggaaucacauauaggaaaaguggaggacagugaagagaccaggaggaagggaccagagagaauggaagaugcagagagguauccuaagagucucccacucaggagccacaaagucgauggguucugccgcaacugcccacaugggcccccaucuuuggagcaaggcugaugugcugcuggcugaggcugcccaccuguaguccaccuucccauccuccgucacagcuuuaucuggcucuuccuccuucuugacgcccauuauaucucccaguuugguccccgccaguucccaguguuugugcugagccugaaaaggaaaaaggucagucugcuccauccugccacaugacugcgagcaauggaaaaucaaucccacgggagagcagacuucaccccgcaggugguaaacucccccagagugcugguggcaccgagccacauuccaauccucaagccuccagcucucccaacaccaggccccgcagcugucgggccuaaggacuugauagaggggacuccuaacuucuaucugugggccuaguaagacuuaugaagagaagaaaaaagaaaaaaauacacauaaacuucccagccacgaaaccaagaaaccaaccuucuugcgcuccuucugcucccugugcuuccgcacugucuggcugccuuuccgagcaaugauggccaggucagaaguagcauccuucacuggaaucaccggcuccggcugcagcaguggggagaaagagcgaugcccguuaaaaucagcaagaaggccauguucauaagaucccuacuugugaaagggacugcuacccucucaugguacagggcuauuuucucccuucucuucuuucugucuccacaucaggccuuuuuugugugugagacagagucuugcucugucgcccagacuggagugcaguggugugaucucugcucacugcagguucugccucccagguucaagcaacucuccugccucagccucccgaguagcugaaacuacaggugccugccaccacacccggcuaauuuuuguacuuuugagacaggguuucacuauauugcccaggcaggccuugaacuccugguauccaaugauccacccuccucagccucccaaagugccgggaugacaggcaugagccacugcaccuggcccacaucaggucucucugagcugucuugucccuggccacagaggagccucaccugcuuggugaagacaaugcgcccauccagaaagggaggcaccagauugugcaccaucagaugcaccuuggccgcguuguccucuucaaaguccucauccaccuccagccgauggaccaccccacuggugagcaugcgguuugucucccagcgcucguuauccugugaggacacaaugggagccacacucaaauugccaccccaaaggucguccugaaagguuaugagguaaguccacacaucaaguccugacagaaggccacugguagcugcaaagaugucacaggccucuacccacagcuccaaagacagaagaggugcugaucccaaaucaccugcaggaguuuguuccaagcagcagcaccuuucaucuaaaucagaaccucuagagggacacacaaaugguaagugucccuagcccacaucagagacacaaagaacacagaccacagaggcaggucccaaugcaccuguucccaucaacaguacuuccccucaaggaaguacugcaaaagagagaaguacgagccggggcuuuccuuaagcuacuaaaaggcucaucacccacuccucuuccaccuccagaggaucugggcuucucggcaaucaggggacaagcugugcugcccucacuuggggauaaccugcugcuuccccacgugcucuaccuccagcucugaaucugcuccaacuucugcaggcagccucaccucauugaucugucuccgcugagcugaaaugcgcuucugcuucuguuuaugcaggugcugcucccgccuccucacguaguccucggaggaguaggccagcggguuguggaacucgucauagcccucguccaucauguaccaaucccgaucggcuugcugcagggcaggaggcaaagcaagggagugagggacagaucaaguuuaugcacgagacauggccaacagaagaagggacgcuugguaggaagucacuacugcaguggagcuacccuugugaggggugcaggagaggccucccugcagacacaugccaucuggaggagaaccacagugggcaacuacacaggacuggagggcagcccaucacgauagcacuucuuagauuuaccacaugguggcaccaacacauaacagaacaguuaggucagccuacugcagugagugacaggguucaccgugccgucuaugccucugcaaagagacuccagggcauugggucugaacagggcucagguguacccucaucaaagcccaguccugcuagagggucacccaucuacagacggccaccagccccgaucagccccucagagguauaaaacuuuacccucuggucaucuucccacugcugccgcuccuccuccgugucaaaugaaauuccuucuucgcccuccucacgucuuccuggaggagcacaggaagcaggucaguccaugcccuggccuguccccagcggccccagacagaucugcagggccaugcagcuccagaagggcagccccugcucauccucgcuagggcaagcaagccugcucuucugccugcugccccacaggccucaccucggccccuggacagacgcgggguggaccccaagugucuucugucaucggcccacucguuauauuuguaggagggaguuggcagaggcgugucauccgaguacuugccccucacagaccugggaacagcagcaccagcaucacaaaacugucacugagcuaagccacguccuccuggccaccaucugcucucccugccgaggcuccuuaccgcccacccagcgaaacugggcugcucugcccagaacaucaccugucucgaucucgaguggacagccgauggcuccgcucagaaucccgauaggaaggcgucggggagggcgauucccacugugagcgccuugaggagccauagccacuguccucuuccucccagguagaccuugaagggguggcugcaucugggccacaaaagacacauccacaggaaacaucucacuuaaccaugacauggucuagaaccaguugccaaaagucaauuccccaaauuuacuccuuuuacuauuucuaaaccuugcauguaucuauaacgguuaagaucgguuuugacaguuuuuaaagauaucucaauuuuuaaugguccaggauguauuuuuccuuuuuuucuuuuuuugagacaaagucuugcucugucgcccaggcuggaguacaguggugugaucuuggcucacugcaaccucugccucccggguacaagugauucuccugccucagccuaccgaauagcugggauuauagguacccaccaccaccccaggcuaauuuuuguauuuuuaguagggaugggguuucaccauguuggccaggcuggucucgaacuccugaccucaaguaaucugccugccucagccucccaaaguacugggauuacagguaugagccacugcaccuagccaaugguccaguuugcauucuguguuuaugacaacauuuuaagggauauuuacuuuaucucuacaaacacacccuucuuggauauaaguaguucuuuuuaauaaacacuucuucuaccuccagcucccuauucuuuccuaccauuuggaaaacuggccauucagcaaaccagccucucaccuuacaggaaccauauccaccccaagugcagagcugugcccaccugacucagaaccaacuaucccaagauguucaugguagaaucgggaauucugacucaaugccucagcaaucucacugaagacgagagucacucacucugccuuuuauacacuugaauccucacaagccaccaaaacagugagucuaccuuuaggucgaugucgugggcucucggguucauuucuucugcugcuacgcucugacccuccaucucgcucugaucugcugcugugccuacuucuaucccgcucaucuaugaagagucacacgaagcuuaaaaacaugcaucccauccuaagguauacacaucuucacccuagagaaaggacaggcugcccacucacucacaggugcaaccugcacugcucgaaugugauccguggacuccugaaacucaccuauccccauucucccaagggggaaaaauaguuacugccuagaaaauuucaaacccacaguaacaguuauuuuccagcaagaauucaaaaaauacuagugcgaguuuacagugaaucauuuuuuuuaauaguuacaauucuaucagcuauaaaacuuaauacugagcaaggacagcauuggauuuuuuugucuagcuuuguuccauagcacuguccuuucucuaucaccaauacuauuagaaaugcuggucucuuauacauauuuacccauuaucuccuuuaucaucaauuuucauaauaaaacgaagaccacacacucaaggagagcagcuauguuacaggcaacagcucuuuucuuaaacuaguauucccaaucccagcagggucaaaaccacucaggcggacaucaugcaaauaggacucccuaacaaauggguguugcaaaaacuccugcaacaagaaaaaggcugacacauuuauucgaaugcuaauggacaauaggaacugugcuggacaguuuaccucugucccucuugcggucauagucucgaucccgcgauuucuccuucuuccaauccuuuucuucuuuggacgaggcauagacaccauguucccgccgcucccgcucucucugccgacugcguucccaaaacucuucgcucacaccacccggaugggauggagucucuacccgagcagaccgauaaugucugaaacagggagagcaacugguaaaggccccuccauaggagaaaaacucugcccuaaaaccuuuggcuguccaaacaagugaucuguccuuuuccacuuucucucccugggacgcaggcucacauauggcaacaacccaaggcauuucuaaccucuaccaucucgucuuuauucaccuuuguuuuuccccacaaauuccuaccuaccuucaguauuacagaaucauaauaaaaucauaaagcucuaaaucuccaacaggaaaacugagagauaaacaugagcuguuauuuuccagccuccguucgcuucccucugggcuaacccauacuaaggccuuuaccugucuuuccggauauuuuggccagccuggucaccgcccucuuccucagcauccuucuggucauccuugcucucuucccaguccuuguaggaggagacuuuggacuucuucuuguccuccccaucguccuucuccucucgcucucuccguuucagggaagccagcaaguccaguccgaguaaugaagggcggggagcaggagccuugaagacaugcugcucgcuggccgcacuuuuggacuugcaaauaagaccaccaaccugacaguccagaucagugccuuccaaucgauggaucgaggcauccucacuggugucccccaucacaggaucugggauuucucuggaaggaaggcaaaccauuugguacuagagaaggcucagcucuacuauaucccacaauaaaugcaguuaugguuauauguaggugauuaaccuuccccaucuccccuuaagaccaggacuacuuuugcucccucucuccaagaccuuuccaucaagucacugccuaucuccaaagauucuccuauuccaacccccaauaaacaccaaaauagauacacacacacacacacacacacacacaccccauacauuccuccccagcccccacaaagauccaagaggcaauaaaaagucucacuaagggacacuuucuagagccugaugucagcagcuguaacagggauguagggaaaacaccacuaaauuugaaucagaaaccucaauuagaaaccaggcucuugacacuuucuaccuguaugaugguaagcaaauaacuuaaucuuuguuuagccauaauuucauaucuauuaaauggaaaaaauuuuuaccuuaucuaauccaugaagcuauugugagaaucaaacaaaaaguguaugugaaaccauaaagaguagcucuuuauguaaccauaacaguuaacauaaauguaacugcuacauuguauuauuugcuauccuccuauauacuguuggucccucacccauuuuuuuacaugaguucuaccucuuccucucuuuaaacaacagguacagcagcacagagauggggcagaaggcuaccguccauguucuccauacuuuaguggcuuuucuuggccuagcugcguuuuacagaaaacaauuuacucacagcagccaaaaucaguuuaauaacaauccauguucaccaaaaauauuuaugagaaacaccagguuaggaaaagguguuacugagaaguauuuaaguggcuacaagacuucuggcacucaaguuggaacaagcuccucuuuaccucucacuacacaucugccacucaucaacauauaucaguucuggaugcuuggauaauuccucucauuccaacaaguuagcaaagcaaaggagaugccaccagaauccagaauuguuuaccaaacucuaauuaaaugcacagcucuacagaguauugccaaacagacuggacacauaauauuaaugcagaaacaagaguuacauuuugaaaaugccaucaggcagaacagaaaaaaagaaagcugcauauuggugacaucugugcgcaugugaggaaauccacacaagaagguaaagauauacaggcucuacucaauaguugucuaaacuaggaaagguacccuggacugccauucuacgcaguugagagaacacuggauguguuguugacugcuguagcucaaugucuagcaaaauaagcguuugauaaauuaaaaaaugaauuaauuuaaacuuauuaaaggaggacaggaacccaaacauuucuggagacagcaagggaagauuccagcaacacaggacaaggagacagccagagagaacuucauuagcugcugagacgaacaaauaaggagcuaaagagcaagauucuugagaaggauuaauggcaaagaaacuacaaggcguacgagaaagccagggaagaaagaaccuggauucauucauucaacaauuauucacugagggugucccugagccaauugcuguucucggcgauagcaacagagaacaagacaaaaauccccgcccaccuggagcugacauucuaguagaagagaucgcccaccagauugccugguauaaaugacacugugagagagcagaggaagacacaaggaguccuacucgggcucggugacagucugggguggguuaaagcggaggccugggagagggaccaaggccacuccaggcagcaucccuggaucucagcgaggccgcuccaggcagcaggauuugaccagagcaaggaggaaggccaaggcggccaggacggaugcagcaucccugaggugaguaaggcaaggugggugacagggacgacagaggaacuccccaaacuggggcccggaccugagcaggggaccaauauccgccgccuagagccgccaugauuacagaagggcaggccaggaaggaagaagggacucucaccucaccaagcgcgacucuugggacccuucugucccggauucuggggcgccggcgcugccaccccucgcucagacaggcucaaggagccaaaauccacaccuugaaagcggccauuauugucccuuaauacuuugcgcgcccccucuauccgcccaaagcuaccauagagagcagccuggaacacgcccgauuccuggauccaaguguggaacgguacgccaacaggcucucaaggccuccucuggggcucugaucagacacuuccgagucuccuugugaccaaucacucuuagccuaagagacuacaucccgccucuagucugggggcaggaaaaggaggggaaaaaggucgaccaucuuuaauacgggcggaggugac

SEQ ID NO: 15810 - RNA, 8801 nt, Homo sapiens
aaggugggcggugacuagaagcucuuccguuuauugggcuguugagcgggggccgaccgacggccaggaguuucuuuucugcgcuugugcguuuucuguucgguuuccuucccgcuagcggggccacgaggguugcuaggcaacagccccugggugacuuggucuuaggguccuguccggcuuggggcugaugaaaggagcuguccgcgcccgggcucuuccgagaagugguugcugacagccacaaagugaaagggagugaggcggcguggacgaguaagguaagugcuggggucccuuagcgcuugugggccaggagcagcgcaacacaggugacuuuaaauauguauaucggauauuuuggaaaauggagaugcgcgcccggcuguaaauaaaaaucacccaugcguucacacgcagagaugaccacugauuuccaguuguuuuucuggaauacauuguaguaagauucuguacaaaagugaguucaagcuuuuuuucuuuuuuugguguuucugcaguuguggcgcgcgccugagguuccagcuacucgggaggcugaggcgggaggauugcuugagccuggggaguugagaccagccugggcaacauagcgaaaccccgccucagaaaaagagagggagagaggaaagcaguggaguuauuggucaaagaguaugucaguuuucuuuccagaaagguuuugugucugcauuccagcaggaacucccugugccugccccuaccacuaucuuguuuaauuuuugccaauucagugacuuuguaaacauauguuuuaauuugcuuuucuuugcuuacugguaaagcuuaacuuuuuaguuuauuuacuguccauuuguacgucuucuuuugggaauucucuguggguaucauuuacuauggacauuuucuuagauguggucucaguuuuccucuccugcuuccaacguuuguccaguugcaccccuagccucaccacuaacaacuuuguucuccccuuacuuucuccuuucgaucaguaacacggaggaacugcuguuuguuugaauucuagugggacagauccgucuucucuuugaccuucccuuucauugguaauuuguucugcugcucacaucugaugacgucccuuugggccaucaaugucccuguuuaaaguaugaccuauagcuggaacaaucuuauuuccuaugugaauuuuaguuaaauaauuccuuuuuuuuuuuuuggagacggagcuucgcucuuguugccuugcccaggcuggagugcaguggagcgauccuagcucacugcaaccuccgccuccaggguucaagcaauucuccugccucagccuccugaguagcuuggauuacagguggcaucugccaccacgcccggcuaauuuuuuguauuuuuaguagagacgggguuucaccauguuggccaggcuggucucgaauuccuggccauaggugauccacccuccuuggccucccaaagugcugggauuacaggggugagccuggccuaauucguaucuuaaaaugugacuugugacaaaaaaaauaggaaaagaaauccucccuuuucauauuuggaacugaauucaaaauaccgaccaucucaauggagucucuuauagaugaccacaaaacuaagcuucuuugucaaagaguuucucaaaaaugaaauuucuaccaaucaugaaaauagauuauuguaguagaaggaccccuggacuagaaauuugguggccuguauucuaguccuugucauuguaguagaaagugcaacuguaagcaagcuaguuuguaaaaugacgggguuguauuaggucccuuguaccucaguauuuuauuauuuguuuaugguauuguaguuuucacacacacucuuaauugaucuguuugccguguaaugaggugcaccuaguaaggugcacacgaagaaucuuuaagccaggacuuguaauaauauaaaguauacaauaaaggacuguuuaaaaaguguaacacaugcaagaaauaauaugcugccaugacagagaauauggauguucucuauauagagauauggggcaaucuucauagguuagguuugaaauaaugaaaagugcugaagaguagauaaagugugugugcugaacaucugccauuggucccuccacagccauucuucauccuccucuagacugcucugggacagggagguuugccugccucaacaggccccugcccucugguuccaguuggagucagccggugguugcaugagcaaaggucagagggagggaggagaguggcugcaacaccuaacagcaggcugcccuccuauacacuguccucuccacucaccucuuucugccacacaauucuuauaacugcuuccuaccguggcuucuuccucccauggccuagggauggguacagcaucccgcuguuacuagccccaaaguaguacacuuuaccguauuguuuuucuacaccugccuuaauuaaacugccuucaaauuaccaaaguugagagugucaucgcuuuccugcuggaacacugauacaauaggcuaucuuuuggggguggggagagagagaaaaaaaauaucggaacgcauauuuguauuuuuuggugaaugcauaacaaaacucugaaagauacaugagaaacuaaugaaagcaguuaucuggcccgggggagggaacaaugaaaacugguuccaaggagcagggacaaagagagggaaacuccacaguguuaccuuucuaugauguuucuuucauaccaugugaauacauuagcuacucugugaauuaauuuuuuuuaaugagggcucacgcacuuaaucuaaacugucuuuaaacauugcaccuuuauuucaggagugacagugaggauucacauuuggguuauuucaagaugagcuuccuacugcccaagcugacuagcaaaaaggaaguagaccaggcgauaaaaaguacugcugagaagguguugguucucagguuugggagagaugaagauccugucugucugcagcuagaugauauuguaagugaaugucuaaaauaauugguuuuuauuaauaaucuguauauucucacuucagcaucugaguaguacaugagagggaguagucaggguuggguauauagcuguucauuuguuaguucacuaagagcugauugugugccugcccugaaccaagcccccaaaucugugugugcugaaucugucuuggauguccuuacccacuagaagcugucaaugcuguuucaccaacaaggugauggaagagcagaaaacuauuaacaagcaucugugaacacuaucuuuucagugcucgcaauagugggauaauaguagccccauuucccaguaggaaaaaaaaaaccagagaggucaaguaauuucccacaggugcagauccacuauauugcagaguugagauuugaacucaguuuucuguagcugcaaauaaucuuuucuagugugcugccuccaguaugugccugaugcagagagagaccuaacccagaacuaagaccucuuaccgccauuucuacugcuaccaucccguguaagagcugagcguacaaauccucauuuccgugguuacaaugagggugugauguguuagcuuggggaaaaaaggaccagaggauucuacccucagucauaagcaggaggaaauaccacagaggucagugauguagacacugaagccacacugccaaaguucaaaccccagcccuacugcucaggagcugugugaccuggggcaaauuacuuuaccuuccugugccucaguuucccuaucuauaaaauggggacucugauagcauauaccuuauaagaaugauguaaggauuaaaugaguuaacaaauguuaagcacuuaggacaguuaccacauaguaauguuauauaagugucugcuacuaauuaucgugguuuucauuucugggaggauugggaggaaggagacguuagggaauuucaguauccacauaacauauuucuaaguuguguuguuuuaaaugagcaugggcuacuuuuauaaaagcauucaaagaaagaaauuaaaggaagaaauagauucacacaguuuuccccaaggauuuguaugcucagcucuuaacacgggauggcagcaguagaaauggcggguagaggucuuaguucuggguuaggucucucuccacaaugaauagacaggaauacucccaugcugucacccuccuaaacucacacaguuuuccccaagguccccuucuaaccucacacaguuuuccccaaggucccuuccuaaccucauacaguuuuccccaagauucccuccuaaccccguugcagugaaugagacucuggaggaugggguuaugcuuugucuaaugugggagccacaugggcugcauuguuggcccaggaguuuuuucaaacaaaacacucuguuguaguaacaaguuucacagaagaaacauuaagcugccucucauauuguaaccuuugucucucucgucauuugcagcuuucuaagaccucuucugacuuaaguaaaauggcugcuauauaccugguagauguggaccaaacugcaguuuauacacaguauuuugacaucaguuauauuccaucuacugucuuuuucuucaaugggcagcauaugaaaguggauuauggguaagugcaguugaucugaaguuaauugcaaccuuguaaguuuccuugguaagcauuuucaguagcuugccuauuuccaugugauguuggcucugugagucuuauaucaguacuguuuccccaauugacgcacucucuaauuuuuuaugcaaaaccuugcuacaaaaugagagugcuucugguaugauugucaaauuuuauuuauuuuuuuaauagugcauacacaugguuugucaaauuuuaauuuccgacuuaaguaugaagaaauaguacagguggcaaagcacuaccauccauaagucuauaaaauauaaaauagccauauuagcuaaauaaagaacucuuaaaauuuucccaggaauuucauuugaaacaaaacauguaguuuuucuuaagcuuuuggacugguaaguggcauuuaugaaagaaacauuccuucuagcaaacuaagaugugcuucucucuugcaaaguuuccugcuuuucgccauugaauuuuaaaucauucuucaacaaagccugucaagaauaaguaacaugauguccucuuuagugccuuccacuccauccaauuaccaucucaauacuuaauauugaugauugggugcauccaugauucugaucauuucuuacugugguugauguguccacuuaucuagaucuguguacccuuuuugucuuuauuugaaaguaugugaaauauuaucuguuuuaaaguguuuuaggcugggcauaguggcucacgccuguaaucccagcacuuugggaggccaaggcaggcggaucauuugaggucaggaguucaaaaccagcauggccaacauagugaaaccccaucucuacuaaaaauacaaaaauuagccaggcauggccaggcgcaguggcucacgcguguaaucccagcacuuugggaagccgaggcaggcagauuaugaggucagcagaucgagaccauccuggcuaacacagugaaacccugucucuacuaaaaauacaaaaaauuagcugggcgugguggcgggcgcauguagucccggcuacucuggaggcugaggcagaaaaauggcaugaacccaggaggcggagcuugcagugagccgagagcgcgccacugcacuccauccugggcaacagagcugccgucucaaaaaaaagauuagccaggcaugauggugggugccuguaaucccaacuacucaggaggcugaggcaggagauucgcuugagcccaggagguggagguugcagugagcagagaacgcaccacuacacuccagucuggugacagagcaaggcuccaucgcaaaacaacaacaacaacaacaaaaaaaaaacacaaaaguauuuuaaagcuguuuauucuacuggaacacauuugauguaaguauuaauuugguacaaccuuuuaugggggccaguucaacauuauguaucaaauaguuuaaaguuuuuaaacuuuuuaacccaguaauuacacuuccaggacuuuaauaugauguugcagaugcacauuuaacaaaugaaagaaauauaugucagcuagaaaaaagcauauuacugaauaauuuguaugacauaauucccaauguugggaaaaaagaaguuuguaucugcacauacacacacacacacacacacacacacacacacacacacacacaagauuggaaggauagacacugaaaagugaccucuggccucauccgugauuuuauuuauuucuuuaaaauuuuuacaguaacauaccugguguuugagauacuuuucuaaaaaaucaauuuuuuaauaccuaccacucaaaaggccaugaauauugaaugggcuuugcacaaugcccaggcaaaagcaacaacagcaaacgaagaaacaaugugcacuccaacacuuggugaaaucugcuugaugauuugagaagugauaaaaauagauuuugugauuacaauagcuuuugaagcuaaagcuuugcacaugacagagcuuucaugcuaguggcccacagcacuggguugagucauuuacuaaauggaaaaaaaugauugaaaaauuaauguugggcuuuauuucugaagucucauugacaagaagaaaauaacaaagcuguuuuucauuuuguuuauccugaaagucuucaacaagugauuacucaaaguucuuagagcaguuguuucucuucuaugcugucuagaucuccagaucacacuaaguuugugggaagcuucaaaaccaaacaagacuucauagauuugauugaaguaaucuaucgaggagcaaugagggggaagcuuauuguccaaaguccuauugaucccaagaauauucccaaauaugaccuucucuaucaagacauuuaguacauuaauugcugucaaagaugaagaagaaggcacaucuugacacaguaccugaauccagcugugcuguguuucuggaguccuuuggaaacaugugucccagaggagaagagguuugacuugcguguagaaaacccggccccugaggaaaagaccccacugguucucugaugaccugggaugccuaacugucuacucccugcaagccucagagcagccaagucauugguguucauuuuccccacagugauuuuuguaacuucucuuucuaauguuuuucuuuaucccuuuaauacagaacccucccaaacauuggcuaguacaacuugauuucaucauguucauuugauacacaagugaacuggaaagucacuucccauagaagcaaaaguacuuauuuucuacccuagcugggugcaugugugugcacacacacacacacacacacccccacaccccuuugccgguuccucgacucauacaucccucgugcuuucccaucuccagucuguauuacuguagguucucuucaaauaauuaauugagcagacaaguuuguuuuauuuuggagccuuuuuggcucuggcuuuuaaacauuguccugguuggcucauuuaauuuuuuuuuuuuuuuuugagaccgagucacucuugucacccaggcuggagugcaguggcgcgaucucggcucacugcaagcuccaccuccuggguucaugccauuuuccugcuucagccuccugaguagcugggacuacaggcgcccgccaccaugcccagcuaauuuuuuguauuuuuauagaggcgcaguuucaccguguuagccaagauggucucgaucuccugaccucgugaucugcccuccucagccucccaggugcugggauuauaggcgugagccaccgcgcgcaccccauuuaauuauuuuuuauguuauaaaauuuaauauggaaagugagaauuugaaccuucaccauccaccacucuauucagguaaaacaaugaaugagccaccuuagcaggagcagauuuuucccagaagcugcugccucuuccugaggcagaaaauuggauuacuaaggcucaaaacuaaaagagaugucagcauuguuggauagaaaugucaccuauaugggauuugccuguuuuaauaacuuuguaaggaauucuugcucuucuaggggugccuggcgcaaccgugggcaaguuacugcuccucuuuaaaccucguggugguuauugaaacagauuuauuagaaggagaggguaggugcagagcuggagagccaugggugaggcagcuugugaccugccuagcagccgcugaccaccucuccaacagaagccuaguccuguucagagcagcacugucacugcaaguccagcccccuuugccaggggcuccauuccaccccuuuccugcagggaggggugccaugagucuugcuuuuggcucauacaggagagagggaaggcugccaggcacugcuuguaucccugcugauaagaggagggagucacuccaggaauaagacaaaaggagaggaggaggccaucaccucuggccucuuccaucguacacuuccugucucugguuuaaucaugaugcauggagcuacaacagccaucuuagguccccgaggugcccagcaucacguaaaacaucgauaugcuaagaagaacaaaaagagcccaaucucugauguuauugagcuccugcaugaacucuggaccugccugccucagacuucugugaaagaauaaaauuucuuuuugccuaagucacuguua

SEQ ID NO: 15811 - RNA, 32525 nt, Homo sapiens
auuaauaucuacacagauuugagauaauuagccauuuuccuauuaucugggaagauaaucguucccacccaaauguucguuaaaaagacaaauaguggccgggcgcgguggcuugcaccuguaaucccagcacuuugggaggccgaggugggccauaucaccugggguaaggaguuggagaccagucuggccaacguggcaaaaaacucaucuccacuaaaaauacaaaaaaaauuaaccaggcaugguggcaggcaccuauaaucccagcuacucuacuugggaggcugaggcaggagaaucacuugaaccugggagguggagguugcagugagccaagaucgugucacugacuccagccugggcaaacauagacuccaucaaaaaaaaaaaaaaaaagacaaauaguucccuauuauuaugaacuguuugaguaaagugcagcaacauuugaagagaauucagagguauaacagaugaaaaguuuguaaaaaacaaaaaaccuauauauguguguauauauauauaaaauauauauacauauauauuuauauauauuuuauuuuuuuauauaauauauauaauuuuuuuuugagaugagguguugcucuguugcccaggcuggagugcaguggcgugaucucagcucacugcaaccucgaccuccugggcucaagcgauccucccaccucagccucccgaguagcugggacuacaggugcaugccaccacgcccggcuaaauauuuguauuuuuuguagagacgggguuucaccauguugcccaggcuggucuugaacuccugagcucaagugaccuacccaccucagccucccaaagugcugggauuauaggcaugagccacugcagcuggcuaaaacccuacauuggagaggacagauuagucaaguaauugacaagauaacuaaaauuucuuaaaaacaugcuauauaggcugggcgcaguggcucaccacuguaaucccaacacuuugggaggccaaggcaggaggauugcaugagcccaagaguucgagaccagccugagcaacauggcaaaaccccguuuuuucaaaaaaauacaaaaaaacuaggccugggggcauacaucuauagucccagcuacucagaaggcugaggugggaggauggcuggagccugggaaguugaggcugcagugagccaagauuaugccacugcacuccagucugggugccagagugagaccccgucucaaacaaacaaacaaaaaccaaaaaacuauaucccaggcacuaugcacuuuaucugaaucuuacuggguuacuucaagaguagaagacaaaauaguauaaacagaggaauuaagaggguuuugacauuuuauacauuaaugagauuacaauagcaaaccuccauauaaaauucuuucuucuauuuaagucccggaaaaguguaaaacggaacgaguuggaugcuucuaggaguauauucuggaaugggggugugcaaaggcuacuuaauacacagaugagugguuuagggaagauuuagaaauugcugcuaaaacagcaaaaugcagugggcuugcacgugaggauugucaaggaagauaaaaugaaguaucuuuagccgagcucgguggcucaugccuguaaucccaacacuuugggaggccagugcaggauaacuugaggccaggaguuugagugcagcaugggcaacaaggcaaaacuccaucuguaccaaaaauacaaaaauuagcugggcgagguggcacacaccuguagcgccagcuacuugggagacagaggugggaggaucgcuugaacccaaaaggucgaggcugcagugagcugagagagcugagaucaugccacugcacuccagccugagcgucggagugagauccugucuccaaaaacaaaaaaagaaaaagagaaagaaaaaaaugaaguauuuuagcauaggccauccaucacagggguuuaggauuguuucuccucucugguugauaaaagacacaaguggccgggcacagguggugcacgccuguaaucccagcacuuugggaggccgaggcaggagguggaucaugaggucaggaguuugagaccagccuggccaagauguugaaaccccaucucuacuaaaaauacaaaaauuagccgggugcaguggcgggugccuguaaucccagcuacucgggaggcugaggcaggagaaucacuugaacucgggaggcagagguugcagugagccgagauagugccacugcacucuagccugggcaacagagcaagaccccgucucaaaaaaauaaauaaauaaaaagacacaagugugaccccaagaaggcaucuggaaagguacucuuaguagaaaugauagguucacaaacaaggcaaguauaggaguuggguguucaccuacaaaagccaucuguccaagagccugcuuagauuugaggaaaguagcugguggggugauggugugauuguaguaaggccaggggagccacuucaggcuuguguggccaaugucuaugcccacguagcauauauccauaagcugcaucucccugcaccauagucaaagccaagaugagcuauuaauggaguugaaaaauagauggaggcuaggcgugauagcucacgcuuguaaucccagcacuuugggaggccaaggugggcggaucaccugaggucaggaguuugagaccacccuggacaacauggugaaacccugucucuacuaaaaauauaaaaauuagcgccaggcgugguggcucacgccuguaaucccagcacuucgggagggcgaggccggcggaucacgaggucaggagaucgagaccauccuggcuaacacgguguaaccccgucucuacuaaaaauacaaaacaaacaaaaaauuagccgggcgugguggugggugccuguaaucccagcuacucgggagacugaggcaggagaauggugugaaccugggagguggagcuugcagugagccgagaucgcaccacugcgcuccagccugggugacagagcaagacuccgucucaaaaaaaaaaaaaaagaaaaaaauuagcugggcaugguggcgcacgccuauaaucccagcuacucaggagacuaacacgggagaaucacuugagccugggaagcagagguugcagugagccaagaucacaccacugcacuccagccugggcgacggagugagacuccaucucaaaaaaaaggaaaaaaagaaaaacagauggaaaaacaggccauggaggugaggagaauaucacacauccacaguugcauaaaugaaguuacagagucaagcgaaagaacauuguuuugagguggaguaggugggacuuugcaggcucuguggagguggccauuacaagggccuuuacugcggggcugugagcacagauguucagcuacaacuaaagagcagacccccagggaggggcuguuuucagucaugcauuuggucagggagccaugaaggcuucucaggugauacacuaagcuugacuaaaaaagaaaaacugagauuugcuaguuucagaggaccuucuauuuauuuguuauuugggaacugaagcugacccuacccuuuucaaaagaucaucuuuucauugcguauggcaauaguggcaaguagaaauagguaauuucauuuucugaccaugugagucuccuaucaccuugcagugaaauagaaccaacuaaauauauuuaauuuaaugcugcuugucuauuaaaaguaaaugaaauggggccuagcgugguggcucauaccugucaucucagcacuuuuggaggccgaggcaggcagaucacuugaggucaggaauucaagaccagccuggccaacauggcaaaacccugucuccacuaaaauccaaaaaaauagcugggcauggugacacacgccuguaauccuagcuacuuggggggcugaggcaggaggauugcuugaacccaggaggcaaagguugcagugagccgagaucacgccacuggacuccagccuggacgacagaaugagacuuggucucaaaaaaauaaauacacaaaauaaaguaaaugaaauggacucaaggucuggggggcaggaaagucugcauuaagcuuugcuuaaauauaaaaguuaauugacacuugagcagaguaacggcugagcuucauuagaucugccuucugggaagacgaagauuguguggcaugaaacuaauaggccaccuaaagggauauauuaagaauucccaggucgggcucaguggcucaugccuguaaucccagcacuuugggaggccgaggcggguggaucaccugaggucaggaguucaagaccagccuggccaacauggugaaacccugccucuacuaaaaaaaauacaaaaauuagcugggcaugguggcgggugccuguaaucccagcuacucgggaggcuaaggcaggaaaaucgcucugaccugggagauggagguugcagugagccaaggucgcgccauugcacuccagccugggcaacaagagcaaaacuccaucucaaaaaaaaaaaaaaaaaaauuccagccgggcguggucgcucacaccuguaaucucagcacuuugggagucugagacaggagaauugcuugaggccaggaguucgagaccagcuugggcaacauagugggaccugauuucuacaaaaaauuuaaaaauuagccaggcacagugcucaugccuguaaucccaauacuuuaggagguugaggugagaggauuguuugagccugggaguccaaggcugcaaugagcuaugauugcaccacugcacuccagccugggugacagaccaaaacccuaucucaaaaaauauauauauauuuuuaaaaaagaaucccacugcuguaacccagcaacauuugauggauccacauuagaagccagugggcagcugcuuuggcacuugcuggguuuuuaucaggacuguuuuuaugucuaaaucacuggcaugauccuuuccucagaaauaucuaguuagacucuuguauuuugcccacuucacuucauuaacagacucguuacagagcuuuuggaauaaaagcccaaaauuguuauuaguuauggaaaaacugcugacgggcugaaaucuguguuagaccuucucccuaccuccuuccccauuuuaccccuucugaguacaguuuuuuuuuuuuugagacagcauccugcucagucgcccaggcuagagugcaguggcaugaucuuggcucacugcaaccuccgccucccagguucaggcaauucuccugccucagccucccaaguagcagggauuacuugcguucaucaccaugcccagcuaauuuuuguauuuuuaguagagacaggguuaugccauguuggccaggguggucucaaacuccugaucucaagugaucugcccaccucagccucccaaaguacugggauuacaggcaugagccaccucgcccagcccugaguacacauuucugucaacuacuuguagaaagguugaaaauacaguguguuguacacuuucauuuaguguguuugaacuaaccaaaccacuaagcaaaugaaaaccucuuuuacuugagagacuuuugcuuucagauuguaaaacacaugagugacuuaaaacuuucaacuucaacuaaaagcuuuacaaagagaaggaggaauaaaagccuuugaaguccuuucucuuauaaaaagcacaacuugcuuaguuuuuauuuauucuguuagcauccucgugaaguaaauggcuauguuccccacuuuggauagcaccguggauuacaaagacugucagcuagagauggaauccuaagcuccucacucccaauacuagcucauuuuuccugaacuggauaucugcucucuuuuuuuucuuuuuuuugagacggagucucgcucugucgcccaggcuggagugcaguggcgugaucucggcucacugcaagcuccaccuccugaguucacuccauucuccugccucagccucccgaguagcugggacuacaggcgccugccaccacgccggcuaauguuuuuguauuuuuaguagagacgggguuucacuguguuagccaggauggucucgaucuccugaccucaugaucuacccaccuuggccuuccaaaguacugggauuacaggcgugagccaccgcgcccggccuaucugcucucuuaaagaauguuccagcugcuuuacuuaauuguagucagcuugaaauuacauuuguuuaacugcaccaaggacccaagagagaacuguaaaaucuuuaccuuucuaauaacuuucaucucauuccucucaucuguucuccaaacuugcuuacauggccuuguucucaucuggucugaaaaaccuuaaccaggccgggcgcaguggcucacuccuguaaucccaccacuuugggaggccaagguggguggaucaccugagguugggaguucgagaccagccugaccaacauggagaaaccccgucucuacuaaaaauacaaaauuagccaggcgugguggugcuugccuguaaucccaacuacuugggaaguugaggcaggagaaucgcuugaacucaggaggcggagguggcagugagccgagauugcgccauugcacuccagccugggugacagagcgaaaaacucuguuucaaaaaaaaaaaaaaaccuuagccaaauugcagacaaacaguauuuucuugauuuuguauccaaaaauaaaaggagagagaacaccuugguuuuuauugugagaguguaguugacucuuagcuauuaauagacaaauaaauacacauauuaaauaagauggcugcccuacauuaauaucuagggaccagaggauuuuuuuaaaccuacuccagaggucucaagacagaagggaauaauaauucuaauauuauaaaaauaggcaguucuguaacacuucuuaaucacuaguaucuccauagaucacauuagacauuauacggcaguuaacaugacaugcuuuuagcaagucucacugccuucuuaugaagggauaauucuggacaauuuuauuuggagauuagguaaauaguaacuacuggaagauaauucacauaucuuuucuuaugaggucugcuaaaauugcuucuuuuuuaugguuuugauauauuuugcuuuauggugauauuuaaaauaggaauaguucugaggaauaaaguucaccuuuauucuuuuucccaagucaggaauagacuaaaauauaagaacacaagcuuuucuuuccaaauugccaaaaaggaaugacagaauuaacuucucccgguuacaccaggugagauugccuaagaguccuagauaggcaaguuguguugaacagacucucucucuuuccaugaaagccucaauauuuagacaacaucaauagaaaaaaauaacuuuugagcucaaguuggagacgaaacugaauuacugacucaucuugaaagguacauauccuuuuaggugucuuuuuacuaauccaauggugaauccaagaaagaggauagaauguuuauucuuaguauguucuaaaucuagcugguuucuaaguuucuuuggagaccagaaguaucacugaugagaaaggucuuccccuugauaauuauaugcuaguacauaacuuguuccuuagugcuaugucugcccauagcuccuaggucugaaaacaugcaccuacccgaaagaauucaauaacuauuacaguuggcccuuggccaggcacaguggcucaugcuuguaaucccagcacuuugggaggccgaggcgggaggaucacuugaggucaggaguucaagaccagccuggccaacauggugaaaccccaucucuacuaaaaauacaaaaauuagccaggcgugguacugggcacuuguaaucccugcuacucaggaggcuaaggcaggagaaucucuugaacacaggaagcagaggcugcagugagccaagaucacgccacugcacuccagccugagacucuugucucauauuaaaaaaaaaaaaaaaaaggaaaguaccaauuggcccugguccuggugcaguguaaccagcauggagaaauuaaguauuucacuucugcaaagggacaaggaaguauucccccaucaaauucauuuuuuuuuuuuguuuucucuacccaguaauuuauauccaaugugucaucuuggauauugugaagauggacuuaaaacagcuuauuuuuccuuuccuugagggauauguagcuaagaguagacuuuaacaugaaccaccuccauucccaaucacaguaugagucauaauagccauaauguuaguuacuguaauccaagcaugauaacucaugaugugguaucagaaccaucauuugucuuuugaucauauacuggcccugauaacauaauuuugcuauuugaguuguauguauccauuucucaugguaugaaggaaacacuaacacuaggaucagagccguucucacacagagauaagaguuuguuuucagcaaaaccaucugaggaagcuucuaaccuucuaauuacaucucuauuagaaggcaguuaaggaauauagacauuaggcugggcgcagugacucacaccuguaauuccaacacuuuaggaggucgagguagggggaucccuugagagcaggaguugcagaucagccuggacaacacagugagacccugucuauacaaaaaauaaaaauauugccaggcaugauggugcacaccuguagucccagcuacucuggaagcugaggugggaggauugcuugagacugcgagguugagacuggaguaagccaugaucacaccacugcacucuagccuggaggagagaaugagacccugucucaaaaagaaaaaaaaagaaaaaggacauuagaguuagauguggguuugaauacuugguuccaccguuaaccuuaguuuucuccuaaguaaauauagauaguaaucccuaccacacggaguuuugcagagaauuaaggugaggugauaacuacaaaacaccauagagccuggagcuugcaagugucaaacuauuauuaguguuugguagcuggcauauaauagaugcccaaugaauguuugcugaaugaaugacuaaggggaucacaugaagccuacuccacaucaagucuuucacugcccaaggucuaggagugcaggucagcucaccauuuaguuccucccacaucacuguauccuaucucagaaccugagccuguaugccugcguacuuuccuuucuaucuucagcaggaaagggccuggcuauugucagacauuucacuagggcuuuuuauuauucccucuugcugucuggugaaugaggacuguaguuucuacucugacugagauaauagaaaccucaagaaacccaacucucuuuucuccuuaugccuggucuccuggaaauaaaagggcacuuaguauacuaacucuucaguagccucauggaucccaagcagaguucaugagaaguaaaugcaaaaucaaggauaggccuggggccuugggguacuacauuuaaaaaaaaacuggacuggccaggcaugguggcucacgccuguaaucccagcacuuugggaggccgaggcgggcggaucaugaggucaggagauagagaccauccuggcuaacacggugaaaccccgucucuacuaaaaaauacaaaaaaauuagcugggcauggaggcgggugccagcacuguacuccagccugggugacagagugagacucucucucaaaaaaaaaaaaacuggaccaagaagacuacaugaauauuauuuguuguaaauuagcaguguguuucaggaaguuuguucuucugcagaagugaguucauauccauucuucuucuaguccacuauucaaccaguuguuaauuuucucauggcuaauuaugauaaacauuauaaagaaagucaaggaagaacuuccaggguacguuuuggaagaagaguggaugaaagaugggguuagagagauuguuauuuagaaggaugauuugaagcacuuguuuauagucagagauaagacacugagucaagaccauaaugcuaauacauuaagguacagagacuuggcccagauuuguugcccugucuucaucccaucacuuugccccuucuugccucuaucuucccaauccugauggaagguuguaaauggauuugagagucugcaguuacauuugugaaguagcaguugaucaccuuuugaaaggagucaagacuaggaggauuuaagaggagcaagugaugcugucuagagcaucuggcuuacugcccaggaagagcagcugcacccagaagcuguuggaggcagcaagcugacuuggagaugaaugacuccaccacaggguaccugccugucuccuaccuuugaauggucugaccuuccaaccagcuugccuggggauaugcugcccagcugguggccugacuauuuuuccuugugaccaccaggggaucaaguauuugcugggcuagaagagcaagcccgccaggcgaugaugaaaacugauuuuccuggagaccuuggcagucagcgacaagcuauccaacaacuaagagaucaggacuccaguagcagugaguucugcaccuucugguaaugacucagggcaaugggagaagaauuaucagagugugugugcucuggggauugugcauggggguugggagaaagacaugaaaaaggagauauguggauccucaguguccccaaagguggucuaaggugugugggcauguguuuauccagaaaaagaggacagguuuggcauuuuauuuauauauauauacuuuuuuuuuuuugugacagaguuucgcucuuguugcccaggcuggagugcauuggcaugaucucagcucacugcaaccuccaccucccagguucaagcgauucuccugccucagccuccugaguagcugggauuacaggcauacaccaccaugcccagcuaauuuuguauuuuuaguagagacgggguuucuccauguuggucaggcugguaucgaacuccugaccucaggcgauccacucaccucggccucccaaagugcugggauuauaggcgugagccacugcaccuggccgauauauauauuuuuaacuuauggacuacaguacuuggcacagugccacauacagauagguuuguugguugugauaggcaaggauauaggaauaaauagugcucaagcagucccuggguuaggucaaaugaaaagaaaaaaaaucccugucuccuaggaucuauguauuuguaaucaauaaaauauaaggguggcauuaaugaaaccuugcuugaaggcccaguuuuaauguuaaacaagaagauuugcuuaguaaugagguuaugcaguguauaaaaugcuaacgucaaggucuucccauaccaauucccuaagaagaucccugugguuacgacaguagcuguuacaaguugagccucauggauugucugucuguccugugaccugucugaacaaacacgucuugagauguguuuuccuaggaagauuucagcacuuuccccaccucauccauuugauauugguuauuauuaguaugaauucagaaugacuuuuccaauuuuucaccacauuugaggcuggguugggugaaaauggagagaggacucugcaaccuucuaggaacuuguuuccacccaagcuaauaauuaagcaacaucaacaacauaaaauaacuuagcaauuaauugcucgggcacaaaaaaaugaacccaaacaugucuggaaaaccuauggaagccaccacuuucuugaguagcaggugggaauuacaauaucugcaaacaucuaauaguuuuccauucugaaggauguacuaucccucuagacaguacacauuuuuaaaaaauuuuucuaguagcgagauauauuuggauuauugcaaaauuacaaaaauauguuugauauaucacuuuauauuauauaaaguuuacaaguauuucagauaagcuggggagaaaacaugguaugauguaaucugugccaauccuucauuauugaguuggauucaaaugaaaggagcuuugggcugggaaauaagacacacaaaccauagcucuuuccaggccccaaauccaguccaccaguugccuggaguauuuaucuaauaaggacacauguaacuacuagcagaugauuugguuagaccuucucaugaagaaagggaauauaacuaguuuugcccaggaagaagggaaauauguugcucucauacugguggauuuagauauuaugcaaggguaguagagaagacaggcacacuguuagcuaggaaaucugaguuuccugcggacagccuggugagacucugcccuauauuucucucuugcucacaucaggcccagaaguccaggauccaggugggguuaagauagggcuggagugugacagcuucccuaggcuuggcuacuucuugugaucuucaagguacuagcacuuuauuuuuucccuuucagaaagaacuacguucguuauuuguuuuucugaucuguuuucauuuucuauuuuauaaguaauagagaagaaaaaucagcucacauaaaccuugcagacuccccagccacaggcagaccuccucauagccacauccuaccccuaaaacuaaaacaaacucaauuccuauguuagucacaagaaauuacauuucauccuaaagaauggcccguuccuuccacuuaaugcauucgguuacccauugagauaauccaaauaaucaacagaaacaauggacuuacuuaguuuagaaugccauguuacaauaguagaguaagaaccgagugagucggauaccacugcaaagugccugagguugguugcugugcuaauuuuuccacuguaaugagcagcccuuucccuauaaagugacaucauuucaaacucauuuacuacugcuuccauugcugguaagagggaagaaaaacuugauguuucuguaagugugccuugagguuugcugggaaagaagagauuagugggguucagaguagaauaguauagugacaccguggagaaguugugcagggggcucauggcaaaaucaguggaaaguguugguaagucagaggugguguacagugggaaugagcucaguguaaggugcuuggggaggugugauuugaagugugagauauuugaaaaccaugagucagaaagauuauuuuuauaaucauguagagggcacgauaaccauuuccaaugcaguuuugcuucacaucuucccuuuacguguauauggcauaacaaaugacagcuauaguugguuuccacuugacauaauauguacccaacaaaacuauauaaacuauauuauggaagaucugaaaauguuuucuauuguaacugccaacucuaggguggagagcagcucaggauguauucaugcaaaaaucagaacaagugaccaguuuguguguuccaggugacagugagggugaugaagaggagacgacacaagaugaagucucuucccacacaucagaggaagauggagggguggucaaaguggagaaagaguuagaaaauacagaacagccuguuggugggaacgaagugguagagcacgaggcaagugacgauggccccuggguccagguccagcaaugcccuacccuucugccugcccugaugcugcucaccccuguggcacagucuugccucugauggucuccugggccugcaugggaggccucuuccuucauggcaccagaacccacaccucagacucucaguucucgccacacucaguuuuccuuuuccauccacgaaucgcugcgccugugcacagcucucuuuccugcagcuccccacgucuuuccagacaugagagaaacuuuguugaaguagaaagcugacuucccaagguggacucuugaaugugcuugcaaaucuaagucaaggugucaccuggagugccaccuucucacuaacuuguuuccugaggauuccugaaaggaacaugacaggaaaaacgcuaccccugucugcagaguuuaucuucagggaaaaaaauugauuggcucucucugaggcaauccuguguccucauggcugaaagccauaauucccucucaacuauuacuuuuuccuucagcccacaaagggaagcuaagaauaacaugcgccaucagucuggguuccuuuuaacaggauacccuguuuaaaaagcuggggcagggaagagaugaguaaagaguccuaaugaguugccuauuuguugaaucacaggucacagggaauuugaauucugaccccuugcuugaacucugccaguguccccucugccagcuagacugcgggagccgggagcaguugauugcucacguguaccagguauggaugggggagcugugugcucuggaacacaagugugggcagcuugucuguagcccagauccugguuuggccuuugucucucucuggcuccugaaggagucuuggguugucacuucuauuaagauucgucuuagggaggcugggcgcaguggcucacgccuguaaucccagcacugugggaagccgaggcggguagaucacuugaagucaggaguucgagaccauccuggccaacauggcgaaacccugucucuaccaaaaauacaaauauuagccaggugugguggcaugcgccuguagucccagcuacucgggaugcugugacaggagaauugcuugaacccaguaggcggaggucgcagugagccaagaucacgcaauuacacuccagccugggugacagaguuagacucugucucaaaaagaaaaaaaaaauucagcccaaagccaggugugguggcucacacccagaauuccagcacuuugagaggcugaaguggggaggauugcuuaaccucaggaguucaagaccagccuaggcaacauagcaagaccccagcccuacaaaauuuuuuuuuaaauuaguugggcaugguggcuugcaccuguaguaccaguuacuuggaagacugagguggaaggauagcuugagccuaggagguugaggcugcagugaucaugcuucagcuagggugacagagugagacuguauuaaaaaaaaaaaaaaaaaaaagagauucugcuccaagcuuccaacauuuuagaaaauaaaugagauauauuagauaaacacauucuggguuuccgggcagacacacugugaaaauuaagugauuuuuuuucuaaauuauuuaauguauauuuuaaauagugaaauagaaacuaauguauacuaauaaugagggcuuuguguuaaagaaaagaaaauuaguuaacaugggccaggcgcaguggcucacgccuguaaucccagcaccuugggaggccaaggugggcggaucacuugaggucaggaguuugagaccagccuggccaacauggugaaacccugucucuaauaaaauacaaaaaaaauuauccaggugugguggcgcacgccuauaaucccagcuacucgggaagcugaggcaggagaauggcuugaaccugggaggcggaggcugcagugagcugagauuaugccacugcacuccagccugggugacaaaacgagacgugucuuaaaaaaaaaaaauuaguuaacacaaaugguauguuaaaaauuagugugaaccaggggauccgaauaccagacuuuuguguucuuuuuaccaugauccaaucacagggcaccuguaccuccuggucgguguugacaagguaucagcacacauggcagccugggcuguaccauaaagauaguugguucaugaggacaaguauuucuucagaagacuaucuugaaaagauugagaaagcaagauauaaauaccuguugcauaccaguauuccaggccagcuucuagauuuggccuuuauuguucccuuaacacguaauuuguaccugcacagugugagccagggagacagagagaaauuauccgagacaugaauuccucuuaggcucugaagagggcucuggcgccccacuguuguuguuguuuuguuuuguuuuguuuuugagacagaauuucgcuguauuaccuaggcuggagugcaguggugugaucuuggcucacugugaacuccaccucucagguucaagugauucucuugccucagcuucccaaguagcugggacuacaggcaccugcccccacaccaggcuaauuuuuguauuuuuaguagagaugggguuucaccauauuggccaggcuggucuugaacuccugaccucgugauccaccugccucggccucccaaaguguugggauuacaggcaugagccacugugccuggcucccacuguuccuuaagucagccacaugucccagaacguaggcagagcucaagcuaaugaaaucuaagcaguggucuaaauggccagggccucuaauguaagagacugacuuuucuaggggcuaaacagaauacuuggaaguuccuuauucugagacuaaagaaaggggacauuucccaaaagucauuucuaagugggugcagauuguccuggagguagcgcaagacugacagaucaaggcucuguuuuacagcacacugcagcaguggugagcgccaagagcuacauguguccugucuguggccgggcccuuagcuccccggggucauugggucgccaccucuuaauccacucggaggaccagcgaucuaacugugcuguguguggagcccgguucaccagccaugccacuuuuaacaggucagcugggcacuuaucccuguugugcugggagcaaauuacugggugugaguucugcuuucugaagucaaagcgaaggcuagaaauagguaaugcaaaggcagcugaugcaugcuccuuggaaguacaaguaagaaggcuaggaaauaugccuauucccucacauagccccaaaggaaaaugaauucccauuuauuuucccaucagaauaucuucaacuagaaagagauguaggcaauuccaagaacacucaugauaaagcauggagaaagaaguuauaggguagagaggacccuggcaugaggaugcagucuccaucguguccuaggaagacuggaacguuguguccuugucccguuugucuaguguacagugcagagucugccuuugcaugcagguagugugagggaaggaggugaguugguggucugcaccuugccugaaggaggucuccaccuccaggagccuccauucccacagcaggacugccccugcaaagcucuuaucaaaaucauuauucuggcuugagugaaaacaccaaggguuugucugauuucuggugcauugcuguggcagguggcucaguuaacuccagaugggcuuuuagaguugguagacacccggccgggcacaguggcucacgccuguaaucccagcacuuugggaggccgaggcggguggaucacaaggucaggaguuugagaccagccugaccaauguggugaaaccccgucucuacuaaaaauacaaaaauuagccgggcgugguggcgugcgccuguaaucccagcuacucaggaggcugaggcaggagaauggcuugaaccuaggaggcggagguugcagugagcugagauugcaccauuguacuccagccugggcgacagagcaagacucugucucaaaaaaaaaaaaaaaaaguugguagacaacucucacgcgaagagaagggauggagcagcagaagagguccaccaagcauucaaacugaccccuuguggugagcguggagccacuggccucauaggaaaagaauaaggcagggcuggagucccgacucuugcuagaaggaaacacuaaccauccaaaauguuuccuuuccagugagaaacuuccugaaguacuaaauauggaaucccuacccacaguccacaaugagggucccuccagugcugaggggaaggauauugccuuuaguccuccaguguacccugcuggaauucugcuugugugcaacaacugugcugccuaccguaaacugcuggaagcccagacucccaguguacgcaagugggcucuacgucgacagaaugagccuuuggaaguacggcugcagcggcuggaacgagagcgcacggccaagaagagccggcgggacaaugagacccccgaggagcgggaggugaggcgcaugagggaccgugaagccaagcgcuugcagcgcaugcaggagacagacgagcagcgggcacgccggcugcagcgggaucgggaggccaugaggcugaagcgggccaaugaaaccccggaaaagcggcaggcccggcucauccgagagcgagaggccaagcggcucaagaggaggcuggagaaaauggacaugauguugcgagcucaguuuggccaggacccuucugccauggcagccuuagcagcugaaaugaacuucuuccagcugccuguaagugggguggaguuggacagccagcuucugggcaagauggccuuugaagagcagaacagcagcucucugcacugaaccacacccuccugccugcccuccuucccaccuaccuacccacccacccacacccacagccacgaggaccagugcugcugccacccacgaggcccuguccuugcugccagaggcaggccuggguuuauugcagguggaccugagcagcccuugcauaugggaacaggaugauggggucaggagggaccuggcucaaggcagcucuggacaagggagcaggcaguccagagaacuggccuccccagcccacugccacaggcugugcuucuaggacuguggggccccuguguggcccaugaaguugugaagucaaauaaauuaauuuuaucuuuacugccccuuucuugcuuuucucucaaugucauucuagcaaaugaagugaucuaggagaaaccuggguggaaauuuucagacaguggcuucugguggcuugccguuuucuuagggaggaugcuccucagcuuaggcuguccaagcagagguccuuauuugggccuuuacaaguugccgaggaauuagcaugacaccgaagaaagaaccgauguugacugugaugauuauucccacaaccauaaugaagauaccuguggucccaagggcuguuuaaaccuagcuuaccuuuuccaaacucagaagaagucucuucucauaacugcuguuuucuaaagacuaugcaauaccuucaacuaggugugcaacuuuucccagcaauauugucgaacauuuacaauucuagacaguagucagcugcaucuaggaauaggcucauagaaauagcugcaauauuaaggugcacagcaccaagaaacucauguuugcauuuuauuuguguuuuauuuguucaccagaggcaaggaaggaaaauaagcucacugaagaaaauccagaauuaaggugguaagagagcucagguuaaggcuagggcaaaaugauuacucuggcagguuguaugacugccaaaccauggaggagacaagagcugaggucauuucuaaaaaguuucugugaugguacagaacaggcacagaaccuuccuagccugcaccaaagguuguguucaguuuagauaauuauagaucuugagguccagaaggaagugcccuaguuaaauuguagccagaaaaauaacuaugccaggaaugcggacuucuuccaauaucuuaacagggaaacuuggauuccucucugaccuccauagguccaaggcuguuuaacagugucaacugacccccgccaaacuagggguuuuguuuuuuguuuuuuguuuguuuuuugagacggagucucgcucuguugcccaggcuggaguguaaugacgugaucuuggcucacugcaaccccugccucccgaguucaagcaauucugccucagccucccgaguagcugguguuacagacacgugccaccacacccggcuacuuuuuguauuuuuaguagagacaggguuucgccauguuggccaggcuggucuugaacuccugaccucaggugauccccugccuuggccucccaaagugcugggauuacaggcgcgagcuacguagaacccugccuggaguuugcuuuuuugagaaaggauaucacucugucaccuaggcuggaguacagugacaagaucauagcucaccauaaccucuaacuccuggacucaagugaucccccugccucagccucccaaguagcugggacuauaggugugcaccaccacacccagcuaacaaacuaagguacuuucaccaagcaggcuaaaauauuuguuuugaaaaauacauuuaaaagaaaauacuuaguuggcgugcuuguaaucaaucccagcuacucgggaggccgaagacgagaaucacuugaacccgggagguggaaguugcagugagcugagauugugccacugcacuccagccugucaacacagugagacucuaucuaaaaaaaaaaaaacaacaacaaaaaaaaacaaacaaaaacuguuuaauuuacuuaauugacccaaaugccuuucucccagagcuccauacuggaguccuacuugggaugcuuuaaaaugacugaguccucaccaugugccacagaugauucuaagcgcuuuacauagaugaucucaaucuucacaagaaacucugaauucauacaaacucaagaguugcaccucuggguucagaagugcccugccacacuagcuguguaacuuuggggagguuacuuaaccucuaugucuuggcuuccccauccacaaaauggaaauaauacuagcaaaaaaagcuuguccguacauacaaagcacuuaggauauuuuguagcccauaauaaguguuccauaaaugccauuacuaguggcaagcuuucuaaauuuuaggcaguagcuaugauuggggcugacuuauuccagcaauuucuggcaguauuccugaguaaagaauuggggagaaggccagcagcgaaggcaccuacagauccuugugauuccacuagaaucuaaguguucagguagacuuccgggucucugaaauccacaccaacagaggggaaagaccaugcuugaggacaagcucaugccaucucccuugagcucaccgcacaaauaaagccaccauuuguguuccauuacaacugcucccacaaagguuucuaucccccaccccauggccaccaucuaaggcugggauaggaagaaggcgcaaacaccaaaaggaaaagcuaguaguuuauauagauagauauauagauauauagauauugauagauauuguguuuacauaguccacaaguuaaaugcagguauccauaagaagagcauuaacaauaaaaauacaaucuguguguagccaaguacagagacuuaaaaugguaaaacagcaaaaaggaucucacaaaaguacaaauauacaguacaaauugauuuauuuaaaacaguuacaaaaaagcacaacaaaauagagauuauccuuagaauuauuaaugcuuuguuaaagaucagguaggauuagaggguaagaaaugguauuggguggagggagcaccugacuaguucuaaggcuuuagauacaaugcaguugauuacauauuaauucagccauuacauacuggggauaguagaugggggaucaguaauuuaucuacagggaacuccuacacagauccauccagaccuccccagugccauccuucuccacuccuuaggacccuaaagccaccuggaugacaacauucccauccuuucuccaccccauucccuauccguauauucuucccucgccuaaggugcugugcaagcugagagcagucugcucucugcagcuggaucauauacuguuuuggcuacagggauccugugugacuaagaagguuguaggggacagccuuauuuuaauacuuuaaguuagccaugaguacagucagucccucccccaacacaaucuagauucucuugaaugcaaguaucagucaagugagggaucaacccugccuucagcaauaccagcaaugcacuaaccacucacagcucacaacuacgugcaaacucccugcccaggggguggguguaaaaccacugugucaucagcucacacucuuucucugaagaaccucaguccccaugacagucauaaagacaaauaaaugcuugcaaguuugacaacagguaaaggcacaugggcugcugccacacacacugcaggcaagaacccaauuugaggccaucuucacugcugggcauuugcaguggaauggcuuugggaucacaaaacuuugaguucgcaaucuaccagggagggaucuagguuuaacuggagaacuaauaaagaaaccuuuagugugaaaagugcauuuaugacuauuguuccugcuggggaggcagcagggcaaaccgcaacaccucuccuccuuccgccccaggcacugugcauggucugcagcuaaggagagagugcagucgacucuagcaucucuggggccagugucauccuaggcacagaccaggcuucugguccaaagauggauccuagaguugaaagagcaacugacagcugcaaagacccagaugcuuauuuuauuauugcauaaugugggagaccuucccuaccccaggaaagcuggagagugaaggcuucccagcaaagggcaaacagguuccugaucgacauccaaccuaauaagguucagcuccucaacuguaguguacacuuuugcccaucuggaagguacuauagcuucagugugguuuaguaaacuuagccuaggaggccaagaugucucccuaaaacuuagucucuguccuauuuacuuuguuuauaagacugugaccuaacuucccauggccaauucaaucgacuagguuaucuuuacuccaauggacccaggccuuuucccagucaauccauguccaacccuucaucuccagcgugaucacucaacucuucaacaugccugcuugcugcagguuuaaaccacaccaccauccugugcuucccccuaaaucgcccaugaugcccgcagguaaaaauaaaacuaaaccccacuugaggugcuauuucagccaaacuuuaaacccucuccgaacuccagaauccaccuaacuggagcuggacgaacuucacugggaugcuggcaugggcccuaaugugguucccuucauuuaguuuuuaaaacaggauacaagauaccacaaaggaaagaaguuaauacaacagaagacaccacuaguagaaaccugcuuguuucucccucaagauagucagacauuuggagccagagggcucccaacagcacugaagccuuaucccuuuggauuuaccagcccaccagcagcauuucauaccaucccuaucgaacaugacuucgcuauaaaauaacauggccuaacacagguaagaaugaaccggacgccuacacuuaaucuacauggccaaagacauggaaggauagggagcuguagaggacagcaggcaggacagugagcggacagcagcaguggcaaagcagcgcagggcaaagcccuugguguuaugaccaacugggaccaagaauauagaaggaccagcccagauuggcugggggcccucccucagguacaaguacucagcucugaacucccagagccccuuccccccaugccaccucuuccucauguauacuaaucuugauaggaaugauucaagacuuggcuuauuauccauccaugacuggguuccccuauucccaaauugguauacacauuuuuauacagcgccagacagucagcaguccuccuuucuauuccuaagagcuggaaauguccuacugcugacaagggacaggcucuggcccuugucaacugcucauucuuaaaaaguuggcaacuucccacuaaaauacucgcuaaaaacugcucucaugucuccugcaaacucaggaaauuccuauaaggaagaauggacacaccacagguuagucauauuuuucaugccuggaggaaaagacuaaacuagagguuaaaggcaagggggaggccacagcucugaccgagauuuagagcacagagauucuuuuccuggggaccauauuuuaugacagauaccuuugcagcucagcaaaaucaaguauuaauauguuauauaugcauggaacgauauugugguauuacaggaacugcugguauugcuucaccagcaagagacagcaacagaaaggucagggcccaacuugccaggguccucaagaauuucucuuuccagaauucaguggaaguuaccagguuggaaagucacaaguagcccaaguggaaggugauuugaucuaaacuaauuggucuguaucugguuagacauagguuugccccauaaggagaaagcucagcuuguguccuugcagacacugcuugagcaucuacuguguacaugucacuaaauucaguugaugagccuuccuaugaggaaggacgcuugugagaaacccaugcaaacaaugaacucuaggaaugaguugcucaugaaacagccagagaugaggccuucucccaaggccuucucauuugaggggauuccucaagacucaaccccacaggcccccacuguaggaaacaagccagagaaagcagcauucagagaaugggggacagagaaggggaaagauaugaucccaaaugcaguacaaaguuggcgucugguucugacacaaaccagauacugaagcacucacggucaggucagcaaccuccuuugauggacccccaaaagcugacugaccaggcaaacugcuuucaaggaaugaaagaguggaggguagggcuuguagcaaacaagccaguuucagucacucuguucccccaggagaacaaccuuuagcaccugaacacuaagaaugacuccauucucagaacuuccccuccccccaggagguagguaagauuauuuauccccauuuggcagguggggaggaagugaaagagccagaggucacgagacuugccgaaaguccuugacagagcagagaucagaccucagagguuuggacuccugaugccaggccaggucucggccaauccaaguauaccuuauaaaggacaugccaggaucauagccugggagaagucuaaccagagagcugcguggacaauacccugaguugccuucaagagucuaaagacccccaaaaaacaaacaaaaaaacuuacccaccugaaagcuagugggggagccuaauucccaauacccaguggaaccccacggucugagcugaugcuaaaaguugugaagaaaaugugggauuaagacauuggugggggguagggggggugccaaugcaaccaagauugaaaauacuuuuugcagaggaauauaccaacacaaaaugacaucuauucagguacugaaauguuaucaagacuauccuagaaucuuagagcugguggugggaggggauggcuuggaggcaccagaaugcugggagaagcaguggaauaagacaggaggggcauaugggacaugugaaaaugccaugaugggcacugcccagccacgcauucgcccuggcccagggcauaguucccuucuuguuucuucaccaagcuguuuggcaguggaaguggaggggacaugauuuugagauuuuaaaaauagagauuauagcugaaggggaaaccagagagacccccuacccaccaaaaacuagaggucuuggucagaguggacaaaaccaacuuugcagacaaggaaaggcagugcagcuacaaaugaggcccaggucacgacaccaugcagcggucagcgcagcaggaggguggggguggcgcaggcacuugggcacaacacagacaaagguggggggucagugccugggaaaaagggucuacuaguucuaaagucaccauuaccagcaagauucugugagauuucaaagugggucuggcaugcugagauggaggagcuuuguuaggugagcuaccuuuccagagggccugccuagaacccagucagccuggcuaucaagucuuucucccaaaguccccugacugagucccuggcaagguaguacuucacucugaacccugaaggggcucucccuccgggcccccgugcugcuagaagccuuguaggcagaauggugaggagagauggggaagggcuaugaagcagaggaucaagcagaguccugcagaugagagugcuccucccccacacacccagccauagacaucuggaacaaaaucacccuuuaaagugcgcaucucucacaagaaggguucugggugggaacccucuuauuuccaaccuuggggccuccugcccuucuaccacaaaaaagaaaaaaaacuucugacaguuuaacugcuacuauaagcuguggaucaucauuuuuggcucuuucuuuacucccucccucugccaucugcucccaaagccuggacuuucucuugcaggagcuagggauggggaggaaagaacagggaggcccugauuuuggaauguuucuucuccugugugcacccccuuccuuccuugccccaggccugcugcuccccaucacaacacccucugggguuguccugaaaggaugccaugggguaaugaacaacagauccugccuugggaggcugacuucaugccuccccuuucccccaaaucucacugccaagaaagccauucccugcucggcgugugcaaauccucugccugcucacggcggcgaggcgaggcucugggguaaagccccaguccuggucuggggaagagguucauuuucccgcauuggaacgcccuucaauggacagcuuuaccuccuguggaaugaaagagggacggagcagcgcagcccgugccuccuccccuugcaugcuguaucuuuggaagcucggggcuggccagcaggccugagcaccggacucaggcugggaaggcucuaccacacgggagcccucuccugccggcuggcucuuccccucacugucacauagcucucuggaucccaagaccguccucucaggccuuucucgggggggacccagcuggcuugggggagcacagcuggccugagaaacugaguuacuguucaagcucuguaaacugauagagaugcagacaucucccaccuguagccgauggcagggcagagagaagaguugugucguccgcccagggcugcaagaggaccaacccuggccauauacaaagaaggggugcucggggggcacuucgaugcucacuuugcucugcugcucaccaaccacaaaaugcagcaugacaaauccaggccauuggcucuccugaauguccacgaccgugcuagagucaaucuucagccccccgcucacuucggcacugcgcacaaaauccugggucuggagguccuccacccgcuucagcucucccguagccagcuggaugauggcgccuuucaugaaaugggaaggcaagugagaggagguaauggggggcggcguuggcuccuugucugggaagguggcucuggccugcacguccagacuugaugcuaccaggaucuccgagcccacaggcagcaggccugagucaguuccagugggcaccagguugccauuggcuacaaccauugcuuuggguaaaggucuauguuuuacugguuccugaugggacugaggguagaacccacgggccugacuuuucucugccagcucugcaggguuccuggcugacccucgccccucacccugauggucggggguaugaugggauagguugagggggcuggguuccuccuuccucugagcugccaccacacgauaguccugagaagcuaaagcgccaaccacccgcuggaccucaaggucaguguccggggucccccggugugcuggugcugcuaccucuacccguggagucugagaaccugaaaacaacuguccauccaccacacauucuaccacuggcaccagucccuggccuucacccuugcuguugggggagucaagggcuucacuuucccgucuuacuaaauuucgcucucguggucucuguccuccauuugcagcagcugcuuccagagcagacuggcucuccugagggguaagaacugggcuggcaccugcuggagggguuucaugcaaaguauacccagcagguagccuggacaucugauaauaaaugggcauccgaccuggagcaagguccagcggcugaguacuugaaugauguggcaauugcccagauggggagguggcagagggagcuuuguuaaaugagugggccggggagggagccugugggggaggaguggcuccuucagccagaagugaggcauauggcacaaaguguggaaggugagagguggcaagguuggcagaaggagauaggaggggacucgguaggaaauuagguggcacagcauagggaaggcuauaaggagacccaaugaacugcagcgagguggaugggagcugagcauaguggaguggaggauaguggaugccuggauguugaauuagugaagacgcuacauuaaacguugggggcaagggacucauauucaccacagaugggaguccaguuggugaaaagguggcaggcggcacagccaccuuauacagcaugccauacugguccacugucagaccggugauggccucagcuccaucaccccccaggcugacucuggcuccugccuggcucugcccagccaccacaaccccucgggaccauucagaagcaucacuggagggugugugguuaguggagcagcugguaguucuccccauauccucgcuggucacggggaggucucguuucuuugguggaaggcauuccugacuccuuucaugaacagguuucauauugcuuugugguguuccuggagccuggaaggagucgacuugcucccuggggcaucagaaggggcuucucuguagcuucccuguaccccucucugcuucuggcuggggcgcccacaucuauuagggaacaaaucagaggcaaagaaaaguaaccuagggaugagccaagacaaaggaaauagaaagaacugugccauggaggaagauguaacaaaggggacuguuagaaaauaaggaggaaagagaaaggggcagacaaggaggcuacccccaacucauccagccugggacaugagagaaacagucggggaaaucacaaggcacaaagagcuacagggacacgcauucaccaaugcacaaauaaccugugggcuccacaagcccagggagaccaacagcuucacgguuagucaugugucucauaagcaccuugucucuuuucugccuucuucccaaagggggcuuugaacacauggucuuuccugcuggcucuuuugcuuuuuuuuuuuuuuuuuuuuuuuuuuaaaacacauggaguuuugcucuuguugcccuggccacaguacauggugcaaucucagcucaccgcaaccucgccucccggguucaagcaauucuccugccucagccucccaagcagcugggacuacaggcaugcaccaccacgccuggcuaacuuuguauuuuuaguagagaugggguuucaccauguuggccaggcuagucucgaacgccugcccuugggugauccgcccaccucagccucccaaagugcugggauuacgggugugagccacagcgcccagccuccugcuggcucuuuuucuuaaguuucuccuuuugcuaccaaacaugaaugugccaccuucuuuccugaacauaugaccucauccuugcuuccuuucuguagccuaauuuggguuaugaucucaccuacugcuaucccaagccuggcuaaaaacucucuuccuccuuugccucaucucaucaguaccucaaggaccuaggugccaaaacccucaggucugcucguguuuuguuuuuuuuuuuaagacuuugcucccuaaccagguuaugaaaauuaacaucuuugacccaugaaauaauacauuuuaacucagccucuauauagugaaagugauuaaacuaguuugcugucaacuuguuucuccucuucaccaaagaacaacaaaauucuaaauucuucugaccuuacguacacuuccgguucccuagucucaaaaggcuucuucucaaugaucaccuucaauuugccuucucuauucauucccuuucuuuuuucuuugugcuuucuuuuaccaauagcuccuucuccacuguaggucugcuccaggcaccacuccaugaaauucugguuccauuccucuaaacaugccuguuuuuuuccccguaucuguaugauucauaagaaaguucucuuucccuuuucucuuauugucaccuuucacaaaugcuuuuguccauuguuauaaagcaacuuuuuggucugaacacuucagugcacaugaacuuugcugccuauuucuuccaaccagguuccaguucuuuggaucugaaaagagcuuucuauauuacauucuguucuguuuuuccacugugacaucccagauauuuuccugaaacaaggaauucaaagugccgguauuaccugaguuuccaguggugcuucugagcagcuguaguaaguguccucccggcuggcucgggagccuagaagauagaaacaggaauggaguaagcggcugccugaccucuaauucuccccagggucaccaugaaagguaauuccaaagcauuagaguauacacguccuugccucaucuucuucuccacagguaaacaguacauuuacccagagugcccaggcaguugaacagagagaaaaacaccucuaaugcuccaacuuguaagaagacaucccugaaaaaaaauuuccauguaucaaauuucauugguuuuccguaacaucauuucccuaacaucuaccugugccuguuccccaaagguuaaauuugcuccaauccaaauuucagauaaacgcacaaauaaaaauggaagcuuuaacacuguucccauaugaacaaugggaagcaggaaaaaucaacucuauggauuuccccuuuauucugggccuaugaaaacauaaauguggaguuauuuaaaugaaaaaaagcagcaguagaugaaaaagaacaauuauuuauguuucuggggcagaaaaagaggucaggggggagucacucaaggagaagacuuauuaagagauuuucaggguuaaaaaaaaaugagcauauguguguguguauguaaaauuuucugagugacaguauaccaagugcugaaucagguaugaaagaaacugaaaauauugccuugguccucagcuggcuaacacuggugaaacaaaacuaccacuaaaccaucacuaugugaaucuacacuugccagaaacgcaaagcgagaaagaauggagccuuaaccucugaaaacagagaaggcaguacagaugagugagugcucugagaaacugacuauccuguccaaguccuauagaacacucuaagccucaacccaaaccgaaugcaacauuucucucuuaagauuggcaaggugcagguguacacaaaagguggaaggauaggaaaacacagugggaaaacaaauuccuaauuccacaaacacauauuauuacacaguggcauaaauaaugacucuuuucuccaccagcagcuuuaauaacugaaaagcagcuugcuuucuucuucauucccaacagaaacuggggucacacuucaaucccaaaaugauccuugcuuucuguaacgaaaacuuuaaagaaaaccugccuccaggucaccgagaaguuagcaaacacaggcuaguaaagggaccgaaagaggcaaaaggucugcagaaaggaaaacaaagagccaagccugugcgccagguucccacaacgcaaaacacacuuaagaauccgaaaccuccgccucucgagaaccucacugagcaucucaaagggaaaacgcagcuugugaccccaaccgagcuaacaggcuguucaggagaguugccaacgcugcuagcagagcccggaaccaagcuccucaucacgcuugggucggaaucaaggggcugaacccagcuggagacccaaauucucugcgggcgagaggugcgcccgacagaaagggagaagcuugucagagacuacgguuauggcucccaguggucccgcaauccuugauccaacaaggguagggcucgaaauugggaauucugcguuuagagaguaggggguccacccuucaccaagggggcaggggcgaggcccugcaggcgacgcuuccuuguuugggggcccuucccgccccacagacucggacaccuuggcucgcaggcacacagccuccggggcgccggggccugaggccaccuuccaggacaggccagagagaagcgcgagggggucuaggugcggccucuccccuccgucuguccacgguucaugggccccggcccgccggagcaacgggcuccugagggccacuuccuccggagcaccgaccccaggccugccuggccccggcggccaccacuuccagggacacucaccagcccauuucacagcgcuucccaggauccacucacucgucccggagccgccgcaaccgcggccgccgccauccccggccccggagccgccccacacccagcgccccccacagccgg

SEQ ID NO: 15812 - RNA, 979 nt, Homo sapiens
cuguaugcgagcaaaaggcuuagccugguacaaacucuggacaaucaguugagagaagucuguuugugguacguugcauggaggagggccuggaauuggccauuuuucugguucuuuuuucucauuuucucauucauaauuucuacuucugugcuauccuucagugccucugugauaagguuuguagugagagccugaacacguuggaaaccagcaaucaggaaaauaggcaaggaaucuuguucaccccucuuuccucgaagaaaguagucucuuuccgaauuuucugcauugaaguaauguucaauuugacgcuuaauacacucuuuaagcaaugcuucuuccacacgauacaccuguaccccuguaccaucaucauaguaauacaucauacugguauuaaguucuguuugaaauggcugaaaaguccuuucaccauguucuugauaaccauauuuaucucuaucucaccuccaauuucauauauaauuucuccuauuguuauguguugguuuacuugcuucagguugacaucuugagcuguuccaggauccaggucuuucuugacucucuggucuuacaucaucugagugguacccacgugugcuuauuagcucucuuucguugauuacuugacuaagccucauccucacugacauuuucaccaggaccauuuaauuuuguuucccgguuuuguuuguucuuuuacuucucuuuccaaccuucucuucuuuuuucuuuucuaucuuguggcuuuuuauuuccuuggcugaggacgcucugauauccaguguucacuaauucacuugguguucgccaauucuccauauccuugaaaucacuagccuuguuggauuucuuuuucuugaguuuuccugcuuucauaauuuugagggaaccgaacucugccuccaggguuuccagcgcuggcugcggccgaccuguugugguuggggacagguguugugaaggcuuuuug

SEQ ID NO: 15813 - RNA, 2858 nt, Homo sapiens
gggaugaaaauggggaaggcgugaggaccuagacuacuucucccuagaucagaaaaagagaauuaccccuugacaaauaugauaccugcuagguauuucccagggaaauuuagggauuggcgucuuucccuagcauguggaggaauuggcagacagcuuccuaagggcggggagcgggggcccaaggcugacacugcuugcauccacgugaccuuaaguuauggcagaugacucugaaacggacugaggccaaugagaacagauggauggagcacucagguuagacuuguuccuucuccuaugcuggaggagagggaugguucucuagaauguuggaggugaguugagagcucgccucuugaauguugaacaguguacucuucugaaaacugcauauucacuuuaugugguuucagaauacugggcucaauacuaacauaagaaagacacuucauugagaaauucuuaagcuuacagaaaaccuauacucuuugcacauuccacauaacccuagcaaaaugcaguuucuucauacuucugucacuuuuuccauuggaagauuugcuuaggaaaauuaauuccuauuuauucccacaaaauguuggcauugcuugauuuuacccaauggggaaugugcuuugaauuuuuggaacacuuuuacaauuaaaaauaaaguagggccauuuuuaauuuguuucaucagaaacuauguuaaagagaggguuaaauauaaauauauuuucguguguauuuuugggaagauuuuuguucaaagcaauagucaaaaucagaugaccuguccauaauaauuaugugucuucaucuucucagaggccccaugcucauaugcacgugucauugggauacacucuugggggauuugguacacucuaauggaugucuaauguucaaccccucgagaaucugaacuugaguccccagauugucaaacuacuggucagcuauugagaauuuuagaacucaggucuuugauuugaaguagggaacauaguggcucacacagaguuuaggugcuguuagaaagaugggaacaagaguguuuugccaccuuauuuuuauaugggaaauuuuuuuuaaugaagaaaaaaugaaaaugaaauaacaggaugauagugaugagugauguaaaacaucuuacuuagauggcagaaccuucggguuguagaauagugaugucuaaaaauuaaaguuauuuugggaauacaccacuuuaauaguauagucuuauaaaaauuauucauuauggugaacccuucuugucugcuauucguuucccaaccuacuuauuggaaccaccucaaaacccaguucugaaaugaccuuaccaaaaguaaauguauuuauuuuuuagucagcagaacucuguaauuccaaauguuguucugugugguagaauuuuuuuucaggaaccauuagguuguauugaaaaucuuuguuauaggcgauaccaaaacugauuauucuuuuuugcagucugcuuuaauucauguccuucugcaguugcucuguauuaaaacaggguaaaaaggccauagcccauuaugaaaaauauaauacaaaacucuuugaccuaugagguaacuuacagacauuguguuuucuaaacaggcugucagugaaagcccguaucugucuccaggugaauguaauuuacuuccgaguacuuuacccagaggauguguuccccaggugggcagaguacaguugaucucuagcacagacagagauucuggccucugcauauucucaggucucuguguguaccucccauugaguagagaagcuuaagauaauuucugagagaagaacacugcugauugugggagcaguuuaggaguccauggaagaaagaaaaauacaugugucuuggcagccaugguguauuuuuguccaaauggauuggaaggauauuugaauauuugaauguugguaugacauaaagcugcagugcacuauagagucaagucauugaauuaccacuccugauacagggcuuuauuguacuacugugaaguguaugugugcaauacauuggugaguucauuuacugguguacggaagagccagcaggagcagcguggucauugcugggugcuauuacaguugcuuguagugagugcuguuuuccaggagauggagccaguuggguguggcagaucuacugaauaucaaaugaugcucuucuucccauguagaccuucagcaaaagccgguacuuggaagccacaggcucaccuucucuaucuauccaauaauuauuaaugaagagaccuccauaagggagcagcuggcuguuaucgauaaauguaccaauuauuaaauaauuagucuccaagccauucagugaugucuucagcaucacuauaggacugucuagugucacuuuuuacuuccuucuggguggaggcuuuccgacucccaaucaugaaggcaaguuaaucuuuccaguuagugacuuuugccccauaguugggguaagcacuuccuagauugagaaaaagcagcuacagucaauccugcucuguuugccucauuuggugaucagucagucacacauaaguuccuuguauucuaaauuucaugcacuucucccagaugcuauaggguuuucucucacuguugccaguggaugucauccagacagugggcucauaucuuacgguuuugugcaaucauugucguauuguagucuuaagacucauuauaguguauuuuugauauuuuugaaauguguuaaauuuuuuaauucaauaauaugagccagagcauguugcagcaaaucuauuguuuguaaaaauaacaauaacaauaauaaauaaaauaaaguggaaucuuuu

SEQ ID NO: 15814 - RNA, 2858 nt, Homo sapiens
aaaagauuccacuuuauuuuauuuauuauuguuauuguuauuuuuacaaacaauagauuugcugcaacaugcucuggcucauauuauugaauuaaaaaauuuaacacauuucaaaaauaucaaaaauacacuauaaugagucuuaagacuacaauacgacaaugauugcacaaaaccguaagauaugagcccacugucuggaugacauccacuggcaacagugagagaaaacccuauagcaucugggagaagugcaugaaauuuagaauacaaggaacuuaugugugacugacugaucaccaaaugaggcaaacagagcaggauugacuguagcugcuuuuucucaaucuaggaagugcuuaccccaacuauggggcaaaagucacuaacuggaaagauuaacuugccuucaugauugggagucggaaagccuccacccagaaggaaguaaaaagugacacuagacaguccuauagugaugcugaagacaucacugaauggcuuggagacuaauuauuuaauaauugguacauuuaucgauaacagccagcugcucccuuauggaggucucuucauuaauaauuauuggauagauagagaaggugagccuguggcuuccaaguaccggcuuuugcugaaggucuacaugggaagaagagcaucauuugauauucaguagaucugccacacccaacuggcuccaucuccuggaaaacagcacucacuacaagcaacuguaauagcacccagcaaugaccacgcugcuccugcuggcucuuccguacaccaguaaaugaacucaccaauguauugcacacauacacuucacaguaguacaauaaagcccuguaucaggagugguaauucaaugacuugacucuauagugcacugcagcuuuaugucauaccaacauucaaauauucaaauauccuuccaauccauuuggacaaaaauacaccauggcugccaagacacauguauuuuucuuucuuccauggacuccuaaacugcucccacaaucagcaguguucuucucucagaaauuaucuuaagcuucucuacucaaugggagguacacacagagaccugagaauaugcagaggccagaaucucugucugugcuagagaucaacuguacucugcccaccuggggaacacauccucuggguaaaguacucggaaguaaauuacauucaccuggagacagauacgggcuuucacugacagccuguuuagaaaacacaaugucuguaaguuaccucauaggucaaagaguuuuguauuauauuuuucauaaugggcuauggccuuuuuacccuguuuuaauacagagcaacugcagaaggacaugaauuaaagcagacugcaaaaaagaauaaucaguuuugguaucgccuauaacaaagauuuucaauacaaccuaaugguuccugaaaaaaaauucuaccacacagaacaacauuuggaauuacagaguucugcugacuaaaaaauaaauacauuuacuuuugguaaggucauuucagaacuggguuuugaggugguuccaauaaguagguugggaaacgaauagcagacaagaaggguucaccauaaugaauaauuuuuauaagacuauacuauuaaagugguguauucccaaaauaacuuuaauuuuuagacaucacuauucuacaacccgaagguucugccaucuaaguaagauguuuuacaucacucaucacuaucauccuguuauuucauuuucauuuuuucuucauuaaaaaaaauuucccauauaaaaauaagguggcaaaacacucuuguucccaucuuucuaacagcaccuaaacucugugugagccacuauguucccuacuucaaaucaaagaccugaguucuaaaauucucaauagcugaccaguaguuugacaaucuggggacucaaguucagauucucgagggguugaacauuagacauccauuagaguguaccaaaucccccaagaguguaucccaaugacacgugcauaugagcauggggccucugagaagaugaagacacauaauuauuauggacaggucaucugauuuugacuauugcuuugaacaaaaaucuucccaaaaauacacacgaaaauauauuuauauuuaacccucucuuuaacauaguuucugaugaaacaaauuaaaaauggcccuacuuuauuuuuaauuguaaaaguguuccaaaaauucaaagcacauuccccauuggguaaaaucaagcaaugccaacauuuugugggaauaaauaggaauuaauuuuccuaagcaaaucuuccaauggaaaaagugacagaaguaugaagaaacugcauuuugcuaggguuauguggaaugugcaaagaguauagguuuucuguaagcuuaagaauuucucaaugaagugucuuucuuauguuaguauugagcccaguauucugaaaccacauaaagugaauaugcaguuuucagaagaguacacuguucaacauucaagaggcgagcucucaacucaccuccaacauucuagagaaccaucccucuccuccagcauaggagaaggaacaagucuaaccugagugcuccauccaucuguucucauuggccucaguccguuucagagucaucugccauaacuuaaggucacguggaugcaagcagugucagccuugggcccccgcuccccgcccuuaggaagcugucugccaauuccuccacaugcuagggaaagacgccaaucccuaaauuucccugggaaauaccuagcagguaucauauuugucaagggguaauucucuuuuucugaucuagggagaaguagucuagguccucacgccuuccccauuuucauccc

SEQ ID NO: 15815 - RNA, 15037 nt, Homo sapiens
cucaauucuuuaacuuugccucaguccaaagagagcauuuauaaagucaagugugugaaaaccauaguugucuaaugcggaguuuuaaaagaccugucuuuuugagagaaacaaugugcguucacauuuagguuccggaagaucucaaagaguuccagaccacagauauuccggugcaucacuguaacuuccgggcuguucucggcugccuuuguagcgcuucuguucucgguagcuacgcagggccagcaccacgcuggcgccguacaugaucacgagaagacaagcaaagguggcugcugcuccgucggugccugccagcuggcaguccauccaggugagacccuugcgggcauagagccucucucuuguuuugcaagugucggugcuauugaucugcagagccacguggagguaaacaccaaugccugugcaguagcccacugccgcuaggaggcugaaggcggccuccgugaggagccacuucccugacaacauuguucgacucuuggcuccuuggaguaaaacacccauggugaggacccccagacccagagaaacagccacgccaccguauaucaggggcgagcggaggaucguguacugcugguccagcugccgaaccugcucuagcucagugcccucgaacggugaguaguaguuguucccaaagccaccgccgcuggaaaagcuggcacugaauccggcaaggacaaaguaggaggccacgaugcauaugagaaccaucccauucaagaccaccuccacuaucugcaccacaccuaggagaagagagauucgggcuuuaacacugacauuacucacccaggccaagccagagacauaccacaggccaccugauuuuaaggacgugguugauucaaugucaacuuuuuuuuuuuuuuuugagacggugucacucugucauccaggcuggagugcaauggugugauuggcucacugcaaccuccaccuccuggcuucaagcgauucuccugccucagccuccugaguagcuggaacuacaggcacgcaccacccugccuggcuaauuuuuguauuuuuaguagagacgggguuucaccauguuggccaggcuggucucaaacuccugaccucaagugauccaccugccuuggccucccaaaguccugagauuacaggcguaagccaccucacccagccucaacaucaguauauuuaauuugcuuuuuguuuuuguuuuguuuucaaucuauguuugaaaaaucaaauuaccacucugaaaacaaagacguggacauaaauauucauuguagcuuuauuuauaauagccaaauauuggaaacaaccccaguguccuucagugggugacucugguuacacaaacggguacacccauaccauggacuacccuacucagcgauaaaaagggaugaacuccuaggcugggugcaguggcucacgccuguaaucucagcacuuugggaggcugaggcgggcagaucacuugaggucaggaguuggagaccagccugaccaacauggugaaaccccaucucuacuaaaaauacaaaaauuagccggguguggcagcacgugccuguaguuccagcuacucuggaggcugaggcaggagaauugcuugaacccaggaggcagagguuucagugagccgagaucaugccacugcacuccagucugggugacaaagcgagacuccaucucaaaaaaaaaaaaaaaaaaggaaugaaauccugauacaugcaaugacuugaaugaaucucaagggaauuaugaugagugaaaaagaaccagucuuggcugggcgcaauggcucaugccuguaaucccagcacuuugggaggccgaggcgggcagaucaccugaggucaggaguucaugaccagccuggacaacguggugaaaccccagcucuacuaaaaauacaaaauuagccaggugugguggcaggcgccuguaaucccacccacuuggaaggcugaggcaugagaauuacuugaacccggaaggcagagguugcaaugagccgagauugcgccauuguauucuagccugggcgacaagagugaaacucugucucaaaaaaaaaaaaaaaaaaaaaaaaaaaagaaccagucugaaaaaguuacauaccgugugauuucauguauguaacagucucaaaaggacaaaauuauagagaagcccagauuggugaucaacaggggacaggaaugaguagggaugggggaggaaggaagaagauggaugugacuaugaagacuuagcacagggauguccagggugagggaacaguucuggauugcaucauggugcugcucacacaaaucuacacaugagauaaaacggcuuagaacuacaaacacauacauaugugugcagguaaaagggggaaaccuaaaugagcucuguagauugugacuuuccuggucuugauauuguacuaguuaugcaguauauuaucauuggagaaaacuggguuaaggauacacaggaguacucugcacuguuuuugugacuucuugcaaaucuauauuucaaaacgaaaaguuucuaaaaaauugaaaugacauaagauauaaacugagaaauuucacucauaccgucucuucaauguugccaaccgcuuucauugguuucaauauaauuguccaguguuccuuuaugcaaauaaaaagcacauuuaaaucugcauuucauucccuucccugcauuuuuccacaaaaguaaguguaccauguacacuguucugcaucuugauuuuuucauuuacuguaucuuccagauguuuucagaucaguuccuacaagaggagccacauuuuguuaaguggccuucgacuucauuguauggauggauuugucuauucaaccaggaccuuacugauagauauuuggacugaaaggaacccacaaauggcacgaggcagaggaagccaacaggccaacagacugaagaucuucuuguccgaggucagcuuuuauuuguuacugacagaggccccaaauccuucuuagguguccuucugggagagggucuccugccauucccgugguguucagggaugagcaugaagagaaauacaaaugaaccgagagcaggaccaccagguucaaguccccgcuuuuuacugccuugucaucuuggccaagccauucaguccuucuaagccucagacaauaugacaaaugaagcuaagucugccaaucuucacccacagggauguggggaggcucaaaugaaagcaaccgugugauacugugggaaguuaacaacaacaacaaaaaagcaaguaugugaaaauacucuaaaaauaaaauaauguacaaauggauagugacgcuacucaguaauguuuccaaaauggaaggggauuggugagaaacauaauaaagaaugggauaaauuuaagaagagugugguuucccagaaaucaggacaacccucuaacacacuaggggguaccaugauguuuauaaucagggcagugaaagacucuaaaguacuuaggcaacagcuacucagcuugcuaauccuaucuccugcugggcccacacaaauuccuagcgguccacagggacauaguaguugagggcucugauaguugagaaguuacauuccucuaauuuaaaacugaaaauaacgucagacuaaaacugcccacucaucacuccggcacaguaagcugcugguuuacacucucccuacagcagagcaagugaauugacccagacaucauuuuaauucauggggguuaguggacccuacaccuuucucucccuugguuuuccuucuucauggacguuaauauuucgcccccugaaggaaaacagaaauacuauacugaaaauacugaaauuccucugggacggauucaaaacccaggcagcaucuaucuguuaggcuacaauggaauaaaucuagaucuugucaaucaccuguugacugcgccaacugacaggaauaauggucuucugcuggguccaaugauauucggacuguugaaggaauauggccagggaauauuaucccagguuccagccaggguuggccuggcuuagcuaucaauaucaaggcaggcucaaguauuuccaagcaugcuuuuagugcagaaagacacauggggcaggggaaggggaaaaggguggcgagcagagcuagcaguuuaucucuauggugggaugggacacgucuccggaaagacagcagaggguuugguagagggaagcagagauccugaaacgacaugagaucuuuguuguaaauaacgucuuucugggucuggcgugguggcucacgccuauaaucccagcacuuugggaggcugagguggguggaucacuugagcccaggaguucgagaugagccugggcaacauggugaaaccccaucucuacuaaaaauaaacaaauuagccaggcacaguggcacgggccuguaguuccagugacucgggaggcuaaggugggaggacagcuuaagccugggaggcagagguugcaguaagcugagaucccaccacugcacuccagccugggugacagagccagauccugucucaaaaauaagaaauaaaaaaauaaaaaaagucuuucugggugaggcuguuuuuguggcugaucauuuaauaaucugcuuaacuauauauccauaccugccuuugaacuuuaaaugugguccugaaaaaaacugaggagagcaagucaacuuuuuuacuuuuuauuuuucuaaaauuaauacaugugcagucaagccauguauaaaugaaaaguccccuucucuucaaaagcaaaacuuaauacuuucugauguuauucuucaagaaauuuuccaaucauauacaagcauguauauauauauuuccuuuucuaaacucaaauggaacucaccuuuuaaaugugaaaaauugucuguauuuaagagaauauuauaaauguauuguaaagaggacaucaacuccaaauuaaaauucuuuggauuuuuuauuggauucacauaaagcaaagaacuuacucacuuggaccgagaauauauuguaauguuccauaagucauaacuuaaggaccgagaauauauugcaauguuccauaagucauaauuuaaugugcaguaagaacccaugaaguugucugaccaaaaguaacacucuucuguugggaaagauuuuacauccuuuuauucuggaugaauccugaauucuagauguuggguuuaaugcuucacacaauggcacauuuacaagagguacaaaacacuuauugagcuuucagggccacuguaaggggcuugcagaauagccucuuugcaacccagagaauuaaucugauuccucuuuccucagcccacgccuaccuccaacuucaauuuuacaggaguaguuucccaagaguccccacccccuccauuugcagaauuaaggaaguggaaggacuggagaguucaguguggaaaaacguguggaguaaucugcuugagacaacuguguuuuagaaaaauucaggcugaaguguggucucaugucuauguggcucuccaugaacuuuuuuuuuuuuugguauuuuggcaauacggucuuggucuguugcucaggcuagaguguagugggacaaucauagcgcacugcaaacuugaacuccuggguucaagcaauccuccuaccucagccucccaaagcucugggauuacaggugugagccacugugcccaggaacuuugaagguaagguucaucaaauucucuuggugaccucccuuuacugaaugaagaggugcacucuguuguaguacaugcuuuuuccuuguggcucuugggguccaguuuuuuugcuuuuuuuuuuuuuugagauggagucucgcucugucaccugggcuggagugcaguggcgggaucucggcucacugcaaucuccgccucccagauucaagcgauucuccugccucagccucccaaguagcugggauuacaggcgcccgccaccacgccuggcuaauuuuuuuguauuuuaguagagacgggggcucaccauguuggccaagcuggucucgagcuccugaccucaagugauccacccaccucagccucccaaagugcugggguuacaggugugagccgccgaggccggccauuuuuuugcuuuuugaaaaauaauuuugauuggucccucacucacagaggacuccagaagccagggucuguugcauccaugaacaccgcuccaugcgacugggagcuccgcccaccacaccaacgcuggcucgcugcuuuuccagcacuggaaacuuccacaacaagggauucuugggaaaggcaguggcucagacuaccuuccaccaccacuugcaucugucagagcguuuuagaaacccuuaaaauucaaacauuucugcuggcuucucuuuuagcuuccuaacuuuucgguagcccuuuauggccaggacagcccccagggcaaagaccacaaugcccagggcagcaaagauuccagcuccuauaucugcuccguggaaacugcagccgaaaccgcuguagccuuugcuuugguacagcgccugccucucuuuacacacaggagagccauaggcagcagagagguaguggaaguagaaguacaaggccgggauguacccccccgcgaugagcauguccaacaagccuucggucaccagcaacaguggacaaugccacgggacccgcaggacacccauggcaacgaagaggcagcagagggcugugagggcuccacuacaggccauugccacagugaccaugggcagcuuuagcugguagaacuggacauccaguugcugggccuucuccccgucagcaccaucaaagccacuguaagccccuccgaacugauaguaguaaaugccccccaagcuggugaugcccguguagcccccuguggaacuguaagacacagagcugcaggccaggaucagcaaguucaggagaaccuccagcauuuggcagcaggcugcaaaaaaaggguguuaccauuuuugagugaugcuguuuggcaccaggagacucuuccaccugaggcccaccuuccgcgcagggcucagaccccugaaggcuucuggcccuguggaagacccgaggccaaagcagcgcgauuaaaacuagggggcaguagggaacuguggucuccagaaauggugccagaaauacuauggacucagaggggugacucucaaaagagcaaagcggugugcccugagagagcggcaggaggaugaugggagagaucaggccagugagcaggaacaaagccauccuggauggaagggcaagaacauuccaccucccaccaccagaaagaugaaacaaggccgggcgagguggcucacgccuguaaucccagcacauugggaagccaaggugggagggcugcuugagcccaggaguuugagacuaaccugggcaacauagugauaccccaucucuaauuuaaaaaaaaaaaaaaaaaaaagacuggguaugguggcucacgccuguaaucccagcacuuugggaggccaaggcagguggaucauuugaggucaggaguuugagaccagccuggccaacauggugguacccugucuuuacuaaaaaauacaaaaauuagccaggcauggugguaagcaccuguagucccagcuacuugggaggcugagguaggagaaucacuugaacccgagagguggagguuacagugaacugagaucgcgccacugcauucuagccugggcgacacuccgucucaaaaaacaaaagcaaacacaaacaacaacacaaaaaacuaaacaaguugucucuucuuuuuugagacaaggucucugucaccuaggcuggaguacaguggcacaaucacagcucacuauagccuugaccucccaggcucaagcaaucauccugccucagccucccacauagcugggacuacaaaugcaugaaccugggccuggcuaauuuuuguauuuucucgugauaaaggucuugcuguguugccuaggcuggucucaaauuccuugcuucaggcgauccuccugccuuggccucccaaagugcugggauuacaggcgugagccacugcacuggucguuaucuccucuuuauauauguucuguggugaauacaauuuguaaggggagaguucuccaaguuugaagaaaaucacagagcuuaaacaauauaauaauucagaaaaaaagcguggaaguuauacaucaaaauguuaacugugguucguguauuagaaauaagaaaaauuggccaggcgcgguggcucacgccuguaaucccagcauuuugggaggccgaggcaggcagaucaccugcggucacgaguucuagaccagccuggccaacauggugaaacccugucucuacuaaaaauacaaaaauuagccaggugugguggugcaugccuguaaucucagcuccucaggaggcugagguggaagaaucgcuugaacccaggaggcggaguuugcagugagcugagauugcaccacuguaccccagccugggugacagagugaggcucugccucaaaaaaaagauaaauaaauaaauaaaaaauaaaaaaaaaaagaaauaggaaaaauuaaguuaauuaaacccuuaaugcuuacugaauuaaaaaguuguuuuauuguucuuagacuuuaacuuauaaguaugucuuaaaguuuaaugcuguuuuauuuaguucccuaaagaguguaucugggcugugauauuuucccagagcuggauucuucccggucccuuggcuucuuuaucuuggacaaagaaaacuggcugcuuuccuuaaaaucaacguuagugaaauauaacuuauaugcaacaaaaugacccacauuaagcuuacagcuugaugcguuuugacaaauuuauguaccauguaaccauaaucaagacacagaacauucucauuagccuagaaauuuccuuagugacgcuuugcagucaaucccucacuuuccuugucagcaaaccacugaucagcccucucucauuagaaacuaguucugccuuguguuguaugaaaggaaagaagguuagaaacuaguucugccuuuucuagaauaucauguuaauggaauaauacgguuauguccuuuugugugugugguuucuuuugcucaacaucauauaagcugggugcugcugagcuggaaauuguacaugcugccaacgucggccugucaacauccugccugauguuugauaaccagauuuaaugccugguuccaguuggucuauucaugaaaccacagcuacacauugucuaaaugaaaugaugaugcucucucaagugcgaucuuuacacuguauaauuuucccccagaaugcaaacaacauuauuguuuucuuucuuuuuuuuacagacagggucucacucugucaccauuuuauuuaugaaaguuauauggccaggcgugguggcucaugccuguaauccuagcacuuugggaggccaaggcgggcagaucacgaggucaggaguucaagaccggccuggccaacaugguaaaacccugucucuacuaaaaauacaacaauuagcugggcaugguggcacgcgcuaccucccagccacucgggaggcugaggcaggagaauugcuucaacuggcacccgggaggcagagguugcagugagccgagaucaugccacugcacuccagccugggcuacagagcaagacucucaaaaaaaaaaagacaguuauacuuacuuauaacaacaacaaaaaaagaaaauguagaguuaagaaaacaugcaauguaacaauugccuguaauacaaccaauuuaaaaaaaucacugugaauauuauauuuuuuccugaacuuuauuuguaucuucauaacuuuuguuuuuuucucucauuaagaacacaguccucuggauaucuuacuguacuucucugaagcucaggagcugcugacagaauuacaggcugugagguugugccaauaucugcaacuagaguaaugauccuuguaccugcauugccuagagcacuuuccucaaaguuccuauaauccuauaaucauaugcaucuuuggaauuauccugagauuacauuuucagguaugagcuccauaaguucucucccuuaggcuggaacguuuucucccuuagucauaguaaaccaagaacuauuucucaccaaaucaugugaacuauaagcucucacccagacaaaccagauuuucuucauugcuggcaaggccaagaccgcuagaaugggaaccuggggacgccacauuugggguggauacaugauaggcuggaaguguuuuucagacuguggguccuaaauaacuaugguuuuuaaaaaaugauuuuguucuuaaugaacgggauagaaaauaucagaauauuugguauauaauagggucaguaugguuucacaacauuuuuguuucugugugugugugaacucggucuuaauguaaaaaauguauauacguaacaaccuugugaauauauuauguguguguauauauauauauacauauauuuuauuauuuuuguuuuuuuuuuuaagacguaguuucgcucuuguugcccaggcuagagugcaauggcgaaaucuuggcucacugcaaccuccgccucccggguucaagcgauucuccugccuuagccuccuaaguagcugggauuacaggcaugagccaccaccccggcuaauuuuauauuuuuaguagagacaggguuucuccauguuagucaggcuggucuugaacucccgaccucaggugauccacccaccuuggccucccaaagugcugggauuacaggcgugagccaucgugccuggccuuauuauuuuaaaaauuuuuuaaauuuuuaauauuuuugagauggagucuuacucugucacccaggcuggagugcagugacgugaucucugcucacugcaaccuccuccucccagguucaagcaauucuccuccucaccacguuggccaggcuggucucgaaccccugaccucaagugauccacccaccuugaccucccagagugcugggauuacaggcguaagccacuacgccagccuuuuucccuuuuuuuuuuuuuuuuaaacuagagaugggguauugcuauguugcccaaguuggucucaaacuccugggcucaagugauccucccuccugggccuuccaaagugcugagauuacaggcaugagccacugugccuggccucagucaauaaaguuuaaaagccauugaucaaauguugggcgucagaucuucaaggagaacaggugcugcaacuuggcugcccacgccaggugacuuucccucucuguuaauucagcugccucgccagaagaucccuccucugacagcuggcagcucauagccaguuccaccuacaggccucugcacuuccaccuggagucugaaagcugcaaacauggcugcuugccuuugcaaacccagggcauguuuaaggagaagcacaggaaaucuagcagcacuuuugagacguuccuccuuuuuuuuuuuuuuuuuuuuuaagaaaacaagaaccucacaaguacagaaaugaaaaugcuaggaacccacaagggaaucugcuuaaauuuuugcuucaccagcucagaccaucccuuccagaaccaccagugacaguaaaugaucaaacagccugcaaaacggcucaccucucccagugcacaaguauuugcauuuguggcauuccaggaguccuuccgccucugacugguaauauuccaccuccucucguccaggccugggggucgagggcagauaucucuccgaaggggguucacuauaaccaaaaagcauacauggucauuagggggugucucauucaauagcguucaggauuagaacucuugacuccucgugcugggcccaaauauuagcagaacagaaauagaauuugucccgguauuuuaaacuccagagaauucucugguuuaguggccccacgggacauccaaauacuuggcccagcuccacuaaccacgugacagaugcugugauugguaccgcugaugguuugucugccccugggagcugucucaccagguagcugcgagcugccuuccugugagugcaaguucucaguucagcaugcaccaggccucuucaaaaccaguuugcauucacaugacucugaugcccaggcaggcauucucuuccucccuuuguuacuuuggaaaguguugagucagcaauaacucuccaggagcaugggagcugcagaccacggauuuugacaucaucacaucauuuccuccucuggcagcccuagcauuuucugucccuucucuccuugcuuuaugcagcacauccugggcuuuguccaagauucaacagggggcugcauucuacuugccaggcucccacagucuuucuagaacaucaugucucucuuagguuugaaauuuuucaaacuuuuagcaugcacaggaggccccuguucaucucucuacacucacaaccucaugcucgcagacccagccauacugaacuacccccuuccccucaaaagaugacugcuuuuccaugccucuggguuacuacagaagcuauucuucuccuugggacaccuuuccucuuccuccucagucuuccuuuuuuuuuuuuuguuuugagauggagucucacucugucacccaggcuggagugcagugucgagaucucagcucacugcaaccuccgccucccagguucaagcaguccucccaccucagccucccgaguagcugagauuacaggcgugcgccaccgcgcucugcuaauuuuuuuguauguuuaguagagaugggguuucgcaguguuggccaggcuggucucgaacuccuuaccuccaaugaucugcccgcuucggccucccaaaguucugggauuacaggugugagccaccgcguccggcucggacagugguuuuuaaagaaaccuaaaaaugcagcucugaauucucccagguccugcaguugcaagugcaaugggcuuuagucagggaaacaacagcuguuucccugggcgaagcuuugacuguaucugggcgcacccuuuguuaugcuaguuaguuuuagauaauguaacauaaacucaggauaggagcucucccgcuguguggacauagcagggagacagacuggacucagccuccaagucccugggagaggggagccugacuccucccuagaggagaggccaggugucaaaaaccagaagcagucgucaccucggaccugucuccuguuggagcuggcaggggagauaucccaucugcucacaguucaccguguggggcacauuaucuggguauucaauggauggaaaaaacaccaggucccuaggaggcgguguggggaccagguccccucuugucuucccuuccccccccacccuccccuagcucacagagucuuccaguacacccugaaccuuucuccuuacaaggggccuaugggaauucugugcaaggcagagauggcaaaguuuuuucauuaggagggugcggucucaagcagccgugggauucgaaugacgcugccuagagagaccucacuggcaaaagggaaaacaaaccuguacccuucagugggagaauuuuacguagacuuuguucuuugguuaaaaauguagcgucucccaucugacuuuuuuuuuuuuuuuugagacggagucucgcuuugucgcccaggcuggagugcaguggugcgaucucggcucacugcaaccuccgccucccggguucaagcgauucucccuccucagccucccaaguagcugggauuacaggcaucugccaucacgccuggcuaaguuuuuguauuuuuaguaaagacgggguuucaccauguuggccaggcuggucucgaacuccuggccucaggugauccgcccgccucggccucccaaaguguugggauuacaggcaugagccaccgcgccggcccaccuguuucugaaggcaccuauuccugggagggguaacacauuaaacuauuaacucuucaucgggcuucccaagugggcggcccggccacaaggaaggggacuuuggagucgggaagggcuggcucuggaacacgggacaagggucugaaccccaaggcgcaguccugugaccaugcgggccgggccggggaggagccuggggugaaccccacccgccuggucuccucccaccccucccucucgggucccggggccucucuuucucuucuccagguccuccagcccagccacugcucacaggggugguuuuugcuuuguuaguuggguucaggccacgagaagggggaacccuaaaguuuuccuucccugccaggucgccucugagagcgcagaagggagaaacggcauuuguucauuuaaacgggcuccuaggacgagaacccggggacgccagggccucgcgggccggccugggccacagguguccccggcgcggaggucgcagcgccccggccccucucaccuuucgggucugcggcgcccggggucucccuuccucugcggcugcggcggcuccggggcuucccagggcgcgggcccaggaggcgcggcugcgucccaggucaguccccgggcuccgucccgcguccggcuuuggcgcgguuuuucccaaacuccguguucaccugcgcgagggcccgcgucccugugugugucccggcgggggccucgguccgggucucuuucccucucucucucccucucccggucccgguuccggucgcgguucccgucccucuccuggucucucuccgggucccgguccccgucccuucgccgguucccgucgcugcuucgcuuccugcgcggguccccgggucggucccgcggucgaucgugggugcggccuuggucugggugggggcgccgucccgggucccgcucucucggccgggcccggggcucgcgagcccccgacggaucuuccauggccggguuccguguccccgcccgggagcgaccugagggcaacaaccaacaaguuucuugggcagguggccaagcccgggggcggggcgggcacu

SEQ ID NO: 15816 - RNA, 15897 nt, Homo sapiens
caguccgcuacggaggugagugcagggcuccgggcgcugugugccgugcccugucccccaggcucuggguccgguugagacgcacucccacccugggugcugcagggucucccguggccuacgcugccaggaggcccaggcugggagagggagcagggcggcggcccggggugcucuuccgcgcuccucgacuccagcuuuggucuuuguggcucaauagcuugcgcccauuggaaggggaaacgcacguugcugucccagccacgaggcccugagcauuuagcacuuggucgacgggggaagaugugucggugcagcuaaaagauggaauauuugcgggcgugaagcggcccgaggugauaccacaagucuuuugacaugcugaggucuggcaggaacauuaaccuaugugcaucccgaguauggaccgugugcucccaggcuccugacauagggucaugaauuagggccgagugggagcgcagagccccucccagucacccggcagcagaagcagcccggcuuuuggaggacauugucuccuggagcagugucagucccaaaagguaacucagcccugcuucucucggcucaggguugacagugaccugggaaugacuucuacaacguaauuacgaauucacucaguuuuagaauauauuuaguagucucagaaucgcuaauucauacccccaugaaaagcaaauuuacuaccuaaaguacaguacuuggauacaggucuuuuugucuuuacucuuaugguauuuagucaaaauacuguuuuccaaaguugcuuaccccuuuucuuuccuaccacuuaagugugguuauguucacuguaguauaguuaagcacauuggcuguucuuuguauuacauuuuggguccucaauuucaccccauccuugcugguuuauauauuuauuuaaaauauauauuuauauguuacauauauaguaguaaacauccaugaacacaccacccaauuaagaaagagaagauugccaguacugcugaauuuaucaauguguuccuccuccucaacccaacucccagccuccaaccccuagagguaacaguuauauugacuuuuguguuaauuguagcccuguuauuuuaaaaaauaauuacauaugcauguaucuguaagcaauguacuuaaauuuuuuuuuugagcuucauauaaauggcaccauuguguguauaagucaucugggacucgcauaauucaauguuaaguuuccaaauucauucuguguguagcuucuggguaauguuccauuguaaaaacuguaugaaaauuuaucgauguauuuucaauggacauguggguuguuuucaguguuuuguuauuaaaaugugcugauaauauuuuuguacguacuuccuacauaugagaguuucucuaguguguaaguuuuuaaaauuaggcacaaauguugaauuauguuaaacaucuuuggcaucuguugagauggacaguguguuuaucuuucuuugauuuauuaaugugaaaaauauacuaauuaguaucuucgugggauaauccuacuuacucaugauguauuuaaugaacuauuggagucuauuccuugauagaauuuuugcauuagaauucauaaaugagacuggucuguaguuuuugcaucaguauugugcuggcaccauaaaaagaauugggaaacuuacuuugcugugcucugcuacgguuuacauaguguuagaauuacucauuuccgaaacauugaaagaauuugcucaugacacaucugagcucaguguuuugugagaguuaguucuucacuggccaucuugguuuaauuagguaaaaguaaucaaggauuauguagaaaaucuauauaaugucauaacaggaaaaaaccuggaaucguauuuaaaaaaaaaaacuauccccuugggagggagccaagagaccaaagaaugccuuggacgaguccagcuuggcaaguagaugaguuuauuaggacuuacauacuuacuccuggauggcagcaggacagcuuuagagaccugugaugccccucgucucuaaguacuuuuuagagaauuuucuggcuguuugccuacugcauuuaaacgaugagacuuuucuugguagguucucauauacuuucuaggauguuuacguucuugcaaacaccugcuccucugcugagccccauggucuugacucacugcccggucuucaagguucaggcagcagguauacacccuugacuagcugagcgggguagcuaucacacuacauauguaauugguagaguugguuuauuaucuaaaaauggaguuguauauucucccaucacagaauaaguuuucucuuuaaacaccagauaauauauuuuuuuaaauggacaugagucacaaaaaaacccugaaaaauguguaaaguagaaguuaguagauuggguuauauaaccaucaugcaauaaagccagaacuuauaaacagaagaaauuagcaacaguaaacuauccuaagcaauuacuaggucagagacaaaacagaauugcugacugacuauaaaacaguaauuaaaacaugaaauauaaaaaccucuggaauguggcaaauaguguaucccaaggaaaauuuguggccuuauaggcuuuaauugccaaauaggaagaaugaaaauaaaugaauaagucaugcaaccucaagaaggugggaaaaaagccuuuuguagucuaagcuuccccaaaagcagaacguggaacaaagauuuguauguaggaauuuauuuaggaauauggucacaggggcagagugaaagacaaggggagugaaacagagaugggagaacugguacaaggaugcauugguaugcucggcccucaacaggcucugccuugcagggcguuugaggagccuuggagucuuaaggcugccccgcugggggaucgacggggaaaacauuuauccauugguuucucuccccuauuggucaagggggucccacagguguuaaugccucugcacuucagggcccagcagguguccacaggugucccacauaggacaccagagaagccccagggcaggaaccaggcauaggugauguagguccuugugaagguucugguagcuugcagcuucacaaagcugacuaaccucuguagaacuggacugaggaugggauaagaggauuggaguggugcuuacacugccccuuacagagcugaaggaacaaacuaagagcagaauuagugaauuuaaaacaaauagaagaaaguaguguugcucaacuagaaaagcugguucuuugaaaauaaaaggaaaccacauuaaaauaaguaaaacacugcucagccuaacuguauuagucugcuugggcugccauaacaaaauaccauagacuggguggcuucaccaacauacuuauuucucacaguccuggagacuggaaguccaggaucaaggugccagcugauuuuggcuccugccaggguugccuuccuggcuuauagauaguagcccucucguuguguccucacaugggggaggcggggagugagugguuucgugggcucugggucucuccuucuucuuguaaaggcaucaccccuauuggaccucauuuaaccuuaggaccuuuagucccacccuuaggaccucauuuauccuuguaaccuccugacaggccccgucuccauauacagucacauuggaggcuagagcuucaacauaugaauuuggcaggggcauaaauguuuagucucuaacucuaacccugggaaaaaggucuagaaagcacauauauucaaaagaagaagugggaaaagcaaacuagcucuggauauggaggaaauggaaagaaucaugaaccaguauuuucugcaacucuguacuaguaaaguugaaauccuggaagaaauggaugauauuuuaggaaaauguaauuucaagacugacuuuaggggcaguaaaagucagaaaaucacuaguccauauguuuuugaauacagugaacaagaggcucugggucacgggacuggcugcuacagugaucuccucucucaggagcugacgcagaaguguaggccuuggcucauucacuaucagaagacuggaaaguuugggaaacagccugguuccuaacuuccagcucagcuuccuaaggacagccugugcuguccuuaggaggacugaccucucaagaccucuccagagguguuaggauucuugaggacauucagagcucugaggaaguggggcaggauacuggggggcagcugccuucuccaggcgcugccucccuggggucugacuccccaggcuuguguacuggggcugcagcccagccaguccagcuucuccugcugugauacugaagauaaugcuuguguugagaaagagaaauaagucaaagaucuugguauuguccuauuucuugaaaugaauuguggauacaugacucuuugcuuuauuuuuuaggcucugcauacauuuuauuuuauuuuuauuuuuuauuuuuuugagauagcgucucacucucaucacccaggcuggagugcaguggugugauacuggcucacugcagccuugaccucccgggcucaagugauccuccuaccucagacucccgaauagcugggaccacaggcaugugucaccaccucuggcuaauuuuuuuuuuuuugagacggagucuugcucuguugcccaggcuggagugcaguggcgcaaucuuggcucacugcaagcucugccucccggguucacaccauucuccugccucugccacccgaguagcugggacuacaggcgcccgccagcacgcccggcuaauuuuuauauuuuuaguagagacgggguuucaccguguuagccaggauggucuugaucuccugaccuugugauccacccgcccuggccucccaaagugcugggauuacaggcuugagccaccgcgcccagccuaauuuuuguauuuuuuauagagacaggguuuugccauguguccaggcuggucucgaacuccugagcucaagugauccacccgccuuggccucucaaacuguugggauuauaggcacgagccaccgugcccagcagguuuuauaugcacucuucuucuucuuuuuauuuuuaauuuuuauuuguuuauuuuuaaauuuuauauauauacucuucagugugugugauauguaucagaauuguaaaguccuaggguuccuggcagugaauuucagugucauagccuggaguccuaggcacugagccagugaacagaucauucccuucuugggcagcuccuguucgcacuccuauuuggaugcaagcugccugugucuugcauuuucugugaggggcuauguugcucugguugggguggcuugccucacacuugucucucuuuguguuucuccuuagcuccagcccuucucugagacggggaccaggggauggcagccaugcaccugacagccuggccccaggugagcugugggguccuucagcucuuccucugggcaguuucagauugaaaaacauugagaaggggagcuggugagccucgggaugacagcugcuuccaccugcuggacuggaacuugugggaaagagguguugugcagggagggcggcagagaccaggacaguagcgaguggaggaagcgggagagugagcaggagagcaggagggugguggucuucugcacacugagggucucugcuccucucuacaggagcacccccagcauagggcucugggugaauggggacguggaaaccgccccugugggauguacugugcaggggugucaguggagcacagucgcagaggauuggacuaucugugguggggauguagagaagaggaauagcaggaccugaucagagaaggauggccgugccucuaauucagggguaagggaaggucacagggaguggagucaagggagggggaagacagucacaugggacggaaugucucauugugcuugugaagcuuucaaaguuuaggaugcagacuuuaggucucugagaagagcuuuccacccuguccugcaggaaagagguguugugcggggaaccugcagaacauaaaccugcaaaccaaauuuuccauacauuuucagggacuucacggauccccugaagcucauccauggacuuccauggacuacagguugggaacaguccacagucacaccaguuguaucuuuggaggcuuacuaugcuccaggagccauacuaagcccuuuguauggucguuugguccugacaaccgccucugugauaagugcuguguuguacucuuuccaccuaaaaagaaaaggcaaaaggggaguagaguaacuugcccaggaucacagaguuauugugugauucagaacugcuuagccauaagacagcuguggaaccagugauguuaacuuggucagauuugugauguguauggaauaauuuguaaggaagauucaaaagcacggugaccacuucacaaagaagaaucccacuggucccgugacaugggcuucaucaaggaaagccaucauuaaagagggauccaauucaaguaaugcuuaagauagaaaaaucauggccgggugugguggcucacaccuguaaucccagcacuuugcgaggcugaggugguuggaucacuugaggucaggaguucaagaucagcccagccaacauggugaaacccugucucugcuaaaaauagaaaaauuagcuggguuuuauggugcaugccuauagucccagcuacucaggaggcugaggcaggagaauugcuugagcccgggaggcagagggugcagugagccgaggucaugccacugcgcuucagccugggugacagagcgagacuccaacucaaagaaaaaaaaaaaucuuucggacauagagacucaaaggauuuguggugauaaggaaggugggaagucaagaacaauccccagguuucuggcugagguuucuugugagggugauucugaccccagcugaaguguaaguucagaaggaagugccaacuuaccaggguggugguggcggcacacagugaagacauuauauuuugugcagagaaguuacuuguugaaggucacacaaagaaggcucacagaaacaccuaaagguuggacuagaauugcugauggguggaggucaguaaauuccaggaagacacauccuagcagagaggaguugagcagcagaucccugccagugagcccccaugguuguuagagcaggcugaggugggcagaggguaagccucccagaggcugcagcugcccaggaggggugguugggccugggagugacacgaagcgucccugagugguggagcuugugccaaccacauagcuuagugaugcaaaggggagaguagccggccagugggaaggccggucucccugcuuucccaaauguucuuggagaaacagugaagcuuucggagaaguuggaaaggaugagacuugaaugggagaggguaaggaaaauucuggcuuuccaggaagacccugcagccugggcagcauggagcauccuuggcuggaggugcucaagcagaggcugcacagccccuuguuggggggucugugaagggaaucugguggggcuggaugagacagaagccguggaugaucuuuggggguggcuugagcugugaggaugagggcgaugggugggcagcagaacagggcugagguuaggcgcaggggaguggugugggaccugcugguggaucagccccgaguuugcugggagggagcagcuuaucuaaaagaguggaguuggcuuuagagaauuugcuuauggaaauuuuuuucuuucagccugucuuaaugugaccucuuauuugugugaaaaauggcaugagguuucccugcugugggagaauguggauacuuuguaguuuacuuucucgauauuuuuuuucugagaucuuccccuuguuguuaauacuaauuuugugcucucacaagcacccuccccaagcccuuauacugcgcucugccccucacuuagggccugagcuauggaauuggcccuagggcagcaggaaccuauuguuucagaagucggugaccuuugaggacguggcuguguacuucacccaggcggaaugggauggccuguccccugcacagaggacccuguacagggaugugaugcuggagaauuaugggaauguggccucccuggguaagaccucucuacccugggaaccuggaaucugccaauugggguuccuggcuugcuucucccuuacagguuacugaggggaucucugguaauccuuuacugagugagaaccccagagcuguuccuaaucuagacuuagagguuacuggcaggggcaaaugccaagccuuuuguaggccuauauaggacuuugcuuggaacugguaugcacuguugauccaacccaugaaagcuauguuuuggaaacacuggaauccaguugcuuccuguuccacaguggcaucuucaguugcccccucaucuuaccugucuugagucuuuucaaggaucucaguguacucuggauuauuucaggccaaggucaaaaagugguaucccuuugggcagaaucucccugcuugcccugcaugaggucuccuaggccuacagucugggcccuaaccaggcucucccacacguucccaagccuucacccccaacccccacauuugccucccaaagcccuuggaagucuccaaggucucuuuaguccuuccuaagccccacaguacuuucccguaguccugaggcuugggaccuccugggguucuuaccuucccuccccauugcugagacagucugagaagaggcuuaggaauuugucugugggaguuuauucaucugucucuccuauuuaccucucccaaaccaggauuuccacuucucaaaccugcugugaucucacaacuggagggaggaagugagcuggggggcucaucuccacuggcugcaggaacaggccuccagggccuccagacugguaagggagguacauauuucccacucuguuggaauuuagcacuuuaggcauaaagccagcuuuagcaacauauaaacauacuguguuuauuggccagucauacagagugaaguuugaguaaauuuugaugauucauagagauagguaguccuuaucuuucugucuucaaaguuuguugugucuaauuccaagaacagaucuuuuuucaaacccuucauucugacucuucaaugcuaauuuuggaauccugccuuucucagacaaaauuaagggacucaguaguuuggggguuccuugccauuucuaagcauuauucacauaguguggaggauacagaauuaacagccuuuucacacagauagaagugcuuaaaagcacagucuuuagaggagacuuuucugagguccagucccaacugugcugcuuccuaauuugcgugacuuugaguagguuauuugaguguucucaucucugaaaauggguuaauaauaaaaggagguaauaguacuaucuuguggguugagguuuaaaugagauaacacauaucaaauaccuagcuuauaaugugugcucaguucaguauuuuuauuuugguuuuggggaauacagcuguacacagggaagguaauguggaagggaggaagugcucuuaauuuuugcuucuuaaaugugaauguguaaaggaauccugaggucuuacagauaugcaguaaguguggagucugcauuucuaugaaguucccuggugauguggcgaugccaguacuucugguuaccagaccacacuugaaggagcagggcuccaauuggugccagcagaguagcugccaaaugacuucucauuccccccgaggccccccguuauuucuuauauuuagggucugugagauucucuugaauuuuuucagugagucuucauuuuucuuagaugguuucuguagguuuuuauuccuuuugaucauucuaucagacgauaucugaccaaagaaggcauguuuuggaaauggaguuugccguauaauggccuugacaaauauagggaaaaaagugauauugugaggucuuaaucaaaggacccuguauuuuauucuguagacagcugacuguccugaagucuuugacuuuuccaggaaacccaucaugauccuagcuggugauagaaacauuaauguagucaguguguguggguuaauugggaugaggaaucaaacaggcucuaggcaggcagaagggagggcaaagggcaugaggcccauggcagcaguguugacuuucuuuuuaaaaaucuucagaagcccagucagugauaccuguuuaagacucauuugcuguaacugugucaaauggccauccucacugcaagagaggaaagugaaaacgagagauauuucaccuaucauauugagaauaauuaaauuauauucaauguuggugagagugcagcaaagcaggaauagacuucuggagaggaugacuagacaucugauaguauagaugucuuagucaguuugggcuacaauaacagacugccauagauuggauggcuuauaaacaacagaaauuuauuucauacaguucuaguccaagaucaagguucaggcagguucugucuggcaagggccugcuucccggcuaauagacagcugucuucucacuguauccucacaugguggcaagaaagggagcucucugggcucuuuuuuaagggcauuaaucccauucaugaggguucugccauagcucaaccuccugauacaaucacaucagggguuaggacuucagaauaugaauuuguggggaggacaaacauucagucuauagcaacagaugaguauuauuuuuuuaguugggaagagaccaguauuauuuagaaagugcuugcuggggaauccaggcaauuggaggggcuuauugagggcaauuaugaaauacuggggcagggggcauauuacaugugguugaggagugaugaaagaugaaaaaauaugaggcagcauuuugggacugagcuuuugagaaaguugggaacaaaugcagagaugaguaguucuaguucuaaagacuauugggauuauaaaaagauuuuuagggaaugaucaaguuuaggauuagaggaagaagugaaaggaaaaggcaagguuaaugcagcaguauuuggaggggaaugggaagaaaggggaugagauggaccucaaauagagccugucuaaaguagaaaugaaguugaaggacaaauuuuggaaagcccacaguuaauguucuaaggaaagaaacaaaauuauuuccauuuugcucccuggugcugcugacuguugucaucuuccaaguugccauauucuguuggauccugugccuuuuccuucuucagcauuuuccauuuuuuuuuaaguaaggaacugagugcuauaggaacaacuaagaagaaacugcaggguguagaaaagcauggugugauuaaaagaaugcugagcugguggacaagaccuagaauuuuauuccacuacugucacuuuuuuuuuuuuuugagauggagucucgcucugucgcccaaacuggagugcaguggcaagaacuuggcucaccgcaacuuccguuucccggguucgagcaauucuccugccucauccucccgaguagcuggaacuacaggcacguaccaccacacccggcuaauuuuuugugguuuaguagagacgggguuucacuguguugcccaggcugguugcaaacucccaagcucaggcaaucugccugcuucagccucccaaaguguugggauuacaggugugagcuaccgugcccagcugucacuuuuaaccuucaugugauugguuauguucucuacaguggccuuguauuaggcacagugggaauggugauuuuuuuuuuaucauuacuuucauugcuuuucauuacuuucauaauauugacaccuauucaacaguacagaaaguguauaaaguagggaagcaaguccacuaaacuuccuaugccaguuuauuuaguuucuuauggauucuucuagaaguuuucuagguauguacaaauauauauaucugucuuuuauauuuuucuuuacacagcugaaaaucuauucuauauacuguuuuuucaacuuguuuuuccauuugauuguaucuuggaugucuuuuuacgucagcauauauggauuuauuguauucuuuuacuaguuaguuacaaauuacuuaucccaccuuauggagaaacccuauguuuuuugaccuagucuggugauuuuaaggagcccccugauuauuauggucuuuuauagcacaguucucuucuuuuuccuaacaugguucuuacaugacauuuuauguuuucuguuuuuuauaguagauauucagacugacaaugauuugacaaaggaaauguaugaaggaaaagagaauguaucauuugaacuucaaagagacuuuucccaggaaacagacuuuucagaagccucucuucuagagaaacaacaggaaguccacucagcaggaaauauaaagaaggagaagagcaacaccauugauggaacagugaaagaugagacaagccccguggaggaguguuuuuuuagucaaaguucaaacucauaucagugucauaccaucacuggagagcagcccucuggguguacaggauuggggaaauccaucagcuuugauacaaaacucgugaagcaugaaauaauuaauucugaggaaagaccuuucaaaugugaagaauuaguagagcccuuuaggugugacucucaacuuauucaacaucaagagaacaacacugaggaaaagccuuaucaguguucggaguguggcaaagcuuucagcauuaaugagaaauuaauuuggcaucagagacuucacaguggggagaaacccuucaaauguguggagugugggaaaagcuucagcuacaguucccauuauaucacacaucagacaauccacaguggggagaagcccuaucaguguaagaugugugggaaggccuucaguguuaauggaagccuaaguaggcaucagagaauccauacgggagagaagcccuaucagugcaaggaauguggaaauggcuucagcuguaguucugcauauauuacacaucagagaguccacacuggagagaaaccuuacgaguguaaugacugugggaaagcguucaauguuaaugcaaaauuaauucaacaucagagaauccauacuggagagaaaccuuaugaauguaaugaauguggaaaaggcuucaggugcagcucccagcuuaggcagcaucagagcauccacacaggagaaaagcccuaucaguguaaagaguguggaaaaggcuucaauaauaauacaaaacucauucagcaucagagaauccacacaggugagaaacccuaugaaugcacugaauguggaaaagccuucagugucaaagggaaguuaauccaacaccagagaauucacacaggcgagaaacccuaugaguguaaugaaugcgggaaagccuucagauguaacucccaauuucggcagcaucugagaauucacacuggggagaagcccuaugaguguaaugaguguggaaaggccuucagcguuaaugggaaacuaaugcggcaucagagaauucacacuggggagaaaccuuuugaauguaaugagugugggagaugcuuuacuucuaaaagaaaccuacuugaucaucaccgaauccauacuggagaaaagcccuaucaauguaaggaaugugggaaagccuucaguaucaaugccaaacuaacuaggcaucagaggauacauacuggggagaaaccuuucaaauguauggaaugugagaaagcauucagcuguaguucuaacuauauugugcaccagagaauccauacaggagagaaacccuuucaguguaaggaguguggaaaagccuuccauguuaaugcccauuuaauucggcaucagagaagccacacuggggagaaacccuucagauguguggaauguggcaaaggcuucagcuuuaguucugacuacauuauacaucagacaguccacacuuggaagaaacccuauauguguagugugugugggaaagcauucagguuuagcuuccagcucagucagcaucagaguguccauagugaaggaaaauccuaauaaugagaaagauauagaaaacucuuaagguuaaugccaaaauggaucaaguaucaucagauucauccauugaaaaaccuccaagagggcaugaauauggcagagucuucauauggaaacaguuuuuauucuauucaguuuaaaucaggaaaggaugaccaguuaaagagaaacauccaaaaauagcuuuguuuuguaccaacaggaauuagaaaauauaaugaaaagauuucguucccagcagcaucaagaaaaguagauuuucuagaaauaaacaguuauggaggacuuguauggagaaauuuaagucuucacugagggccacuuuacaaaggaaauuugaauaaauggagagagagagaagccuuguuguuggauaggaaaacccguacuaaagauacucuaccuacauuaauuuauuuguuuaauuuuugacaacaagcauguauuacuuuugaaaagaugaaaaauaaagauuuauuuaaaaaaggaaaaagguaugaguacauuuuuaauuuucauguaauugagaaaaccuuucuaaguauuagaugaaagcuagaaacuauccacaggguauguacugauaaauugacuacucaaaaacuaaauauuccuguauguuuuuguuuuaaaguuuaaaagauaaagcgcaaaauggggaaauacuuuuguaaaauuugugauauaaaaguguaguauuugggcaugguggaucagaccuguaaucucagugcuuugggaggcugagacgggaagauugcgugaggccaugaguuccagaccuguaugggcaacauagcaagaucccaucgcuacaaaaaauaauaaaagccaggcguggugguaugugccugcaguccuugcugcuugggaggcugaggcaagaggaucaccugacuccaggaauucgaggcugcagugagcuaugaccaccacugcacuccagccuggguggcagugagacccugucucuuaaaacauuaauaucuaaagauaaauaauuuagacacacuaacaggcagcuuuuaaacagauacuaaaaaaugacuguuaaaguaagaagagguauucaaucucaguacucuaaggugugaaaauuaguaaguuuuuuugcauauuacauuguuauauaugcauacaugugauacuaugcagcugucaaaaaugacauuuacuauagaugcccuuuauauaaguauaaaauguagucaacaagauagcauguuacaggguuucuauuuuguaauaacuggaacucuugcauaaacacauggcuuuucagguccugaaggaagguggcuaccuuggauucccagucucauuggugguuuucaaggucucugaugaagaucuuggaagccucaagauacucuuuggaagggaaucucucaacaccuuaaaaaauucuaagcaauaggcugggcgcaguggcucacgccuguuaucccagcacuuugggaggccaaggugggcggaucaugaggucaggagauugagaccauccuggccaacauggugaaaccccgugucuuccaaaaauauaaaaauuagccaggcaugguggugcgugccuauagucccaguuacucaggaugcugaggcaggagaaucacuugaacccaggaggcggaggcugcagugagccaagaucaugccacugcacuccagccugggcgacagagugagacucugucuuaaaaaaaaaagauucuaagcacuaauaggagcaggcaagcuaacuaucaggaagcugaagaacagc

SEQ ID NO: 15817 - RNA, 2234 nt, Homo sapiens
aagaaaaaaacaggugaaaugaguuuuaauaauauaucuuauuuaacauaauauaucugaagcauuaucauuucaauaugaaaucaauuuaaaaauacuaaugagauauucuacauucuuguuuuacacuaggucuuugaaauuuggagucuacacuuacuccacauuccauuuaggaccagcuacacauucaguggucgauagccauaaaugaugagaggcaacuguaguggagcaguaguacagcaguagacuguaaguucuguaggcaaaguuggugucugucuuguucauuguuauaaacaacaguguuuggcauagaguaggcauucaauauugugaaauugaacuaaauauaauugaaagaaugaagacauuaccaagggaauccuucaauguuuccccacagcacuuacagucuaaaucauucaauucugcacgcaauuaguuggcccacauaguuuguaauuaaauuauuccacaagcauuuaagguucacaaaggaggaagcaucuucaucuuguuaucuguuguaucucccagucaaccacaguuccuaguauugugauguguagauucaugcaaucaacaaauauuuauuuaguguccacgccaggccaguuacuauuuuaggugcuggggauacuauaagggggacacagucucuguucucauggagcucacagacaauaaaaaguuacaagagcuuugaaggaaauaaauaaggugacaugagagagugugauggaggacagagcaaggaaguacggaggagaaggagacaguauugugaagagccagggaagggcaaucugagugugucuuuuugaggcagccacauugacuuuucauuuucucgaauucuccaaacucauuucugccuguaacuuucuauuccuuuuucuugugcugcccacccucucccuugcucuucuauagcugguaucuucccaugucucagcucaaacgcaacugucuccucaaagacacccucccuaaccaccugucuacugggcucaucacccuugacacuuccuaucacauccugacauuuuguuuaguaccacaaccugaaaugaucuuguuuaugcuucuaugaaauugccuugacaauugcuaucuuucaaugcugagaaaagugucccuaugacaaauauaugacccacaauuagugaucaauagauauuuauuaaaugaaugaaugacugaaggucaagaguuaaagcauuugggagaugucucaagucaugguuugaauaaauguaaaugaagucuaggaagaaccacacucuauuugucugguuucucugagaaggaagaugggguuaauggaugugggauuuauacucuugcgccgucucgggcauggggcaaccugaguuuugguuccagcuccuuugagaaucuacagcuauggaccaucugaccggguaaauggccacaaacuuuugcuuauaacuuaaggggguucguggaccuccugaagaggucaaaggaccacagguuaaaaauuccuguagagauaagagauuuccacagcaacacugggaggcaggaggcagguguucaaugagauaaugcacgaagcaucuuuaaagaacuaggccuggcgaaguguggcuuuggggagaggugguguccgaagaauccuuggaaaccaaauucuuuugcaccuagcagcuggggcggugguugcuauugacgcuugccuccuccaaucaucgcgcggcuugcuaggcugugcggcuccgugguuaccguggcaacggacggcaacagcucgggcggcgcauggagagugcgggcggcuucaagcuggguauggagccccucagcggcggcggggucugugaguuggacgcggggucuuggcggggaauggagguagaauaaacgugggacccggagugcaccaaggucagagguccucgcagagauuguggggucaaagugugagggacaugggggcuaaccggggcguccccucuuuucguccucguccucgcccugcgucccaggcguucuccagacuuuccagaccccuccccuccucagccuucccuagccacuucucacucccaugaaaguuacgggaccucggauuuuuguucuugggauuccccugccagacagguagccugaagggcagaaggccugaggugcugccucgcuuccaacuuggaauuagccccaggccuuggacgaaucauuucccgucuuaccggggaaaaugg

SEQ ID NO: 15818 - RNA, 113758 nt, Homo sapiens
cggguugaggguuuucuguuauuucuuuauugggguggggguggggugcaucauucagaucuuugugcuggugccuacgugcauacaaguacacacacacacacacacacacaggcauguguucacguauguauacauauacacacaaggccagagcucuagugugcuggaggaggggcaagcucuuuuuccaagaggguauuagaaagagguugauuccagaggaugaguggucucugaggcuauagccccccacugggugggcagccagcucugugagaaugccagggugcagcugacagcgcuggaggccuggggacuggacucugagaggagcuugggcagacacagcagccuccggccccaacacugcccuggguuggcaggcccagcccugguccugacaggcagguccuugagcuccucgggagggcgugacgacccuuaguguuucaugggaccacucggugggcccuccuccgugccaggccugucagaggacaacccuccgguccaggugguccccacgcccgcuccgcuggugccgcacuuccaggugcuuguucuggaccuucucaaagugcugcagcagcucugcguagucgaugcuaggggagucagcuuucugggacuugggggcugccuuuagacugucucugggaagagggagcagaaaugcucagugucagggaucagcucacagggggguuacugcuggagggcaguggggucagaggcagagccacaggcuggugggcucggccugugggcgucugucucaggccuggcaacucuuccgucauggcgggccccagagcugggaagccccugagcaucccccucuuccgcaguuggugggaacagcuaacacugcugcuuggcuauugcccucggccugugggcuggcgauggcgcccagagcaggcaucgcauugggaagcauuuccuguuuacgaguggcucccuuuggggugaaagccagggcuagcagccagccaggaagccagcuggggccuggaacagggucuggggagaagggggagguggcagcuuggcccuuucucugagaggcagggcuaggacuggggaaaaugggaauugcugaagagccucugccgggcccuccacuuggcaggacauuuguuuuugaguguuggggccccaaggccugcagucacucacugucccugggaggaggaaugccggucucaccacuggacaugccuacagcuccuacauuccuguugcugccacccucuccaguugcucuguacagcaacacagguugugcacugcacagcuagugugcaugaugcucccuauaauggugcaaugcgguagccuugcugucccugucaagcccagugcuuagcuugccccuggcgaugagauccccuugggcuccuguccuguuccuacucacccuccagcagugucucaugaaauguucugcucccucccuuuggccucacugguuuggaggagcagauccaugugggcuaggaaguaucuguuuccaggcccugaggccugguggaccugggaaggggucucaggaagacugugggcugcucagcuaagcagagagucuuggggcccuucaaguuuaugaaaagaugccaaucggcggggccgggaaggggggugcaggcacuggcagagcacaggaucuagacagaccuggacccaaccauaacuccaccgcuuccuagcggugugacuugagcaugugacuguuuccucaucugcaaagcgagggcuaccuaaggagcggcccugggguggcugccaagaugccuugacacgauguguaagagcuucaccugguauccagccccagcuuagguaucuggcaggugccacuguggcuacaguucugccccuccaacgugaggccagccggggcccagcagcuugaggguggaaauaaaggaggccauuuugggggagacaaaaaggagcucccccaaaacgaacucuuggccaugaguucaguccagcaggaagagucaacggccagagccugacaguugcuucagguggccaccagccugcugggcaggaccagggcagggggacucuucccacaguugagaugccaucuggggcccggaggcggccuccugcaccccugcucagcucugccugcccacaccuguucccuucccgccucccugcugaagaugcaccaccagaaaacaucuuggacaugucuacggcugcggcugcugcuuuucugggccuggcgcuccuggcucccuagcggggcucagcugacuuuaguucaacaaagaucaaaagcagcugggcggggccauucuagagggccaggcugugggcaguguucuaggcugugguugcuacugggaagggaccucccaggcacaguaaccuugggaaccaggugccacugcuccaagagagcagcuuggacuucuaaggaggccaagggccaccccggagcuugcagcccuaaguccaggguguggccagacgcuccucuaacccacuuaggccaaggccacaggugugacccuaaagugugucuucugaugcugggcacccacaggucugugcguugcuccccaugacacuccuggcaagccaaggccuuagguuaggggagcuuaggggccuuuagagagaugcucucagcacuggauggcaaacccgggaagauggcgucgguguggcaggguuggucggggugggaagagugggccacaucugcucccugggcccuuaggguggcaagaaguccugcucccugugaugggcagacccuuccuggccugagaucuugggagcagggcgggcugugucaccgggggugggugacacugccugggcugcugagcacagaggccaggcccgcucucccugccccaccuaaugcagauggcugcucucaggcccugcacaucuucuguagguccauaaccacccucgggcaccgaggcugaggccagccagcccacagcacaguguggcaaguccaggacucagggccggcucucacucuugccaucccacccaugcaccuguugccagcuuuuucuuagagguucccuccugccuuacugaggagacagucacuggggaguggcccagaagccagggggugggggagcugagguccccagggccuugauggcacuuggagcacacagaaccagggaugggcgaggaguguacaaaacucucccagcuguucccagcuccaaggccugccccgcaacucgacccugucugccagcugucugccccucccagggcugggacuguccucagcucccuucccagggugugagccguccucugggccccacccugcaaucugaccccucccccagcuguucugaaguccccuggcaugcccacugcuucugugccccuaucuaugguaucucuuccuaggucguugcaaaguaaggcuggggguccagggcauugaaggcuagggggugucucacacacccauuuaguccaaaugugcauuuacugaccaaguaaccaagaacccagagagggcacugggcuugcuggaggucacacaacaaauccauggcagagcucacaccagauccuacucuaggccugcaaagcauccacugacccucagaaucuucuacccagaggccucaaccccuuggcucaagacuucccugacugaccgugggagauucugaggaaagccucauuuucccagcuucccucugcaaacuuguucuacccugguuugaggagucugacugcucugagccucugcuccccucccaagacgaggagaucagcacucggagacccgggagaggcugggcuggcucccuggccaggaggacucccaggaaggcaggcugguucccacagggagacuggaggucacagggaagcagcccuuccugccuccucccugcuuccggcugcaccuuccccuccugggugccugccagguugacccuaacacuauggggcguugaagggccaaggcaaaggcugggccagcaaggcccgguguggcuucuaggccucucucggagucucucgggagcugacagcacuccggccccaggaacccacacaugcgcccccgcuccauggcugacccugcuccccuggggacacugcaucaggugcugucuucuggggaccaccuggcagcacccugagcagcugggguggcaaccggcucaaggccuaguccugccacugcagggcacugccuucuggggaaauggggcagggaaggcacgagccggucuugguuggggccacacuuucuagggguucagccucuccagcuggccuggggcagagagccuaucaggugccccacacucagccauccgagggccagucugggugggaggggcagugggagccgaugccagcgguguggagggcacagggccuccgggcaggccugucucaaggcugccuguguccaucgcaaaggcgagcacccgaggcccuuugcuggagcaaggcgccaggccugcugaguggcucuaacagccugggagggaauucuagacacacagggcaucugaugcaagcugggcgcgcuccauucagcguaaaucuucucaguggcucugcugguuuccauggcgaccugacaagugaaauuuuccaucucggaugccaaaugccuguggaugaggcaaagccuccaaggguuaccaaauauagaugcagcccuacaggcucugggguaggggccagccguggguucagggugggagccggcacuccucugaccagaggcugccaagcugggccucuugguggaggggugccuaggaccuguuccuuccaugggcaggaccugagcaggggagccuugaguguaccccugccucccaccccaccccggaaguggcugagaagguccuagcaaugauggggucucccagugacccaggguugagccucugccacagacaggguggggaggggcuaugugaggccugggaggugcccagcacagacagccacuggggcccccaucucuaagcuggggcaggaacuccucccccugcccgguguuucucuccaggguccucugucuggguaacuccagaugcccucagaguuuuuagauuuugcauagccucacugagcuggacccugauugccuggaaguguugcuacucccggccaccgugugagggcucccagaaucccuugcucggugcucugauguggacacaagaggccaaggggcaaguggcugcgggggggaugguggucacagugacaaaaggggugggaugcugaagugagggaggccucagcagccccuggcaaggcccuuccucaccaggcuccucugggccugucccugcucagggggcgggggcagcaguccccagccggcacucacucggucugcagcagcucaggguugggcacgcacuggagccggugcgagagcagcuggaaggcgcugcucugcggcaggagcaugagcaggccguagagggccuugaucagguagggguuguucuucacguccagcagcugcaggcgcagaucugggguaggcagagggcaggggucagggaccuggcacugcucugggacacgcccagcccacacugccugccuccgacuggccaggaccaccugggacuuggugccauggcacccacagcccaaggacccagcuguguggacccagccagguggcuguggcuuccagcgagucaggggcuccuucacagccagucgcgcugcccccaccucccccaggaguguccuagccguuuccaugaucucaucuuccuuuccaccugcccaccugccugucugaucuuuccaacagucaccucagccccacaaccccgagacacgcuguggggccuggucuguuucccgccccccgcucagcugccucccuggugauacgagggcucggggccuguaguguaacauauucuccaguuggcuccacacgugccagcacgggagagcuauaaauagggugugcuggagagaaagacgguagauuaggacagcuuuaagagagggcaggauggaaaaacgccuuuguguguagcgagacacacaccaaagccccggagcgucugggaggugcuucuggggcuccggcucacaugccagcccugccaccacccuggcgggggaaagagaugcacccggggggcugcccagcacucauuccagcccaagcugcagcacggaccccgcugguggcuggcuguaccacaaggcagucccagcuuccccaaggcgcacaggggaggugggauuggaaacgggcucacuuuucuucugcgagccucuccaggagaaucacuggcuucuacuuccuugugucccuaggcccaguccaggcauuguuuguggaggauaugccaugugcuuugggagagggacuaugucaccccuggagcggccacacagggggucccgcugacaaagggaaccugagcaccaggccuuagggccaggguguuggugcgcagggagcagaggaauggaggccugcuggcgcccuccagaagagacccccaccaccacuguccuaggccuggcugcccagcagaagcgcgagccuguuuccaguccuuucuucccuuugggccuuugggaagcaggcacugccgguggccacaccagccaccucuaggauccaggcgacucagggcugggacgguguugggcgagaccagggugugucucuccuguuacccugccccagcaaagcccugggcuugaggagaaggugcuuggaguuccuccagggucagggagggagggcagucauccuagggaugcuucuggaaugccaagaauguacaacuggagagaugagucaggacagaccagcagcaggagcagggucuuuuuaggaucugaccucaggcggccgugugggugccugugucccugggaggcccucggggaagugucacgcugggcacaccugggacaggcuuuagcgcacucugcggagagcagggucuccccccugcucuucugucuccagggcaucaguuccuacggcacccugcugcuugaugaggcugcccuuugaagggggcucaggaggggaugggaacggguguucuucagccccugcauucaauucaggcuccagggcucaggcugaugggcuuaggccgggcgggucagagacgcugccagagagugggagaggccggguggccagcuuggcagggaagguggccaccagcagaguggccuccuggcuucucugcacauuauaagcacauaagcgucauucaaaguguguauguugaggugcugagagcugugcucgccccagccagcugccacuuuugcacauucagccuggguguuacuaagcaggcagcuccugcccacuggcucccagcaaaugccaacucuucuuucagagagguacaggcauggcucuugggccaacaggagcaccugcagagggacucgggacccacaacuucagagagccagagcagaggcagcagacccggagggguggcuggggacagcccaggggccugguaucagccuucaaggggguucugcugucagcgcuggcucauguccaggagacucacugugagggauacaggcaggauccagguucugaugccacgugccccagcccugcucuggcuggccuugcaggccuaucaucccagucuuuuuuuuuuuuuuuuuucugaggcagggucuugcucugucacccaggcuggagugcagugguacagucacagaucacuguagucucaaccuccugggcucaagugauccuccuaccucagccuucugaguaguggugacuauaggcaugcacucucaugccuggcuaauuuuuaaaaaauuuugugcagaugagaucucacuauggugcccaggcuggucucgaacuccugccguuaagagaugcuccagccucagccuccaaagugcugggauuauaagucucacauucucaacauuccagaagcuucccuggggugacugcucuuccucccuccccagccaaaagagaccaacuggagcuugacuucacccaccccacuccagggcagccuuggacucauggcgcgagguguggugggaggugguucuuacaugugaagauggggcacucaaucagcugcaccagcuuguccaccucugcgaggaaguccacggugaccuccagguccccacugggugugcagucaaggaaagucugucugcugggccagcacagccgcagcucacagcaccacacgcccucccccccugcaccuggcuuccugugcacagagccugguuguggugaagcaggauuuggcgcacaaaggacaccaggcucuucccuguuccucgccuuucuguccuaaauggaacuccccuguucaggaguuccagguuccacucuagcagcugucuccucugcacccucccgggcugggagaggcucuuaucacagcgcugcagcccguugggggagggcugggcaggaaggguucucuccuuuccugccagcagggcugcagcaagcuugcggcacugggcaguggccugccagucucugggugacagaaguggcugagaggagcaaauccagguuguagaagggaagcaggcacacuguggggagccaggcagggccacaccuagcccuccacugaggcaccuccuggucccuucuuccuuacucccaacuccuggcuggucauguugccuucuaaauagcacuccaauccuggguuacaugucaggcacccauggauggggcuaguuugcuuacugguguuuuaaaaaaaaucuggccaggcgcgguggcucacaccuguaaucccagcacuuugggaggccgagaugggcagaucgcuugaggucaggaguuugagacuagccuggccaacauggugagacccugucucuacuaaaaauacaaaaauuagccgggcaugguggugaacgccuguaaucccagcuaccugggaggcugaggcaggagaaucacuuaaacccaggaggcggagguugcaaugggccaagaucgccccacugcacuccagcuugggugacaaagcaagacuccaccucaaaaaacaaaacaucuaacucuggaugccuuuugaugagcgcagugcugaggugagaaugggugccuccugcuucugaggccucugcccagccugcuucuccccagugugucauccucaagccugucgggcucuagcucuguggcccccgaaggcccacgccugggcugaagccugcaggcucacccagccauccacccauauucccagcuccaggccuucucccccacccccacaccaggcccaggaggaacuacaaugagcagagggcagccaccuucucccaggggcaggagcugggguucucucccaccccagcaagaugguccagcaucacccgcuggcaccugccgggcugggccuacucagucccaaucccaacccacaggguuucucccgggccagcucccccuccaagagccccucuuugcugccaaucucgcucucccaaauacgucccuccccucccaguguccuggcagcccugaugucacaagcccugaggcugaguggagggguggggacaggagcauggcacuugggcccgccuguuggguggaaagggggcagccggccccuuccugccccucagaggcucaaccccaaccacagugagaggaaggauacaacuucuggaugaggucauaggcgugccgguaguucugggugaggaagcagagggacaccguggugacuggguuguggcaccaggagcgguacaggcagcagaacagguucuggcucuccugugggggaacaggcaugagccgugaggacacgccugcuccuugccccuacccgguccacguggggaccugagggaagggccacaggucuaagucccaggggccuucagucgggggcagccagagccagcuuagcaccccggcugggaacgagccgucacaaaggaaaugcugacagcuccuucgcagacccugucauuaccucccagucccagagcugugugguggcugcgagggccuggcugggaguggcuguccuuugugcuggcaugucugcccuuggcaaaaucacaguaauuguccccccuccccaccccaaagaacucuguggucccggagccccauggggcugggaugaugaugggggagugggcagggaagggaggaagcacacuuaaaugccaucuccuccccaccucugcaguccacuucgaacacuuggaaaccacccaggaacccagcccacacuugggggagcccuugcccccgaggaaaauucuuaaggccucugcgaaugucuggaaggaaccacaggagggaggcagggcuguggccuggaucgugcagagccacuuggccccagaugcccccagacaugggccuggauauccccgaggcuccuggggaggguguaagcagggucugagccggcaggggaccugggaaaugaaaccccuggagucccugccuccaggaugaccccuguccccgcacggccucugcagccaccaccccagccgggacacgagaggccugggacccgcgucucuccuuguucauaggggagugagagugagugaguguccuuucugcucucucugaccagucguuggugcauccccauccagagccugggacggaugggcaacaaacuugacaccuuggcuuaugacaggugccuuaggagccagaugugcccagcugugggagagaggggccaggccaaggagggcgagaagagcuguuaaccccugauucgccagcaagguuauaacccagaggccuggcccuaagaggguggcaccaccaugcagggugggcccacggccagcagagccucuguuuucaagggggcagugccuggagugggacuggggugucaaccaauggaaaaggcagggcugcuggggggucaggguggacacguggacccuccugcgggcagagaccucagugugggugacgugacgcacccaugguuagugcugcgcagccacucacccgggaucccuauuucccaguggaccaggggaagucucgauuucaaccccgucuucucccugagagccuccuggggccagccgaggggcgggcucacacagggugugcccccuggcaugcaggagacgccugaggauggagucccggacgcagccuaccagggucuucagguccuucagcugguuccuuagcuggaagagcucuguggaggucagcaggaugguguugagggcguggaccauggucgaggcgaacuugagguccuccucccgcagcaggaugucugccauugaguggaagauguucuccgcauucagcaggaggcacagcugccuggagagcaggcagacuggggucagggcgcaggccgaccuggaaggcucugugucucagccugggaggccuccucuugguuuugcagcguccuggggaaacugcucuuuccugaggccaguguggagccaugacucugaggccugugguugugggagggcggggaaggguggggggaaugccgcaccugccucuaggccucccagcacugccuaccugggccuagccacgccagggcgccccacgcuauauuaaucucccggcacaagagaaacagcugggccuccagcuacccaaaauaguuccugagaucccgucaccuuccugaacucccacaugucugagcaauggcccccaccccaggccaagacacgccuguccccugcugggcuuucuucucuugcuagaacucaucuucauccagccaauucuccacacaucggucaccuguuuacugccccacuccuccuccuggaagcccccgaggucagggauuugcacuguucgggcuguacccugcggccuggagcacagauccgugugggaucagcguuaugacccugaguuuuuucuucacuguacggauggugaaacucuggugaagugacuugacuaaggucgcagagucacuuacggccagagucacuuagggcucgcuggucccugggccaugaccccuuucccaucucuugucuaguuaagagucguucagggcuaaggaucggacuuugugaagaggagccucccuguuauacaaaaggcaaaaagggaacccagaggaugaagaaaagcagauuccucagggucccugggccggaugacacgagcagugagaaguggguggugaggacaggcuuggaggaauccgcgcugcuuuuccacgugcccuuggaggccuggccugcaggggaagggcaccugggcaaugcuucccagcuggagucccagggauucgggagcuuccccaaaacagcaugaugcaggcaggauggggcaugagcgggguggcuggugagaggguggugugcagcacugcgcuuccugagugcugggcuggcggcagcguggcaccccugcccacaccaccuuccgucuggggcuaagcuccagugccugacgccgcaucccgucuccagggaagcaucaccacaguuccaacacggcgucggaggccccgaggucuugggugcucagugacgugagccacauuucuuggugggaggccugaaacaccuccaucuccuccuaggucgcuggacucagccuccgcuccgcaugaccugggcccagcuucccaaaugccccugaacgccagccauggcucuggggccaggcuggagaagauuccuccccacccccagccccaaagcaaccccagagcauuugguaacaaagaggccagaccacaaagcgcaaacaguaggcaggccguuccagccugccccggcuggagccugcaggccugggcaagaaaccacgagaaacagaaacaagcggcacagggaggggguggcggccgcacgagugagggccgcuucaucuccccgcgcaugccaccaggacccugccaugccgggggcuccccugggguuaggugggaggugaaggccuccgccugguguccccaacuaccagcggugugaucucaaugucuccgcacaauuuuuccaccuuaauuaggggcaauaccuaucugugaaauagggggaaguucucagagggcagccugaggacgaggaacaagccauguaaggcuaguguguggaacuagccauguaaggcuaguccucuggggagcugcuggcugcagagggaaagcccagccaggcagccucaagccaaaggccaggaggugguggcccugcugcagagcccagacagugcuuccuggccccucccggucccccaaccccuccaugagcccugucuccauggcugugggacagaaauguuccagaagggcaggcacaggaggaaggggggcguucugacaaauggucacaagugcccgucgccggcagcuggugccgucuccaugacagaggccaacagcugagccgcugccaggcagcgcucuccagggauccaggccggcaggcgggaccuguggcagcagagggcaggguggugcccaugugagggcaggcugaggagggugcggagggagggacggaagaggggcugguggugaggagaagcgggcacccagaccuccuggugucccagagaagcuggggaaugcugacuguguuacagaaggucaggaauaguggaguuuucuggaaacucuucucuugccaccagugauaccacccucuccugguuuuccucccaccucucccccagggcugggguagcccuuccgcucuucucucucuagucugugccucuugguagucuguggucccaaucagugacucccacacaugcccuccggcccugagccccugcugggcucuagauggaacagcugcuugccugguggaaggcccugccuggccaccuagcaggcauuucaaaccuugcugggccacaaccagcccuugguguccccauagacuugccaacccccuccucaucucaguaaacgguggcacuguccacccagcugcucaggcccaaaccacgagucauccugacccccagucccucugcuggguccacuggcacguaugggggccuuacccugggagcacaaccuacacggccacccugccccacacacccgcccccaugccuagggggcugucagcaucuccugccugguccaucuccccaugucucaggaucugccuccugcugcuucuccugcccccacaguccacccuccacacaccaacuggacaauccuaaaacaggcccaucagaacaugccccucccugcugggauuugcuagcggcuuccgccuggaucugaaacaaacccagccccucaccucggccuauagggucucacaccucucgcugguuccucuccagccucccucuugcugucccuccuccacucacggcauucuagccucuuggguuuuuugguuccugaccucgccaagcccacguggcccuagaggcucugccugcucugcccuggccagauggcuuggccaggaauggcacguggcaggcuccucccagacaucgaggccugggcuccaaccucagguccugaugaagccucagucugaaaugcaggccccuccuaccagccccuucuaagagaaaguucuaguucuuucagggcacucauccccaagaagcaagggucucccgaacagaacgguaggugcacugacccuccacccccuccgccaggccagcgcauucucucuguucaugcccaggcaggccuuuuugugcugugcaaacaccaguguguggaaaacggcagucugauguuacauuuuugcccuugucacccaucaggccaagcccugcccagaucuugcacucucuugcuggccgaagaggccugggaagccagcucaucccaggagacucuggagcacaagccuccucacgaggugucucccucugagugaggugucucccucugagcaucgcuaauuaaagcaccacaagagggaaagggagaggagaggccgggagcaggcaccacagagagcagugcugaggccaugucaugcuccagccgcucgcucaaccacccuugcuccaggaggaagagccuggagaggcugcucuggggcuggcagcggaggggccuccacugaggaugacucccauccuacugcugggaaggaggugggggccgcauccugccugaccccaggucacccuagguuuggggagaaggaaaacccagaucacugcguugcaaagccucaagaagacaguaauaauagcggaaguguuggccagcucacggggcccuuacuacaggcaaggcucagggcagagggugugagaagugggcccuugagucaggaagcuggggagggaggaaagagggcccauuuuccacuacagucccuaguccacaccgggaucuguacagacagguggccuuggaguucccacgcaccuggcacugggcucuggguuagcuccacucgcagugucaugcugaguccucacauaaccugggcaggguuaucacccccacugcagagaagaggaaucugagguucagagaggacccacagcugaccggaggaggaggaacagaguauucagaccuagaagaaucgacuuccagaaccugaguucuuccucaccacucugcuuccccagugccugcugugagugggcaccaggggcugucccugcccggcggaggccuggcagauggcugccuugcagggcugcugcaucaucacuucuuugcugagccccagcccagcuugaguugccugccuggcucccaagcgcagugucaacaguggagcacagcuugcaagcauuaaacaugugcccauauuuuccaacacccgcaugaaaacgcuauucgucaugagacaauggccuggaaugugcuuggaaacaaggcagagagcuggggugggagggaaccugaacagggucugggagggcauaggggaccucuuguaccacccuggagacccaccauggggcuggaggagggcagggguccacaggggagugugucaagucaguaagggggccucugguauaucccgaugacucaggcacaggcaggggggauguggccagaaggcaaagacacacgccauuuagggaaggcuccucccucaguggcaauggagcuuuuggcccagcaggggcugugucacugguuguguccuucacacacagcccagaggcccuguggacgcagcucugccuccccgucuugggcugcuggcugccgccuggacagcugcucccccuuccaggucugguuuugugcugggggcgggaccagcuucucuuugguuucucugccacauacccaggcgcucucaaaagagcaaccugcccucggccugcucugaacuucccggagcccagcagagggggcggucacuuagccuuaagaacugagacuacacagccuugcccaugaacauucccuuuggggcagccuccaaggccaaggcuaaggcucaugcugagaccaggguaggagagacguggcucugcaucccccugcagccuucuccacugcucuggagcagcaucugccuggaggugacugcaccacaccugccaggggcuggugugagccuucgugucacugucccucccaucacuaacacuggcaagcaucagcacacaucaggugccagccauggacagccgcaggccucugugggagaugcucucccaaacccccaccuggcauccacacacagccccugcuucaggugaaaccugggccagggugggcaggaggaguaaggugucaacuggcuuuguaggugccgcagugucuggguggcucuagacuggccagucacgcccuaaggucaugugguccaggcuggcaggagcccugccucaugguaacagaaggggcggugggagaaaggcauggaugggagccuggagccuggcacugucuucuuuguccuuuccuggguugggggcaggggccacacacugcaucuccuccagggauaagacaggucacugauuugggcaaagccaggccuugguuuggaggacaagacuuccugggggcuuuaccccccaacaccccuccugccuggggcugugugcagagcagcagaagaggggcugugcaaacacugcugucugagggugcagcuggcuguggccaguggccucuccccaccugguuaguuccugcaggccuggagcagggcaugaggagggccagcucacagugggagagagggagcaguuccuuuuaggacagacucaucgugggagccuggggagggcagagccuggcacguuagaggcuagggacagccggagcccgcucgggaggagcuggggaauggcuccuucgccaggugucuguaggagcagagccccgugcugcaggugaggcccaggagggcaaaggacggagcuugggucuccuuguggggagcugacauucuggcucccugccgugcuccgcccuagggaagcuggacucugccauguggcuucaggcaagacaugaaacuucccaugaucucaugucccugcacccucugaaaacaggaccagcgaagugaccaaggccagaaacacuuccccauccucacuguuggcugauccuucccaggucccucugcuguuugcucgggauacuugugccggcucccuuuggggacccuccucuggcucuggucaccaagcaggggcaugcuacuggccccccgcccccaccugcccagugacuguuaggacgcugagccaucugcuggggaugggaacccaugcacucacugggugcaggcucugcccuccccaccccuccuuccuugggccuggcuucuuaagagggugaccaaggcagcagcagaugaugcaucugacccgugguggggguguuuugggugaguguucagccugggaggaggagaggccgagggcccaggaaugcccuucugccagcacuggccugcagggcccuugguggacgcagccugccucucugcgcaggugggccaaccuggcgcucaagggcagggauguggacagggcaucagaugaacucaagagaaguucauggggaaauggagacugaagcaaccauccccucccaggggccucugacauucuugacuaucccaaacaauaagccaccagcagcguggaaaacagcuggccuggcggggacagacccuggacucaaacccuagaaagagacagcaagguugagagaugagcguggaggcugggggcgccugcucccgcccggcaugcccucagcugcucucucuacuccagcccucacuggccccgcaacgcugcccuccccaugaugaacagaggacucagaagaagccucagcuggcaaguuccaggagggguggguguaccccaccuccucaguuuuccccuaugcuccaccuuguccacucucgcgugccaucgaugggacauccuucccaguggagccuuguugguggccccaugagaggcaagagugugggugauuuugcucgguaccuccuguuagacuaguucacacaaguggccucacuggauacagauacaggaaggucuccuccuacugcccaaccaccccaagaacccuaucggguucuucaugccucugcuucuccagucuggcaccaggacccucugguggugcucauuucccaccccagcagguccaauucucuagccccacuggccugguggggacccugccugcaagcccagcucuuuggucagagggugucauggggcauggggucagcgaucgcugugcucccuggcaggcuguuggcagcuguggauggggaugggguucuuacaugggugacugggcagguaguccuggcuccaggucccucagaggcugggcuggaugcugauucugaggacagugugggcuggguggacuccaccggucucucugcaagucgccuuaggacugggcaaaccagcaggagggcaacaggcuucaggugccugcugagggcagggcauccuggcucagaggccccucccuucucccuauggccaggccuccuuccuucauuuccauccccagcugccuguggcucacugaccaugcacagaggggcgagcccuuguuuauuuucuuuuuugagacggaaucuugcucugucacccaggcuggagugccauggugcgaucuuagcucacugcaaccucugccucccggguucaagcgauucucuugccuugguggcugggauuacaggcaugugccacgauacuaggcacauuuuucuauuuuuaguagcgacauguugaccaggcuggucuugaacuccugaccucaagugauccacccgccucggccucccuaagugcugggauuacaggugugaaccaccacgccuggauagcccuuguuuccuuucuacauuggaugcuggauggugcccacauccauccccuucagugguccaaggccaauggaccccaguacuuuccuaggagacaccuggagucucacggccaauaaaucugaggugcaaccuaauaucaaggcuacaaacuacagagaaggccuggaccgcucccaccggaaaagggccuccucccugccuuguuccugccccacagcugggauccuuuaggaauuuaaagagaaagcagcuuuugggucaguauaaccuuaggauagggagaggagggaguagccucccaucucuaguccagaacgcuccagaaucucacugcauccugccccucccccucugcucucuucccuuccaacucucugcuuccaaguaugaaaacuguaaaucuguuuuauuuauuucaaucaauccucggcagugugccccucagggcaaaggcagccaugguaacccugccaacucaugccuuaaaaauucaucguuguuuaaugcagucgaugugucugguacacuuaaaaguuucuugcagggaguggggugggaggaggaggaggaugcggaacuuguuuuucugggcuuuguagggagcugguggaaaggggauggagggaggaggggcacaggaagaggccuucaguccucuuagccaucugucccucugugcaagaggaggugccaucgggcucugggaggucccagacaccugugcugggcucaucuagagaccuccauagaaggucucaucugggugggagcugccacagaaaacgaaacagucucacagaggcagcugaagccucagccccccaggauuagcaggucccucacccuaaguuuggggcuugcucuagagagcaaguugacucccgcuuucugaacugcccaggguggagucagaugacccuugcugccacgggaggggcucugccuucuccucagaauggaagucaucuucuaccuuggcccaucgggcuggcuuggccuuuuuucuuuuuuuuuuuuucaagauggagucucgcucugucauccagugcaguggugugaucuuggcucgcugcaaccucugccuccuggguucaagugauucuccugccucagccuccugaguagcugggauuacaggcgcccgucaccacaccuggcuaauuuuuguauuuuuaguagagacuggguuucaccauguuggccaggcuggucuugaacuccugaccucaggugaucugccgcuuuggccuuccaaagugcugggaugacaggcgugagccaccgcaccugccuuggccuuauuuuccaugugucuuuucagucugaccaccccguccccuguguccauucacagguacucaagcccccuguucuuucccaggacagcccuccccugucuccugccucaccugcugcuaguucccaccaauuuccuuccuaaggugguacuuggccccugggcccucccugagcccugguuccuuuucagcuuacaccacaaggccuagggcugggccccuacaggcaaugggggagaugaaugcuuguaggacagaaaauuaacuuccaggaagggacaagguggccuggguuacuuuggccguggggcugggcaugcacauggaacugcaggccaaggggcuucagagucagguggguucugaacuguguuaucaggguucuuggcgggugucuggcucuggcggaagcauuucgcauucugcaaggagucccugugagggaacucagcagguguuugacucacaaugaggucugcguuugugucuuagaaaagaggcugcgccuucuaucccacauagacacaccccagaauacggcuggaugcaggucagauggcgagggcuggggacaggcguguaacccugugcuggaggcucugaagcugagauagcaggaaggaccgaugggguaucugcugagauagugucuugguguuggagaaaaacgcagugugaggagggcaaggccggggugaggagacagcugggugcggggaggaggggcaagagugcggccggucuggccccugccuggagaccauugucccccggccaugaagccuuggcacggccgcagggaccuucuugcaugcugaauccucagugcaaaugaaaacaaagggacuggucacuaaaggaaauccuguugucuccaugauaaucaacuccaagaagugcugagaagugcccaagcccuugggucccugcugggcuccugcccucucuugccacagggauuuccuccaagcuggaaucaccauuuccuuccuaauccuggccacaaaugacaguacauuaggaacaucguguacauucaacuccucagcaugggccacuugugauuucagcccagagcccuuucuagcagagaaugccaugugcggcacagaugagaggccuugccaaagacccccuuggucagccuaaccccagcaccaaguacucacugcugcccacccaccccuuugucccccaacaagcuccagggccuacacagcacagagccuuagacacacuuuuccgggaagacaguuuggaccuccugagcugcagagaucacuggggccuucugguguggacuggagcgaguuucuccagaagcuuccuguggcuccggggcagcauaucuguagccagcuccuuuuaccccacucucccgcuggagccaccucuguggguggauggcacugaccacaccuggcugggaugguguuggccugugauccacacuuaguucuacccuccuagggcaaugguuugucuccaaggguacgagagggaagcagggccuugaaacugcagccauaguucuguagccuggacccaaacucugacccagcggagaaaguccacggggcugacuccaacagcagguucccggaaaccaguugggagcagcagcuccugaguaugggagucaggccagcuacugccugagguccaggcuggggagauuuuaauauaaagauuccuggugcccagggagacauggccaaggcuggugcucugaacuggcugauacauucccuggcugacacugccagggaaauggccagggaaauggcaucccugaacccuaccugcccuggggccuccugggcucugcuggagaacugcagcuguaaccuuucucucccuuugaagcccucugggcuugaacccucuaagcaggauuuccuccugaggaugugcucagcugcccccguggaggccagcccugcccacgaggaggccgccaccgccuggcacgcugcuuccuggcccugccugcccuugcacgccccugccacccgcaugggacaggaaggaacugaagccaaggacuggucccaggccacacagccagggccacagaggggccagaacuuggguuucugaccuggcacucauguucccaugaacauguucccaugcucuguggcaucugcaagggacacagaccucccuucccuggcuggcuccccuucccacccauucccugcagcuuguaugcccagggcagagacaccccuucacccuguggcaugugaccucacacaggguccucggagauugagucugucuugggacggguaauggaaaggcaucccugcaucucugccauuuuccccugcaaaccgcagggggacuugugaggaaugaggcgggugagggacagcagugcugggacccgaguaagguggccagagcuacuccggccccaacaaugucuggcgacgccccuugcccguguucugaucaccaagcuguuuguuuuccuuuacuucaggcgacgauucccaaacuagucccuuuguuccaggccagggagcacuccagcugcugcguauuccacaguuuacagauggugagccuccccuucugccucgucggugcuggaccaagacacggaggccucggcagggcccacacucggccccucuggccuugaagccacggacccaacuuggguccagcagccccaguguucauauggccauagccccgugucaacauuucccucccccaaauuauuuaaccagaugggcuguccuccuggucaugggcccugggugauuacagugauucacuagucucucguguucccguggcaacuuuccuucaaaggaccuccugcgcucugaaggaguuccggccaggggcugccauucugguuucugggggcaccucgagugcucugcccugggcgccaugcgcauggcuucagcuccacgucccucagcggggagccgccagccccugucccaucaguguccucauccacccagaaggcugcgcauuuacccucuagaacaaagagggucccucaagccaggaauacccuaacugaggaaccccagagccuggcuguaugcauggaccacgugcgggccucaccuccaggagguccacgaucuguacucucaacaagcuuccggggcggccagagaccugcugccugcaacugccucaccaggccugaucgcuucaggcauggccaugcccuccugagggaaggaggagacucuggcaggagucugagaggauggguggcagcagggccuggcucggccuuggagcucuaggcggaaggcccugacacuugccuucuugaggccccacccccaccugugcagagucuggguccugguuuacguuucugcuuggcauuucacuguuucccugcuggucucuaccuucacggucccgagccugcugugcacagcccuggccuccucuguucaaacagaaagauaaagaggucagcucuugggcaagaccugugcuuggacucucccuggccuccugacagccauguggccuggcccaccugcauagccccagcaccccaagaggaagcacagcucacagcugcugcccugggcacgggccauuccugccuuucuggcugugauuaggagcuagagccaugagugccuuucuugucuucacaucuuuaguccagggguuuugugaaauuuuaugaacugagauggcuuucucuaggcuuuauaagugcccacuuaaagagcacugagauaagugucaggaaacaggacgagaaguuaaacaugaauacucaccagugguaacaaagagcaaauaucagagcagccucacggcggccucugagaggccgguaaaaagaucagagucucaaaggacugggaggauggaggugccacagccguaguggugggccacagcauggcugggagggggcuccuucaguuauucucggccaaauggaaggggagggguucuccuauuuguacccucccccacccccucccgggaggcugaaaaaauuccuuuugugaucagccauuuucagagaauuuuaagacggaugaaauaggcuuuucauccacauguucccugccagcccaggaaaucuucccuggauuaaacgcgugagaaauaagagggccccagacaugaggcguccuuggaagucacccgaggggacaugucuuaguccuagcucuggguuacaggcgaggcgcccuauagcagaacuugcgcuggugggcaagaggccugcucccuccacuccccaccaggaucacgccacugccccucugagcaaagacacgagguaaccaccgacagagaaaggcggguggacagauuuaauacugggauauggcagccuccguggggagggacagugacccugagccauugggcucaggcugggagcguagaggcagugucuagccgggcucaggauccggagggagauguguucugcacaaagacagugaaggcgguggaccugggcaagcugcagagcucuccgaguccagagaccacugcugccaaaccagcaccagaccgagccucaugcugauaaaugcacagaaagggcugcagaaggaaacacaccaagcugagacccagaggcuacuucugagggaggagguggcagguggucaggggucuuucccauuuacugcuauaccauucugcauuauuucaguuuuuauuguaugugguuuaauauuucuaaacagaaaauaaaguauugagaauccucugugugcuucucuuggacuccuucuuggagaggcuuggcgacggagcccacgggcagggcuggggaaggugcuaccuccccagggcaugggugcuccagccuggccacgauaguggagcuuuccucucuagaggggcugcugcagguuuaacaauggaaacaugcauuuuacaaaugagaggaucaacagccaggaaaagguauuuuuagcuacgguggcucuuugcuucaaaggcguauguuucaucuaaaaccaggcaaaccuccuacaaagucugccugcuugcaaggagugauuagcauaauacaagcacgaaaaaaaaggccuggcuccacuuugaggcaggagugccuacuacagggggaggcuuucuccuaaaauagaaucgccagcagaugaggaaagucuuaucaauggagacgaagcccccaucuccacuuagagcaaaaaagcuaccgugcgcgaacagccuggcuaugacgggcgcgcugcagccaccagcauagagcagggucugaggauggaaacgcugaccacaguuccgcccugaagaccaccauucugggugcuguuugaaucacuuuugccucaggcucccaccuucuuccaauuaaaguacaaaggguuucgggcugccuuuccagacguccuuccccuggggguagggaagagcccagucaagaauggccaggggaauggacguggaagagggcaggcuugaggagacacagaugaugaaaucuuagggaggcaccuuccccagaggccacaccacugugagucagaugucugcuccucugggacccucuaucaacccagagcacuugccuccugggcuccccacucuccugcucaggagcaucuuuguuuuuguuuuuuuuuuuuuuuguagagauggggucuugccauguugcccagguuggucuugaacuccugggcucaagugauccacccaccucugccuacuaaagugcugggauucuggcgugagccacuacgcccagccugugggcauauauuugauugcuaucuuuucucuccuagaaacccauuagcuggcugugggaagcccgaaccugggccugugggccuguguauacguggagaaaggcuugaacucuucuucaaacaccacaaaaaugaaacggaggcugugacccuccaggagcgguaacugcagauacaaaucucugcagcugcuggaaacagggcacucggcagcugcuccagcgccccucuccuguggccugcuugcuuaccaggcccagggcccauccugggggccugcgaccuugggcugcgggggucggggagggggcuggggcagagagguggcaauuuugcucucuauuuuaggcaucacuggcaggaaugagagaagagacuggaaggaucagucaucucuccaucaucucucuccccugaggauccccacagggguaagaucauagaugggucuucccgcgagggucagggacugggaaauauucacagacggggcacgcagcugaagaucugagaaaccaauuacuaugcuacuggggggcccaggagaagcagaaggaacuggaccgggacagccgcucacgcuucaagggcaggaauggaggugacuccaggaaccugucaacugugggggcagggggcuuccaacagagguaggugggggucuucuucaggaaaagggcuggaaggaggggcucagcucaugggagaggaaggaaaaagcugacucuucucaggaaaaaugaguggacaaggaaagcuggccgaguucacaggcaccuggcauuagcugacugaagccagcguacccugaagagccaaacaaguccauggcagggaugucugcggugucgagaugguuuuaaacuuaguccagauuaucugcuuaaacugccuguccuagcagcacugaaccuuccagaaugacacagcagcaagaacccuggucaagccagcuuccugagccggcuuccuaacuagccugcgguguuucacgagacuaauggcagaggagaguguguagggccacagcugucauggugaacaagugagggucucaccaccugcccccacuggcgagcccugggccccacuucccuccgucccacuggaagcucugugagccagccaccucaggcacagccuggcacaugcccacugccuaucugaaggcuccucucagggacuugggcacccucacacagcgguaggagguuuucugaaccugcuucagcccuccacuggcucacaggguaccucagagguaaggccaccaggggccucccagccacacuccagguugcccagaggguguggggacuggucucugggcuucugagcagacugcuugcugugucagaaacaccucccccacuccuuccccgaccaguuccuacucaucuuuccuggcucagcuuagaugucacguuucagaagcuuucccagacucccccaacaggcugggcacccccucccccacaucuguuucaccaaggaucaccacugugcgaugcuaugcuugcaaucgugacuaacccuggcgggcagggacuagcucugcccacugcgguguucccacuggugggcacugugccaggcacugacggacacccaggacaggguugcucagugauacauggcgcuuccuggcuccccugccugcccagcacagcagcagcgcccugccgcccccugggugaaacucugaucuacccuugcagggagggggccgagcucuugcucccggcgguuccauucucagagaggcgagcgcucuugcccggccugacagcuguggccuaauuuccagggcuauaaccgggcuccuuauuuuuacccacuugguauuuuucauuacugaugcaugggagauggccagggauugggaaugggggaggugugggcuaauggaagacgcguaugcgguggagucggggcugucgggccaaggugagggccugcaggcgggauagagaagggguggggacagaccagacagauacauguauuuuuaaauuuuacaagggaaaaagaaaaucccaaaucccacccccuuguuuuuccucaguaagcauuuucaacaaggucacaaaugcgcuggcucuauagauuuuuggcuccaaaccacauuucaggcagccuuuaaaagccaauucuuggcauagcuucagcggagccugaggagaggggaaaacuagggcacuuuuaugcuuucagaaaaccucagauccaggucacagcuuccuggcucuacugacgcuguggggcaccccccuucucacaggccugaccugaggaccccccuccaccucccccaguguuuucuucagagcauggaucacaagaccaggucaccuguuucuuuguuacuugucccugugggccccucccaugaggcugcagccccgggggaggcgugagccaugccacagcuggcauggggccuggcacaucccaggcacucaggaauauuugcggaaugccccucuguguggagugagugaaucuuugaccccuguuccccagccagggagcucucuccuuaugaacuccccagugcucuuguccagccccuauaagauguucccaucucccugaaauaccuucuccccggucuguggaggcugggcccauguuggccuggcccaggcccuccuccguacaaaggcagcaggcaguaaauauuuacaggagaaaucaaagccucaguuucuuucuguaugaaagaacccaacuggcccauaaggucccuccuggcuucucccugacugagacucucugggacucugaucaguuuuggcccugcggcuacccaggccugggucacauguauggagacagggccccaagcgggcccugguaugaggugcugggccugcgucccaauuccacacgcgacaaaggguagaagacccauccgcucugccugcauggaugcuuccagaaauagugcuguuggcggaaggaggccacaaaggaggaaucagcuggaggccauaccuggccaccaccuccucacugccugcucccacuguggaucuggagggucacugggucacauauacagcuucacccucccacuuuccugcaggaaggaaggaguuggcugcuuggaggugaaaaagucacuccuucaguuacccccaugguggcccuugguagggccuacuucacacuccuccucugugagcauuuaaacccagaccaccagguccacaccauuguuggcucugccuccugauguccauggccuuggauucugguuccagaaccaugacggcccaugacaccugcuccugugucugagggugggcacccgacccuuuucagggcaaucagcaccagcgcacucuggccacacugaugggucccaugggacaugagcccaggacaggugcugaaggcuggggugccgagagggccggagcgagccaccuggccacaaagcggguggccuguccacuaauggggcagauggaggaggaagagccagcuguggcgggggagaggaggacuugaggacaggagguggccugagccuugaacuucuaguuuuaaaugagcccauccucgccucugccugcacacuaccuuuauuuuucuuuuuuuaaaaaaguauagaauguauuuuccggauauagaucggcacacugaauaguauugauaccuuuguuuuucuuccuguaagggugagaauugguuuucugccaugugccguccagaguccugacugcacagaacuggacaagagcuaguugcuggguggguugggggacagaagacgggagagugcugggguuugaguauucauuuuuuucuuuuucuuuuuuuugagacagggucucacucugucacccaggcuggagugcaguggcacgaucucagcucacugcaaccucugcuuaagccucccucucgccucagccuccugaguagcugagaccacaggcgcaugccaccaugcucaguuaauuauauuucucuuuuuuuguagggcggcaaggguuucaccauguugcucaggcuggucuugcacuccugggcucaagugaucugccugccuuggccucccaaagugugggauuacuggcaugagccaccgcgcccggccuugaguauucaucugaaugacucuauaacuuucucucuuacucuucucuagaaacaggagaaagugagucaaccccagaacaccugcguuccaggagcugagcccgagggagcaguugggccaagccuggcucugugaccagccacugcccaccccgggagcuccucggcuccucacaguuaucuacuaguugcuucugguacugagugcacaaguuacuaggugccaggcugucuccuaagcacuuuccauaugcuucgucacucagucucacagggauuaggaggagauagugaugauccccgucugcauuucucuuuuaagaaaacugugcuuggggcugggugcgguggcucacgccuguaaucccagcacuuugggaggccaaggcgggcggaucacggggucaggagauugagaccauccuggcuaacauggugaaaccccgucucuacuaaaaauacaaaaaauuagccggguguggucgugggcgccuguagucccaacuacucgggaggcugaggcaggggagaauggcaugaacccaggaggcagagcuugcagugagacaagauugcgccacugcacuccagucugggugacagaaugagacuccuuuuuaaaaaaaaaaaaaacaaaaaaacaaagaaaacugugcuugggaaggcagccacauggccagccccugugguucuccuggcucagcaucucgugggaagagugaccccuuuccuuaggugugcuguugcuccccaacuccacgugggguucuguuagggcugccacucacagcaccccucagccccaccucccugccacuggcccugucugggccaaucagagcuucccucuggaucauaacuggcugggaugcaaugcccaggcgaugugguggccgugucucugccacuuggaagagaccaaaacagcauggcugaccucaaacaaagacugcagagaucuugcugacccuggucuuggucuggauacagaggccagugaaguuccuuugcucauuuuggugccuuugaccuggguuccuaccacaugccacccaaagggugcugcccaauacaguaagauuagugguucccagcuccaggcugcagaccaccgcuggccuggcugccgcagaagccccuuggauucuggcaggucgggagggcuggcaggauggcuaggaaacuuugcuuuuacaaagcacaaacaggcuggacuagcugguuuccaagacccugucaagaauuaagaaaaaacaccucucgauuccagguggaucaugcucagcauccgcuuacugggaaugcggaacaaucaucacucagaaacaggcggcuucauggauauguuuccaugagcuccuaauuccccgaaaaagcaucacaaaacaaaaaaaaugcuaacuguaaagaaaaauugauuaccuggacuagauuaaaaauaaaguaugucuguucaucaaaggacaucauuaagggagugauaaggcaugccacagaguaggagaagauaaugacaguauauacaacugagaaagacucagauucagaauauacaaaggacuuccacaaaucaauaagaaaaacaccaaaaacucaaugggaaaaugagacuugaacagacucgucacaaaagaggauauccaaaaggccacuaagcuaugaaaaguuguucaacuucauuagucuuuagggaaaugcauauuaaaaccacaagaugauacuacuguaccccuaaucagaauggcuaaaaucaaagacugaugauaccaaguguuggugaggacguggagcaacuggaacucucccacaaugcugacgggaguggaagcuggcacaagcacuuuggacaguaccucccuaagcccaugguaugucugcuugccaauccagcaauuccuagguauauaccuaauagaaaugugucuauaugguuaucaaaaggcacauaagaaagcauuauccauaauagugucaaaccgaaaauaacccccaugcccaucaauacuagaagagauaaauaaaucacgguaucgucauacagaauauuccauggaaaugugaacuacugugacauccaacacagacgaaucucacaaacccaauguggauccaaagaagccaggcuuugugaaaagagcaccagcuguacgguuccauuuauaugaagcucaaaaccaggcaagaugaaccucuuguguuggagucaguacuugagggaggcggggaggggcugucacuugcaggagacgugaaagugaccucucuggugcuggaaauguucuauuucuugaucagagggcucauucccuggugucacaguuagugaaaauuuacaagagcacacucaugauuugugcacuuucaaauaguacguucuuuaaauuuacagucaccaaagacauccaggcaucgagccuggagggaguugaggcugccacaccgcuuugaucaggacgaggaaagaagacacaucuggggugcugaagcauguguuaugugguaagaaagggagaacgcuucccggggagacggcaagaccaagcugaaaacaagacagugucucgggcacgguggagcuuccaaggcaccuuucucucugaagcagugggaagggcugggaguugucaaguuuggaugacuguucuuccuucagagggaaaggaguggauaugcaaauagcaagccugggggcagaagggcccaucugaggacacagguuuacugaugacgagguggauggugaaacggagacacaagugccacaaucagguggaagcaaaugcucuccugggguacugaggaggccccgauggccccauguuggggcuauccgcccauguggucuggagcuggagcucaagacuggggccggggcaggucacaccccuucugagggaauaaagagacacaaaacuuagcacuuaaggaagcagcuugcgaaaaaggaaagugagagacggggcucaaaacagacugguggaggaccagaaaaaaugagcgcugacuugagugcacuugaaucaucucagcuuggcuucaaagaggccaaaguggaugaugcgagccacugcgauaagccaggggaaaaacacaucccugagaagagggggugacacauguccuauugagcaagagucaaaagggagauucagaccuggagagauguucaccgucaaagugccagggagcuccugggagaguaugccggcuacagaccagaagugggccagaauaagggacaggccggcaugguggggcuggggccuagaaggaagccagaaaggacguauagauugacuuggugcuucaccucugccugaguggguggagucagugggagccauccugggcagggaugagagcccuggggauggggaugggaggaagggaagaggagaaacaggaagccgaggaagaggaggagaaagaagaggaagaggaggagguggggaaggaaaaaggaggaugaggacgagaaagacgagggggaggaaggaagaggaagcagaggaggagaagagaaggaagaggaggacaaggauggcgucacaucaggagaggucucuguggggauuuuccucaggcuaaauaacccuggguaggauggcgaccccaugggagggcccggcuucucucuaaugaggcugagccccuggcugccaggucugagguccuguccugguguguggagaucaggagacguggcucucgucucagcucuguccccgucugcugcaugggacagccauugugccucucugggcugcagaacacgaacccuccaggccccuccagcugcggauugcgggcuggcggaucuggcgcugcucugcagacaggguuaggugaaucccauggugccaguccuggauagcacguguccucugggccugugugauggugcucauggcaggcguguccccccacaucagucucaccaucaggccaucacucucucuuuccccacagcacaggagcacaggaccccaggcccgguggagggcaccucagcucuggggucuuuggauggcuaugcaguacccugcagaucaccucccaaugccacaguugagaaccuaggacuggggacgagggcagaugcucaggugccacaggugccuuuaaaagauggaacaaugacgaggacaacggcaaaugacccaaggcccccacucuccugggacucacugcaucugagcccugaacuacagaaaacucccucauccacucagaucccaagagccgcuuugguggccauccccgccugggcuaugaaguggacuuggcccauccaggacucuuccccgggcacugcaugcucccuugcaggguggcgagugccaucugaggcggaauucugugccaugggucccccaggccaggccccuccgagggccacaucaccccugcucagagacaggagcucucuccuuccccauggaagaggugccuggucugggcggccuuucacaaaccgcaugcagcagaaacccuuuuggguguguuucugugacggggccaggguuguggggguucugugaucuucgugacucugcuaaaucgcaggcggagagagaagggagaagcgcacggggcuguccaagggcaacccagggaaacacgcugaaaggacaccgggacaagagaaagagcuuccugagaaacgcauucuacaacgauggacaagacacacucgguguuuaaauacgcugaagacaaagggcacccacauuugucuguccuggcucagaugcaggcagggcccaaggaggcagaggauggaaaauggcuucuaggggccaguuccaaaccuaccacuguauaugcauuuuuuaaugauacugacugacugcgguagcucaugccuguaauccuagcacuuugagaggccaagacaggaggacgguuugagcccaggaguucaagaccagccugggcaacauagugagaccccaucucuacaacaaaauaaaaaauguagccaggugagguggcucaugacuguaaucucagcucuuugggaggcugggguggguggaucaccugaggucaggaguuugagaccaaccuggccaacauggugaaaccccaucucuacuaaaaauacaaaaauuagccaggcauuacacaggugguacacgccuguaauuccagcuacucgggaggcugaggcaugagaacugcuugaacccgggggguggagguugcagugagcugagauugcaccacagcacuugauucugggugacugagugagacccugucucaaaagaaaaaaaaaaagauuuaccaagugcaagaaaaaugcauaacugacuuccucuuacuccaaaauaaaaaauaauaggcaugguggugugugccuauagucccagcuacuugagaggcugaggcaggaggucacagcgaggugagccgugauugugccacugcacuccacauagcccagugacuggcuaugaagcccagucacccuucauagccugggugacugagugagacccugucucaaaaaauaaauaaaugauaccacauuaugguacacauuagcuacuuguuaauuaaugaagcugcuggagugaccaaugucaaaucuuuccaaguuuccuggcauccuuaggugaagucuaaauagugagauccagagaauacugcaggucccaucuagaaacaacuucucaagcuucagaaagaaauccauuaucaaguucucagccccugaaaacuguuccugaccaucacccuaccagcccugcugguugccugagcuauggggcugggggaggugaugcuucucaggugugcagacaacaaagaacgugcuuuuagugaaagacuggcaaggggccagcgugaaccugaugaggggucugaccacgugugccaugugguggccaccgaggaggggagcuuucccaccaaucugcugccagguccuccccuccaucacaggggcuccuggaagugggggugaccgcugauucagugggagcauggcugcuugggcuguggggacaggggucacccugaaggacacauggccaccucuugccaaguucaccugugaccucuagucuccucccaccagcccugcucaaagcccaguggaccccgcaaacaccaagaugccaccccuuugaggcucuugggcccccuaggcacacugugcagggcucccucuggccagcauuuccucuacuccccucauaccccaggucagaccuaauucaucccagccuggucuagcaaggccugccacaugugguauccauuuugcaggagaaaagccaucccuuguuacagggagugccaguguguaugacacuguggggacugcuuggaggaggcagagcaaggccaggaccaccccccacuccaucuccagccacuucugggucaacagggaacaaccuccgaugguucugugaggugcaaggacgcuggucauuuugccauggacuagggaacaauggaaugcaggcugggccaggcucucugggcucccugaacuuugcaccucacaaggucaucuuuucaccugggaaggcagcacucuuuuucucccaacagucuuuucugugugucagacugggccucuugggccuccugggucccccugccauucccauugcgaaggggucucuaauuaggagaugagaagccgggagccgguuguguaaagcggcuccugcugcacacacuccucugcgucccuugcauggcgacaaaaacacuucagcccuggccccugggcggggaacggcuguggaaagcuccagaagauucacacaaggagcuggacagacaacucaagccagcaagaagagaagcuucugcugagagggaagcaggaagcucuguggaagaauuccuccugccuguucaauguccugucucccuccccucagcugggggcccaaucgauacggcuacggacuuaugaaagaucaaaacccaucugcauucuggguagguggaucggggccucuucuagcaaacagacuuagguuggugcacauuugccacagcaauuuauuuuuauccugaacaaaugaacgcaauccauuaaaagggugagaggaagaguggggccgccuagaagcucuagcuugugagcuggggccagaggcaaacagggaucuggucuggccacuucacucuaauucgccauccauuagcaccagcacaaugggcuucugggggcccggccaaugccuccaggcaggugagggggcaccgcacaaagacucacagagugaggagggggucccgaugccaaauggacucgagauucggcagcugcaggggaugacagagccugaugugggagcugggcuugggaggggcgccaguggugcagacggccgguggccuuggacaccuuggugauuuggccccagccaagggcccuguccacagggcagaaugcacgaggccagcaaaguggaauuucccaauuacggcaugaaagagaguuucuucucaggcccuucccccaggccccacaauuaaaaacaaguccaguuucuagcggcugcccggccccccacccccucagugaccaaucagcuccccacuccaccuauucccccucuucccaacacaagggcucuuaugcaaacccaggacacuggggaggggcaguagcagaggcacauauuagggacugagcauuugcucagcuggacaggcugccacgccugucuguagcagaggugagaggaggcccagaaugaaccggaagccuugcugcugggcuucucugggucaggaucucgugaaagaagucccaugacugcuuccuccuuucccuugugggccccauccucuccaaaugcccgccucaucuuaggagugcccuguucuccugggagguggcucggaccucaucuaccauuaacugggccgguucggaucaggcccuggcauucaccgcauacaguggcucauuacagaugcaagcauucuccaccaguccucucugcaaggcggcagggaggaagaggaggggaaaaaugcacagucgcugaagccaaagcgcggcuggccggagggccguguuggcaggcagagcgacugucuucagacuugcucgcuucccagcacagaagcaggccuuguaaagaucacagcugucgggucacgcuggaguucauaucacaguuuaucaaagaggcuggguuuucucccuccucuccuuucuacugaggauaaguggaugguucacggggagacaaggccugggcuuguucugccugcauuagcauggagggugggaagaggccgggggaaggcaacgcacaccaacaccuacuccgggcagaguuguuuuagcggagccgggccgggccgcuggugggugcccugggcacuggggcaacagggccggugcacuggagccagcucucggcacggaaggugccaugauuucauccccucaggggugugguucccccuccacagaccacccugggaagcacaagcccuguggggaggcugaacaacagccccgcuuuaucagacacagccagcacuggggcugagacaugcgccauuuauauaaccccaccacacuaugacacggcaggcacuaucaucgcugcgucacagacaaagcagaaaggccuuggaaacaggucacacaguuaaaaaugggaggaauugggguuugagccccaaaugagugccucgggaggcucaucugccuuaguccugcaaagucccguggagggaguggggguacagcaccccaccgcacaugucgccaucuucgcucuaucugugagcuuggccucaacucccugcugcuaaggaaagggccuggagccagaguagcuggcuaaaaaaugaagguuuuaaagccacuggcuucaccuugacaugcaucucaaccguuauguccaccagaaaaggaggcuguguggacaccgacaggaaguccaacccacucaagccuggcuggagcuuggguaccccguucucacccccacugacuccgacauggaggugcggccugggaaagcugccuggggaagaggaaacgcucccagggucuuuagggaaaucaugcaucuuccucaaugccaagaacccccaccagaugugugucuucaagaacucccgaugccucugucuuucuauagcagccgcuccaggucccagagcuaaacacacuccugccaaaagaacagcuuuucacuugcuggccagaagaaucucuuuccuuucuuucucagugugcaaucuuggaggcugagaagaacaauuuagaguuugccuaacagcuaaagaggggguuaagaaaucauugugcuccucaucaggccuguggcuucaugccagcaucugcggaaccaucgcgaugccucucuuuauuuauuuauuuauuuuuauuuauuuuuuugagacgaagucuugcucugucgcgcaggcuggagugcaguggugugaucuuggcucacugcaaccuccgccuccuggguucaagcgauccuccugccucagucuaccgaguagcugggauuauaggcaugugccaccaugccuggcuaauuuuuauauuuuuaguagaaacgggguuucgcuauguuggccaggcuggucuugaacuccugaccucgugauccgcacaccucggccucccaaagugcugggauuacaggcaugagccacugcacccagccaacgaugccccucuuuaaagucaucgcaggagaaaaggaagugcaauggagaagcaggagggcagguggauaccccccuccaccucaacaaagcucuuuggaacggccucagccccccacaggagcauggggaggauggaggaagccacauguuugcagggccuuuuccaugucagaugcugugugugcccccagacuggguggcugggccugcaacccuggagcugguugacaauggcuuggugugcuggcagagugggcagcagguucccgaaccagcugggccagguggcuguccgccaggaugcacauugacaggugugggugcugcuuuugggggacagcagucuggagaaaccgggugaaggacuaggagagacccaguccucugugaaaggcccagccacaagguuccuucugucccagcccacugggcuucuaguggggaugccaauggcuaagagaccuucuguggcugugcgggugggagugaggccuggaggccagccucaauuuccacugagaacccaguguggcccauggcagguuugagccccagaagagcaagcgaucgccauacugagccccuggagggugggaagggaggacccacuggcccagcuccugagcacgcugaggagcugggccucaggugguccuggcacgcaggauguucagggccucucacggcaccaggcucugcacucccacacagaagggacaaaguggcggcugcugaauuagcagagugcaggaguuugcagcccagcuccugcccagcccagugggcacguuacuuccucuuauuuucccuucugcaaaaugacgauucccgugagcccaggaagcccaggagaugcacugcaaagcaagcaaagccucccuggccuggagucugcaccugggaacauggcagugggcuggccuccagcuucacagagccucaggcccugagcggguggggagggcaugcaagcaugcccauggggccugcacuucugcuccaugcagccuggagaugcugguuacuaccccaaacuccuucucgccaugcgucuuggucauguggggcugagacaggguggaaaacccaccucagcccaguucuccagaggggacucuagcuauagauuccuccuccaaaggccucuccuuccacugacucccugaaagucguccaggcaaggagagcucaucaugaguacugaugccucugcaauuuggaaaaccacaugauguuaacugucacucuugugggaacauuccgcugcuuuccuggugggggggccucuugcaccauagcuaaccucuaccucaauucccuaccugaaacuggccaacgugaugggaagaaacaccauggaaaucuuccucuuuuggccaaugaagguuaagaauccauuucugucucucugacacggugguucucaacuggggugauucuccucccuaggggaccucuggcaauguuuagagacauuucagacggucccaacugggugaaugcaagugcuacuggcauucagggggcagaggccugggaugcugcugacauccuacagggcgcaggacagcugccaucccgaagagcuauccggcuccaaugccaacggcgcugaguucgagaagcccugcucuagaagagcccagagaagcaagaggguggugacagccuccccacuaucacaggggcauccuuuugguggccagaccaucagaagcccugucccccacugugguccugcucuuugucuuucuggucaggcaggccuguccucucccacaacucaauucugcggccccauccccagggugcccucaacuccaccucagcuccugagcuggccggucaccuccuguacgcuccacucccucaacucccccagcagcauucaggcuccugcagcggcucgcagcagaccauccccgggucucaccucccucacugccuccugccaucucccugcuuggccgcuuccuuuaccucucuggcccuucgucauagccuccuuuucuggcuucuccuucuuuccccaaccauuacagucuggaacacguaggguucagccucagaccccuucccucucacucgaccucuucuuaagaacucccuaagaaugaaagcuccacaagugcagaaccaucuagaauggucccuugcacagaguuaguguucaguaaacaucuguugaaugaaugaaugaaugaaugacuaugccaucaauuucgagauuguaucuugggccucgguacccccuuggagagccugguacagcaaacuacuucuucaauaccuucuuuuugaugcccccaaaguaauucaaacucaaacaugcacccccuccucacucccugccacucuuccggggcucccaccucggggacuggcaucaccauccacccgcugcccaaaccagaggccuggacacccugacacucccagcucccucuccccucacucucuccacaucagucaccagacaaaucuacuuccuacucagucucgaauccucauucucgaauccggcugcagcuucccaucccccucacaagcugccacagucucugcuuggacaacagccucccagcuggcuccaccucagccccuccaacccauucgccccagcaacaguugucuuucaagccagaaauccagucacguugauccccugcucaagcccugucagugccuccgugcugaccccugaguaaggucucugauccucacuguggcccacaggcugaagcugcuuauuaguuuacagcaagaugagcuccccaggcuccuucuugccuugaagccccauacagccuaggccccugccgggacuccuucaacuccugacccccagaccaugguagucgguagucuacucaguccccaagcaccccagaccacuuuaauaaccccaucaccccagggguuccgauuucacucaucagagggaggcccaggcuuuuuuuuuuuuuuuuuuuuggagacagagucuugcucuuucgcccaggcuggagugcaguggugugaucucggcucacugcaacguccaccucccggguucaggcgauuugugugucucagccucuugaguagcugggauuacaggcauguaccaccacaccuggcuaauuuuguauacggcaucuuuuuuuaaagccucuccagugaucuaaccugcagggcugagaaccacggcuggacagcaccuagggccauacggacuacucuagaaaucuccuccaccuggcuuugguguagaagcuggaggaauuugugcccugcucuagcuuucaccagguugagggugacacugggccacucuucugcuacuucuuggagcugaguuggaggcaaaagaccagccccagccaugcugcuggugaugacaguucuagaugccuccagccucuggggcuggugcccuggcaccauccugggcugggcucacaugacucaggagccuggcuccaccaagccuggcuaaaucccgcacugggggcugggccuggagcacagccccaugucccacgccaucuggcucaccuccuuuccucuccaaaagccugacaauggcauugaauaagaggcuguuccaccucaggggaagauaguaacucaggaagcaaaaaaugaauucaguugugcggaaaaacaucaacacugaccugucuguuucaugucagaagcaucagcaaccaguaugaaggggcaaccuucuucauuucuuacagauccaaaggucaggaaaaggaggagagagaagggaaagagaagguggcugcuuugacacuugaauggcgugaaagugaaaagccggggccgugggaggaagaggagaaagcgcgccgccaaggcugaccugaugaugaaagggccucugaccuccaggagcuuccguucgcugcugaaucucuugagaagguugaucaugaacuuauaaaaguaagaauucauggugggaguugaaggagaacauucuaagccuuugguaccuguagagaaagggauagagccagcauuuauucugauuauguguccacagggugaugagauccacacagaauauaaacaacuauaaaugccaaaaagaugugugugggggguguuauaacaagaugagggaaaaucucuaaucaagagccauggagcaacagagaaaaaggcaagucugcacaagcaaauacaacuuggcuuacugcaaaaaugcccacuaguuaaaguccuacucguaacuugaaaaaaaaaaaucccauuacuguccacccuuucauccaagccuaaaccacuuagugaacaucucauguguauaagacccugcuaggugccaugauuuuuuuaaaaaaacaaacucuacucauuaucccaguaaacgaaauacacucaagaucuauuugggccauuaaggacaaacaagaagucaaagagaauaaauggguaagguacuugugucagugagucaagucauuguggcucaauggucaacaaaacugauggacccacaagaggcaaaagccaagcuccuuuccuaaucugaccugaggaaaaggaaugaugcgcacagccacucgauuacggacagcagacaccgacaaauguuacaaaguguuuuaaacuuuacuuuugaaaucaaaaguucuuucuuccucauccucaggcaaagaugcucuuuuaggauagaacucugaaaacuuucaaagccugaggugacuuucuaaccaggagcacaaaugucucugacgcgugucccagcuagaaaacacaccgagguacagauaccaccaucccuuccagaccucccuugcacacacgccccuugguaaaguacccagcaccaaggggacaagggaaaggcugauggaauacuuggauggucugggguagcguaucuguaugcccguugguaucuucccuggacaucccuucuaauauaugccaaccuccacagcucugugaaaggaguuaccaagggauggaagagauccucacucacugugccugaggcaggaauuuuuuuuuuuuuuuuuaaagacugagucuugguuuguugcccaggcuggagugcaguggugugaucuuggcucacugcaaccucugccuccuggauucaagcuauccucuugucccagccucuugagugcugagauuacaggcaugcgccaccacgcccaguuaauuuuuguaauuuuuuuuuuuaguagaggugggguuucaccauguuggccaagcuggucucgaacuccugaccucaggugauccaccugccuuggccucccaaagugcugggauuacaggugugagccaccacacccggcccaaggcaggacaucuuuaaaaagaaaacagcuuuauugagauaucauccauauaccauaagguuaauccuuuuaaagugugcaauucaguaguuuucaggacauucacaaaguugugcagccaucaccacuaauuucagaacauuuuuaucaacucccaaaaggaaccccauacugauuagcagucauucaccauucucacuuccauggccccuagcgaucacucaucuaccuuccgucucuauggauuugccuauucuggauguuuccuauaaauagaacuaagcaguagguggcuuuuuucacucagcacguuuucaagguucaucuauguuguaguauguaucaguucuguacucauuuuuaggguugaauaauauuccacuuuauauuccaaaauauggaauacggcuauucuauauuuuguuuguccauucaucagcugguauuuucucccauucuguugauuuuuuuuuuuugagacagggugauacuauaguuugauuauuuguccccacccaaaucucauguugaaauuuaauugcuaguguuggaaguggggccuggugggagguuacuggaugauggggguggauuucucaugaauggguuagcaccauccccuuaguguuacuuugagacagcaaguucugcugagaucuggcuguuuaaaagcguggggcaccuuccucuuacucucuugcuccugcuuuggccuccucugccugcugccccuuugccuuccacuaugauuguaaacuuccugaggccgccucaggaaccaagcagaugcuaacaccaugcuuucuauaaagccugcagaacuguaagccaauuaaaucucuuuauaaauuaccuacucucaaucaggucuuuuuguuuuuguuuuuguuuuugagacagagucuugcuuugucucccaggcuugaguacaauggcacggucuuggcucacugcaaccuccgcccggguucaagcaauucuccugcaucagccucccaaguagcugggacuacaggcgugugccaccagaccugacuaauuuuuucuauuuuuaguagaggugggguuucaccauguuagccaggauggucucaaucuccugaucucgugaucugccugccuuggccucccaaagugcugggauuacaagugugagccacugcgcccagccauguauuuuuuuauaguaaugcaagaacagccuaauaaacagugucuugcucuguugcccaggcuguagugcacugaagugauuacaguucacugcagccucaaacuccugggcucgagcaauccucccgccucagccucucaaguagcuaggacuacaggcuugugccaucacacccagcuaaauuuuuucuuugagauggggucucccuauguugcccaggcuagucucaaacuccugggcccaagggacccuucugccuuggccucccaaaguguugggauuauagguauuagccacugugcccagccucuuuuuauuaaaaaaauuuuuuugaagcacaaaauuuuuaacucugauuaagcccaaugugucuauuuuuucuuugguugcuugugccuuuggugucauagcuaugaaauuaccuaaucuaaggucauaaagauuugcugauguauuuuaggucucuggucuauuuugaguuacuuuuuauauacagugugaggaaagggucuaaauccuuuugcauauggauaucuaauuguuccaguauaacaugauaucuuaauagccaauucauagcuaccauuuauugagcaccuacuaugugcuugaccugccuaaacccuucacacauaguaucuaacacccuaaaaaccaaccaacaaagaaacaaaaaaaaaaaacacuugaaaaauaugcaccauuaccauucccauuauauacacagaggagcugugaauuuggguaaggauuauccaaagucacauagcuggcgagugcuagaguugcugacccaggcagcuggucuucagagcccauguccuuugcagcucugccaggcugccugucucuucggcacuaauguucggacauguuuggggcucacagauuaggagguggugccuugcuaugcaggagggcagaagauggcauaaagacggaaacccagguccugccaagcugagacugaggaugcaggaaaugacgcugugaagagcuauggagccagcaccuggccgcagcucucuggaaacccagggaggacacugggggaugcagagcggccaacagaggcaucugggaccaucauuuuccaggcuggccccuuucugguccagaaguugcgugggagccaucacuuucucccuggaccagugaggaaauggccaggcacaagcacaagauaggcaggauguggaggaucugggaaccaaacuuggccagaagcaucagauguucccagaagcaucagcccaaagcacaaaacaagaaugugcagaaccauccagaguauuccaagugaaucucacggaggcgucuggacagacugacuguauuugaugccagcgggcaggaagcagcagcaagacucuccucccaggagcuccgucuuucuugcugagcucagacuuccuguauguccucucaugguccugccggggagauggcugggucuagaaaaggcguuuuucugugcuguuuuucccagcugugaaucacucuauaagggauuccuuaccaagagccacaccuccaaacuguagcauccucaaucccaagaaccuccuagacagcucgcgugagcggcaugaaggagcccugagugagaaggccaguucaaggaaaggccucauuccacuucuuguuuggacugcauugugcugggucccugccugaaucagccuggcuugggagguccugagugacucuggaauggcaaagagucucugcucccuggcccaaaggggcuguuugcagaaucaagugucacauucuuauagaucgaguuaccccaggcccagcugggggcugaucucuaaagagguggcugcagagacagcuguugagacagcccugccucacuguucccucccucaggagaugaauuugguaggccgugguggccuggcuggagggcacuggcuucaugcugcccacacuggaggcacccuguucacugcaagcuucucccaggugcuuguuuggaguggggagaggugcggggccguuccagccucacaggggcaguaggaagcacugagcaugguguuuaagccucaguuuccucaucuguaaagugagugcaguaagagccccuauuaaaugagauaaaaacauguaaugugccggguccggagccugccgcacagucugcacucaguacacgggggcuccuuuuuauuagcaagcgucccauagcgcagagcacugcgcagggcagaccguucucauucugagucucagaauggaugucugggggcuggucugaaaugucugaguggggagauuucauuucuggcacaaauucacagugcucuaucaggaugcucugaggaagaaggggggccaccugugacccccacacaucuggggagggagaucagcccaucucuccgcugacagucuggcuaaagauggcagaagagaagggcugggcugcucuggacacaacucugaacuccuuagccacagccccuaguguggacccaaaauggacucucaauguccaggcugccccuuggacccuggagcugaggcccuuaguggaagggaggaggagggcagugucacagcugcgagaagccgcagcaagcgauucacauccucagcugagugcagcucagcccucacagugcucccaaggcuuaaagacuuucugcccuccccaagacaggguugggagccuugggaggggcugcauugagaccacagguuugagcagggcagucuuuucccagcaggggagguggggaaaggggccacacuugaaggggcagggagggcgggcuggacagggaugggaaaggccucagugcucagcaggacagggugggggcugcucgcucuuucccagccucaguggcccccaucgcccccagccacucuguugaucugagcugcccuuuggcuugagaugcucucugaggcagggcugcaggcucaggaggaggagauggguggagagagaacaagcucaccccgggagggugacuacaggagaaaugggccccucaaguaugcugauuuccgccucacugcugccugcucuuccgcccaccuccggcucuggcucaucugcucuuguaagcaggguccugggcugggugcugcaggcgcaugaggaaagugggagccgggacggggcagcucagggcacgcccuccaacacugcgcuccgaggaccucagcgguuuuacucaggggugccacugaggcacagcccccuguagauggugggcagcugcugcagcagggggcgagggagaggggggcccacaacccggcugugugucucgggagacaggcucucuuugaggggcccaggagagugggauuuccauuccccaauccugcagagggcaggagcaugagggagagugccaucccucagcugaaggccacugugccuuguauuucugguuugggcaagugaggagccugccagccccuggcaggaagugcacgugaccggcggcuggccaggggcacagagacgcacuccacacagaaacccaggcuggcggggugggcggccggggagccagcccugcagauguuacuaagugaaaccugauguggugacaugagaauccacagaacgucucacaaacaaccugccccgggauguuuuggauugaguuuugugguuaugacgugaagaaaccucacaugucaggauaaaaauaacccuggcuucaguacauaacgcgaguuacaguucaacagaaccagaugugaaaacgucagccacccaguucaggcccagcagggucccugcuccacuccggccucccucccugcugggguugggguccaugugcccggacagcccguugugggcucaagaucugcugccuggaggauacaagggaagggccagaggccgcucaggggaggcagcaccaccuucuccgaggccagcuccucuucugugaaccaggcagggcuaaagagcaucaagucgugcuuggcacaggaagugguccacagaaggggugggugauggagaggcugguauggaaccaagaggacaggguggggaaggggcaguuucccccaagaaucaaguggcugggagaaagggaggcugagcagggucuuggggguguagagucugcagaacuggagggggugcacagcuacguagacaaaggccgccgcaauggcaccaacucgggaacccacucaaggggcaaucacuuucucaucugugggccggccugggucggcaggacaggagcgccggaggcaucaaucauagccaggagacuuugcagcugcucaggucagagcgagagagaagccgaugggaugcagcagggcccaguggggacuuccagcugacgcggcaguggagaggucauauagcagucugccaccgggaaagagcuauugcugcagggugagggcuggggccaaaggcagcgaggagaggguguggaggaaggcacccccugcugguggagcaggggggcuggacugcuggggcuuccaacuggacaagggagggccuggcagcacggguaugagaggaugccauucugggcagcagugccgggggccucaggcucaggugauuggugccccugccuuccauuauuuuaauaaacuuucaaaaauagguacugacccuuacugggcaccuggugccagggauuccgggguaaguaaacuuggccuguguggccugccaugacgcuauucaaacugagcugaugacacaaaucacccagcacugggcgacgcugaggagccuccgcaugcacuuccagcugggggucuaagaggucacagccaggagggaacagaugugaacuucaccacccacccaggcagccugagauaagcaaguguguuggaacagaggggcaggagaagcugggaucuccagggaagccucccacaggggcccucugcaccggccuguaauaacuaggacacaagcaaaggcccccuucacaugcagggagcauuuagccuagcccuugccaugugggagcucacagagcccccaggcaccccagcaccugguuuauagagagggaagaaguagcagugagguaggacccuuguccgaggucacgggauggaugggcaaagcagggcugugaaucuagaucccucugaccccagugcucgugaucccuacugcugcuuccugaggcugggaggggugagugggaggaaggggcuucaagagaaacaggugcuuuccuggggcugguguggcuggaggaagugguggcgggcagcaaaugacaagaaaugaggcauugccguggccugaggccaggaaggggucucugaagucacugugaagagaggagagaugcccccaucacugccagguugugcccauggccuggccccucuccuccuccccucuggcuguggaagcuuccagugcuggcgcaggugggauuccugaguggggugaggagugugggcucucgggccaggcuccuggcccaaacaaguggggaaugacacagugcuggccucucagagcugcugugaggaccccaggggcucacccaaaaagccagcacgcgugagugcucagagcagggcagggccuaacgugaccucagccagugcuggcagccaugaugauuguugccgugauuacuggggaaaauggcuuucuggcuuucugcuagaacuuguuucugucuggugacaugaagaugcugcugacauuuggcuacaauacacuguccugggcuacaaggaaugaaaccaaauaagaacaggucauuaucacccauuuuuagagccagggauaaaaacaccuuggaccacugagccccgcaagguauacugacaugaacaguuuuuuuguuuuauuuuuuuugagauguagucucgcucuguugcccaggcuagugugcaguggugugaucucggcucucugcaaccuccaccugcuggguucaagcgauucuccugccucagccugccgaguagcugggauuacaggcacgcaccacuacgcccagcuaaauuuuguauuuucaguagagacaggguuucaccaugcuggccaggcuggucucaaacuccugaccucaggugauccaucugccucagccucccaaagugcugggacuauaggagugagccaacguggcuuacgacaugaacaguuuuaucccagcagcauugggccccguggcaggcaaagucagggaagacuggguuuuaggggcaaacgucaguccuagggugaccuuuggccucagacugacacauuacugugcauggcuaaggauccuaaaggcugauugggucuccccaggccuggcugcacccucucuggcagcauagauguccaggccccgggaggaaaggcaugucucugacaaagggcucaucccagaggccuccucuguccuuugaaguuuuuugcacaggcucaggguacggcgggcccacaggccugucugacaucccuguccccagagccagcaggaccuccgcagacuccccugaguggagacaggaaauacaaaaggaggagacacaggagaucccaggggugggagacaggaaaguguggugucccucagccagcuucccucacagcugcccgcccaggcugcuccccauccuguuugcccccaggccacucucuccccgauucugcggcucugcacaggugaggaaugagggaggcagggugggagaagccucugccuucaccgcucugcgagggagggagagauguuuaugcaaggccaggcgagaggaaaaucccaugugggcgacucugccucggggggcccugggaaccauggcuguggugcauuaggccaacacggcagcuacccaggcaugugauggacucgcuucuccacugcugcgugugauccgcaccaugugguucccuacagaugccaccgacuucaccuuugcuaggcucccugccuccgaggcuuuccagacagucccuuugugccuucggggcaaucuccccuacagggacacagcacugcugccuccaaguucuccaaguucucagggcugcgcccuggagagccagaggcaggcagaauccaaacaggaagaggguauggcuucacagccuuguccaugugcauggccagauggaaacagacagaaagagccccuugcaugccugagaagcagucugggaaggagcagcuugcggagggaugaaugugcacuuccugcaugccuucugaccucagcaccaccccacacauccucagugccuggcacgugcccucccggggcagcggaggugggggggcggggaagcagggcacacucuggcuccccuggcuguucucuuacugguuuaagcugaccuuuuaaaaucauggccccauuuguaaaaucugaugccagcuguggacacgcgcaugugcacacacauggaucugcuuggagccuugaggcccacacgugagucucagguuaagagcuccuggcccagagaguuguggauucuccuuccgcagcccccacugcuccuuggcuguggauucuugaagcaagaagugugacuggcugcaggcacuuccuugguguucuuuccaggauggaguuucuucccaucuggcaugcuuugucguucuucuaugaauuccgagggagucccuggcugaugugagcuaaucugacagccucggugaguuggggcaagagucucuacugccauagccucguucauggccugccuaucuuggcacggccaggagcugggguucagggugcccugccauauagugccccuggcccugccgcccaagcagcgcaaagggcuugaugcugcagggcccaccagggacccccgggucagguucugcucccccauggcacacguccuacucccuccggcccaggcugcccucggcagucuccugguccuccuuccaugagcaggagccuaaaucacagucaucagcuucucugugcccgggaggaagagauaaaacauagggaagacaggucacagagggccugggaggccuggguguccuggcccugucacaaggcugugcugccuucaaguucucugcugcugccacuuugaggaggagagaagaggcuguggcgccugcuuccuggggagggagagccgagggugcacccccagggacccuuugcccaggccuccucccugcaggaugccuccucuuggcugcugcccgucuuccggucaguucuugcugcuccuccccacccgacccucccuuccuaaggaagagauauccuuuucucucuuccuuuccuacccccuuugcugggcccccacacuccaccucuggcauuccugccaucugucccaaggacuuaagguuggcccccauguacugacuuggggacacaggacggagaauggacucguuugccgagggacagagggugggagucccagcaggggucccagggucaggaugugggaaccacuuccccgaccacggccacugacugccuagaacugggcuccugggcaaggccccacaugggccuucuaugacuucaccuggcauguccuggggcacaggcagcccugcaggucuccggcugccccuugaacuucucaggcacugggccuggucuuagggccaaaaagggcuggggcgccucccacugaggccaaggaaguacucucaggcugggaccagcccggcugggcuguggcgggaggcugaggcuguaaggccccuaaaccuuuaugacacgugaggcugcaucaaagugagaggugaaggcagcuggacuuccucggucuaguggggacuuggagaacuuuucugucuagcuagaggauuguaaacacaccaaucagugcucugugucuagcuaaaugcaccaaucagcacucuguaaaaacacuagcuaaaggacuguaaaugcaccaaucagcacucuguaaaaacgcaccaaucagcacugugugucuaaaggauuguaaacgcaccaaucagcacucuguaaaaacgcaccaaucaggacucugugucuagcuaaaggauuguaaacacaccaaucagcacucuguaaaaacgcaccaaucagcacugugugucuaaaggauuguaaacgcaccaaucagcacucuauaaaaaugcaccaaucagcacucugcgucuagcuaaaggauuguaaacguaccaaucaguacucuguaaaauggacuaaucagcacucugcaaaauggaccaaucagcaggacgugagcgggaccaaaaaagggaauaaaagcuggccacccgagccagcaguggcaacccucucggguccccuuccacgcuguggaagcuuuguucuuuuguucuucacaauaaaucuugcugcugcucacucuuugaguccgcaccacuuuaacagcuguaacacuugccgcaaagguccguggcuucauucuugaagucagcaagaccacgaacccaccggaaggaagaaacuccggacacaucugaacaucugaagaaccaaacuccggacacaccaucuuuaagagcuguaacaaucacugugaagguccguggcuucacucuugaagucagcgaaaccaagaacccaccagaaggaauaaauuccggacacaaaagcaugggccaacuaggagcccuguguggauguccagaggggcgcaauggacagagacccccauggagacaccugagauucacugggaacuuuacuaccaaacguguccucaggcauuuuccaggacugcauugccagagggaaguggcgucugccgaggccuagggagaagagcuggccugccaucuggaagggaccgaggggcgagugcugggggugcuacggccaccuuuacuuccaaggacugcccagaaacagccugugugaaugaugccgucuccugccugggcugccugccacgugcagugcuauuuuuagcuucucagagaggaagggaauggccaccuagucuuccaccuguuagaccccaagaccgaagccccuggauuccagacuggagagaugcugccuaggcagagagaccagcagccgacccagaugguuuuauguuuagccaauggcucaaaagcaucaaaggugcagggagaugcagagaaaguccugugagggucucuggaggcugcuagaggacuagggcugccugccucugggcggucuugaggugggagaucgccaguagcaacccacagaccccucacacccuggcagagcuccagagcuccugagcaacaacccaaaggaccgccaugguccagccuaagacccggcacuggcacuaaggccccugaggcuagaaccuucaggagaagacuuaccagagguguucaguaggccggcucugccaggggugggcaccuggagcucugaguggcuggccuggaggucagggccaucgagggggccugggucauccgucuggccugcgggggaggaagcgauuucugccagcaccuccagguccuucaggaucaccuggggagagaagcggggcaggagggaugagcucuccgcugagagcugugcugaccugggcagaggugcgguugguggcacacagccaccugcaggggugggaggggucugcagaugacagcaggcugggaagagccacuaaggccacagcuggggcaugcucagaaaagugaaacaaaguauccagaaugaagggaacacagacuacagugaauggggccucuggaggaaggaaacuggaaucugagguucggagagucagcuuccccacgaucccucucucgggucccuugaacagggcucugaggguccccaggagucccaggacucaggaagcagggcguuaucugcacagugugcacuucaaggcccgcaggcugcgcaaggcucccaaagugcccuccagaccauguucuauugugugcgguagccacggccccacccaccauugggccacagaacagcugcuucugcagaggugacaccaggccacugcagacccuaaagcguccuccacauuuggcgugcuacucuggucuccaagguaaaggacuuccuaauguccagacaugucaggugguccucgguggcucuaaagugucccugcacagauguggguggggugaggccccagccugaccaccugccugcugaguucuuccgagacagaggcagaguggggcgugggaccagugcugagugugagcgcaggucagcacugugucacaauguccccagggcugcucuacagcccccguauccuuagaagcugccucuccucgcacagcacccaucuuugccuggcaccaagagcuggcagggcggcaaaguccagccuaccacucugcugcaaugggcaauagggagaggggccacggaccugcccuguugggaggggcuucagugugugugugugugugugugugugugugugugugugcgcgugugcgcgcgugugccugugugcaugcaccugccccaggggcugcugaggcuuccuggccaccuucugcuggcuguguuuauccugcagggaacuccucacacugcagguggucgccugcucuuucugccccucacuccucucuugcucugggcuagggacuaugccuguccccccaaaagguguaucuccaggacugucccugcgcccagcagaugcccaacaaacaucaguugacugggugguugccugugccucuuccugggcuacucugagcccaggccaagaauaacgacggcaaccggggcuucagcccuggaccagggaaagugggacagagccugaugggcagggccaugugggccaggaccggccagguggcuggaauaugggaauacaagauaagguuagcacuguagggcuccuacugagggauuaaaauguuguggaauuagauggggguaaugguugcaaaaagcuugugaguauauuaaaagccagugaauucuaugcuucaaaagggcaaauuuuaucuagaaaacaaacaaaaaagauaaggccuacccccucaaaagccauuccugucaaugcaaacacagugccagugccucccccacacugcccaauugucacuucuccuccugguuccucuaggccagcccuggccgggaaccccuuugcuugcucacccauucccgcccccucagucuucaaacagugucacguguuggcacgcaaucucccagccucauccaggcaggagcuggcacucgcucacacagacucacucucacagacuccccuccuacuguccaauucuguccuucccuucaucccucucccacucauggagacugggaugucugugggccccugggacccugcucugugccagcggcugcguuggguucuggggcuguaaaggugagucacagccaccccugcccguggccuggcacacagaguggagagcugaugaauccacguggcugagacacauggcugccacacagcccagucauauggcaggagcaaggggugccccuccacccaggccaggagccggggagcccugggugggucucagccuagaaguagggagggccgaggccucugcuuccacugaggacagagccuccagggauucuuugcuucagccacagaagaaagacacagggcggagggcaggauggggaaguggcacagcaaugaaugacgccgcgguccugcccgauucagccccugcacaccugccacggcaggauguacaaaggccaugcacaccaaugcuugcuggacuguccaagcacggccagggaggggacuugagaccaggaaauggagguggggggaggaugggggaaugacucauccaaaauuaaacagugaggcaagagucaagccaacagcuccucaaacaguuacccagagagcugccauagguauacucccacuccuaggcaguuaccaagagaacugcaaacgucugugcacaucaaacuuauauauaaaugcucacagcggcauuuuuccuaauagcuacaaaauggaaauaacccaaaggcccugcaguggagacaaggagaaauggaacguggcacauccacaccagggaauauuauuugguaauaaaaagaaaugaaguaccugcuacacguggaugaaccuugaaaacaccugccgagaagccagccacaaaguccacauccuguaugaugacuccauuaacaggcaaauccacagagacagaggguggauuuguggucgccaggggcguggggagggaggcauggggagugacuccuaacgggugcaggguacauacagggcuucuuucuggggucaugaaaauguucuggaauuaguacugaugguuguauaaucuugcgaaaaauacuaaaaguuacucuaugguauacuuuuaaaguauacaauagagucguuuuuaugaauuuuaugguaugugaauuguacaaaaaaagggcggggggggcaaaacccuaaaucagcaaccuaauuccuaacccauuugcucuugcucugcccacagcccgaggugguggggucucacccacucccuggugucucucgccugauccaggggagaggaggagcacggugaggagaucugugucucuuuacaucacuuugcccccucgcccccaugcugcccaucccacccaggucugucugcacagggggacagaggcacacaccucugggcggccaacacugguggccacgugcagcaggggaggaaagugaggagaaagugugauccagcggggcggcuggggccaggccagcacucggcaagaucccugugccauggggacaaacugauucaugcuggguauccggcagguaccuacuucccugucagaacagaggccuggaaaaagccaccgagaggccuggccugugcaagguugucuccacccuucgaguggcuccagggccagaggagcaggcuguccucgcucccggccacaaugaaugcccucacuugucaccagucucaccucacaggauacacacaagggaacugagacuuggacagucaccugcucaagguaacagcgaguccaccucaaacccagcucugguccccaaaccugagccugcugauaacacuacacagggugcuguggucagacaguccugacauccaauccugacccuggaccaguuaacuucaaccacacaaugcucccucuccagacagcugcugagcagcugcugugggcuaguccugugcuggguauaagagacacaaggccagacaggucaggcucugccuucagugaggucauggacucccggaggagucagguggugagcauuuacugauaauacagggcgggugccagggacccagugaugaugccugggggggagccaggaggcucuggaaguaguugagcaugaguuggccaagggaguaagaagggagagaauggcauucaaaguauucucuuaccuagcauaagccauucauggacgcagaaccacguggcacauuccaggaaacuaggcuuuggggccagcuccagaguggggaauggggccagaggugaggguauggccagaaaucaggccaaagugguaggcagggccagaucuucaagagcucaugacacaaggccaggugcgguggcucacgccuguaaucccagcacuuugggagaccgaggcaggcagaucaccugacgucaggaauucaagaccagccuggccaacauggugaaacccccucucuccuaaaaauacaaaaauuaguugguauggugcugcgaaucuguaauccuagcuacucgggaggcugaggcaggagaauugcuugagcagaggcuguagugagcugagaucgcacuacuucacuccggucugggcaauagagugagacucugucucaaaaacaaaacaaaacaaaaaaacaaaaccauaaaccaaaaaagagcucaugacacaaagaagucugaacuucauuuugcagaggaugggagccucaguuucccuauaugcgcaauggagauuugaccuugccaggcuguugugaagauuacaagagauacuugaugugcaaagcacgaaaagcgggcacacaagaaaggcuggcucaccacuuccauuccaagauuucuggucccacagcugagcuguucccuggcccaggcuuagugacugagcauggacagcagugcccacaccaagggcuuccaaccccgcuuucuccccugcagagaaugugcuuagcccaccucaguacuacugccucccaccccacugcagagcacagccagcaaagcugcauauuuuacauuuucaauucucuuauuuuagaaaguuuaacaccaaauggcaaaugaaugcaaauuacacuucaauugcacaauuaaagccggaaauguugucuacagguucguucaguaaucccagccacuccucuugugcuuacauaucauaggauuugucucugguccccagaggcuggcaaaaagcccacagcccugccugagacaacacugugugcgcuugugcgcacagacacacacacacagcaccccuccagcacuuuaaauaaagcaggaccccgaaacagcauccccauccccaucuucccucagucuccuagaggugaggagaaggggccaccaagauggagggcaaggaauggcuugagguggggccugggguguggggagccggcugauacccggcuucugugccccuccaguccggcugcugcuucgcucccaguugcuagcaaaccugacucagcccagggggugaccuugaggcucuggagcaccaaucucgaugcacaccuuggccaggacucugccucugccugggguggaagagaggcccuggugagaggaaggcccugggaggcaaccucaacagggggccugggucccagcaacagagacuguggggagcugcucuuccagcugcaccuggcuuugagccucugugcugggccagaguuuuggugcucuagccaccuggagacccugcaacccuugguguauagguagaaaccucuggaggagaaggcgaucucaguggccuggcuuacugugagccccucucaaggccuggaggaaaggcccgagagcuaaagacacgcuucuaggccacuccugccucagcuuccaggaaaacagaccuaguccuccuuccagugagcaggcuggcugggccuguaguccuggcucugacgaugagaaaaggcucaaagaaagcgggaggaagccacaccaauuaguaugcgcuacacagcuuuuuugcaaaaugaauauaaaacacuugugcuuucuuuuugugugagagaaagaagggaggaaagagagggagggaggaaggacaagaaagcaauauucugcaggagcaggagcgccugccguuaccauggugacaggcggggguggggaaggcccaucagcuggccccugguuucggaguggagugagcuggccauugguggagugaaagggucaggguugguggcaccugggugugggcagcaucucacaaagcagcucuggagggggugcucagggcgaggggagagggcuuuuugccuuccacgguggugacuuuacaccagcaaagggcauauuucaaugugggaggagggugagugucuggguggggccaccacaggcugucgccccagugcauucuagcaggugaagucuagucucucugggaugguggcugcuccuucucuucucugacugguccauccaggcccucacugucccaacaccuggucccagaccagcccuaggagaccucgguguggaaagcucccagcucucacucuccccagggugccgcggcagcuccuuuaccauccugggaacagcuggggacuggacaccagauuugcaaggucaagugucgaggcugggaggcucguucucaccucccaccaagauucccgaacauaaagucccagggcgaggcacucagucucaacugaauaaauacuugcugaccugcagcguuggacaggaaauggaagauggauggcucugagcagcuccugccaaggaggauggacggagaggccgcccacuucacucuacccacuuauccuuaagaaacuuggucaaacguucacacaggccauuggucggcugaugagcccuaggagucaacugacucagccuucuagcuacugaagagggaacccuucuuguguugacaggaaauccccaagcugggcccucuccaggccuggccaggaagaagcugcaagaauguuuccaacggacacacuugguacuggcggggagaggugaacucaggcuaaaggccuuggaagcugaggucuggccagugcaggccacugccaaaggcuaucugaugccucugccuggagcggucaggucgcagggccuugccugaaaucugggucagguccagcagcuacuucuucugagguggagcugaugugaaguacacaggccccgagggcagguauuccuggaaaaccuuggggucuucugcuccccuccaagcaggagccuggccccuuccuucgugaggggugcagccuggcuggccaagccucuucagucccugaccacauauggaauggcucuuguugcccugguuuaggggcauuagccagagagcacacccuaggaagccgggcugcuguacccaggaaggguccccugggggagccaugggaaggacaguagggcuuccacugcugagagcauggaagaaggcauuggcaccagcuggcaccggggccagaggccuccgcccuggacacaaaguaaacaugagcugcagaaggcagcaaucgggcccuggcccuggccugggaaagggguggcauccugagaaacgcccuggucugcacggggucacagcagcccugccuucugcaacaaggaaggaaaguguugccuaaaagaacgcuuagcuuugguggugggaaaggagcacuacuuaggccuagacccauuuuauuucccauugagaaaacugccuugauagaaaacguuuugucuuaguaaaccaaaagcaaccuaaaaaaaaaucauaaaucuuaguuuguguugcgugacuuugaacacaaacccugggggaugaggacagcauucuguguuuaaacauuuugccaccuuuccuucaguguccagcacugugccacauaugccagaggccagcgccuaacgcugacuguuagguuccacugauuaacagugacagcaccauuagugccagcacugggucuggcagcugagaacacucuagcggccauuccucuuaggguaaaggagaaaagaaaggccagccucagguaagacaccuuugagaccagaucccugaccuccgucuucucucccacccauuccaaggucuccccuccuuccagcugauuccagccauugcucacuugcaccauccugggcccugacccagaggguacacucucaggguuauaaauucucuccaugagcugggcagggaacgggguggugccugcugcacugagagcagcacgagaguggugcccacucauacccgcuauggcucugucaccaggagauaagccuaggggccacggcagccaggagaaggcuccugccucccuccagggccccgcuucauugugguuuacuugcaagcuacgcacaguccccgagcgaaggaugcaggcucuaccccauaggccucgcuuccaaucugcugugggagggcccaaugcagcaggacaggccccagauguggggcacguccaaggagaugagcuccucauccaaccaaacuccucuauuuguucacuuucucagaggacgcuucugagcaccuacugugggcugaauggacuguccucacagaacucccagcuaacaggccacgauggagagggauuagagcuaggagagggucugaguggacggggggacauaaagacacagagggaaccuggcccagccuugaugugcaggaggagggggugugugugugugugugugugugugugugugugugucagacagauggacagauaaacaaggcuucauggagcauauaagugagaucuggcccaaguuacuuaacuucuccaguuuccucuuaggggaaauggggaaaaugacagaaccuacccucacaggguugucugaucgugaagaugaacuaagaucacucacaaggggcagagcacaggguguggaacagagcaagccagugugaaaauggugggucucauuagcaguggggggacggucccaguccucuacaucucugggcucaccugggcucacccaggcucacccaagcuccugccagucugugggccuugugacuugccaacagggaggugccugggaaauccagcugauucagccuuggccaucuccagaggaggaaaaaucaacacaugacuugcaagaaauuuuggcuucugaggacgcaggaacgcuaaguggggugaaaaccgggggcccuggcuuggcugccucgccuagggcugcauggagagggcaccagggcugagagcuggggguauauggccuacagucucuaagcaagaucucacgcuggucuguaucugugcucccagagaugugcaccaaacccacugggaagcaugugaaaaauaccagccccugggcacccgggcucugcuugagggacgacugaggaaggccgggagugaggcccaagcagcuggauuuuaaaagcuccagggaauucuggugacaguccugguuuagauggcucugcuguguggcuugagccggggcuggauagugugcucaguccugcaggcaacucgcccugcagcuuggcucuaggaggugugagugagagcgcccauuccugccucagggaaaggcuggcugggcuggcuccucuuugugggguuccuccuaccccagaggcccugccgcugggagagccgccucccuuuccaccaugcuucucagcccaaccucugccuucaccaggagcuaggcagcacccuccuggcccccaauccauucauaccaguuacugugcccagcucuggguccucacugguccaucugcccagggcaaggaacauggagagguaaauacucaaacccuccuggcacacaguccugucuucccugcaaggagguggcaaggcuggccgcaguuacucugggucccccugugcucugggguggcugcugugggcacugacaccacaaggugggaacaucuggaagaaugagggguggguagaggcccucucaguggguacaguucugggacuguuaccuugccauuccccucucuucccuagcaacgauuugccgccaagccucauuuuagaagaccacaguccucucugaacccccagcaguggcugcugguaccucugcugggccugggaccuagcuguccccgaggaggaaggcucagggccguggcuggagucuagcugcuuugcuggcuggcgguggcccuucucccuggcacaugacucccucucacuuguucucagaagcccccaaaagaagcugcagggacagccgcggggagaggggacagagggcaguguccccugcccacggcagggccaggggagggugccucaggaagaggguccccgggccaucagugcccacccagcuccucuccccugcaggcugggcucuugcaagaggagucaaguucuuugggcaccgacacggcaccccuccauucucugggcugaggccguaucuuacugcgugaucugauuuuaaagauaucuguggaauugagguggggguggagggguguuuuuguuuguuuuggagaguggauggaaugaaaauuggagggaagugaacacugaggcaagaaucugaggaggaaaaacaaguacuguucuuauggaagacuguccgcuucugagcaggcagcauuaguauuccagggaguggagucaggaccacacagauucagggcuggaagggaucucagaccauccaguccaaccccaguacccugggaagaaaaccgaggugaggcggugucaugugaccugccuggucccguggagagccgggcagcgugggggcagaggcuggcccuccugaucugcacccaggcggcuucuacaccacccugcagcaggccuggccaccggccucagcgcuucugggagaaggucagccagguggaagauggagagggcuucuggacugagcccuggaggggggcuaggggccaccaggucagugagcagccagggacagcccauggggccugggaaggaaggugcaggagaaugaggucaaaguuaaaugcacagagggagaaggugcauuuagaacugaaggucagccaaggacaaaacccuauggggucagcggagggccugggccuggauaaggcagugccuccacccugggccgggucccugcucugcagugaggugacaccuugugugagguuuuagaugcucuggaaucagacagauuugacugucaauucuggcugacagugugaccuuaggcaagugauccuccucacaccucgggguaacuaagaucacuccuggaccaccauguggauucauuaagacacagaugcaaugcacucagaauggggcacaagccccgcagacuucagcuggggcccucuccuccuccuagucuccucccacugauacgagggguugacacaugacccaccacgguuccuaaagaaagcugcagcgggggugguggaggggccgucauuggcucucuaagcugcccucaaaugaaggggccucuacuuuaguggaagcccccauuuugggguagacacugagggauggcaguaacagcuccucucuuugggggacgggagagagcagccccagccaccugggaaccuaggggcacucugcuuccucccaccauuccucacagcacagcucggggguuuggggcuucccccaggugggaccccaggccaaaguccgugucaucaagaauuaaaucccuuuaaagcaggcagaugagcccugggacccagcuggccaacccaccugaccacggugacaaggacugcuugggaaggauaagguaagggaguacaucuguggaccggauggcaugaggcuggagaaggaaaggggcacgcuggggugauacacagggcugcuucugcccugaggcaggaagccaggcagccucaccccagcucugcucugcucugcucugggcugggcugaggcuccaggcaggcguggcagcagcaguggcacugccagcccaaguugggccguuccucugggcuccuaggcaagccccgaucugcuucucuuucuggcaacucggccuggccccagugagugcucuccuuucagaucucugaaccuccugaguuuuuccgauccauuucuccugggaccugcaccaugaaaacaaaugaacucuccccuuccuccccuaccaaagcaaaucgcaccuuaaaauacagucuagggcauggcagggggugcuucccagcgccuacccugcuggugaggggcugagaggcccaagaccaaggagggcuggauagggcaucugccaccagugaagagccccucaaggcgccccauuccucuccccucaggacucagcagaggcugggacagcccuugggguucuaccccaugggucaggcacuucugcuaccuguccucaacccagguaccacuggguuggggaggcaccgggccaccuuggaccggguacaucgcuguacccaugguguaccuuacgaaacuuacaacaaaagcuccuuuucagaugcccuuacaccacucccuagaccuugcccccuaccauccuuuccuccugagucauggccgugccacagugggugugauggguggcccauguucuucaugcagugaguggguucccaaacuagaaacguuaccacugccaugaauacuguccucggaauccuacuuuccaauuuuuccagaaaggugguucucauuucuuuucuuugcaucuacaccagucacaaaagccacaaacucccaucagcaauuuuucuguuacucugaagcuacgggagggggaagagaggaguuccuccuggguugagacucuucuccaaaguguuaaggacgccccggcucugagaugcugggaagacucuggggacacuuucucuguaggcccaacugcaaagaaaacaguucaugcuggugacugagcccagcagggcuugccuucucgaucucaaagguuuugcuuuuguggcuguggaggcuccaaugcagguccucugcugacgacgccauuucucuuccucucccuggacucagggcggccagcuggagcccuuccgccugcgagucggggaaguggcgcugugaaccugcugacaauggggcucuaaugaguagagcucaugcugaaugcagccuugcuccugcucugggcagccucagcccaggagugcuggggaggcuggagaagggaagacgggaggggagacaaaugcacagaaggccaguccuguggcccacuguguccuugucugccuuucuaugaccucaaaauggaacucaagucccucaaacaccccugagguccuccggccucuagagacaggcaggaaaacagagagcagcuucuguccuggguuuugcugcugaagcagaagcagggaggacccggagcagaugcagagcccauugcccugaucucaaugugcaucuccaggcccuuuacagaaaugaccuccugcaucggaggagcuacugcuuaucguggguuuaugugugcugggucccaaggggagcauuugacauucaugaucucauuucauccuuauaacaaaccugggagcaagcuuccacuauuauuuucuguuuacaaauaaggaaccuaaagcucagagaggcuagguuaccaaccaucaaguggcagagcccaagguggacuccuagacuuccugaacccaaagcccgugcucuuaaccaccaggccucagugucaccuggguagagaaggaagaaccagagagggaagucauucagaaucacaucaaaauuacaaaacacugagaguacucaucauaagugaauaaaaccuacaaaaaaagacucuaaagcauuacugaaggacaucaagauggcucacaggacugagaaagagccuggcuccugggugggggaguucaccacagugagacgccaaguucccccaacauacuuguaacgacagacaggucauuauaaugggccagggucugggugaggggguuacgcuuucucuuuaaacacgccuaugaggcugguguagacaucauuauccccuuuucacaggcccagggaggguaaacuccuuggccaggguccccgguaaggaagguuuagagcuaggauucaagccagggucauggccaccugucugggauguucacguucacucacaggggaauagacauccuuccaggauuuucuggagacugugaucacccugagaguuccaaaagcaggcugggaggcagcugugccuaggaguuguggacuaccugaggucccaccaucgggaccauggagagggcccccaucccguggauacucacagguggggguauggccaucuuacaggcagaacucacucaggcagcauggcggcugcccagcugccaggcagccaacaacuggcaucuucugggcaggggaagcagcagucucaccucccaaacagggacccagcaggaugcagugagcacgcacccugcauucugcacuguggaaaucagggucacauuuucacuuaaaaaacaaucagaucucuagcuaugggaggauuucuacuccagugccaggaauauuaauuugacaccugcaaauucuuuuugacaaaaggaauuuucagauaacgucugcaaggagcagguggugcugaggaaacagccacuuaucuugaauaaugggaaggcagagacaacugaggaugccagaggguggagacuaacgaggugucacucgguggaacugaggaacaauggcagacgagacaccccagcgaggccacgcacccgugggacugacagagauggugguggcagcagagcugggucucugaggcucugcugcgccagcucuugcaucaccaacaccugagcacacuguccccugcgagcaguggcucucagcgagagggaggagcauguggguuuaucacaaccauccugggagagcaagacauuugcaacacagaugacaaagugaaugucccaaauauacaaagagcugcuacagaucaauaagaaaaguggacgaaggaucugggggcugaagggggagcuuuuucaaaguacacauaccagcugggcaugguggcucaugccuguaaucccagcacuucgggaggccaaggcaggcagaucacuugaggucaggaguucaagaccagccuggccaacguggugaaagcccgucucuacuaaaaaugcaaaaaguuagucagguguggugguacaugccuguaaucccagauacuugggaggcugaggcaggaggacugcuugaaccccggagguggagguugcagugagccgacaucacaucaccgcacucuagccugggcgagagugagauuccaugucaaaaaaacaaacaaacaaaaacaaaaaacccacaaaaacaacaaaaaacacauacaccucuccauacucuccacgcucaagaacuucuggaacaagaccacaaaaccuuccccuggugaaaucaugaggaaaugaggaggaagauacaaccacacacaagcucgccuccugcugcugacaugggcugggagcaugcugggugagacucaggccuggugaggaagcgauuaagggcccaggcuuuagugccaaacagaucuggcucuggguuugggcucuaccaccuccuagcugugugcaggucaugugaccuccucaggccauaguuuuuagaaaugcaaaauggaaguaagacgacuccccgcagagaaccgucgugaggguucuacagacacaagugaagggucuagcgcgauuccucccaugguaaugacuuccuacaguuaagaaucuuccacgacaaccugugccgcggggcugccuagcuggaagugagagccuucgcagcgagcacugagguuaacuuccaugagugaggacuuugguaggagaggaccugccugucuggcuguguuccugcuuaaccuaacaagcuuucauagucuugaaucccagggagcuccaauucgagaucagggcuguuuggaaauacuugaaaaauccugagagggcacuuucuagauauccuagaaaggaaguuucaggagaagaugggcuuugucuuguucaugguuguuuucccauugccaaguacacagcacacccucaggcucaccaaagauuaagcaggggacacuuaggaaugugauucuggaaagcaaccggaugggguaagaucaggacucaucacuaaugaugaagguccccaaaucccuccucuagacagaaggggaagcagaggcucuucacugcuguuaugguaccccucaacugucccccagagcaguuuccacacccuccccagugcaggcccacaagacgugccccaaaacccugacaacauuuggcacuucagcaaaucgaguuuccacagccacagccugaacagcgcuguuuaauggacugcaucuccgccugcucccuuucaaugcgcacacacaaaaaccaauuucaagcacagaaagcuggaugggauuaaacaacucaguuuaaaggacugaaaacucagcugcuuccagugaaguccuagggaaggaaccaaucagcaaaguucugcucuucuuuuuuguauugaaaugagggcugugacugugcagugagucacucccaacucgcaggcagaacggggccaaguccaccugggccucgcgcugcaggggguggugcacgaagagagggugugugugugugugugugugugugugugugugugugugugugugugugugugugugcaugggggggcgggggguaggcaggagaggccaagggcauacucacagaccaucuguuuuggauuuuucugguaauacagaaaaccucagaggaccuagagguugauaccugccuguccauuucucucuucagcccagguucgggaaagcaaauucaggcugcaggacagcugcccgggccccccacaagccuggcaccagcccagggaagacugaggagccucacuccauggggacuggugagcaauagcccucucccaucccccccacccagccucauccacucucugcagugugggcaggucuguugauucacgagcuggcugccucauggagauacagcucugccuacagcucacagugccuuggcgcucagaagaggaaagugggcugaggcucagcuuggaccgucagcaucugagaugcagccugaagagcugguauggauggagggaugggaugcugccgugcaaugggcacgcgcagcugcaaacccugccgcuuggcugggaggcaggggaacccgguaaaggaacaccacgcaaugggcauggcugagaauggaguguggaaagguguguguggcuggggcagacuccugcccagaugacaggaagagccaggggcccccuccaccucccaggccagccucuguacuccagcucucucagagggcucacuccugcugccugggaucugggucagccucucccucugcaccagcagcucuugguggccccaaaaaggcaaagcuuaaggguccaauuucaaacuagaggucauaauggaguccagcugaaaugaguaacacaaccaacgcuaacugagcgugcagcaggggcccggcccagugcuuagcauuuuacauggaucauuucccucucacaucccccuaugguuacugcccucauugaacagaggaaaacugagaugcugagaugcagagauacuaagugucuugccuuugggcagccucacuccaagccaagcuccccgccuguccugugcugccucccuuacugacacucugccccagcugcuccagaagggacuacagaagaguccucacuccuaaagugaguuuuuuuuuuuguuuuuguuuuuuugagacagggucucacucugucgcccaagcuggagugcaguggcacgaucucugcucacugcaaccucugccuccuggguucaagcaauucucccaccucaaccuccugagcagcugggaguacaggcgugcaccaccacgcccggcuaauuuuuguauuuugaguagagacggaguuucaccauguuggccaggcuagucucgaacuccuggccucaagugauccacccaccuuggccucccagagugcuggaaaaacaggugugagccacugcaccuggccccaaagugaguauuaaacacagcuuuaccucuaggaaggaugcacuguaccaaaauaagcauaucucagucacuaacaaggggaggcagggcagccgauguuccauaaguacggguggcguuggugaccuaccucauccgauucauccgauaacgucugcaguaggaugggaaagaggcuguccgugugccggaacaucuggagggcagagaagcaggggugcccgugagugcucccuucgccccgggacuacgugcagugcagugucccgcuggugugcacggacccacuggucugcacggaccacuucccuccccgacacaaugagggcuccucgcagcaccugucacuucucugccggccaggguuucccuagaagggcaaugaccaaaaugcuaccaacuaugggcaggcccuggaaaaccaaggcggacccagaagaggccccuggcuuggaggggcccagggcucaccuuccgaggaguuuugauguagaggugguagagccacuugagaacugcaauccuggucaucaucccaauggccgugucacugagguggcaguuuaggaccugcacgaucccgucgaggugaagggucacuggggcucuuucagugcuguggguaagaucgggagggagagcagaggugaagcccaccauagcccucucccauggagucauggcaccacccugggccugcacauccugagucacacacugcuaaccaccgucuagggggaucgggggucagggauaaccugaucccacacauccuugcuggucucccaccaucccagcucagcccagcccagggguuugaagggggcuucucucucucccuuuccaaagaaguuuggagcuugcugcugggcuggaaccaugauaaccauguuuugggggaugaggaccagucugcugggcucccacucacuuuuccuuuucuuucuccagcaccagccuggcuugcacaggaggagaaacccucucccagucacugagcugaccugaccaggcucaaggcauuaaguucagacccuuucuuggaaaaacaaaaccaccaggucuggacuguaugagggaaggucccgauaacaacuguugaccuccgccaggcccuucaccggccaucugaaggauguuucucaagugaggucagggaucgaggcuugucauugugccuugccacugcaccagggcacucagcacauuuggccuaggagagacacccuugagaguuaagaccaaaaugcgcuccuuugaguuggggaagggguaaacacagccucugccuaugagaaacggauauuguucaggagguacuuuuguucuggugggcacaggaagcccccuggcuucuguggacugaaguccugcggguccccaaaguucugcuaagcagccugcgggacagcgggugcugcugggaggcuugaguugguuuuuugcccaaagcacugcucccuggcacaggcuggguuuucaaggugggggcagcauggguagaaaaaccucgggauauuggggaggggcucccuuccuaccgaggcacuacacuguacuucccaaauggugccgacaggugcaggccagggguugcauuuucuaaggaccugggccagcagaucaguccccugccgguauaaaaccgucucuucguggcauuucuaggcugcucaauuauucauuugcaucaggaacugauggcugugcuuuccucacucgccugcagccucucugaagcucauuugaugugaaucccuaaagggcaugauucugcgcucuguaauugcugagaggaauugcuauuuaauaugguuugaugauccccauggugcacauuucaggggcaagagugggcacaucuauccucugguggccaggagcuccgggcaugugauacagccacagagccuggaacugagucucugggcggguggccacugugauaucccuaguggucacguggcuggaaguuccuggugucuucugaggauaucgaaacacuuaaaucuuugcuagccugagacagacggggacaguacugugcagguagaggagucuagggcgguaaacacuggccccgucaaucucuuaaucaguuucucucaaguccacugucccgcagaaauacaacgcaagucacagauauaauuuuacaucuuccaguuuucaauuaaaaaggagaaacaggugaaaugaauuucaaugcuguuuuaauugacccaauguaucuaaaauauuagcaucucaacauguaaucaauauaacagugaauguaaacauucccaacaaaaucuauucucuuuuguguccuaagccuuugggaccuggugugcauuucaccguuacggugcaccucgguucagaguagccaacaggcacucaguagccacguggcugccgcggaggcccacacaacaguccacgccaggacuuucugaguguuuccuugucaucucuggcaguuuccuagccacucccuuagcugacggccagcauuuacuguuuuaucucccauucccucuuuuucccguccugcagagcuccuucccuugcguucuguuccacacacuuuuugggcuggaagaauccccuggcuagagaagcucauguccuggugguggaagagaugccgcccuacagcccaaggccuuaugcaaagcaggugaacagaagccacccccaccccaaccuggucuuuccugacccugugagccccaaagucuguagugagccccuuuccagcagaagccacagggacauguaggcugccaggguccagggugucacgaggaccccgugccuggcaaaucacugugacaagcuuggcugaaacaguacccccugggaggaaggccuuguuuuuccuuguuucccugggauccuuggaacugcucuggagcugcuggugaggaggagggcggugccgugaccagguccccuacuccacuggcauggggcaggaucaguggugugucugagccccuggggggaauaacagcucugauaacaauggcagccaugauggcugugaaaagugaaagcucuccugggcgcuuuccuacacagccucaagucacuccuuaaaaagcccuauggccuaaagcaugccacuuccauuucggggaagagggaacugaagcacacagauaggaagucaccuggccaagauuacacggccagggaaugguggggccgcacuuuggaucugaucagucugacuccagaauaaucucacccgccacacggcacagccuccugaccagggcagcaggcucagagagagucccugguggcaucgccuccacuguauccugggaggggcagcagaacggcagcuccaguguggaccagccccucugcacccaggggauaccuggcagcuccagguguccguggaaggagguuagcacacauuuuucaguguaauuuuguaugagaaggguagacaguggcucacaccugaaaucccagcacuuugggaggccgaggcaggcggaugauuugaggccaugaguuugagaccagcuugggcaacacagcaagacccugucucugugaaaaauuuaaaaaauuagcuggguguggugguacauuccuauggucccagccacucgggaggcugaagugggaggauuauaagaucccagcugcugccagcucccagcugucagcucaccuauggugagcuaugacugugucacuguacuccagccugggugacagagcaagacccugucccaaaagaaaaaaaaaaaaaaaagaaaaacaaggggaggcagaggacacgggggaagccuggugcuccccaccagugcacuaagaauccaaaagggccaagaugucaggcugguuggccccucggcaagcugagcucuguggcucacaguggcccuaagaugcugcuggccagccuguggggccucuccugcaaguggugcugugucagggccaaagaacggcagcauaucacggagcugguaugugaacuggcagcauuucguguauuaacauucuccaacuuucuccacagcaaacaccugaacacagcgaaccugaagguauagggcaucuucaggcugcuacugaggcgguccugccgcacucaacccagaaccucaucacuaaaaggaaccucaugguucagguaacacaauccuucaagguacggaugagcaagcccagguccagaggcaguacgggacccaucugagaccaugaggccauguaccaagcagucauucccugggcuggagacacucucccugggcuuuucuucccuugccuggcuggagguggaggucaugggaagcagguggacccuagaggaccaggcagacugaucuuagugccuaggaaagggagggucaagaucccagcugcugucggcucccagcugcucugcugggcaggguuggcugcugcugcugagcucugcacaugcucagcaggggaacuggggcucugggacccugcacucuuccuagagggcacacugcaugaugugcucaguuccccagcugcugggccggagccugagagguagcacccugcugucguggcuuaccuuacccaucaagaacagagggagcucacucaguuuaaaauacauuucugcaucaguuccaaaaagucuagacgagucacuccugggggcuucugaguuauuucaaggugucugcaaaauuccauuuucauggagcauuuucucauaaagcaucuuauaaugaaugucuuacacauacgcguacuacaguuuccaaaugcauggcgcugcugugacuauuaaaauauagauuuacugaauaaugcuucugauauuaccaauaaauaauaauaaguuccaguuguucucucagggagacagcacuucauuucuguaacgucuaacuuuuuacaguguucggguuacaucucuaaucaaaucagaagaaagguaaaucuaaaaauagaauugcuucugaaauugaacuugcucuuuaaaauacagauaauuauaaauuuuuucaaucagcagaggcuacaagcugggaaauacugauuucuagaacuuucugccugcuuauuuacagggcagcuagcuacaccaggagagcuggugucacugaagacaucaugacccuuggcaacagccugagccucauaguggggacuucauacaacaccuguuugagaacuccuaaaucaaaugaguuagggaggccaacugcaaaaguggaacucuccaacugcaacuaauaaaguuaaaugcacgggcucuggagucagacagaucuagcuugaauuccagcuuggcuacuaauuaguugagugacucugggcaagaaguuaaccucucugggucuguuuccucauuuguaagauggggauaauaacaagguucuuguaauaacaauuguagcuaaaguguguaaagugcuuucugcggcccaggcaccaugcuauguucuuuacauacuuaaaaagcuuuuaaaaauuauuauuauuauuauugagacagggucuugcucugucacccaggcuggagugcagugguacaaucaugacucacugcacccucaagcuccggggcucaacugauccuuccaacucagccuccuaagcagugggaacuacaggaaugugccaccacacccagcucauuuuuguauguuuuguagaaacagguuuucaccauguugcccuggacuggucucuaacuccugggcucaagcaaccagccugccuuggccucccaaagugcugggacuacaggcgugagccacugugccuggcuguucuuuacauacuuuaacucacugaagccccauaucccuuugaggucaguacuaucauuauacugaguuuaaagaugaggaaacugaggcgggggaaaucacgcuacuugaccaaggccacagccaggcaugcuggaguuagggcaugaauccaggcaguuggcuccaccaggcagagcagucacgagagagaacacacccaguggagacauuucucucuuaacccuuuccucagcuggcaagcaugcuuccuccaaccggguuccuucacguuccaccucucccuggggaguccaauuuuccaccucccauguauuucccaugcucuggaggguggaggaacccagaccuacagccaccucaccaccugcugcuuuuccagguggcauucuuccauggcuaagccuggggccaccaggggcuucccgaguaucgcaggaagaggggagaugagggagggggaagacagcuucugcucucagguuuagucaguuaauucucccuguguuucgguccaagugagaaaucuuucauaaaaaaucugggaugcaaggauugcuuccauggugauccuugaaccccugaaagugaauucagaauuucauguggaugugcauuuuuuuggugugugugugacagagucucgcucugucacccaggcuagagugcaguggcgcgaucucggcucacugaaaccuccgccucccagguucaagcaauucuccugcuucagccucccaaguagcuaggaguacagguaagugccaccacgccuggcuauuuuuuuuuuuuuuuuaauuuuuauuuuuaguagagaugggguuucaccauguuggccaggcugaucucgaacuccugaccucaggugauccaccugccuuggccucccaaaaugcugggauuauaagcgugagccaccgugcccagcuguggaugugcauuuuuuuuggaagaggguccauagcuuucaucaggcucuccaagggucaauggccacucagaggcacaggacugccaccaccauggcaguuuccagccaggugggaaugccuuucugccgugggaggagucuccagucuggccaccacccugggcagaccugaacugagugaaacugguggccucacguggugccuugggcaagcggcgcagcugaagaaucacagggugggucuggcuaccuggcaacucugcacgaucccacccguguccaagcucagucucacugugucaauacccgcugugggaagaagguggugggcuggagcccgggcauguuggcucugguuuuacaacucugaaggugcccagcucuugagcacagcuggugacacugacugugcagcugccacguggggaucucugucaccaaaagucaggaagcacuagaucauuuguucuuguuugguuuuuuagguaggaugguuuggauuuuagguaggauuuggcauuggcuccugaaugacaaguauaaaccaaaacccucguccagucuagcacuuccuggccuuggcacaagaacugagggcuccuguaggcucaucccagccgacaguagcacagucuccccagcgaggcagcggacagcggugccccucugcagcccauggcuuaagccuaccucugccuucuccuagaccuccccgaccucccccucaauccccauagcccagauuacagagacaagucuacaacaggcuuuuggcugccagagggaggcuuuuaaaucccagaucagauccugccauucccacuugugacacugucuccacagccuccagcgcaaaagcuaagcccucugcaggauacacaaguccucgcaugucuguccagaccguuccccgaguuccaggacccaguaccugagucugccucccccuuucuccugggaugcucagagccaccuggaacgagcucuugaccaccccacccacaccugcuccuccuuccagcccuggugugcaaaugacacuaggauagcgggggucuggcucacaccaaauuucuagaaggcagucuuucccucaccucucuccugccuaccccaucccacccaucagugaguccugugguucucaacacagagcucaaacccacccaacuuucuccacaugcugcuccuccccagccugagcccccauccccucugauggggacaacggugacagcucccuagcgggucugcauccaccgggccccuccuagauccacuguccacagagcagccccguucuuccucccuucucgucccugccaugaaaguaauacuacugaccccacgagacucagacaaagcugaaggauccgacguaaagguuuagcacugcgcuggggcccuggaagccuggcuauguugacuggcauuagcuguuauucccagccagucuucucauugccugggcucaggcaccauggcccucccuuucugguaacuucaccccucacaucaaucacuccucuuuccaguaacuuccuggcuacuucucugccucaccacuggaguaaaugaaugaaggucagggacacauucaggggccagcucuuaucuuggagccuacaggggugagcacaggcaggugcacuggaacgcguggcagcuaugugaaaaggagagaauggcaacauucgcugaucuccuccaucaacguaggggacuccuagugguacauuucauaaacggcugcaccugcgugcuuggaaaacaugcucagggugcugagggaugaggauaaguucacaaaugacaucgaugagggaagaacccuagcuaggggucuggggggaagagccucuugggguagagugcacacuuucucuucaugagugauuggcucucccagggcccagguucacugucaaguucaggggaaagaaaccccuguaugagacccaccauccacucuagccccagagaugccaaggucacccaaagaaaaagugacauggggcaaguccaggggacucagaccagggcagaaccguuacaguaccuuccgcggggagucccuucaccuugcagggaguauggagggagccccaaggaagagaauuauuuugcugccuggucugcacugcccccauguggaagacugcgccauuacagcugaccugggcgcacaggagacaacagcuccuggggccggugauuuauccuuaaucuuggacaugauuaaugacugcccaugcucaggcuguccuugaacagacuuccccuugugggucuuguuggccccccaucauccuggacaaacagacagcgaugagucaaggcaacugugucucacugcagucaccauguauuagcuguacuuuuauuauuauaacuugcguuuacugaccuccaauagcuuaauuuuuuuuuaauauuuaaaaauaaguaagaacaauccauuuucuuucauuccuuuuuuuuuuuuuuaagacauggucucacucuguuauccaggcuagagugcaguggugugaucucagcucacuucaaccucuggcucaagugauccucccaccucagccuccccaaguagcugggacuacaggcacacgccaccaggcccagauaauuuuuuguauuuucaguaaaaacagggucucgccauguugcccagacuggucuuaaacuccugagcucaagcgaugugccugccuuggccuccccaagugcugggauuagaggcauaagccaccaugucuggcccccaguggcuucuaauccgcccuaucuauccaucaagccuggguggggugggcuugcucaguguccuucagauuccuucaucaauuaacucuuuuguguacgagggugucccaaaagcagcagccgcgaguagaauuugccuugggucauugcuguagucucccgcauccaggaaagaucuaggccgcucgcuuuccacaaaccuucuggcugaaacaagccacuuaccuggcugcagugaagacacugaugccgcuacugaagcuggagucacaggaaccaucuggaccuccugggagaggaagaggaacaaggggucaugaaaggcuguuggcucucuugaauaaacaagaccccugugacaagcacacacagaacucuccagagccccauaccuugauucaggcucuucaaaaggaccauggcucuggagcccugaggacccaaccaacgcccagucauucucgauaguccccaagcuuguaagucuguagucacagugaucucacaaggaggggacaccagugcuaaacacaucugucaaaucucagaagggaucacuggccugaggggaauggauguuuaaaaugacagauaauacccagcauccuuagcuaucaggaaaaugcaaauccaaaccacaagauacuacuguacacccaucaggauggcuaaaauaaaagacaaauaauagcaaguguugaugagaauguggagaaacuggaacccucguacauugcuggugggaauguaaaauggugcaagcugcuuuggagaacagucuggccauuccuccaaaggcuaaacauagucaccacaugacucagcagcuccacuccuagguauaugccaaagagaaaugaaaacuuauggccacaugaaaccuuguauaucaaucauguucacaucagcauuaucuacaauagccaaaaagcagaagcaaccgaaauaucuaucaacagaugaauggauaaaugaggugugguauagccauacaauggacuauuauuuggcaauaaaaagggaugaaguacugaugcacgccauaaaaaugaacuuuaaaaacauuguguuaagugaaagaagccagucauaaaagacuacauauuguaucccuuucucgaaaguguuuagaacaggcaaaccuauggagacggaaaauggacuggagguugccuaggacuggaggagacgggggaauaggguauaauggcuaauggauucuuucaagggcacggaaaauauucuaaaauugauuguggugaugguuacauaacccugugaaucuacaaagucacugaauuguacacuugauguugggugaauugugugguacaugaauucuaucucaauaaagggcuuaaaaaaugacuuuggggaaaggacugugacugcacugugucugugcccgagucuuccuccaaguggccaacucaauaccugucuuaguauuuaacuuaccaucauauaacccaggguagaaaagcaucuaccuggcaucgacuacuuauuuuucucaguuaaggaauaaccuuuaaauuccaaccuuuuucuuuuggcaucuaaucaaguuuccuaaagagccaagauguucuagaucuggaaagcugcugguaggauccuguuccgccuucaguccccgucuaggcacuggccacagcucucacugcacugaggagggaagagggggcuggcaguccugcagugcuuggggugggaggugcuauaggaaaaaauuccagacuccugauacuaauuuuuuguaguugugaaauaauuuuagauguacagaaaaguugcaaaaagaguaaagaauucuuuuuauacccuuuagccagcugccccuaaugcuaacauuguacauacccauaguucaauuauuauuauuauuauuuuuuuuugagauagagucuuggcucuguugcccaggcuggaguguaguggcacaaccuuggcucacugcaaucuucgccuccugcacucaagagauugagcccaccucagcuuccaggguagcugggacuauaggcacguaccauuaagcccggauaauuuuuuuuuuuuuuguauuuucaguagagaugggguuuugucguguuacccaggcugguuacaaacuccugggcucaagugauccacccaccucagccucccaaagugcugggauuacaggcgugagccaccaugcccggcuccauaguucaaugaucaaacccagaagguuaacuucgauacacuaccauuaacuaaaugauuacccuaauuugaacaucacgaguuuuuccauuccuggccuuuuguuccaggaucucacacugcauuuagcuaaacugucuucuuugucuccuccaaucuguugcagccccucaaucugugugucuuucauaaacuugacacuuuugaagcgcuggucacucugcagaaugucuccccguuuggguuggucucacguuuucucacgaguagggaguugcgcaucauuggagggaugucacggaagugcugcgccucagugcacccuaucgggggaacguguugucuguuagccucauuacuggugacguuaaccucaucgccugacgcacagugucugcuggguuucuccccuguaagguuacuguuuuucuguuuguaauuaauaaauaacuugggggaagauacuuaagauuggaaaaauauucuguuuucccucaaacauguccccagugauugaccgcagcacucagggcuggagcuugccuauaacaaauauuacuguggaauuugccugauggugauuucugucuccccuuuuccuccauuauugacuaaaauuuucuuuucucuuucucccccucuccccucuccccucccucccucccuuccuuccuuguuuuuuuuuuugauacgguuugacucugucacccaggaugaagugcaauggcaugaucuuggcgcucacuguaaccuccgccucccggguucaaaugauucucaugccucagcuuccugaguagcugagauuacaguggcgcgccaccaugcccggcuaauuuuuuuuuuuguauuauuaguagagaugggguuucaccauguuggccaggcuggugucaaacuccugaccucaagugauugauccaccucagccucugaaagugcugggauuacaggcgugagccaccaugcccagcguauugacugaaguuuucuguaaggaagagcugucccuucuccaccauuaaucaauucaauuauuuaugucauuauggacuccuggauauugauauuauuccguggguuacaaaucaaaaugaucauuauuuauauuguuguucaaaugauaccagccuuggccucuuaaaaguuuuaaauuauacaaauauauccucauucuaaaauuuucaaacacaaagcaaaaccucuuucucuccuuaaucuucaaucuuacuuuucucuaccugcccaucaccgcuccccgggguaggcaagucucuugugcuggcuugugcuguccuacuucuuauuuuguaaacauaaacgggaucacaaaacuuauuuucugcaacuugcaucuuucacucuguccuauggcuuagagcagugcuauucuaggugcgggccauagaccuuuucuccuaguaaagggggccuuuauuuccaugucuguacugcugccugcccccuguagacccaggacgcagcucagaggggacaggggcagcuguggcagggggcugggcccgcucagaugcucguccuccuagugccaaggcccaggcagccuggugucugucugauggaccagggccuggggaaaggugaggaaaagcuggggaaagcugggcaggauagacuggaacagcagccaggacuccaugccccuggagggcaucuuuuagaaauacccacauuuauagaugaaauaauguggcaucagaaauuggccucaaauuaauuuagauugucuccagauuuucacucuuacaucucuccugugcuuucaugcagggugggacugcugaggggaaggauugggcacuucuuauuuuaauagguauuguccuuuagguucuaccaauuuauguguauuuccaaauuggaagagcaguuaccccuucuaaagccuuucuucaccuguacaauggggguaaugacaguaccuauacccuaagcuugcuaugacaaugaaugagcuaacauuuguuagguguuuaaaaugacacccaccauaagaacuauuguagcauuuuuuguuuguuuuuuagaaauggggucucauucucucccccaggcuguaguggcgugaucauggcucacugcagccucgagcuccugggcucaggagauccuccugccucagucucccaaguagcugugacuaaaggugugugccaccucgcccagcuaauuuuuuaaaauuauuauuuuuguagagacagggucucucacuuuguugcccaggcuggucucaaacuccuggcuuuaagcaauccucccgccucagccucccaaaguauugggauuacaggcaugagccacugcaccuggcccauuuguuacauaaaggauuaauggcccugucauggacuuucacauuuuucuuccauuucuuucuucugacuuaaaagagcucuuucuuguguuuggauacuaacucuuuaaugacaaaauacauugcaaauaucuucucccagucugggccuugccuuguaacuuuuaaccuuuuuucaguuacaccaauuuuauuuuguuuugagauggggucucgcuauauugcccaggcuggacuuaaauuccugggcucaagggauccuuguaccucagcaaacugaguagcugggauuaaagauacgcaccaccacaccaccuucaguuuuuaauuuaaauaugguuuguuucaauuuuuuuuuuuuuuaauaauuuuugcuugugggucuuguuuaaaaaauucuaccagguuuuuuuuuuuuugagauggagucuugcucuguugccuaugcugcaguggugugaucucggcucacugcaaccucugccuuccagguucaagcaauucuccugccucagccucccaaguagcuuggacuauaggcaugcaccaccaugacuggcuaauuuuuuguauuuuuaguagagaugggguuucaccaugcuggccaggcuggucucgaacuccugaccucgugauccgcccaccucagccucccaaagugcugggauuacaggugugagccaccgcgucuggccccuaauuuuuguauuuuuaguagagacgggguuucaccauguuggccaggcuggucucgaacucuugaccucaaaugauccgccugccuuagccucccaaagugcugggauuacaggcaugagucaccaugcccagccauaaacauguauuaaaacaacacugaagcacccguuaguguuugucaugugcuaagcgauuuacaugcaaaaauuuugucugaaacacacaaccacacuauagguuagguauuacuauuguuacccuacuuaacaaauaagaaaucugaggcucagaaaggguaggcagcugucugaggggaacagauauaaagucagcagagccaggacucauaggcagguuguucagaccccagaaucucugcugccauuccugagacaaucaggucacguccuggaggggaccaggcuggacacgcaaagugccauaagagcucagaaccagggaaacggcacugugcuguggauggccccaaguggcaggccaagggggagucggagcaagugaagaggcacagaugaggggcugcccugacuggagguccugugguuagaggaggagggagaagaugcggagguggggcaggggugcaaauaugcacacacacaaagguucuugcccggaggugugccaugaggaacguggugcugucggcggaucagcacaaguaaacaaagaaggccaggcaugagguccugucuccagccagguggaccagagugggaacagagggagcagagagggaagagugagcaggagaggcugugaugaacuugucccugaccagcgaagcuaucuguccugcggcuggcagggacugucuccugggcaccuugguaaaagacuggugauuaguuaguuacaagcuaagcagggcugagaguggauguaaaggcgccaaauuagcucuuaccaucucugggaacuaguacaaagugagcuuuucaucugcugaaaugcuguuuaugaggcaguaaaauccagagccaagaggcaugaauguauccugguuaggguaauacucuccugggcaagcagcugugugaaaaaaugcuuaggaaaaccaucuaaaaagguagauaggcugcacuggccgggaaucaaacccgggccucccgcguggcaggcgagaauucuaccacugaaccaccaaugcuccagcugguagggauguuuuuaguugaggccacgacccacaggauggagugguuccuuucuagcgggcuugacuucuugccacauaagcagaaagguggcaggggcuguuggguucuaauuuagaggaauaggcacugacuuuuuuuuuuuuaaauugagauauaauucauauaacauuucacauaacaaaaauuucaccauuuucaaaguguucaacuagguaguuuuuaguacauucacaaaguugugcacccaucaccucuauuuaauucuagaacaucuccauaaccccaaaaagaaaccgggcaucuguaagcagucagucccaauucuccuuuucuucaaacccaggcaacuguuacucuauuuucugacuauggauuaagaggcacugugaacuucaaacaaacagagcagaaggugaagcuguguuaaguucuaugaucuuaacuacguauauauauuaaaaacuggaaaaaauacaucaaaauuugaacauucauugccucuuggggauagucuuguuucuuugcauuuuucucuacuuuccaaauuuucuaaaauuagaauuagaaaacaaaaaucaaacacucauauuucagugagaggucacaaaauauguauccccgagucuucuaguuucucccaguaaaaaaagcuccucccuuugaaggcccgcacuagcuuaucccuccaaguuaacuuauuucuccaaguuuucuuuuuccaggagcugccaaaaagcuuucagcugcugcauuggccgggaaucgaacccgggccucccgcguggcaggcgagaauucuaccacugaaccaccaaugcuccagcugagugcuguucugccuccagcuguuuuguugcucugauucacaguggugauggcacagcuguaaccugacaccugagauggguccagcauggacagcugcuggauuuuaccagccaaaccuaugggaggagguggggcaugcaugcuugacauucugcucagcuguucaaaagaaaaguccaugaauggcaaugggagaaugcucagcaauucuuuuggcuccugugggcagguuccagaccuuacucuguuauccuuaaagaucugaguaggcuuagucuucccuauaaaaaauuucuugacaaauuagcugaaacugucauucacuuguuucucuuguuuuauggccuuguggguuauucuacugaaugcugugauuucuuuuaccacugguugauuugucuuguuuugcugucuugccuccuugacuagacuguaagccucuggagcacaaggacuuugucugguaaacacagcuugauguauaacagauguuugcuaaauguuagauuuguaauaaauggaauuuaacuagaaaaaaaaaucugaguagguuauaucucaguuuacucuggcugcuucggcaaaggaggacaucaacccaaagcugaucagugaccucuuggugaggacagagacccaagaaauaugaaagcaucaggguucuagauuacaucuggagucaaauuccagaugccagucggcauaaaugugguuucuuuuuucuuuuuuuuuugagauagggucuuucucuguugccuagguuggaauacaguggugugaucauagcucacugcaacuucugccuccugggcuccugggcucaagugauccucccgcuucagcuuccugaggagcugggacuauaggugugcaccaccauaucuggcuaauuuuuguaauuuuuuuuuuuuuuuuuuuuugguagagaugggguuuugccauguugcccaggcuggucucaaacuccugaguucaugcagauugccucagacucccaaagugcugggauuacccagcccggccauaaaugugguuucuuauaaugcaguuuucuuuaccuuacagcuaaacaagaaaauuauguuagaggagucugaaaggagagcagagcaacuucacuuuuuaaaggcacuuauuugggcaagagaauuuucaaguacagaauaaaucgaagcuagagcuuucuuaacccucccacccugagaaugacccgcaugguaaaggcagccaggcuucuugguggcuggacgucuacggccaagaaucaagugcccccugaauccugguacuccucccaugcuccaaaccuuccugcccugaaaacaacucuuucccgugaauccaggaaaaagaugaaggaaaggcuucauggucuuugaggcaggaaggguuaagaucauggcugcuggagacagccugccuggguuccaauccgguuccagucuucacuagcugcgaguguguggccaugguacucagcuucccuguguccugucugcagaaugggggagaaccacugcugccacugcgcuggguugcugcuacaauugugugagugacauacauaaaguaguccugguugcuuaagugaggccccaaggcaacuccuaugacaucuggcucccugggcccccgacaggaggugagguguagggacggaguccacucaccacuggcugugcccuccugcuuuggcagggcaucgucaggggugggcucugccugccucugcccaggucucagcucauccagcucgucguccucgggggugaccagcuucaucaggcucugguugcacacguuggccacuucuuugaugccugaguccacugauguaaggagcgugaucugauuuggaugccugucucucuaaaucucuugcugaaaugugauucccaguguuggagguggggccuggugggagggguuucggucauggggguggaucccucacaaauggcuuggugcccuccccaugguacugagcgaguugagugaguucuugcucuauuauuauucaugagggggcucguucuuucaaaaagccucccaccucucuugcucccucucuugccaugugaccugcuggcuuccucuuugccucugccaugacuaaaagcuuccugaggccucaccagaagccaagcagaugcuggcaccaugccuccuguagagucugcagaaccgggagcugaagcaaccucuuuucuuuauaaauuacccagccucagguauuccuuuauagcaacgcaaaauggguuaauauagaguggucccagccaggggaggcuucucugaaccucguauuccuagucuggagcucagucgucucagggcuacguuaggcagacaggcuguccgaacugagccccugcucuccuugucauacuggugccccugugaaaugcgccuauuucuucucuuaggaccccuuccuaaacccucccaccaacaggaucuccccagcccaagguggggcaguaugaacucagaggguuggaacuuuggggccccagagagcugcuccagaucugcaaguaaccaggcaagguguggggacagccagcaucagccccgggucccuggcuuuccuaauccacguuuggcuccaucucuuuuucccgagcugcuagggacuauggaagugugauggauccuaagagagcccccagcccccagugcagggucccucaacuucauaaucccuuuggggcuucucucaauuauucucucccaaagcaaaggauacuuuucuugcggucaucguaggccaagcagggcaagacagcagucaggaucccggaggaguaaggcagcaugacgcggcccgccagcuggaugaacucccgcauccagcacauggcugucagcuggaugaggucaucuggaaggggaaucaggggguucagaggggccagcacacgcagcccgagugcucccucccauugaccauacacgugggauggggcuggcggccuguggaacccaagcgccugacggcuuccagccucaccaaugcucuacuaccugugugcuuugccuuccaaagguggagacacaggcugggacggagcaacaauccugugcuagacuguaagggcagccgcaucccugccccucugcacugggacucugcuccuccucucaucaagaguggaauuaacuucuccaccccuugaaucugggcuggccuugcuucuuuggccaaugagacgugguggaagugaugauguggcuggaucaagccuaggccucaacaggccuugcucacuucuacugucugucuuggaaucccacugaugccauaugagcaugcccaggcuagccugcuggacgaugagacaugugguccagcugcccccauggucccggcaugacaugagccagacaacugccagacauaagugaggccacuguggcccauccaccccagcaacccuacaguuaacagcagguacuugauugagccuagccaauccuggcccaggugaguggaaccacccaggugacccacagacuuaugauaagugacugcuguuuuagggaaugacguuuuguggugguuugauacucagcagaagugaacagauacauaaucccaagcuccaagcauuucaagucucagggcuaaggccaaguucaccaguaaggaaaccuccagaucuuacuccacacaggccacacacaccaggugaaaggaccucugugucucuguggugacagaacccagaccucccucugugagacccagcacuccaccucucccagggcccacugucacacuggcuaauauuccuaccaggaaucuccccugcccccucacugaagcugagauggugaaaggggcuucugcagagguggcaguggcagcagcaguggcagccguggcugugggcccucccccaauacucaccuguugucuggcaguggaucaccaggauguuggccaucucagcaaacuucacacuggagggguucuucuuaauuucuuuuaagaauucuccaagaacaaccucacaccuaugaacaagaacaggaaaguggaaacagcgagggucagccagggcuggaggagccucaaaccagccccauuuccgugcugggucagccacccagagggcggcuuggcuuuuggacuugucaggugaucauuuucagaugcuggggguugaugggcucuuggcuccucaaagcgggaagcacaagagccaggaagaagaggugauuuccugcccuccugccgcggccucucugugggcaugaagcacaugggcacagcuggggguggcaggaggcagcagcuuccugccccuuacuccacucacauuuugcgaaucucuuugccauugucacccaggaucuggaagaguccauccaggaucuccggcagguaauccagcagguuaaugucuggcaccgacuccagaaccaggaucugaccaggggaagggaacaggaggggaagucagcuccagaacccuguuuccugcucaccaagccucugggacugggcuguaggaaggggacccugcugagacagcauuucccugcagugcaggugucccaugugggaggagggugcuggcaaggacagucagcauuucuuguuuaaugugcaggggaauggcaauuugacucuaaggaaauucggaugcccaggggagaaggggauggauggggaaggacagaaaaggcuagaaaaagugagauugcuggaaguagcacugcuggcuuuaaaggaaacucagguguuuucugggacaaggaaagaacuggacucccuuccagggcaacaagaaccugaucccuucagggccaacaugguggguuucgggggcaaagcugaauaagguguuuuugaauuaucagguguuaauggcuauucaagggagaacauggaggguuccuauagccaaagggccugacaagagugugcuagagagcagauuuuccaaacuggaggcuggagaaacgguguccggccaggccuuacccaggagaugaugaacugccgggcauacugguuguuggaguaaauccucucucgcaacaaggggaugaagcucaccaggucaaacuuguugcucucagucacaauguccuguggaucagaggaaagugagcugccgagagcccgagaccagggcugccugaccucgcugaaucacuugcccagggcuggcuccagcgcucaggcggccaccaaggaaaauggcagauccugagcuaggcauaagaggucucuggaguauucauccugucccaguccacgggauacgaaaaacggguagauugaaagcaggaagcaaagucgagagaaccaacugaauggcaagacccuacucucuguggucuggauggaaugcccaggccccugcugucagggccagagagguguggaaagugacaggcaagcuucuuugcucuagguggcggcaacaaaaggggacauuuugggugauggcacaguucuguauuugauaguggugauugagcucgauauucuugucauagaacugcacaccagggaguacauguaaauuuaaaauauauuuuaaauucaagaagaacauucccaaugacagaauuucuaagcuuuacagacagacgggagaaacagauuguagaaauaaaaguggggacaaaguacaaauaccuuuaaaaggcggucuaggagcucagauccgcuuuucacauuggggucugggucggcugccagcugcaagaggcacagacaggggagggacacagaggcgagggucacgguuggaugcaagaccagggauuuccugcaaauccgcagccgaggccuuggugcagcccagaacaucuagcaagaacaucacccuuucggugaacacauuugagaaaggcugggaaagugggaguggguacaauggaguuggcugaggagcagauucaggaaauacccuucuguucagggacuucucccaugacccgcugggguuccuguucccuguugugacugggucacgggguugcuucccgucagccuuccccagggguuuccaaucuuaaagcgcuggguccuuguuccacuccuggaggaggggacaggguagcugcgaggcugauacucuagaaacuuccguggcauucugcaggggcagcagcauugcagggcugcuccgcgccugggaagggaacuccaccaggcugcaagaggcacggaggagagcaugagcuuuuucuagggcacuuaugagcuagacuaagugcagcccucccuaaagggaaaguacggucuggaugauggcgucagcaucauccccuucuaccagggaggcgaguguuucacagacuaucagcuucuucccucuacuguauggcagacugauacuuauaucaaaugcaaucaaaaugaauuaaaagagaaaugaaaaaagguauaaaugcaaguccauuaaaaaugauuagauucaacagacaguaagugucccuugcagccacaugcuuguuugcucugcuugcaucugggaaaagggguccaagguuccagaaggucaagugaggugggggaaccaagcgcagcucagugaggaggaggaggagggcgguuaccuugcucagcccgucaaagagcacguugaaguggggcagcacagcgccccgggccaccuugacgauguuguagagggccucgcaggcauaguagcgcagccugcugucugcaucauugaagcaggucagcacuggcucgaucagcuccuucagguagagcccugaguccugcaaggaggcaggaggagaagacagaucagaauggguuggagcccaggcccugcagccugcagugccagcugacaucccagcucccuugaaggugcucaggccuuugugugagggcugggcucaaagacccuucccaagccucauucccaggagagggcccaugccuaggggaccaggcugcaaggccgcaaagccagccuugcuggucucaggugcggacagagugguaauaaaacauaggucugcaaugcccuacugggucuugacagggaaggcaucgggauggcuuggucagcgucaaggccaggacugguaugucugucccuugggugaaaggcccaccuugcccagugcgauggagcaggcggccaggccgaugaggcccccuuuccggcugugggggugcugagacagggcaaacuccugggacagggucuggaucacaugcuugauuugcacgguauuguucugggccacgaacucccggaccagccuggagagagaggagagaggggcugugggaaucaggcuaccucugcuguggccuccagggccuggggcggcaaugaggaagggagaugaccuguuuggaaagaggaaaugggagacaggcgucucagggcaggucucaguucuguugcuggcugagucaucguuguuucccuauucugggucucaguuucccuuuguguacaauggaauaaggaacaguggugcuaucucacuucugggaaucugagagaaugcaaaucaaugugucacuggggaccaaaaaagugcaaugcauuaucaguugaucaacugucuuuauucaacacuuacucagcuuuccauucgugcaucucagaaauucuccgcgucugagcgacuauuuccagggacguugcugggacacauagcugaaucaggccccaguguaauggguaagagccacaugccaacaaauaauuguagcaaaguggcaccagugauaucacagaagcaagaaaaggcaaugggcucagucuccucgggccguccaggagggcuacagggaggugccggcugagucagaucuuaaaaacaguaacaggcacuuuccagguaaagaaaggaaggcagagcaccucgggcauagggaagagccuggccaaggccacgcaagcugacauggcauaucugggacaggaugagggcuccagcguguggaaggaguggcuagagacagguaaagaaaagaugagccggugaaaguuuuccagcaagggaugacacgcucagccccauguuccaacuggacaucucuggugguggcuuggagaagcugggcuggggcaggcauggguuugacgggagacugaugccggggacguucaggagaacacuguagcuaugggguaaggugguccugaaaugugacugaggcagugggaaagugcagcagggacuguuucuagaauuaaauggaaaagcacuaauagcugauauaagaggagagaggaggguaggguagacagugcccccaggugucucccuggacagugaugcugacagggagaggagcaggucggagggaggcugcccucaugggagggaggggcugcuggucacccagggaggaugacucccaaggcaggcccugcccugaguggaggagcugagggaggccuggcuccacaacagacuagucuguuuucagagccccauggacacaaaggccaggccucugcccucccaaaucucacauggcaugugguggcaggagugccccagaucacugauggaggagaggcagcugggguggucaggggaguuuuccuggaagugggauggagccggaucuucaaggaggcagaagggaaagaaacgggccuuccuggcaaaaggaacccugguagcagaggugaggaugcggaaguagccaaccuugucuggggccccagagaacaguacagcagcgggaugggcugcuggugguaacuggggaaucuccaguuagaagaauagauuucauguaccagggagcugggcauaugaaagacugucuuaaggagccuggagaugcuugugaaaugaggacaggaagcgugagggaugacacugguggagccacugaagguggaaaaagggcagucuagagaccucagacuuuaaaaaguaacugcaggcacucucucuccuugcuuugcaucaaaucauggcagguaucuugcucaccuguuccacaaauggggucucaaguugacuugaagaauuuuaagaacagucauguccaaaagguguccauuagucugugugguuccagcucaggagcuuucuaauaguuagagcugggacuuucuaguaauuaaaaccaacggugcuguccugugagacagugagcacuccggcaaaaaggcuguucaaagagggaccgggcagugguucgguaaagauuuaauacagccaaucauauggagcaccuaucaugcgccaggcacuguucacgcaagaggugacaaaauaggucucgcucugggcugguggacguuggagaggagauggaugcuucaggaaggagcuguacaaguggccugugaguugccccuugcuuucgucuuuaugggacugggacuguggaugaacccagggccucuggauagaaugugaacuccaguucauaggccucaacucucaaaacagcguacuaaggccuggcaaggaugguucuacaucaacuuguuuggucucccaaacuggacaaaccagccaggugagacccaaucaucuggcagagugccuaaguauugacagacacagccccuugccaaaagcccugcagaugcucuaccaaacagcuggagcauuggugguucagugguagaauucucgccugccaugcgggcggccgggcuucgauuccuggccaaugcaaugaaguguugcuuuuucugccuuuugcuggccaguuuuccucacagagagauccugcuagaggagccagucagucccuccaacuacaccagaccugcagcagccaagggugcccacaaaucuggaaccacacuucccugcuaagugcacacaugagagcugcuggguucuccagagaaacacucacuauggcuguggagccaugaacuugaugccuucaccuuaaggggacuccuguugugcuguccucagccuuggccagucuuccgcaggaagcuggcaugaaaccugagaacaguaacacaguuuaacacaagacuaaacgcagaauguggugggaggacucaaacaguaacaguuuaacacaagacuaaacgcagaaugcggugggaggacucaaacaguaacacaguuuaacacaagacuaaacacagaaggcggugggaggacucaaacaucagagggggaaaaagccccccaaaguuuuaauauacuuuugcuaccaagaaagacucaagcucuaguuucugucacaaggucugaaggcaaaucaacuggacacgcacacccuccugcuuccugccuucucccuccugcucugcagccugaguguuccauucuugcaacugugcugauguggcagcaucagagacuggcuucauauucuguuaaucaacuuauaugcaaggaggcccaagaaugggguuaaagggaggugcgcacacagcugcucacaucuggggcauuggugguucagugguagaauucucgccugccacgcgggaggcccggguucgauucccggccaaugcagcagcagaccuuuaguuuaaucgugagagacugaauuugagauuucacacugccuaaagaauuuauaaauccacucugagaacugagaaugacuuguuucuaguuggauuucaaaugccuuugaugaaaacacuuauuuuccuaaauucugcaaagaucuagaaccuggucuccuuguucuugaagaauccaggaugugggaugcaccuaggcccgcuaaagcagcugugccuccccacgccugcccaggaagccaggacauguuuccgcuuggcacaaguuacagcgacacuaggagugggaguggggacauccucgaggcuucagcaagggguccaaaggaaagccaaccugcacggcagcgaaggccacccuggagccaccuccucuccugucuccuuguuucaggucacaaacauuccccgagcaacuggacaggagacuccuccugugcgaugaccaguggaugagagcuauucccugcccccaaggagcucucugccagcgugggaagaggaggaaagaagagagggcuuaaggaauacugugcaaacagaaaaaacacuugguaagaagggcaugaggugacucggggcaggccagaaagagaacgacccgugucugccaggcagggauguacuagggcucuauaagggucagcauuguagacggguuuugaaggaugaguagguguucguucuggagcugguuaggaugaggcugaacaaaggcucagaggaaggaggagcaggcauuugguuuggcagaaagaaaagccacagguggaggggaaguaggugacaggguuggaaaagcugcucccagucaugcagcaagggacccuggacacuuggcaaaggcacuggcauuuagccccgguggaugugaggagcugcagaagaccaugagcucgcacgugaugugaacuuuaggaagggcagucugccccagugggugguauggguuugaauggcacuuaggaagcuuugaagaguacgaggaaaguggcucugaugucggagugacagccugcaaaaguaacagggccuccugagggaggcaagggggauuucugugcugggcguucccuccccacccccucaccuuugcaaagagcaaaugucuucuugcuuggcaccagccggaaggccucccccaccagaguccuacuaggacucaauucagagcaccccaggccacuacaaaaaugacagcccauucaggcccuguggccccaggaacuccaaguuucuacuguuuccgccccugcacuuaaggguagaauauucuucaucuccaggaaaacaggcgucaggcagacaaacaauggcuggagggaaaaccauggaacacguccuuaccaauaugucagucuggagagcaccgggccuggggucaaccccugggccaccggcaggaagaaucuguuccacgaaucaagccuacccuacuuaucugacacuuggggcaagcaaaacagggccaggccgaccucugaccucugcagccuuccugcugggcucccagcacaggcuucuacuccagccaggccugccuucuuacugcgcccugccuggcccaugcugcaccucccaucugcccacucucuagaaaagcuccuggucccuuaaacauucuacccagcccucaaaguucagcucaaauccaacccccugccuuuccugaugaucccacgaagugagcgcagaaggacucaggaccccucauucugugcccagcaacauguugucgaaugucagcagguaaauuccuucuaauuccuucucaugcgugauuccuaccuccacaacuuuuuuuucccuuugagacagagucucgcucuguugcccaggcuggagugcaguggugcgaucucggcucacugcagccucugccucucagguucaagcgauccuccugccucaaccuccugaguagcuggagucacaggcgccugccaucacgccuggcuaauuuuuucuauuuuuaguagagacgggguuucaccauguuggccaggcuggucuugagcuccuggccucuagugauccgcccaccuuggccucguaagugcugggauuauaggcaugagccaccaugccuggacccuccacaacuucuugauaaaguccuugaggacuggcaccaugugucugcaucucuagcacuaggccucucuccgaguucagaacuuugagugcaguagguggggaaacacuugucaagacgggcaggggugacaggcagcuugagcuguggggaaaaccugggcaagaccccacacugccauauuggugacaugggagugcuuugcaaacccaaaccuaaccugcuggguuaaucaauacugcauuuggacgguccucacccucuacucuuauaguccagguuagcaggagcaaagggcaccauuacuaggacccaaaaaugcacaucaagaagggcucaggucaccagagcuguggcugcuggccggggaaaggugcaccggcuuggaugacgccugaaggacaggugaaggcguccucuaaccccucgcuaggugcuccagaacugcccuagucagccagccugugguguggucucuacuucacagggcaagugcagagacaaaaaaagaaacuacaaggggaagcagaguaagugcaguugaaaaccugggcagccccaguuccagguuuagugucucuucaaaagaccacacuaucccuccuuucaucuacagguugggagccagaggugggggaucugaggcugaacuaguuuugaaguuaguaucuggcccagaaacucucacgaucacaaaucccuggagaccuucacuaaugugaagggcauggacaucgcugucuuauacaccagagcagggauccacuucugccugguuuccuccaaaaagugcuaaagaacccuggcuggagagguguccucuagaggcugcucagagccuggguucucagcuggccaguggcauugcaggauggcaggaacacccauuccccagaagauacaagccccaaggggggccaacaucaugcucuugacgccacccucaaugucucaaagacugccacacugacuaccugacaggagaagcagccauggacacugcaagacacaucuggacuuucaugagccaagggagagccuggggccauccagcacagccacaggaccccuuagcuuaacucuguaccacagcacagugacagucgcaagagacugucacaggucacaugaggacuauugaguugaccacuuccuaagcacucacacucugcugaguauuccaggggucaguuauucccgacgauaccuccugcuguagcuauuauuauuucacucccaucuuccagaucugaaacaguaaaucaagccccuuuccuacggucaccaaaggucugaacccuugacaucuaccaaguccauaucccuucaacuaugucacagucccucccucccaucucccuaagccacuucagcugcaaaccaauugcacccaauuacagauggcaauucccuugugcagaacuaaggcccccaagugaaacguagcuuucucuauacacuuucacacagugcucggucaucgccaaggcacuccuuccauacacagggaguacagaggaggugccuacuugagauguuuugaaaugaggcucuagcgcuggucuucugugaacgcaggacacagugaguaaccaucagcugaguacuuacuauuugccaggcaacgugcugcauguuuacauacagggucuaauugaaaccuuaaaacaagccacugaguuaaguaccauuacacccauuuuacaguuuguggaaacugaggcucagagaaguuaagaaauauacacaaagucaugcaaguuguagaugauggaucuaaaaaucaaaucuaggcuuuucuaaccccaagaucuaaaaucuuauccacuauauuagacuagccccuccccaaauagcacagcuaccaccagcugggugcccacugugugccaggcacaugauuucauuuaacuccaaucccaugucauuuggugauggcccuaugucccaaccucuguccuagguggcagagguuuuagccacugaacucagguucccauguguucagagggaacauccucagcuguagguggguuaaucaugacaaugacuuuacagggcuuuuagagaauuaaauuagguaacugcauucugugcucuguacugcacaugcucaaauaacaguauuagugcaaagucagaaucagagacaagcugugaucuuauacauagcacacgagguugugcucauuccauaaauguuggcugggcacccaccaaccaaccuagguuggaccuaggaaugaacugauuagaaaugagcagauaugacguaggaaugagcauguacugagcauacaguggauccaaccaguggaaaaaacuacaaaggagaagcaagagucagugacagcaggaggcuuguuuugaucucgggugacaguaguugugacuacugaauaagugcuucccucagacuguaacaaaacagcacuaauuuaaauauugggacacaauucacauaccauaaauucacucuuuuagaguguaggugucagcagccuuuuguauauucacgaagcugugcaaccaucaccaccgucaauuguagaacauuuuuuuaccauccccaaaagaaacccugcacccacuggcagucacuccccauucccccgcgcccuaggcaagcccgagucuacuuucuguuucuauagauuugccuauuuuggccauuuuauacaaauagaaucacacaauauguggccuuuuaugguuggcuucuuucacuuagcauaauguuuucaaggggcuuuuuuuuaaaauaagaaaacugaggcacaaagagguuaaaucagagaucauaaacucaaaugcccacacgggccaggcaggagauaugggggaagccaggagguaaaacaggcucugguuaaucugccaacagguggcaaagcucccgacgauuugcuuugcaggaaugcgggcccccaaagccacaucucccaaguccguaagauaauccagaaaccugaauuucacugugaaauuucucaauuuaaaauacuuugugauccaggccaaaccaaacaggucugcguguaggucacagcccccaggggccagccugugaccccggaauuaaacaauuuaaacagggucccacugcugauaaacagccaagcuggguggaauucugaccugcacuccaaaaauuaccuugagccacuggguaauaaauacaguuaugugccacauaaggacauuuuggucaacaacagacugcauauuccacaguggacccguaagaugauaauguuauauuuuuacuauacuauuucuauguucagauauauugggguacacacauaccacuguguuacaacugccuaacuauucagcagucacaugcugugcagguuuguagacuagggacaauaggcucuaccauauagccuaguguguggcagacugcaccaucuagguuugugugaguaacucuauguuguucacacaaugaugaaacugcccaacaacacacuucucagaaugcauccccugagccgggcgcaguggcucaugccuguaaucccagcacuuugggaggcugaggcggguggaucacgaggucaggagaucgggaccauccugccuaacauggugaaacccgaucucuacuaaaaauuaaaacaacaacaacaacaaaaaacaaccaaaaaaauuagccgggcguuguggugggcgccuguagucccagcuacuagggaggcugaggcaggagaauggcgugaaccugagaggcagaguuugcagugagccaugagaucacaccacuggacuccagccugggcgacagagcgagacucugucuaaaaaaaaaaaaaaaaaaaaaagaaugcaucccucugaagcgauacaugacucuggcaccuuccccacagaggugguaggcuccgaagaaccaggucaaccuucaccuguucaacuuucaccuguucacagagcuccagggacucgccucccccacagccagcaggcagggaggcgugauucaggagcucugcucccagcagcccucccuggggcuuugggcucucagggggcauggccugggccaccuagcaggagaguuacauuugcuggcuuugaacucaaaguucaaaaacaagaucaggugcguucagggagguagaaccacagauggaacucaaagcucaggaccacuagagacuugaccaugaguggcgcugucucucccagccagcagugagacagugggggcccugccuccaugaugccuggcagagcgagcacccaccacacugaucagagugccugcuagcauuucucccccacauuagacucuucugggaagacagccuggcaucuucccacccuuuucauuacgacugaucaaugacuauauuaaaauugaaaacccacaaaaccggcaacagccaugauaaaaauccuaaccugacugccuuauccuauaggaaauugugugguccugugggaauaagguuguaggggcaaaaguucuccagaacuuuguacaacuggaucccaacacuuagacaguuaguguggucacuuaacaccacacugguggucuuaagauucuggaucuggggguccuucaguugaggcaagcauccaucucugcauuuuuagugucugagaggccugucaucaugauacaauccccucuuauuagugguuuuaaugccucacuggaacaccauaggcaggacuggcucugucaccugagcucuguagaacugaaaguggcagcuaaaaccacuguggagaauuucaaguaucaaauuccuuuuauuauaaguauguccccuuucugguagggaaaaccagucaugcaguggggacgucuucugagacacaugaaccugaguuuucuugcuagguucuagcugugaaaccaugggaagauuacuuaaccucaaggagccuguuuccucaucugugaaacaggguaacaccaccacgcccauagggcagcgaugcaaaauaaaugagaugagggguauaccauggccaaaccaaaggaagcuuuucuauauccucccaaccauccaaaauggggcagacagcacuuuauauacgugcacucccaggcuucacuaugaucacugugauggacugaacagucccccaacccccagauucauauauugaaguucugauccacagugugacuggauuuggagagagggccuauaaggaaguaauuaagguuaaaagagguccuaaggguggggcccuugauuccauaggaucaguguccucauaaaaggagacaccaggcuggggcaguggcucuugccuguaaucccagcacuuugggaggcugcagugggaggauuguuucagccuaggaguucaagaccagccugggcaacauagugagacccccaucucuauaaaauaaauuaaaaaauuaaaaaaauucaagaacaacgcauuuguuacuaugggucuuacugagcuaaaaucaagauguuggcaggcuauguuauuuugugaugcucuaggggaaaauccauuuucuugccagcuucuagaggcugccagcauuccuuggcuggugguucccuuccaucuucaaagccagugaugauccggguaaguuuucuuacaucacaucacucugacacugacucuucugguuaggguuacauugggcccaccucgauaauacaggauaaucucucuauuuuuaagguuagugauuagcaaccuuaauucccccuugcuguguaacauaacauauucacaggcuccagggauuagcauggggcaaauauaggaggcuaucauucucccuaccaaaaagugguaacagcaguacugacagaugacaacuaugugauauacguauguuagaaauaauuagggcaauuacauaacaauucucucucuauguauacaguuuguaacaauuacaaugugcccacuacuacacuaaauacuugauaugguuuggaucuguguccccaccaaaucucuuguucaacuguaguucccaguguuggagauggggccugguggagguggcuggaucauggggguggauuucucccaugaugaugaauggccuagcaccaucuucuuggugcuguucuugugauagugaguucucaagagaucugguuguuugaaagugugcagcaccucccugcucacucucuuuugcuccugcucccgccaugugggacgccuugcucccucuuugcccuccaucaugauuggaagcauccugaggccccgccagaagcagaagccgcuaugcuuucuguacagcuugcagaaccgugagccaaauaaaucucuuuucuuuauaaauuacccagucucagguauuuguuuauagcagagcaagaacagacuaacacagcacuuuacaacauuagcucaaacaacucuaugcauauuauuauuaugcucuuuuuacagaugaagaaauugaggcacagagguuaauuagcuugcucagggucaccuagccaguaaaugggagcuugaaccccaguuccagagccugcucuuaaacaccaugccacgcagccucucaggaaauaggguaucuuaaaggggcaacuuaccuaagaacaggacuaagcacuuucauuuagggagcacaugaacugacucauuuacacuacauagauaacugccaauauucggacucuucuuuuguugggcaucugcagucugauuaaugagagauuaauuaauagucuguguuugcugagggucacuuugaccaggccaaaugaagaauauauuaaaacauacaauauccuauguguaccugacacauagaaagugcucagacaagcaaaaugcuggugcuggugaagcacagauaaguaagucaguaucuaucucuaagcaauuugugaagcauauguucugaggaaggcauugaacuaaccagccauucuucauucuaagcaugacuggagaagguuggaaacagaugagagggucuuugaggccagugcuucucaaacuuuaaugugcacacaaaucacccagggaucuuguuaaaaugcagauucugauuccauaggucuggagcaaagcugcagagccucuaacaagcucccaggugauccugaugcugcugucuguaggccacgcuuuugggcagcaagguccugagccugcaauguuauuuccccaccgaaaauguacggucauucauuuauucggacaccagcugucaagugcugccaggcuaagugcuaaggauaaauaaaacagauacauaaacagaacucucugcucuuaaggaguucacagucaaggcacugcugaguuucucuaaauuccacaaaucaagggcaauguccaauacaaaaugaacucgaucaaagacaaaacccuuacagaacugugugcagagugagaacagauacacagguugcgcuggaagcaacaauaauguugagaugaauaccucucucuucaaggacucaacagacgacucaagcuacaauaaaaccggauauuccugagaagcagagugggugagggacaaaacuaggugucaaggcaacuucaaagccaacaaaaccccauggacacggaaccaugccuauauaucauuucugggucccucuauucaguauggcaaugugcaauaagacuugcuagcauucgugagagucaggcauaaacaaaaagcuauauaaaaggagcagucaagaaaguggugucugaugagagaagcagcuagaugguuguggacauacugaguaugagagcugaauggaggcagggugggggauuucuuaucaagguccgaacccuuuaguuuaggaggaaacuaaaauccaaagcaacauuugauuuggauugcaagcagcaguugucaaccggggcaauuuugcuccuucaggggacauuuagcaaugucugaagacauuuuugauuguuacaacggauggagugcuacuggcauccagugggaagaggucagagacgcuguuaaaaauccugcaaggcacaggacagcccacuacaaccaaaaaucaucugccccaaaaugugaauggugcagaggcugagaaacccugaguuaaggaauuugccccagguuaacgaaugaaugucacaccacggaauagauuagagcaguccaauagagcauucugcaaugauggaaacagucuauaaucugugcugcccuauauagcagccaauagcuacauguggcuauugaacacuugaaauacggguagugugacugagaaacuaaaguuuaaucuuuaauaauuuaaauuuauaauagcuacgcacggccaacggcuacucuacuggacagaacagaaauacaauucaccuuuucugacucgcagacugguauucuuccaguuucacagccugcuucuuuccaauuuucugaaaucacucacucacuugacuuuaacacuaaaaugugacugggaaaaaacccacaaaaguaaaauaauacugcagaaaaaaaaauaaauaaaacauccccaguuaaacuuucgcuguuuuguacauugggaaauaaaguaaaauaucagaucauuguuacacauacauguaacaagacugcagaagcaagaaaggucaaauuauuucuacuuccacuugcagggaaggguguuauaacacagauaaaacaaaaaacucucugagccuugagaucacgaguuuuccgaccugauuucucuacuuggucacuaacaaucuccuucacuucucagaagcuggguaagaaaccaggcuggucagcaucaccugcaaauucuccggcuucugacuucucucucaccacagagacaacucucugauuugcugguuuggguggcaccgcaccgaagacucaccaugugccaugcacugugcaaagcacuacccauacaugaugucacuucauucucacugcagcccuuuguggcaccgggagguuaaaaagcugggaccaaaucacacagccagucaggaguaaagcagggacucccagauauggcucccaaucugcucuuaaacacugcgcuaagguaagggccuaaaaccugggaaaguaacccuggcugggaaggcgugagaagucccccuggggagcagagcagucaggggcugcauagccagggagggguccuggcggcucuuacuucucgaucuccagcgcugccaccuuccgcuuuucguacagcuugucauugagggcgcgcacgauguuaggcgugagcggcgcgaaauccuucucgggguucaugguggcagcugggggaaccucgcgacuccuuagcccgcggcugccggggccgcgccggggccaggggagucugcggcuccgcucugcccccggcgccggcgcauggaccacgccgcucuaggcuugccugccacgcuccgccgccucgcccuggaacccgggcccggaccccgcuccagcacaccugacccuggccgcuuaacaacucccgcccggcacuagcgggacucacgagacagcggccauguuacucgagucacaugacucuacagcacuuccgccuuccgucgcg

SEQ ID NO: 15819 - RNA, 25950 nt, Homo sapiens
ccccguggucccccagcuccccgccucacuccacgggcucggugaggccggucagggcacagggcgagggccucuugcccugagcacccuggauggugacugcggauaggggcagccagaccagcucccacaggaguucaacugggucugagacuucaaggggugguggugggagccccccuugggagaggaccccugggaaggguguuuuuccuuugagggggauucugugccacagcagggcucagcuuccugccuuccauagcugucauggccucaccuggagcggaggggaccuggggaccugaagguggauggggacacagcuccuggcuucuccuggugcugcccucacuguccccccgccuaaaggggguacugagccuccuguggcccgcagcagugagggcacagcuguggguugcaggggagacagccagcacggcguggccauucuaugaccccccagccuggcagacuggggagcugggggcagagggcggugccaagugccacaucuugccauaguggaugcucuuccaguuucuuuuuucuauuaaacaccccacuuccuuugguuugcuuugcuuugcaucuucaggggugaaccuggcggggaugggagguggccaagugcaggaaguggaggggggcagggcugaggaugcggauuuggaguggauggagccugcccaagggauguggaaugagagggaugccagggauggaguuccggcccagcccagcccagcccagcccagcccagcccagcccagcccagcccaggggccucugcaagccuggguugggggaggcgguguugggcugauaccuuggcuuugacccuugccauccucccucccucccucccucucucccucccucccucucucccucccucccuccaucuggcugcccccaggcagccccuagcagggacacauaugggacauuucagagacccaggucuggcccuggcaccuacauugagaucugagauccucugggaacccccagccugucccccugcagcugggaucuggggugggaaaggugagguguggggaugggguaggaagcagccaggcagaggcagggguguuaauuacaguacaccuuuauuaauacuggaaucuucacagugcaucuguuacuuguagcagugacuauauuuaaaucggggaggaugguguggagggggcggggaggagaggagaauuuuuccaaaaucugacggaaagaaaagaaacaaaugguucagaugggacggagggugggggagggggggagggugaguaggaaccaggagggcugccuggggugggggaauaaauuaaaaaaaggaacgaguuaacaacagcaccaggaaaguuacuucagucaaaagacgcuuuugaaaagaauauuucuccguacaaaaugagaaauuaaacgaacguaaagucccccaaaccaaaguuugugaugugggaugguuggcucggaucccgaggugggugggccuaugaggugguugcuaagucgacgcaagggcggcggggguggucucagggauggacaaggggauggaguagaguauguacagcccccggggcucacaggggagggggacggcggagucggugggggcugugccacacgagccccccucucuggguagccccugccuccuuucccaucaggaccucugacgcccaggucugcccacccacugccccucacucuauucccaccacauccugaauccugcuccaccgcccugccucggaagaccccugcagcccuggggagaauguguggcggaaauucuacccaagacuccccaaauaauuggucaccugcucuccuggccccuaaaaccggggcucugguguuggccugagcuccacgggcugagugcucggccaggcaguuguugaaccuagugacuuacuuacagggaccauucuucaucagcucccucugaugggacucuguccacaucagggccugcuuggugcccggaccuacccaggagcugcccagcucaccgcacaagaacucccaggagcucaagccugggaggcucagacccagcuccauucuaucaaucaaucaaucaaucaucaagaccaaggugcuccugacccccagguaggacccugcccuggggccacgaugcccucugagcccugcuuucccuccugaccugcggggccaccaggacucccuccgcucgcccuaggcucacgugcuuuuaccugcugagacuuggcgugacuuggugcguggggugggggcagccuugccccuccccuugcccccgcugccaccacgagccuggacuacagugggggccgugcugggauggcaucuccuccggcaacagagagucaaagccaaucuucccagacucgcucccccaccugggcuugcagccagcucagaccacagcagacaggccgggagccucccaaccuuauuuuggcuacgcucgagacacuggagagaacaguagcuuccaccgggcucugggggagccaagucccucccuucucauccugccauaggaccaccggggggucccugucccccaggcacucccagacacacacccuguaucguccccucucccccacacuuaguccucguccacagucagcuccauuuuauuauauucauaaaaugaccccacaccuccuacugcuccagucaccccccgaaagguggcuaaaacugugacccccaaaguuaaaagauugauguacccaaugagaaguggacaucugaaaacggugccuguguggcuggccggugaccccagggccuccggccuccuaacccugcugcccuaguuuccaaagagcugcucuggcccccuccagccagccucacggggugggggaggcgaggggugggagccaccacagggcccccaagacccccccccccaagcagccccugguuuccucccugagacuuggcgugggcccuggaacucccuucccacacggggggccuggccgcccaacuccaaccugccgcccuggcccccagcccccagcagacauccagcccagcgugcaccuggccccuccacagccgccccgccuccuggagggagaggggccugggagaggcagagagaaggcaagaggggaggagggggcucaggcaggggagaggggggccagcauuccaggaggagcugaggcaggaccagcccugggagaggccgggauggugaaagggaggccagccuggccccucugucaugggcagcggcccuggcucuggugcuuauggguagggaagaggcagggccccagaggaggaagaggagggaccgaagagcauaaaacagaccccgaaccaggcccaggccugcaggcuccguccuggccaggcuugcuaagaagucacuuccuguuuaaaugcuggaauccaagugaggugucuuuccauaaaguggcauggccucugcccuggcucuguccucucuccuggcugggccuuugcucugagugccugcggcucacagaccaggccaccugcucgcacuggggccugagaggauggggaggguggcgccaucauaagaugcggggcgccgaccugucguuggugacgguccugcggagccggaccccacgccggauggccaccagcaugucuucggccggggggucgcugguggcggcuggggguggggugggcgucuccuccguggggguggccgacagagcaguggggaaggggaacuggcccucacccagugcgugggcacccgccaccagcucccccagcuucuccaccaggcugugccgguuggccgccagcugcugcugcucguccucggccccugccccgggguacccggcugccucuggggaugggcugccccaggcuguguugggcaggcugagccucuuuggggaggccuuggcgagguccggugccaggggugaggcggucucgucgguauagaagacgcacuccucacugcccgcccgugugggccccauguagccgggggagucaggcaccgugggcgucuucacagggacgaugggcggccggauggggauggggccagcgcuggacagggcgcggcgcacggugggcuugguggagggugugcggcggaugguggccacgccggggggugcgcccgagggcaggccaguggccgugggcagccccgcggugggcagcccagcaguggaggcugggcgcuuggucuggaucaggcggcgguaguucugggcgauguugcuguugcgcgggaugguggaugacuugucaaacucgggcgggcccucgcuguccgcauccccauucacggaguagcagucguagucggagccugggggcacgggacacagugaggcccagggcccagguggccccuugcccccagcccaccagggugagcacagagggggaaggacggggcccuccuggauggcuaagucccagcugucccuggucccaccccagccccgcgggccugccuugggaggggaugguguccucagagcaggagggcgugguggucugcgugcuguagccgcuggaguacugcagcgagucccggcugcucuucuggugcuccaggcucaggccccgcgucagcaccauggccaggucacuggcggcgggggacaccuccucaccgugcugagggugggaaagugcaggcugaagccuugcgcccccaauccccucugcccaaauuccaggcagcccugccaggugguuggagccggcccugaggccacuggcugggccuccugggacugaccugggcgugaaggggggcccuggccagccuaccuuggcugcgaugguggcaggggacauccggggucgcggugccucuuccccgcuggggcccagggugcccccacuggcagggccuggcucugugucucgcaggagcuccacucgguccuuccuccgcugcagaguggcgccugagggcugcucaugggagccgaccuuggaccaguccugcagggaggguguggcaggucagggggaccacuggcccuaccaccuauggcccgggggcccgucacuguggcugaggcucaggguguccagggcuaucagggggucucugguucgcaaucacagccaagggcagagcauggagugugacuguggccccucagucccaccaggcccagggguaagauguggcugugugggcagugacuguaggaaauggccagguggcuugucucuuggggacaggugcugugugcacgcaccccuggcugaacccaggcccuuugugcaguaauggcaccagguggggagggcauggaugggaggggcagcuggugacuguccuggggccgggcugggagcacugaccgaggugggggagcugcacucgcuaacggacuggcagguuuccgaggccucggaagaugcagagcuggaggacuucugccaugcagaggccagcaggcgguugcagacagaggggccggcaggcagcaaggaggagaggagagaacaguuuuggucacagagcuggcaugcaggggggcgguucaauucagcgccuugcccagcacccacccccccuaccccagggccacggccgcugagugucugcagcagcacacagcagcccagagugcacacggugaacgcugacccaccugacagcccagcccugcgcauuuugaagacugaccacaggacucacugcugacggccuggauauggccaccgaggggaaaaagagauacuaagggcggcagcuggguguuuggucugagcaguuggguugauggugucacaguuuucucagacaggacacgggggaagugugaagccccgagugccacgcugagcacugagcugagcugccucugaggucucugcauggaugcaaugagggccgucguauucauaagcugagugcagggagaaguugggguuggagccaucagugcaguggucuuggggugggaugaggccaccaggcagcgagugcaguuagacaagauucaagggccaggcccguggcugcugaugcgcaucaggugggagggaagaggagagucccguaaaggagagccugcucugcggagaaggggggcagcugugcugaugcugcuggguggggccaucggcuuggggcacaggguguccauggagaccccgaggagaacugcuaccauagaagggggugggggaaggcuguuuuaaaguggacugaaguaugaaagggacacaccugcucugggcagugggcuggacuagguguucugcgaggccccccacuccuaaacaacuacaaagaauaaagaaaaaagcaggguagacacaggcccaugaaauccugagcaugugugaccggcaggguucccuggggcagacgccagcuucagcacagcaguggggacguggaucacggugagguguuggccugggaaugagccaaguuaagccagggcagcccccuuccuccagcucucugaaucauucuggauuuagauccccagauuuccugcagauucgaaugaaccaagaucaccaaaauaaaaggaaaccaggcaccaccugugaggauuuggaggaaauaacaaaugcagacuuuuggcaauaugacgguuaaaguaaaaaaacucaauggaaaaaguauuuggaaaacucagugaaaaaguucaacacuugcucaugaaaaacaauacaaagacacaagcugcuagaaaggaagcuaaucugauaaagaauaucuacaaaugcauugauacuuuucccucugagguugggagaaagacaaggaugcccacugucaucacuccuauucagcacuggaaaucuuagccagugcaauaaagcaaggaaaagaaauaaaaaacaaauggauuggaaagaaaagaaagaaggccaagugugguggcucacaccuguaaucccagcacuuugggaggcugaugcauaaggaucacuugagcccaggaguucaagaccagccuaacauagugagaccccugacucuacaaaaaauuaaaguuagccaggugugguggcacaugccuguggucccagcuacacaggaagcugaggcaggaggauaucuugagccuaggaauucaaggcugcagugagcugugaucacaccacugaacuccugaacuccagugugcgugacagagcaagacucugucucaaaaaaaaaaaaaaaaaaaaaaucacuauuuacaaguaacauaauaguauauguagaauauuaagaaagaaucuacaaauuauuagaauuaguaagggguuaacccuuuaacaagauuauuagaacaaaauccgaaaaagaucaaucacauuucuaaauaccagcagcuaacaggaaaacaacacaaaacaaaaaaacaaaaccacccuaaaacaucaguguaauuuacgauaacaucaauaaacacuaaauaccuagggaaaaaauuccaaugacagauaugcaagaucuuuacacaaaaacuacagaacaagcugggcaugguggcucacaccuauacucccagcacuuugggaggccaagacgggaggaucacaugaggccacaaguuugagaccagccuggccaacauggugaaacacugucucuacuaaaaauacaaaaauuagcccggcguggugguacaugucuauaauuccagcuacucgggaggcugaggcacgagaauagcuugaacccaggaggcugagguugcaaugagcugagaucgcgccacugcacuccagccugggugacagagugagacucugccucagaaaaaaaaccaaaaaaccaaaaaccucuacaaaacauuacugagaggcaguaaagccuaaacaaacagagggauaucugcaauuccauucaaaucccaggaguuuuuuuuuuuuuuccuuuugguaggaacugacaagcugauccuaaaaguuacauggaaauggaaagggccgaaaauagacaaagcgguaccaaaaaaaaauaaccaagcuaggggacuuccaugaccagauaucaagauuuucuauaaagucuggcugggugcaguggcuaaugccuauaaucccagcaauuugggaggcugagguggguggauugcuugagaguaggaguuugagaccagccuggccaacaugacaaaaccccaauacaaaaaauacaaaaaauuagcuggcugugguggugcacauguaaucccagcuacucaggaggcugaggcaugagaauugcuuaagccuggggacagagguugcagugagccaauacuguaccucugcacuccagccugggggacagagugagacuguaucaaaaaaaaaaaagacuuuuuauaaauaauuaagaugguuacaauaauuaagaugguguggcauugguauaaggcagagaaaucaacaaguaggacagagugccaaguccagaaauagccacacaccuacagacaccugacugaugaugaaggcagcacugcugugcacugaggaaaagaagaugcuaugcuccaaaugucuaugucucccccaaauuccucuguucaaaucuuaacccccaagauaagguauugagaggugauuagaucauuaggguggagcccucauuaaagguuuuagggaucuuauaaaaagagguuuaagggagcuaguuugccccuuccaccacugaggacacagcaagaaggugacaucuaugaaccacaaaguggguccucaccagacaccgaaucugcuggugucuugauccuggccuuccagccuccagaacugugagcgcuacauuucuguagucuaagccacccagguuaugguauuuuguuacggcaguccaaauugacuaagacagauuuuuuuuuucaauacacuguucugggucaauuggauauccauaugaaaaaaaggaccccuaccucacaccacacacacaccacacacucaauuccagaugagcugcagaucuaaaacaaaagggcaaaaccaaaaggcuuuuagaggaaaacaucuuugugaccuugcaguaggcaaaaaucucucaagcaggacacaaauagcacuaacaauuuaaaaauggauaaacuggacuauuuuaaaacuaagaacuucuggucauuaaaagacccccauuaagacaauaaaaagguacccaauagaaggagagaagauauccgaugaggaacuuuaucugcaauacuaaaaaguucuauaaauugguaagaagaagacagauaauccaguagaaaaaugggcaaacgauuuaaaaagguccuucaugaaagggaauauucuaacggucuuuaaagguaugaaaagguagcuggguucaauggcacacaucuguagucucagcuauucaggaggcugagguaggaggauugcuugagcccaagaguaugaggccagccugggcaacauagcaagacccuaucucuuauaaaaaaguaugaaagcugggcaugguggcucaugccuguaaucccagcacuuugggaggccaaggcgggcggauuaccugaggucaugaguucaagaccagccuggccaacauggugaaaccccgucucuacuaaaaauacaaaaauuagcccaggugugguggcacacgccuguaaucccagcuacucgggaggcugaggcaggagaauugccugagcccgggaggcggagguugcagugagcugagaucaugccacugcacuccagccugggcaacagagugagacucugucucauaaaaaaaaaaguaugaaaagguguucaaucucauuagcauuagagaaaugcaaacaaaauauacagggaacuacuauuacucugcacccacuagaauggcuaaaaugaaaucaauauaaaaugccaagcgcuggugaggauguggaacagcaaugaacugucauaaucuuggccaggugugguggcucaugccuguaaucccaguacuuugggaggcugagggggguggacugccugaggucaggaguuugagaccugccuggccaacauggcaaaaccccaucucuacuaaaaauacaaaaauuagccaggugugguggcaugcgccuguaaucccagcuacucgggagucugaggcaggacaaucacucgaaucccaaggauggagguugcagugagcugaaauugcaccacugcacuccagccugggcaacagagugagacucugucucaaaaacaaaacaaaacgacacaaaacaaaacacuguccuaaucuugcuaacaggaggguaaauugguaugagcacuuggcuuacugucugguaguaccuaucaaaucugaagaugugcauaucccaugacuuugcaauucugcuccuaggaaugugccccacagaacugcauacuagaauguucacagcagcacuauuagcaacaucauagccaaaaaacuggaaacuaugcaaauguccaucaaaaugguuaaauuacauauucacacaauagaaugccauauagcaaugagcaugaucuauauuuccaccuaaaacauggcugaaucucauaaacauaacugagcaaaaagaagccagacauaaaggauacauacuauaugauuccauauauacauguagaaaggauaaaaagggcaaaacuaggccaugccugaaaucccagugauuugggaagcugaagaggaaggauugcuugaagguaggaguucgagaccagccuaggaaacauagugagacccccaucucuauaaaagaaaaaauauaaaaauuagccaggcaugauacugcacacucguagucccagcuaauugggaggcugaggcaggaagauugcuugaacccaggaguuugagacugcacugagcaaggauugugccacugcacuccagccugggugacagagugagacccugucucaaaaaaaaaaaaaaaaaaaaaaaaaagucaaaaguagucaggauagcaguuacccuuggguguguagugacuuaacagagcacugcuggcuucaggaguggugguuauccugcuuacguucuuguucucgguguguuuagaauaccucaauaaaaaaguuccuugggcagguguggcaggucaugccuguaaucccagcacuugggaggcuggcacaggcggaucacuugagauuaggagugauccaacauggcaaaaccccgccucugcuaaaaauacaaaaauuagcugggugugguggugugugccuguaaucccagcuacuuaggaggcugaggcaggggaauggcuugaaccugggaggcagagguugcaguagccaagaucgcaccauugcacuccagccugggcaauggagcgagagucugugucaaaaaaaaaaaaaaaguuccugaaagacucaauggugauggguuauaacccauagaauaaaagaaauauuuaugaguccauauugauauaaauuaaaaauugaauauauaaauaaaugggggagaagggacagaucuuuuuaugguagaaucucaauuaauaaauguaggagaaaugacagaaauagaaagucaccuauuuuaacaagcaagaaucaucaguggaugccaaaauuagagagcaaaaguacaaggagaaacaggacauuuucauccucucaaaaguauccccucacaggauauuuuauuaauuaaaaagggagaaauaaugacucuccaguggagaaacuuggcacacgccaccuuaacuaaggaucaaggugaacaucagcagucacacgacgcagugacauugugcagcauuuaggaugcacugacauggggacaaccgcacuucugugguacucuugccaaaacuguauggcuucuaauucugaaugaaaaggcaucagacaaagccagauuuagaggcauccuacaaaacaucugaccgauauucuucaaaaguaucaaagucaugaaaaacaaagagggacaggugugagaaacugucacgagcugcagaaacugaggugacaccaacacgaaacacuauguaggguccuagccaggggcaguggcucaugccuguaaucccagcacuuugggaggccgaagugggcagaucaccugaggucaggaauucgagaccagccugaccaacacggugaaaccccgucucugcuaaacacaaaaaguuagcugggcaugguggcgcaugccuguaaucccagcuacuugggaggcugaggcaggagaaucacuugaaccugggaggcagagguugcagugagccgagauugccccacugcacuccagccugggugauaagagcaaaauucaaaaaaaaaaaaaaaaaaaaaggaaaagagaaaaacccgggaacauuauguaggguccugaauugggucauggaccccuggaccagcaggacaggagagagaaaacuggcaaaaauagaagacuguacguuacuuaguauuauaccaguguuaauuucuugguuuuaaaaauguuuuuggugguuacauaaaguaagaugucaacacuggggagauucugggaagaguauaugggaacucuacauauuuuacaacuuuucuacaagucuaaaauuauuucaaaauaaaaaguuaaaaaaaaaacccaaacaaaaaacccucaguggguagguuaaauagcaaaaaaaaaaaaaaagaaaaagucgauuguaagauaaaacugaagaaaugauccagaauauauccggagaaacaaggagauagaaaauaugagcucagagaugccuaagauagaaagagagggcuggacaugcauccaacuggaaucccugaggacagaauagaaagaaucaaaguggaaguaaagagauaaugacuggcugggcgcgguugcucacaccuguaaucccagcacuuugggaggcuaaggcaggcagaucccuugagcccaggaguucaagaccagccugggcaacauggcaaaauguugucucuacuaaaaauacaaaaauuagcugggcaugguggugcaugccuauagucccagcugcuuuggagggugaggugggaggaucgcuugagccugggaggaggaggagguugcagugagccaagaucgcgccacugugcuccagccuaggugacagaguaagaucgugucucaaaacaaaacaaaacaaaacaaaaugaaauaaugacugaaaauuccaaggacaaaugaaagacaugaauaccaacaaggagagguuaaauaaaaauaaauccacauuguagacacgcuguagcaaaacuaaagagaaggccuaaaagugcccagagagagacucagauuccucagaaagaagcaucagugacugacagcugaccuuccaaccaaugguggaagccagaacacagcggaaaaauaccuucacaguguggauggaagacaacugucaccccagaauaguguuccuggcaaaacgaacuuucaagaagaggacaaaauaaaacauguuuacagacaaacaaacaaaaacugagaguuuacaacuacagaucuauucuaaaagaacuucuaaaagauguuuuuuacuucagaaagaaagaaaauaagcuuuggaggauuugagaugcaagaaaaaaaugacaagaaauguguauuaacauauggguaaaucuaaauaaguacuguauguauaaaauaaagaaauuaagaagaaaaaugucauuuguggguacuguaaaaaaaaagagaaaauaauauagcuuguaaguuugagaaggagugggugacaaguaaaaaaauauauauuaagggccuugaauuacucaggaggugggguuguguuaaguaugcauaugguaagauuucaagguaaccuauaaaagaaaagagacagaauauaacuuacaauccagcagacggggaauaagagaaaagaaaaaacaaagucaaggguagagacaagaauucaggacaaauagaaagaagaaagccagaaguccaaauaugucaguaaauacaaaggggcuaaaaauggcaauuaaaagauagagguugucagauuggauaaaaaaagaaaaucuaggcauuaugcugcuuacaagagacucauuuaagauauaaagauaugugaauuuaaaagcagagauagaaaauaauaauauaaauacugaacagaauaaaggccuugggggccuucaggccagucucaacagcuauaguagucucaacagcuauaguagucccgcauguggcuugccugaugcuggcauaaggcugcugcaccccacccugacugauccuccuaacgcccccucaccuggcuggugaugucugaaggcauaggcgaggggggcuuggaguagguggcguccugggagacgaagccagagucaugggaggaaacgcuggagaggcgagcgguggugguggcuggcugcgccaggcugcgguagcgacagguggaacugggugaguauguuugggcacccccaggccauggggcuccgccacccuuggcacugcuacugcugcugggggcacuaggggagugaaggaagagggcacagcagccagacagggagacagagggguguguguuugggggagguugacaaacgaggguggggaaagaggugaggggcaaaggaaggaaaagacaaugucagacuaggagguccugagacccaggugcuacacaggagcuguguucugggacgguguggaaggggagggccagagcaggguacccccagccccagugcugaggggagccguggucagggaaugcccagggugaggcaaccucucugccuccuauucugccacuaagaacaguuguccaggcugggcacaguggcucaugucuguaaucccagaacuuugggagaccaaggcggguggaucauuugaggacaggaguucaagaccagccuggagaacauagcgaaaccccaucaccacuaaaaaugcaaaaguuagcugggcaugguggcgcaugccuguaaucucagcuacuuggcaggcugaggcacgagaaucacuugaaccugggaggcggagguugcagugagccaagauuaugccacugcacuccagccuaggagagcaaggcucugucuugaaaaaaaaaaaaagaaacaagaaacaguuguccugucugggcgugguggcucacaccugucccagcacuuugggagucugagguggguggauugcuugaguccaggaauuugagaccagccugggcaauagggugagacccugucucuacaaaauauaugaaaauuagccaggcgugguggugcacaccuguauucccagcuacuugggaagcugaggcaggagaaucgcuugaacccgggaggucgaggccacagugagccaugauugugccacugcacuccagccugggugacagagcgagacccugucucacaaugacaacaaaacccaaaaaacccaccaaaaaaccuauugguuucaccaaagaucuuaaucuagauuccuauauccuaaagaauauaucuuuaucacugaggccucagccucccgaguagcugggacuacaggcacacaccaccaugcccggcuaauuuuuuuguauuuuuuaguaaagacgggguuucaccguuuuuaccaggauggucucaaucuccugaccucgugauccgccugccucggccucccgaacugcugggauuacaggcgugaacgacugcccccggugaguccaaucauuccuaaaccaccuucucaaaaucugguauuugccauccaguccuaacuggaugucuagcauauggugauggugugugugcguacagaggucaccuuccaaguggguccugcacccaccaucacccucacucucuccaaucccucaaggguguccagcccucuauggcucacacccucagcacagcaauucaacccuugggugguguuccuggcuaagcgugacccugaagccucccagccucugccccugcucauggcuguccccugcaaucagccccuucacugugggacggccacccacgcagggucugaagagccucucucugagguaguagcugauugcugugccuggcuucucccaagcucuggauguccagccagugauucuggggagaggggugccuggcaaaggggggcccccaccagcacuucacucugugcuuacuguccuccccacccaaggaagcuugaaccaucaaugucuccuccaaacccagccccagugcccagccaaggaaaggccccugauccugagccuggcuagugacugcgagauccuuggccucuccccagcugugugaggcucccggggcuagccugggccaaggcuccaaaugcggcagcugccuccaugggaaccagcucuuaggagccagccaggcuggaguguccuauaccuuauggccccaacacuuguuucuagaagccuucccaucucucccugaucuuugacucuuacuaugaccccacacggugcuaggccuggcagaguccagugguuaaaugcugggacuucaugugucaguuuccccuucuguaaaauggagaugacaccauuccugauacagcaguguuaggauucaaugagaaaaaaugcauaaagcacuuagcacagcaccuggcacauaguggaugcuccauaaaugaagcugcuacugccccugcuuccuauucugccaacaaaugccugugccaguagcagucuugggaugacagggcacauuuucccucuacauaugcaaauuccucggaugguguaaaaguugugaauuuugaggcccugaagcaauuucugaugcaauuuugcugggaacauccccacuuccucuugggauaccgccccccacaccccugggaaccccacccccacugaccugcacaugcuggacuuccgggagcuggagcugcugggugaugaggguggggucugguaggaccagcuguaguccgagcccuuuaggucuuugauuaccuggacagggacauggaugggggucacuggaggcagcuccucagagcuaguagggccagaggcccccccccacucucuaauugugaaccacaucccaggagaagacccagaaaucugaagcccccucccccaggcuccuccuaauguggggagcagggagacaccagaggacacagccuucucggagccccuucagcuaacaugcacugaguagagauuccgagcccagccugggcugggcgagagugacccugacaccauggggugcagguugcuccugcgccucccugaguuuguuuacuccuguuccugucuuagaguggaagauucccugagauaacguggcagaugcugggcaugcaacaagugccucuggagcgugcugcccgcaggcugugggacaggacuggucugagugcaguggcagcagggcuggggugggguggccagguacgccugggucuaggggaggggaugggguuucuggccaugaagggagguggggcgucuccagguucggcaggaggucugcccacauggagcagggcaggcagacucugggccugacuccauggauccaggacuucacccaucuacucugagucugagaacgcugcuggccagggcauacccuccccgaccugggcaggugcuccgggauggccugcagugggugucagaaggggucuggucuuaugccccuagcugccucccccaaaugccauccucuuuuccccuuuacuguucccaaccuagggcagcccaucuccucccugccccuggcccuggcccuuggccagagggcucccgcaccugcucgcuggcgggaggcaguuugugggguucugcugucagcaccaccaagucgucgaugaugcccugcaggugggugaucucucccagcauggucagcucuccauucugaggaagcagcgagucagaccugcuggcccuaucgcccaccugcccgccugcccagcgccccuggagaagcagcagcccuugucgggccucuccucucucaccccuccucgcuaaccaaugcugcucggggcuggugcagguggggcccacacagcccagagggcuggcaugauggucucuccagaccaaaucagugcauggugagcuaugagaccugccuuugggccaggagcauguggccuugaugcccccagccagggacugcugagaagugacccuucuuggaggucagaaggucaacccugggcccagcccaccccucuggggucugaguccccaggagucccaccaccacaggcugcaggaaggugaugaaggugcagaagcggccccgcuccucgaucagcgcccggcgcacggccugcuucuccgucuccuccagcagcagguacaugucguugacguccugcagggcacuguccagcuggggcugcaggucuccuuucccuggagggguggggaggagaggccuugcuggggaugccagccuggcuugccacacccacaaaugggcucagacccuggugguggcaucucucggccguugggcuggguguugcccuggggccaggggacugcggagggcagugaggacucuggggcuuguggaagggcuagucccaccaaagcaggcagagaggacagacacacacacaagaaagaggccaaagcugcaaagccacgcuggauuggggcaucuccgggggaggcucuuggcgcccaggagcucugccaacacggagacucgcuggccuccaccugggguacccucacugacccgggauggcgccccucaccucacaagguccagggagguggggcagaagcgggacaagagagaguguggggcucagcuguaggccaggccacagggggcgggggccaggagagcuagggcugggccuuggaggcagggaaggggucucaguguggguccccacucagcucagggagcagagcacacagcaacagcgacacaagaagcagcaagaaagagagaggcgagaggaugaugcagaggagaugaugagauggcaggugaggaggugacaaguaaggacgcaggccagccuggugggggcggggcagccagggccuguggcccccaucccgcccuggccaaccccuccuggccuggcagacugacccagcaguggcccgggacucaucccuggccagggaccccgggggccccagggggacugugccccaggccccucccucguggaccgaccgccuuccucgcuucuccuuggccuggagagguuccuuccaauggcccugagcugggggagacagacaaaugcgacaaggacgggaggagcagcuggagggaccgacauuugacuuaccaaguagcucuacaggaaggaugugggaggagaggaggagagacagagaaagaaagaaugugugaaagacgccggauggacagagccacuccuggggcgggggugccugggccuccugcugccucccauagggagguucuggaccagguuuggggggaagggcagcucccucugucccacccaacagguuggaggguccugugucggggacagcgccccucuggcugggaugaaggcuuuggggcgccccacggggcgguggggcuguggagcggggccguggggcuguggcuggggggccgcgccaggcacuaccuuugcgcgccuucuucugcagcuucagcguguccgacgacuucuuuuugaucucaugccgggcucguuuguacucugcagaaggggagagcggagcgcucuaauggggucccugcggaguggggggugggaagcccggcuccgcgccacccucaccuuucgcgugguccuuguccagcugguuggccgccuucuuccaguccucgaugcgcuccugcagcggguugaugaggcucuccagcagugcgcugcggagggcgggcgggagcgcaggucagggccgggcucccccgcgacgccccguccccccgccccccugcccgcccgcagcgcccacucacuuggugaacugccgcagcuuggucucgaugcugcgguggcgcaugcacaugcgugugagcgccgagccgaugucccucguggccccuggcgaggcaagcgcggggugggaaggggcccgcuggggccugcgcagucccggccucgggccaggagggggcgccccggccgcgcaggcggagcccgcagcccgcgcccugcccccgccgagccgcagucccgccggcccugggggauucggggccuccuccaucuccaccagcucuuccuccgccaucccagccgcgccagccuccugcggcggccuccccucucucccagcugggagaggccggcgccaaagaccguuccaggagccggccaaacgacccuccaggugugcccagaugcaggugcgggagugugagcacgcccagggcccgaaggagcgggagccccaggucucugccacucggaccagagggcagaggcggcgccaagcccaacggcgcgcucaccugacccugcgugcucuuagaaggacacgagggcaugagugggaagaagcccuaaggagaaucucugugcuggggggucacaugaacagcccacagcaaaaagggaauccccggggaacacuccugucacuacuuacccacuccugcuugcaugccucuugugacgaggggcucacucucuccacaaccagcccacuccacuaaggagcagaacucaagguucugggcuuggcgucccguccuuucccuggcccauccccuacucuuccuuuccagccuccaggcccacccuggggcaaccccaaccuccagccacgcgccuccccaccucggguguugguagccaugucagccacuuucuggaaggcauccaggaaggccacagcagccagcacggugguccuggggagagggacaacggcauggauggucggugguugggcggggggggggccucugccugccccuccccugcuggggugcccugggccaccucaccucagcugggaaugcagcuucguggccuuggaguugaaguccucccagauaggguaggagcucugccgggcaaaugggagagaaagugagcuucuuguggggugguugcagggcuugaccugggccgggcucccugcaugcuccauccagacuuggggcaguuucuaagacagcagcccugccccauggagagggaggcucuggguccucucggagggcagaggaccaaggacagagccaucagcaugaggaaagccugucccugggaacgggcgccuuugccaagcccucccucccugacaucaggacauccacccuacaggcuacagggggcucacauccucccucaggggaaauggagcaggaaguggcagguccuguccccucgggguuucccaggggccuggcaggggaucugggcugagcccaaugagaggcaucgugucucccggacaugugccuaggacacuggcacugaccugcccaccaggggcagaggcacaguguggaggguaggggguggcagggcugaaggcacaccagguguagacuggggccuccggggccccugcccuguguccuggaagcugccaucccaggccagcagcaguggcucccagggccgaggaggcuguggcugcugcagggcccagcuagccugccugggacaaccaggcccugggcugaauggggccuugugcggccaacagagccaccuuucuccacccccugcuccccuccccuccuggggaaacaguguggccuuuaucccagccuggcccaaggcuccaaguugggaggggguuucccaauagggaggucgggcuccuggccaccgaguuguccaaucugauuuuggggcuuuucugguuaacgcaugccccgggguccuggagaaaccucagcccuggcccaagggcccuguggagguuuugccccuugacgggcagcccugggccagccaagccccagcccacaggggcuucugacccucccuuccauguaggauggggcgauggaggcuggggcucuuccugaggaaaggggaaugcggagacccuggcccucagggccucagagggaggcucugccuggcugcaacccaggagcaggcuagggcuugcccugccagacuaggagagcuugcaggggugggaaggagacagggcggcuuagggggccucagaaucucccuccccucccagcccaaccaaaccaguguccagagaaagcaaauauuugcaaaguccacagaggcugaagcaagaguggguaagcugugggugggcuguucccaaaugggcacagcucagggugaaggggccugggaagcuguuccuagccgucccaaggaguggacucaugccaccuaugccuggaguaccccuugggggucuucuaaaagggggcgcucucccaccgccuggacccccacccccacucagccuugaaaccuugcuaagaucucccuuuagggagcagagaaguugcuagggguggagggggguccagagccagcugcccuggcacccaggaaccuucuuagccccugagcagcccuggggcagucucagagauuaaaggcucuccccauggggaggggacaagauggggcgcaggggaggccaggccauuuccccucagcagauggaccuagaugccucagucucuaaggaccuggacccgccccccuccccacgguaaccacauaaaggaccccagagacaaagagcuuaugucuuauuuguuuauauccgccucuucauggauaggucaauuucacugauuaaaaauaagagauagggcuccagcagccagugccccaggaacagcauccucagccuucaccugggacaggcccagguaaaccuuccccacagccccauuucaccaacaaggaaacagaagcccguagagguuagcucauuugcccacggccacaggguggcggggucaggaccugaucccaugucugccuggucacugcacgccagguagagggacucccuuacaaagcagggagacaagcacugaacgucaaggcuggggaggcggcagggacugcugggaugugagagacacccaguucugccccaagcacaguggcugcucuggaguggggaggugaggggcuucucauuagaggcgcccaaguggacagggaugaggggacucugucucugucccggcaguggcugugguucagauguggagugugggugagcaauccagccuccaaucccagggagugggcuuuccaggugccccugggcaagggcccccugucugagccucaguuucuucaccuguaaaaucaggagaggaggagcaccugccccacugggucaguguggaaauugaagcaggugcugcucagccagcacuccucgcagcgcccagcacgcaguaagugcucaguuaacaccagcuaacaguacgcaagcccugcccucugcaggggccccuagcagaggccuggccaggccuauguguccaggugacauuccccacucuugaggggugggugaagaguaugaccccauuuucuggcugggccagcacuggguggaggccccauucaccuugcugaaggugccgugcccagaacuaugaccuuuggcaagucucugccccucucuggguuucaaugggcagccugacaccagugggcaucugaccuuggcccccgcucagcccaaggucagggccucccagaggcccaggggagggcuucuguggggccuguggacucacugugggguggccucacggggcaagcucagucuccucaaccuggcugcugauggccgcccuuccucuacggaggcccugcugcucaggccaccgaggggaaaauccagaagcugcccccgcaaauccagguggucagcuuccagguggccucauccccuucucugccccuggucauggccccugaacacaugccugugucauagguaggggcgaaucuguccuuggcaucaucccaggugaagccucuccuguuuugccuccacaugucagcaaaucaugcccgaugucuggcuugaaccucuugcuaugaucugggcccacuuccuucugucucaucccaaaguuccuugcaaauuggcuggagagggagagagacuguccuaguccacuuccacgagcaaaaucugcugcucucugcagugguugcuaugaggcugccagugguggugggugguggggugcgggaaggcccauccggagccagcucugggaucggccaggggaggguggucuguguugcccagucccuuaacaggauccuggggccagggcugugauguccacaggacagguggggacugcugggggccagcggaggggcccagauguacaguugcaagagaugggggucccagggggagugcaccaugaggggcaggggguggggggcaucuacaagccgcuaacuggguagucccaggccaggcuggcuucaggccucuuccgggggcagagaucuggcagcugucccuggggcuguuguccuggcagcaccgggagccucgaacuccaaccugccagcaacccccaccccucacggggccuguccuagcagcacuguacuggguggugucacccccaucccuggccuggugggauucuguguugugcacuuggagaaucugcgcugggcugugggggugggggcccuugggagauccuguggggugccucguucuuuccccuucucccagcccccaaauccugccccuucauccuaggcuaaggaaagggggcacggcaggagggcaggaauacugguuccuggcccccacccuaucacuggagcugggcccucucugccuagucagcguagggcagcccugccaaacccuggccucauuuggggagaggaacccacuaauuuucccaggaggaaaaaugggggcugaggucaggggaaggguccaauagucuccuuagugaccuugagccauuuccaggccucaguuuccccaccugguggggugaggaaugaaugggugguuggauccagccugaccuuaagcaauccugggagacaaggagggcucggagcugagagcccagggugguaaugggguaggaaaagcgcuuccuugggguugcuccaccgaccccaaccuucaucccgccuccucccaaggugaugaucaaggccuauccuugggaugcagggacauucagccuggagaccuuggaguccuggagcuuccuggggcuguggggguggggcggggcugggggacgcagucucacggucgggugcagaggccuaggucggcggggaaggaguuaacgguucuccgcuuuauuauuuuuuccugcuuuggcggugacagcauugucugggcuccggggccgugggggaacauggugguggaagggggcggaggccgguaagaccccggacucguuaaagggcccuagagucgguccuggauccaaaccccauucaugguuuggcggucuggggcgcagggagccugcgugugcacaggcucgggucaggaccccacggggccaccgcgggcaccgcacggacaccccgacacacgagcacccacacccccagacgggcacccggagacacgggcgcccagcagacgcaggcaggacgcgcucagacaaggacacacagacaccgcggcgcgcggccacacgaggcucggccacccgccgccacgcguccccggggggucccgcacccgucgccgcgcgcccggccccgccgcgccccgguuaccuucaugucguugacuauggccuggaagagcccgcccagggcgccgcacuccuucuccgccgucuccaugcucuggcugggccgggccgcggcggcggcuaggcgcacggagcgcggggagcagcgcaagggagggggccaggccgcgcgggcgcucgcuccgaggccgggccgggccucccgccuccaggcugcgcucagcggccggccgcgccgcgcuccggggucgcgggccuccggcgggcggcgcgggccaugucgcagcggggcuggcgggcggcgcggggggcgcggcgcgggcagcucgcggcgcagccucggcgcggggacug

SEQ ID NO: 15820 - RNA, 3691 nt, Homo sapiens
aguugggucauuugguagcguuuaggcuuagaaguuacuaauuuggagccgugaguauauguguauaagcuaguaacacgugauggucaagggaaguacuaccauuuccuguggguuauuagggccuccagcuguuaugaggacacacuggggaaucucagcuuuagggagucgaugauguaacuggagaaaggcaaugcugcccucauaaagcaaucagaaacgagauuccaccugccaaaugccaagaggcagcaaaguccaugaagagagcacuguauacagucagaugaccugggcucacuagccucuaagcauagucuugguuuccugccuguaaauugguagaauaagacugauuuacugggccuggcaugguggcucacaccuguaaucccagcacuuugagaggcugaggcaggaggaucccuugagcccaggaguuugagaccagccugggcaacaugacaaaaccccaucucuccaaaaauacaaaaauuagccaggcaugguggugcacacuuguagucccaguaauuagggggcugagacaggaggaucacuucagccuaugaguuugaggcugcagugagcugugauugcgccacuacacuccagccuggaugacaggacgaaaccugucucaaaaacaccaaaaaacaaaaaccggucuccuggggucaugguagcacaaacgcacaugacugagugcucagggguucugaggcuuguccgcugaccuggggcucuggcccugggagaucugggggaccugcuguccuauaugugaugcuuugaaagaaaggggcaucauuccaagccaagaggccccagagagggcaccgugcgguguucaggcuucugugaggccccagugagauccuguggcugugcccccaucaccuccacccacucugcccucccacuagcugcccaacggaugaaucaacgccuuggcagaguuuuccagcagggccuugcagagagugugugugaccuguguggccacugccuuggggacgggugaggaguuagccuggaacauuccagcgugggcauuauuguccuguugcaaguucagggcaaaaccaggaauccaguuuugucgauccaauugagaaaacauuucaugaacaacuacuuguggcaugcauuggcacucggaauaaagcgcacuauugucacuagguuggcauuucuuuuucuucuuuuuuuuguuuuuuuauuuuugagaccgagucucacucugucgcucaggguggagugcagugaucuugguucacugcaaccucugccugcuggguucaagcaauucuccugccucagccucccgaguagcugggauuacaggcgccugccaccacgcccggcuaauuuuuguauuuuuaguagagaugggguuucaccauguuggccaggcuggucucgaacuccugaucucaggugauccgccugccuuggccucccaaagugcugggauuacaggcgugagccaccgcauccagcaaggucagcacuccagacuagguuggcuguggaagacuggguguuaauaagggguuccuaaauccaggauucugugcucacauucagugaaacacuacagacuccccucuuggauaguuugaggcuuugaacacagccguucuccuauccucccccacuggcccaucccuaaugaauccaaaugcagucuaguaaaaucaggaagccugcuaugaaaacuugacagagauauugaagaugccccugcaguugcccacucugacccaggugaagggagaauggcuguaccuuuggugauggugcugagggaaaggaccucaacucccguaagugcugggucugaggccacguguuacaccaggacagguccugugucccucaggaaaaccuggcuuuggggucagaccucaguaaccagcuggggaaucuuagguaagauucucucucucucucucucaaucucucuuuuuuuuuuuuuuuuucuaagaaaagagacagggucuugcucugucauccaggcuggagugcaguggcuuggucauagcuuagugcagccucgaccuccagggcucaagugauccuccugccucagccucccgaguaguuauaacuacaggcaugagcuaccaugaugccuggcuaauuuuuaauuauuuauuuauuugcagagaugggggucuuucuauguugcgcaggcuggucucuaacuccugggcucaagccccagaaaaggggugaggaaucuuacccaaggccaggcacaguggcucaagccugaaaucccagcacuuugggaggcuaaggcaggaggauuccuugaggccagcaguuugagaccggccugggcaacauagggagacgucuguaucuacaaaaaaauaaauaaauaaauaaauaaauaauuagcuggguguaguggucccagcuacuugggaggcugaggugggaggaucgauugagcccaggaggucaagaccacaguggguugugauugugccacugcucucuagccugggcaauagagugagacauugucuagaaaaaaggcaaggcaugccgggucaugccuguaaucccagcacuugggaggcugacaugggcggaucaccugaggucaggaguucaagaccagccuggccaacauggugaaaccccaucucuacuaaaaaugcaaaauuagcugggcaugguggagcgugccuguagucccugcugugaaacuccgucucaaaaaauaauuaaaauuaaaaaaaagauuauucaccuuuuggagcucaugucucuucaucuguagacuggguaacucauuggugcucaacagggaugauguaucagagaaaggccuuuucuuccaccuaauggacccccagucccacacacacacacaaacacacacacacacuccagucaccaccacaucacucaguuuuguguuuuguuucguuuuuuuagagacaggaucucgcuauauugcccaggcuggagcacagugguuauucacaggugcaguugcagcucacugcagccucgaacucuuggccucaagagagucuccugccucagcccccugaggcucaugucacuacacacuacacccaacuccccaucaccuggcuuuuaguuuuaugagacgaagcuuuugucuaggccgaguguucuggagaggagcugggguagucccuuagaacaguccaagcugccugggagccagggccuggguuugggggacuucuuguagucaacuggcuggcgcccucagucagagcaguccccuggcggguccucuggguugaagacucccuccuacuucacaguccaaggcaggcgggggccacguggcccugccccgccccugcuggcuucgguuccugagcagagcugcaguggccugcuuuccccgcccuucucaucagacgggaagccuggacuguggguugggggcagccucagccucuccaaccuggcacccacugcccguggcccuuaggcaccugcuugggguccuggagccccuuaaggccaccagcaaauccuaggagaccgagucuuggcacgugaacagguaagaaggcagcaggcuuucucuccuaugccuggcuuuccucugccucugacggccuggcuuccccaccccgauucugcugcugcuucacugaucccaggaagagggaccugagcuagacuu

SEQ ID NO: 15821 - RNA, 26587 nt, Homo sapiens
cggagugcaccgcgagggucgcgcagccucgcguuaaagagcccgcuccgccgagcgccgggcgacggcagguacgucaguccgcgagggucgccgcagcgccccuugcgccccuugcgccccuugcgcccccucagcuuuccggugcacccucccugacugggagcaccgagucgacccgcgggccgcccggguccugacagggaagaguccccgggagcucugcggugccccgggagcccacagguguuucuacgcucccgcguccauuuggccugggucuuccaaggggagccccgcgacccggcuggugcggccggaccugcuggcagcugggaccgggagggaugcgggccucagaggauccucacccugaggcagguggggcccuggaugccggcgcugcucugauuuuacuuugaggccgcuucuccucucucaguuuacccggccagggcucaguauuaugcacaaaucucaaugaugugcucuuggguaauuuacaaaacgauuuuacucccaaguaacuucuuucggucuguuauuuagaaggcagcaagucagaguccuccgugagccuuuuuuuccucuuuaaaguucuaaaaugugcagucccugacccaccugucuucaaaagguucauaugaagaguucuuaguacuuuauucuaucucuggcuccccaacccuaucccagucuuggacagcguggggcugaggacacuaaaaaauauuucaacuugaucucagcagaugaggcuguauugaaaguggguagaggcugggcgccaaggcucaugccuguaaucccagcuacuugggaggcugaggcgagggaaucgcuugaacucaggagauggagguugcagugagccaagaucacgccacugcacuccacccugggcgacagagcgagacuacgucucaaaaacaaaacaaaacaaaccaacaacaacaacaacaaaagaaccuuagggccuuagggcacacuuucucaggaccucuugagauuguguaacuccagcaaacuauuaauuaaaaaaaaaaaaaaggccgggcgagguggcucacgccuguaaucccagcacugugggaggcggaagcagguagaucaccuauggucaggaguuugagaccagcguggccaacauggcaaaacccccucucuacuaauaauacaaaaauuagcugggcgugguggugcacgucuguaaucccagcuacuugggaggcugaggcaggagaaucacuuuaaccugggaggcggagauugcagugagccgagaucgcgccauugcacuccagccugacgacagagggagacugucucaaaaaaaaaaaaagccaggcaugguggcuuacaccuguaaucccaacacuuaggaaggccaaggcgggaggauuacuugaguccgggaguuguaggucagccugggcaacaaagggaggccccaucucaacaaaaaauaaaaaacuagcaggacucaugcauagucccagcuacuugggaggcugggaugggaggaucgcuggagcccgggaguuugaggcugcagugagcugugaucacaucacugcguuccgcccucuggugacagagccggacccuguuucucaaaaacaaaacaaaacaaaacaaaagccuagccugccugugcuauuaaagcaauggcaaaagccaaaauuacuuuugcaccaaccuaauagcuauguuucugcuuuuuaaacuacaguuuucuugucuagagcuucagugagauaagaaccaauucuuaggacuguugggugggucauaugaagugacacugaugugccuuugccauagugccugaaaaagcacuccauauguauuagcuacuuguaucauuuuaccuuuuuuguuaaucucucaggggaugucccucagccuugcuugauucccgaggccuucccugauuuuuuucuucuucaggacagucuuuaacucagagaauguuugagagcuuccaguccuuccuccuucagggacagguuaaacucuccugcuuccuugccuggcuggaaggauuaucauucauugagccacuggugugugccacauacuuuacauuguauuucaugcugaaaacaguccugggagguugaugucuuuggccuuaaauuucagauuaggaaacugaggcuuagagagguuaaguaacugcugggcaugguggcucacgccuguaaucccagcacuuugggaggccgaggcaggcggaucccaaggucaggaguuugagaccagccuggccagcauggugaaaccccgucucuacuaaaaauacaaaaaauuauccaggcaugguggugcgcgccuguagucccaguuacucgggaggcugaggcaggagaauggcuugaaccugggaggcggagguugcagugagccaagauugcgccacugcacuccagccugggugacagagcgagacuccaucuuaaaaaaaaaaauagauuaaguaacuugcucaggauccuacaggaagcaggaagagguagagauggggacagagccuuuugggacugauacgcaacccaggacuguuccucugccccugucauuaguaagggauacucuccccacucuggccaugaccugucaccugcccaugucucucuaucacuaugcugagaugaagacugggcucagaacuucugggccauuggacucucuggggcauuucuuuuuuuucuugagacagagucgcucuguugcccaggcuagagugcaguggcgugaucuuggcucacugcagccuccgucuccuggguucaagugauucuccugccucagccuccugaguagcugggacuacaagcgcgcaucacuacacccggcuaauuuuuguacuuuuaaaagagaugggguuuuggcauguuggccaggcuggccuugaacuccugaacucaagugaucugcccacuuuggccucccgaagugcugggauuccggaugugagcuaccacaucuggccauuucaaggguuucuuucuuucuuucuuucuuucuuuuuuccucagacagggucuggcuuuguuacccaggguggaauguauuggugccaguuuacugcaaccucugcccccagggcugaaacaaugcuuccgccucagccuccugaguagcugugacuauaggcacauucacugugccuggcuaauuuuuguaugugugugguuuuuuguuuuuuuuuuuuugguagagaugggguuugccauguugcucaggcuggucucaaacuccugggcucaagccauccgccugucuuggccucccaaagugcuggaauuacaggugugaaccacugcaccuggccucuugcugucuuucagugccuuugcuugggaccagauaucauuaucacuaucaccugaauaaggauccaaaagacccagguguguugcaacuuugacuauagcgucuccuggccucugugaaguggagauaauaggagauaauaauacuuaucuugcagggucuaaggguguugucaagauaaaaaaaaaaaaucacagcaccuuaacugugguccagagugcucaguccuaguggcuauuauuaauuuuuuuucuuucuuucuuucuuuuuuuuuuuuuugagacaaagucucacucugucacccaggcuggagugcaguggaacaaucucugcucacugcaaccaccgcuucccagguucaagcgauucuccugccucagccuccugaguagcugggauuacaggcacccgccaccaugccuggcuaauuuuugaauuuuugguagagaugggguuucaccaugcuggccaggcuggucucaaacuccugaccucaggugauccacccgccucggccucccaaagugcugagauuauaggcgugagccaccaugcccggccuauuaauuuuaauuuuauuuuuuuugagacggaaucucacucugucgcccaggcuggagugcaguggcgugaucuuggcucacugcaaccuccaccucccagguucagccucccgaguaacugggauuacaggugccugccaccaugccuggcuaauuuuuguauuuuuaguagagacaggguuuaccauguuggcgaggcuggucucgaacuccugaccucagguaaucuuccugccuuggccuuccaaagugcugggauuacaggcauaagccaccaugccuggcauccuaguggcuauuauuacuaaaaucaucccucccuuguauuuguuuaggcuuugucauaauuauaauagauaauacauacugagugcuuuacauauauuuccuccuuuuguacuucagcucuacaaaguagguuuauuguagugguuaagcaaguggacccuguaguggggagcaugaauuuaaaaauuaauuaauuaaauuuaaaaauaaauuaauaaaaaaaaaggcugaggcaggaggauugcuugaguccaggaguuugagaccagcuugggcaauguggcaagacccaaucucuuaaaaagaaaacaaacagugaaaaccuuagcuaggcaugguggcaugugccuauggucccagcuauacaggaggcugagguagcaggauugcuugggccugggaggucgaggcugcagugaguuaugauugcaccacuacacuccagucugggugacagauugagacccugucuuuaaaaaaaaaaaaaaaaguaaaaaagacaauaaaaaaagaggccgggcaugguggcucauucccagcauuuugggaagccgaggcagguggaucaccugaggucaaaaguuugagaccagccuggccaacauggugaaacccugucuuuacuaaaaauacaaaaauuagucaggcgugguggcacaugccuguaauccuagcuacucgggaggcugaggcagggagaauugcuugaacccaggagguggagauuacagugagcugagauuguaccacugcacuccagccugggggauacaguaagacuccaucucagaaagaaaaaaagguaauaaaauagauacucuggaaaaaaaguuuaguuucaaacuucacucugccacuugcuagcuuuggcaaguuacuucaucucucugugccucauuucuccgucuuuuuuuuuuuuuuuuuuuguagaguccaggucucuguauguugcccaggcugguuucuaacucuugggcucaagcgauccuccugacauggccucccaaaaugcuggaauuauagacaugagccaccacacccagcaguuucuucaucuuuuuuuuuuuucgagauagauuuuugcucuucuugcccaggcuggagugcaaugguauggucucggcucacugcaaucucugucucccagguugaagugauucuccugucucagccucccaaguagcuggaauuacaggugcccaccaccacaucuggcuaauuuuuguauuuuuaguagagaugggguuucaccauguuggccaggcuggucucaaacuccugaccucaggcaguccugccccugucucccaaagugcucggauuauaggcgugagccgccaaccacgucuagccucuuuuuuuuuuuuuuuuuuuugagacggugucucgcucugucgcccaggcuggaguggagugcaguggcgugaucucugcucacugcaagcuccgccucccggguucaugccauucucuugccucagccucccgaguagcugggacuacaggcacccgccaccacgcccagcuaauuuuuuguauuuuuaguagagacgggguuucacugcauuagccaggauggucucgaucuccugaccuugugauccacccuccucggccucccaaagugcugggauuacaggcgugagccaccgugccuggacuucuuuuuuuuugagacagaaucucgcucugucgcccaggcuggagugcaguggugugaucuuggcucacugcaaccuuugccuccuggguucaagugauuauucugacucagccuccugaguagcugggacuacaggcacgugccaccacaucuggcuaauuuuuguauuuuuauuagagacgggguuucaccauauuggccaggcuggucucaaacuccugaccucgugaucugcccgccuuggccucccaaagugcugggauuacagaugugagccacugcgcccagguggcagugcaguucuaagcugccugccagaggagucuggaauuucacaggaauaggucuguuucagugucccagcugugcucagucacugguugugagaagguucguucaaagcguggccuccauguaaacaaggugggagauucagaucguagcagcugggggcgucuguuaguuacacucccugcugcagcugaccugaggguuagacgugccuacggccauacaguaaauugguggcaaaguuggagggagggcuuggugggcauccugggaggagccuucacccucaagugccuggcugggaucucuagcuggaauuuccccucuggauuucccugcugggcugaguagggaauggagcaauuucugacagaggcuuuuccugaaggcguggguguugcugaguggugguguccugucagccucuucucuucugguggcagcagagccuggcacuggaauagccuguggcugagcuucagguuuccugucacuuuggcuggggugugggcugaccaccagaugugugcucagggcgcagcucagccaguggugagcagcuuacuugcaugggcuuuucccaugcugaguuuugagggguggagggaggaaaugggggugcugcuuugugggacagcagugggagcccugccagaggugaauguguggguacuccugggggacucggucucggggaggccaggggcucaggagucagauugguuuuccaucuggcaggagugcuggcagguugggggagacaggggugggggugaagccaaaucuuuggccuugcuuucccccuacuugcugagagugcccuggaggaagauggcgggcagguagggcugcagcccccgcugggcuggcugagaccccugggaagggaggucuccaagugccugcuccugcagcucugagugcauaugcgcuccccacagcugcccccuucuccggggaacccccaucagcuugaggagccuggggggugggguuaggcauuugcucucgccuuccuuucccccuugcuuuggguggccccaacucuuaccccauccugcugcccucccuuccuccuuccugggcacacucccuggggaaaucacacccauccacauuuuggaaugucagcagacaugcugaccacgugacccagccauccgccuugguguccaccuggggagaugaaaucuucuguucacacgaaccuaucuccggagguucauagcaggacuauucacaucugccaaaaacuggagauggcccagaugcucuucaguggguaaauggagaaacagaugcggcccauccaugcgagggaucacugcuccuccgaaaaaaggcuugggccacagauauguacaaugacuuggauacaucucagaggcaucauguuggaugaaagaagcuaaucucaaaagauuauauuccauuuuauuugacuuuuuuuuguuuuguuuuguuuugagggucuugcugugucagccaggcuggagugcaguggagugaucauggcucacugcagccuuaaccuccugggcucaagcaguccucccaccuuggucuuccaaagugcugggauuauagacgugagccacuacaccuguccuggccuuuauuuuauuuuaguuaauuaauuagagauagggucuuauucugugacccaggcuggagugcagugauacagucauagcccacuacagccauaaucucccaggcucaagcaguccucccaccuuagcuuccugaguagcuggaacuacaggcacacgccaccacgccugccuaauuuuuguauuuuuaguagugaagagguuuugccauguuggccaggcuggucucgaacuccugaccucaggugaucuguccaccucggccucccaaagugcuggaauuacagauguaagcuacuauaccuggccuguucgacauuuuuucuuuuauuuauuuauuuuuuuugagacggagucucccuuugucgcccagguuggagugcaguggcgcgaucuuggcccacugcagccuccgccuccuggguucaagcgauucuccugcuucagccucccgaguagcugggauuacaggcaugccccgccacacccggcuaauuuuuguauuuuuaguagagacgggguuucaccauguuggccaggcuggucuccaacuccugaccucaggugauccccccaccucagccucccaaagugcuaggauugcaggcaugagccucugcacccggccgacauuuucuaaguugaugaaacuauagcuuuagagagcaaaucagugguugucagggcguaggcggggaggagagguugcaugaggaaguuuuuuugaguguagauggugauaccaacacgaaucuauacacauguuaaaaucauagaauuguauauaaaauuaauuacuuuuaguuaugaugguuuaaaaaauagucacaucuacccauauugcugucucaggaagccccuccgcuuggccagaauggagcagccgaagggaguugauuggacagucaucauccugaccugccaguacaaggacaguguccaggucuuucagagagguaggggacuccccuucccaccuugccccuaauggagaaccucccuccccuuccuggcuaugucccuccaacaccaggugccaggccaaccuggguucaaacccagauugcacuucucccuagccaugugacagcauacguggcaugucauuccuugugccuuaguuuucucaucuguaagaugggaguaauaugacuucucucacuaaguugggugaagaucuaguggccuccuacauggaaagcuaagucaaggaagaucaaacacugaugaucaguaggcuugcuuacgugcuuugggccagggcagagagcuggggggcaggucccagugucucuucugacccuagaacuggaagugcggcagaagcgggagcagaucccugcugggacgcuguuacuggccguggaggacccagagaagcgugugggcagcggaggagccacccucaacgcccugcugguggcugcugaacaccugagugcccgggcaggcuucacugugagugcucaccagggccaccucccuggucugugucccugcuggaaccaggucauuucugagauccccagcuccucuggcuccaucgccuuggccaacucagcauuggucucaguuuuuguuucuguaaauugggcggacucaucucugccuugccguucaagugagggcagaaggcagggccagcuuuugcaguguuuuuagagaguuguagccaauaucucaaagugaggcuuucuggcuucucuugaaacauucaaaggucuugcuagccugggcugucauccccauauggcaacgaacuguucgcuggaccugagcugcggcugccugcuuugggcaggccaugugagucagcaucccugcuggucccgugucucccaugcaaccagccacuucacccggucaccuugucugcauagcaucuuugugugcagagugagggcgagcacagacuuggacaugcucugcagagggagauggcaccagcaggggaggggaccacuguagcugccauggcgcugacuccccuaagucacccagccagcccccaacucuuguugccuguaaccuccccuucaaaacagacagcagaggccgggcgcgguggcucaugccuuuaaucccagcacuuugggaggccgagguggguggaucaccugaggucaggaguuggagaccagccugaccaacgugaugaaaccccgucucuacuaaaaauacaaaaauuagcugggccugguugcacacaccuguaaucccagcuacucgggaggcugaggcaggagagucgcuugaacccaggagguggagguugcagugagcugagaucaugccauugcagugagcugagaucaugccauugcagugagcugagaucaugccauugcacuccauucugggcaacagagcgagacugcaucucaaaaaaaaaaaaaaaaaaaaauuuaagagguagccaggcguggcagugcacaccuguagucccagcuaguuaagaggcugaggugggaggcucgcuugagcccaagagaccaaggcugcagugagcugggaucauaccacugcacuccagacugggugacagagugagacccugucucaaaacaacaacaacaacagcaacaaaccagccagcaagaagguggcccagguggagggcccugggaucccuuauccaggagggaccagggcugccccuugucugccuguggccauugguuugaccuugccuuuugucccuuggguaccugaguggauuuguguuggagucucucucuggauucgagggugccauccuccagggcgucugccugaggccucuguucacagggcuuucccacuccugcagguggucacauccgauguccugcacucggccuggauccucauucugcacaugguaaaugaacuuuggggcaggggccaagcagaaggccagaaucccaguucguggaguugagcaggacuucagggguguucugccacugugugugugcaagaugaaaucugaaagauucuaaauguccaaaaauugggaaauggcuaaauauauaccacauauuuucccagcagaauauuagauugaaagguccaucuagggccgggcgcaguggcucaugccuguaaaucucagcacuuugggaggccaaggcgggaggauugcuugagcccaggagaucgagaccagccugggcaacauggugaaaccucaucucuauaagaaauacaaaaauuagccgccaugguggugcacaccuguagucccagcuacucaggaggcugaggugggaggaucacuugagccugggagguugaggcugcagugaguuaugauuacaccacugcacuccagccugugugacccuuucucaaaaaauaaaauuauaggcugggcgcaguggcucacaucuguaaaguggcucacacagcgcuuugggagguugaggcgggcagaucacaaggucaggaguuugagaucagccuggccagcauggugaaacucugucuuuacuaaaaauacaaaaaauuagccaggcaugguggugcaugccuguagucccagcuacuugggaggcugaggcaugagaauugcuugaacccaggaggcggagguugcagugagccaagaucgcacuacugcacuacagccugggcaacagagcaagacuuagucuaaaaaauugcagugcaaugcaaugcaaugcaaugcauaauauaaaaauauauuguaggagaaaauaucaagagaacauuuuuuaucagcccuccacuggauggcuuucugccugcacagcugaugagguggccuugggcucugugcacugaggcuuccucaccagucccccgacuuccagggucgagacuuccccuuugaugacuguggcagggcuuucaccugccuccccguggagaaccccgaggcccccguggaagccuuggucugcaaccuggacugccugcuggacaucaugaccuaucgggugaggcugggugguggcccguggugccucgucccagauagagccacuucccucccacuguucccccagguaugaucuaugcuggcucagcugggagaaggaaugguuuugagggugccuaauguuaguuaagagcuucaagaaguuaguugugucugggggcaguggcucaugccuauaauuucagcacuuugagaagccaaagugggaggaucgcuugaggccaagaguucaugaccagccugggcaacacagcaagaccccaucucuacaaaaaaauuuuuaaaaaauuaccugggcaugauggcaugcacuuguagucccagcuacucaagaggcugaggcaggaagaucgcuugagcccaggaguuugaggcugcagugagcuacgaucgcacuacugcacuccagccugggugacagugagacccugucgcaauaacaacaaauaaguuagucuuggucacauggggaaaguuguaaacccaggucagagagugggugggggcagaccaggucuuggaggcccuuguuacuucaacagcacaguauccuugggcaaggagggggcaggugaaggccugggccaggcaccagcuguguucugucuccuuccccccacagcugggcccgggcuccccgccaggcgugugggucugcagcaccgacaugcugcugucuguuccugcaaauccuggugagccugagacuaccugggacugccuuccuucgucacagccacagcaagaagccagcucugcccuucuugcccacccugccucugggccugccccgcugcccuauuagacgggaagcuggaggguguggagaaugaagccugguggaggcagggcuucuccugcugugccucagucugucugucuauaggauggacagaagcagcccugccccuucugucccacagggcucugcggaagaacuuugggagaggaggguugucauucucccaggcgaauguccauuuggcuuggaaaccguauuucccuuuuagaggugcccaggugccgcagcccugggcucuugcuuccaccugguggggaaauccgugccuuggguggaggccccugggagccuccugacugccccaccccacagguaucagcugggacagcuuccggggagccagagugaucgcccucccagggagcccggccuacgcucagaaucauggcgucuaccuaacugacccccagguagugccccuggggacaguggagccggcuggggcagccuuccuccugucagugggcagccuccucccugucagugggcagccucucauccuggauuuccucgcauguuccugaauccaaggaguuuccuccguggcaguggcaccagugcucccuuacucucgccaaaaauacauuucacaccgaccgccuguccagucucugugcccaggcucagggcugcaaagaccuuuaaagccugcccucugccaucauggaguagaaaucucaggcccccccugagaaugccagcaacugccagccuugcguccucagcuuuccuuuggagaaugcccuugcugccaccuguggcuguggccuccuuccagaucccuuccugcucccuccgcugauucuguuucucccugcacauagggccuuguuuuggacauuuacuaccagggcacugaggcagagauucagcggugugucaggccugaugggcgggugccacugguauggcugcugggcccagguugcggggcuuuggggaccuuaugggacagggagggagggucugacuuccuucgauuccuucuagaagccuccaggacaagcuagagcuagaaucugaggacaggguagccuuggaauucagggucuuguccugagccagaaagccuagaaccaggcgggcacgguggcuaacgccuguaaucccagcacuuuaggaggcugaggcggguggaucaguugaggucaggaguucgagaccagucugggcaacguggugaaacccugucucuacuaaauacaacaauuagcugagcaugguggugugugccuguaaucccaacuacuugagagguagaggcucgagaaucgcuugaacccaggaggcggagguugcggugagcagagaucgugccacugcacuucagccagggugacagagcgagacucugaaucaauccccugcccgcuguaaaacaaaacaaagcaaaccucaaaaacucaaacgaaaaaagaaagccuagaaccagaaugugagcaaguuagggagugcgguugggaggaggccuagagccagacuccgggaaugcuuccaucaugaggggcaaggauuggagaggcauggagaucugggaguggaccauggcgaggguggagaacuggguucaggagaaggccugacaguugagggugucccagaaggugucuuggugggagcuaccccaaguaagccuggagucuggcugcuggaguggucagaaggugacacucccugccugguauggcacucagcuucauguggcccaucugcaugugcccucccugacuuguaccagggccugguccagggcccuccaucucugauccuuuuggggucccuuccaggucucugggguugucuucuucucuguggagacugccgagcgccuccuagccacccacgugagcccgccccuggaugccugcaccuaccuaggcuuggacuccggagcccggccuguccaggugacugggggagggcagcuagguggggccuggcuugggggcgaggcacugugugaccucaggccagccacuuccccucucuggggcagagucuccgcagacgggacugcccugguucagccucagaacuugggggcugaaccccugccaugccaauagcugugcuucuuccccuuccccuagcugucucuguuuuuugacauucuccacugcauggcugagaacgugaccagggaggacuuccugguggggaggcccccagaguuggggcaaggcgaugcagauguagcggguuaucugcagagcgcccgggcccagcuguggagggagcuucgcgaucagccccuuaccauggguggguacugccucucagcucccugggguggggagaccaugggagugaggaccccaagaauggagcugcucacugcaugcugggccaggcagcccagcacagggacugggcaguucuccuguccugugccagagccccccacugagcuaccuccuuccccuucuugucuuccuuuugucucauuccugggcucucccagccuguccacuuuuguuucuguuuuuuuuuguuuguuuguuuuguuuuuugagacggacucucucuuugucgccccggcuagagugagguggugcgaucucagcucacugcaaccuccgccuccuggguucaagcaauucuccugccucagccuccugcguaccugggauaauagccaugcaucaucacacuuggcuaauuuuucuauuuuuaguuggucaggcuggucuugaacuccuggccucaggugacccgccugccuuggccucccgaagugcugggcuuacaggcaugagccaccaugcccggcccuaaccugucugcuuucuuuuuuuuuuuuugagacagaguauggcucuguugcccaggcuggagugcaguggcguaauuucggcucacugcaaccucugcgucucagguucaagcgauucuccugccucagcugccugaguagcugggauuacaggugcguggcaccaugccuggcuaauuuuuguauuuuuaguaaagaugggauuucaccauguuggucaggcuggucucgaacuccugaccucgugaucugccugccucggccucccaaagugcugggauuacaggcgugagccacugugcccggccaaccugucuacuuucuagcuguguuguguggcuuugggcagguuccugacucagcuuccccuaacaggcucauggccacaccugcccccaugugucucugcugcugggaggcagccuggccccugagucgcagcaggcaugggguuggguucaguacuuaugucuuuacagccuaugucuccagcggcagcuacagcuacaugaccuccucagccagugaguuccugcucagccucacacuccccggggcuccuggggcccagauugugcacucccagguggaggugagaccucccugccccuccggugccugcugguugucuggggucaggugggauguggauucccgggaagaaaauagccggcacuuggaacagaugacccgagugcagguguuacccugguuuacacaugaagugcuggaggcucagagaggcuaaguaacuugccuaaggccacagagccaguaaguggccaacucaggauucugcauugagcuugccugauugagaagcuaaaggagaccuuuauuuggggucugccuggggugacaguggugggccugggucagugccgugcugcugaggaaggggacagguaggguucagagguggcccccaggguggcaagguugggcguaguuggacaggugggauggaaauaggucucaggcuggggccaaggcagguccagagaggagucuagggugcugcagggcaggggagcaguaggccuggacgcuuugccccuggaugcuuggcuugggaggagagcuggggcagcccugggccucgaccccccucaugcuccuccuaccuggcugcacaggagcagcagcuucuggcggccgggagcucuguggucagcugccugcuggagggcccuguccagcuggguccugggagcguccugcagcacugccaccugcaggugaggccugagcgugugggcagauuggggcgagggugcuggcaucccgcauguguugggggguguugggugccugcccacccaggaugccugcccugucccccaccagggccccauucacauaggcgcuggcugcuuggugacuggccuggauacagcccacuccaaggcccugcauggccgggagcugcgugaccuuguccugcagggacaccacacgcggcuacacggcuccccgggccacgccuucacccucguuggccgucuggacagcugggagguaggcagucacccugcauucccucacccccaucuucaggcuuuggggagcccaaggaguccuggcccccaccccacugcgggguucucugagcacuggcccgugggacaggcugugaggagggucggauguagggaggagagaaugagggaggagauagggugaagauaggcugugagaccagcagagucuccacaggccuuuaccucccuccuugcaucugcucugccaggugggcuggguggggauuuuguuuuuuuucuggagauagagucuugcucuaucaccaaggcuggagugcaguggcccaaucucagcucacugcaaucucugccucccagguucaagcgauucuccugccucagccucacgaauagcugggacuaccagcgugcaccaccacgcccagcuuaguagagaugggguuucgccaugcuagucugguugggugggguuguuguuuuuuuuuuuuuuuuugagacucacucugucucccaggccggagugcaguggcgcaaucuuggcucacugcaagcucugccucccggguucacgccauuuuccugccucagccuccugaguagcugggaguacaggcgcccaccaccacgccuggcaaauuuuuuuguauuuuuuaguagagaugagguuucaccgcguuagccaggauggucucaaucucccgaccucaacugaucugccugccucggccucccaaagugcugggauuauaggugugagccaccgcgcacggcuggguggggguuuuuauccuuauuugacaggcuagagacugggauucagagagggagguaacccgccuugggcugcagccuguuguggugggcugggccuggaacccaggguucugcuccagauuucaggcaccuuggcgggaguguuggggcugcagggcugaaaacaauuucagaaauugcuccauggcuggguguaguggcucaugccuguaaucucaacacucugggaggccgaggugggaggccaggaguucauaccugcagugagcugaccacaccacugcacuccagccugggugggucaaguauguucuuugucugucuuccugcccucaugugagcacuugagcagcuccuggcccccuggccgagugucucuaacccuuuccuguggccccugcagcccugacugcuucuuccucucccccagagacagggggcaggcacauaucucaacgugcccuggagugaauucuucaagaggacagguguucgguaagguggacaccccuagggccucugugggccugggcagcugggguggcugcugcucuuugaggugugucccuccccugccccagagcagcacgggccguguuaccauccaggggccugggugguuuugggcagccggauucucuccaguacuuucccccgggcagcucccagucucuggcugugcugacuuuggcuuucuuguucaauggucugggaaaggaugccaggcagccuggcccccgaccugaauugcccacuuaugcuaccucggaggagucuguccuguccccaugaacugacaggcggcucagggcuuggggaagagacuggagcuuuugcuucccuccugggaaugugccuucuccccacaucagagccugggaccugugggacccugagacgcugcccgcagaguacugccuucccagcgcccgccucuuuccugugcuccaccccucgagggagcugggaccccaggaccugcuguggaugcuggaccaccaggaggaugggggcgaggcccugcgagccuggcgggccuccuggcgccuguccugggagcagcugcagccgugccuggaucgggcugccacgcuggccucucgccgggaccuguucuuccgccaggcccugcauaaggcgcggcacgugcuggaggcccggcaggaccucagccugcgcccgcugaucugggcugcuguccgcgagggcugccccgggccccugcuggccacgcuggaccagggugagugugcaggcugguagugcugcagaaucaggccaggggcaccugcccucccuguccucugggccauccccugaggggacuaggggaccaugaggugcucaagcagggaaggggcaugcuggaguuuacuuuuaggauucuggaaggccucauccuugucaaugggguuuggucugagguugaggcauguucauccuugucagugggguuuggucagagguugaggccuggcagcugagcucuagguccuaggcacaucggcaaacccugcguguucuguacugggugccaggaugugggugcagagcguggcgaggggacagagcccccaggggacauggucaucucugcaugaggucccaagcacacuuccgggggcucacagccuuagccuccuaggcugaaccucauggaaggucccagggaccguggacaugaaugguauugaagccacucacccagagccacacggcuagcugguggugaggcugagaccugagcccaggugguuugagcccagagccugagcucuucaccacuauggguguccugggugggggugaagagacaccuaugggcugggacuggcaagacgagaugaucucugccaggcagagagcaggagugcaguuacagucaaagauacauugugggcaaaagccaggaggugugaggggucuggcgcauuuagggacuguugaguagccucucgugaaagaggauuuugaagacaggccuccuccccugccacccccaacuccuugucccucaguugcagcuggggcaggagacccugguguggcggcacgggcacuggccuguguggcggacguccugggcugcauggcagagggccgugggggcuugcggagcgggccagcugccaacccugaguggaugcggcccuucucauaccuggaguguggagaccuggcagcgggcguggaggcgcuugcccaggagagggacaaguggcuaagcagguguguacuaauggaggucagaucccuuggauaagccccuugcugucugggaaguggacccugauggaggaaacccagagagagguggggcucccuuggguaccccgggacagucagguccccaaagccaggcaaucugcccccagcuuggggcugcaugccaccaucccucccccuucucuuggcaggccagccuugcuggugcgagcggcccgccacuaugagggggcuggucagauccugauccgccaggcugugaugucagcccagcacuuugucuccacagagcagguggaacugccgggaccugggcagugggugguggcugagugcccggcccguguggauuucucuggugagccccuuguggcaggugggguugaggguagcugccccagagccaggcuggcagcuucugugaccagcuugagucuugccacacugccauagggggcuggagugacacgccaccccuugccuaugagcuuggcggggcugugcugggccuggcugugcgaguggacggccgccggcccaucggagccagggcacgccgcaucccggagccugagcuguggcuggcgguggggccucggcaggaugagaugacugugaagauagugugccggugccuggcugaccugcgggacuacugccagccucaugccccaggucaggcacccugggaccucugcagguggggcuggccagcugggggcucggggcagaagcuagagacugcaggccaguggggucuggccugagggccagccagucuggcugaggagccugaagggaaggaaggggcugggagucaaccugcaaagaugacacgugucccugucugggagcccagaggcccuuuuguggcuuggggauggggccaguacugcugcugggcuuuugucccaccggaugagucccgcacugggcugggaaguccagggugggugggugccugcgucugcccaucgagacugaauuccuuucucaugccuguccuucugcaggggcccugcugaaggcggccuucaucugugcagggaucgugcauguccacucggaacuccagcugagugagcagcugcuccgcaccuucgggggcggcuuugagcugcacaccuggucugagcugccccacggcucuggccugggugagcgggcccugccuccugcuacccaccgacuguuacagcccuccagccuugccugugaucccccuuccuggccucugcccuuagacggagucaggcaggccugggcaggguggagguguuucaugucugcucucuccucuccgcccugcaggcaccagcagcauccuggcaggcacugcccuggcugccuugcagcgagccgcaggccggguggugggcacggaagcccugauccacgcagugcugcaccuggagcaggugcucaccacugguaugugacugcccuggaguuggaggaggucacugacacuuucccaagggcccgcggggggaguggggcuccccuggauuugcaugugauuggccaacagccacaagacugugcugcuguuggaaauacuuuccuucuagucacuuugaccuucucuggucguuuucaaccugaaauguucuaccucccaacgagccguuucacaagcaucuacugagugccagauucugugcugugcccuuuuuuuuuuuuugagacggagucuugcucugucgcccaggcuggagugcaguggugcgaucucagcucgcugcaagcucugccucccggguucacgccauucuccugccucagccucccgaguagcugggacuacaggcgccugccaccacgcccggcuaauuuuuuuguauuuuuaguagagacgggguuucaccguguuagccaggauggucucgaucuccugaccucgugauccgcccgccucggccucccaaagugcugggauuacaggcgugagccaccgcgcccggccugugcugugccucucaugcuuguuggaaccaggugcugugcuucgugacugugccuuuccagggcugugcugggguagggcugggcagagcugcuuuggaccuuccgccuguccuggcaucgugcccuuacuugagauaugaucaccugugcccccgcccccacccccuggccauauggugggacagcaagagcccaacaaugacuaugaucuaaugaaugucaccagcgccaggcuucucacuccuccuggccaccgagcccccuggaacccauggccaguguagagcagcuacagcuugucugguuucagguccaccucagggugucaggucccgucuccagcacaccccuggaaagaaacugcugcaaaggccuacugaagccugacugugguguuuucugucacucugcagcucaagccucacauuucacuguagugacucauaucccauaaucgguagucauuagcaaaaggagcagauggggaagcauuuucaguuuucuuuugagguguaccauucaaguucuacauuuggccaacggaaaacuauuuguugagaacccacucuguggggccccagggauaaaaugagcaaaaauggggucccugcccucaaaaguccuguggucuccuggagacagacauuaaucaauaacuacucaggugcauguguauuacaaacugugccaagugcuuugaagcagaggggcacaguuaagucuugacauuucaagacuuagccacuuugcaacuaccagguuuuggcugcaaaguuccagauggcuucugucuuuugcauuucauacuuuaaacccuugcaggcccuucccuaacuaucaagggccugucccagaagcaacucaaguuuuguuauuuuuaauuuuuuuuuauuuuugagauggagucuagcucugucacccagauuggagugcaguggugcgaucucagcccacugcaaccucuaccucccggguucaagagauucuccugccucagccucccagguagcugggauuacaggugccugccaccaugcccagcuaauuuuuuguauuuuuaguagagaugggguuucacuguguuggccaggcucgucuugaacuccugaccucaugauccgccugccuuggccucccaaagugcugggauuacaagcgugagccaccaugcccggacuaguuuuguuauuuuuaugcagcuacaaggaggaaaaugauacauaccuuucauuacugaagauggaaagauguguaaguuagauaagagaaaaacagauccugaugaccuuccuuccaacauaaaccaccugucagaagacggugcagggagacucaggccaaagggaagguaucugucagccucuccucugacuaaaacuccccuaggaggggcagaggucaguguaaaauauguauuuuuugagacagagucucacauugucacccaggcuggagugcaguggugcgaucucagcucacugcaaccuuugccucagccucccuagaagcugggauuacagggcaugcaccaccaugccuggcuaauuuuuguauuuuugguagagacuagauuucaccauguuggccagguuggucucaaacuccugaccucaaaugaucugcccgccuuagccucccaaagugcugugauuacaggcgugugccaccgugcccggccauaguguaaaaucuuuauucuucagugugguuuaucccaauuccaauuauacauuaggucuaaaacaaaacucaggccuugggaauuccaagcuuugcccuagagugaagcccauucccuugcugggauuguucuggggacagaagcugcauagcucacuguccuguggaguugagggaagcuaucuuuccacacuggucccagcaaggggugcagggccgggagccuaggcugggagagugaagcugggccagauagacuccaacagugacagucccugggcucacaggagguggcuggcaggaccaaguagguggccuaaugccuggcaucaagguggggcgcucccgggcucagcugccacugaagguggagguagaagaggucacggugccugagggcuuuguccagaagcucaaugaccaccugcucuugguguacacuggcaagacccgccuggcucggaaccugcugcaggugagcucuggccccagcaugagggaggcaggcagggggccugccagcugggccuggguccucaccaccccuucuccugccccguccgcaggaugugcugaggagcugguaugcccgacuuccugcuguggugcagaaugcccacagccugguacggcaaacugaggagugugcugaaggcuuccgccaaggugaggggcuuccucugggggggucagggcacugggagcgaguauucugucacuuguggguuugaggccagggucaucugcaggcuuggcacaagcuccagauauucggccucugggaacagaagccuacugucuguccucuccagggucucacauuuaggggagagcuacaucugaggacaaaauuuucaucaugggaaaggcccuccagcccuaacaggaagcagagaggggaagggacucaacccauggcugaguuccaaggaagucugagcugggcaggguccccaguguguggcuucacagcucccuagaugccgacuaugcugggugugguguugguugcuuccugcacauugguccucaggcaguccugggaaguggguuacuccuggcuccagccggcacuggaauccggcuucuuuaccaugacacuggcucagcagcacgucuuggcacuucaugcaaucuccagaugggugcugaguaucuuggcccaggcacgucacuccccucugccccaccucaggaagccugccucugcugggccagugccugaccucguacugggagcagaagaagcucauggcuccaggcugugagccccugacugugcggcguaugauggauguccuggccccccacgugcauggccagagccuggcuggggcaggcgguggaggcuuucucuaucuguugaccaaggagccacagcaaaaggaggccuuggaggcggugcuggccaagaccgagguacugauggggcugggguugguaaagagaccucugggggcaagagaccucacuguggcccaccaguuaaccaggggcuauaucuguaagucccccugguccugcaggcccaguccagccuccagaaggccugagauuuguccagagccuucuaaauacuuccugucuuguccagggccuugggaauuacagcauccaccugguugaaguggacacucagggccugagccugaagcugcuggggaccgaggccucaaccuguugcccuuucccaugaagcuggcuucucucugcaacaggagaaaaccuggagcuacagugucccccaccuuccuugccccaugggaaccuccaccuccuacuccccacccaccucugcgaaucugcucccaaaggaagcugaccagagcaagaucugggcaagcagagagugccugggacaggacugugaccugguggacaggggccuagauguagccucuguuccuccuggacauaggaaggucccaagcuuaguaucccacguggccuuuacaaauccuauggcuggccuucucauuccacaagggcccuggaaaggguugacagccagccuuggcauauggcugggagucccuuagcaaggccaacccugaagaggcccuuugaggcauucccuauggcuuagaguuguagacuuacacucaacccucaugugagcgugggagugaggguggcggucccuugccaaguugguagcagugacccagugauucacugccaucccaggccuuaacuagcaaaacuacggagcgugccaagugaccuggugccugugggaaguggguucucaggacuggcauucuuggaauaaauucacucuguccuugcaggugguccucguaaagucacuuuugcuccugcugggagcaguucccacuucucuacaccauggggaacuggcccuggggugauccagcuuguggugcugggggcccaagaggggcacgagggucugggacuggaugggggcuccugccaucaugugggccccggacacagcugugugcugcacugugugugggagcaggcugaggucuuggguuuuaccuuccuauuucagugcaacugauagaccugcccugccccauagcaucuggcccucccugguaacagcacacuggcaucucuccaaggaguagcuuuauucagggaucauaaacaucacagccucuccucaaagucaagccuaacugcuagguccccagauguacccaaguugucuaggacuggcagggguagcuuguuugcuguaguguuugagggcaagagacugaccauccaugcagaaagcuggccugggcugcucgcugccugccguggcuuucccaccucauuaggagcccgcuucucucgguggggagaugcugcccccagagcaucaccuggccaggucugagggcagagcauggaguggguccagacuuuguuucucugcugccagccguagaaaggucugggcugucagaucucccccaagccagacagccucgcucagcuccuuggcuggggccccuuagggaacaggccugcaagugugaugagccaggugugcucauccaggcagcuacaggcgcagccucuugauaucuucacugcggaagucuauccgcagggccagcaccuggcgcacuucagcaggggugaggcgccacgucaaugggccggaauuggguccccaguaaucgaggaucucggucaccu

SEQ ID NO: 15822 - RNA, 3519 nt, Homo sapiens
gaggccgcagcccaccaccaggucguacaucuccacgcccgcgucggccagggcgagcgcggcggcggugagcgcggcggccagggccgagccaccguccuccagcagcagcgccgacaccucgagcugcgcgcgcggguagcggcccaggcgcacagccggcuccagcgccuccugcagcgccagcgccagcucacgcuccucgcagccgcccgggggagcgcggcgccggcggcccgcgaagggugcgcggcggaagucgcagagcaggcgaccgcgcagcgcggccggggccucgccgccugcuccggccgggccgccgccgcgcucgccgcccucggccugucgcgggcccgacacggcacacagcaccuuggugccucccgccuccagguaggccgagcccuuggccuggcucagcagcccggcgcgcgcguacacgggccguagccgcguugggucgcgggugccgggcgccuccuccucgucggccgcguacagcugcggcggcugcgauucuucagggccgcggaugcggcggugauccccaggcauggcgguucuuggcgugcgaaccccuuccgcccaacgcccugccgcauccacugguucuuccguuguuuaaagacgcgcggcugcgcaugggcugucgagagagcggcgggaggcacuacagcgccccuggaggcccggagggagaacggcccggucccaguugugcaggguagccggauccauccaucuugcuggaagggaggggggagagcagcuccaagaaaggcuucucugcuuccaacuaccuccaccccucaucuacugaauuaugaacgccuugcuccaagucaccccaccuauuuggccuccaccuccacagacguuugaggcagcccuaggggcuguucccaaaauuuuggguucuggggcuggacuaggugaacaccacagcagccagcaggagccacagcauuuauucuacagacgccaaaggcugucaaaagagccagccccuauugggaagagggauagagaucaugcggcauuaaguauugcacgugguccuuuuauucucugcagcaaaaacgauuccuacuugcugacgcggaaagcucaggucuggagagccguuaucuauagaugcgagcgugacgaucaacagcaaugcgggguuagugguucuagaccgauggcacugacguggagggcucagggcagaaauuuaaggggcacugagacauaggacugcucccaaguguguuccaguuacugcuggguuaggaggggcucuuuaaaggucccaagauucaaauguucuuguagcagaugaagagcucuuggcuggacggauggauccagugggagccuccuccuuccccacucaguucuuuacauccccgaggcgcagcugggcgaaggaaguggccagcugcagcgccuccugcaggcagccaacguucuugccuguggccugugcagacacauccuugccaccaccuuuaccguccaucaagccugacaccugcugcacccacucgcuggcuuuuaagccccgauuggcugcauucuagaagacaggaagggaagggggagucagcacagaagaugggauugagggaggaaugcagggaaagaaaggauggaggagccaucacccacuccuugcccugggugauacugcuggaggccgagacagacuuuacggcugguacagggggcggccauggccacugccaggacaggacagaguggcaaagccagguaucaaccagaugucuucaccaauaagaaggccuggguaagggguacuggcaaagguaaccaaccggugggcagaaaggcuguuucgaaugcaggcuguacacacacaggccucagccaacaaccuuaagaccuaacacuucccacuggugcgagguggugcugaccuggggaacuugacacaggcacgugaucuugccagccucauuguccaccgugaagagcauggcagaagucugaggggagugcaucuugaagagcuucaaggcuucauucagggccuguggggaggaccuggcucaggccacggugcuggagcagggacccucacuagugugagcauuugcagcccucagaaggccugccacccaccccuaccccuucccagagcaggggcugugcccagggccuguggggaggaccccagcgccgggcccugccccuacccuggcccagguaugccucccacaugcagggagcugcugcuccucccaaucucaaucccagaccgugggcccuuaggcaaccacuucgcucagagccacagaggccacaugucagccaccagagagcugaugagcccuaggggaggggacccuggccccuggguugccuuggcugaggcgccgcucuccaucuccaggaugacaagaggcugguugggguugcugucgaugaacugcuucgucuucucuaacaccugcaagaaaaaaguccagaacagcagcucagaccaaaagcccaggccccgaaccccuggcuguucugccagccuuugccuaggaaacacucuggccacuggugcugccaggacucacucguuucuggacaucggcuuugcuggcucgguccaagucauccaugaccuucuuuagggauuugagagucucccgcaauucauccuucugccacugggggaugacugcaguggccagggccuggaaccaauagacgaccaucucaaucugggccacaacuugcugggaugucaggguccagcccaccccacccgaacccaaguccucccugacuaguguccuggaaaggaaagcaaggaaagcuuugagaccagucccuuuaggagcagcuguggcaggugaaacaagcagggcuagagagaaaggagcagcagaaagcugggcucccaaaucaggcccgguccuuaccaggcugggaacagccugugauaagcuuccuggcagcuugaaaugcaaauaaauaccaggcaggcuuggaagcaggggccagccuuagcccauuccccaaaucccuccaccccagugcccauacaugcuugggaagagcucuccugcuagcagcacugggagcagcagggaauguccaggguccaaggacaggauccauggggucccugcuacaaggcuacaggacaacagaagucagcccaaaggcccauuccaccaagaaccagggccugacugacuacagaugauuuccugaagacggggcauguuucaugcaccaggcccugaggacggagggagggaagccgccccuaccucuccaaggucagcgaucucccucugcacauccuuguuuggagcagucugagccuucacuuuggcuuccaugacagagagacauuucuucaagcucucugcuuuccugagggccugggaggggacaccgggucaaccccaagcaggaggucugagucagacucacuauccugugucugagcagcugcggaagccccggcgguaggccuugcagcaacauaccccaacaccccaaaagugucug

SEQ ID NO: 15823 - RNA, 10495 nt, Homo sapiens
cacccuucuucgugcuucagaaaguagggauaucuggggacaugacuguguuucccugggguccuuucagaagagacuuaggaagcuccugcucaggaaucuggcccucugaaagagccccuucaaagcagccugggcagcagguaacgugguuucccuugcggcccccuccucccagcugcauagacucgugguuugaagugaacagaucuuguccggaacacccugcggacugaccugcgggcuugcuugcugacuccucucaaaggugagcccgcguuugggggugcuccgggcucaaggcuuggggucaggucacuuugggggccugcaguuuagggagccgggcugcccuuaugccacugagaagaaagcaggagcagagggaaggagcaccucaucagugagcaguuagucauccggaaaugauuuucccugggaaggacaagagauacaaaccaacauggacaguuaugaagaacaggcucagaagaguuaggaucaguuggggaagagaccaguacaaucuacauuccuaaagaaaguucaggaauauccccugggaaugugcacgggcaggaaaaggagccugagcgguggguuugugccuggcuuggccucauccucgcucaccucugagucuccgccucuucuaugguaacggggauaaucucacucccuguugccauaaggacauugcacuuacuaaacagccaugggcagugcauuguucccugcaaagugcuggucagcgaucauuugaccacugcuucuucccaugccgcuuccagaugaaucugaggccuccaggccagacucgaucccucuaucccacagcacugggugcugacuccacacaucccccuggcuuaccgcugggucuggccuccccauuucucccccagggguaccccacuugcugccaaccauccaccccugacccccaucucaccuguccccuccaaguucugggcuggcauuuuccuuuuucuggcaaacaaguagacaaaacccccauaaaaaccaaaagcccaacuccaucucacagccaaagguuuugggaccuuuuucuuccccccucccuuucucucucucuugcuuucguuuucuuuuguuagguuuauuuuauuuauuccaaguaaacucccagaacagcugaugaugucagacaaaucagggacauuugcucuuuuuaccuccaccucaaaaacugaugacaaggggagaagaaagagccaggggggagagugaggcaggggaguagaaccugcccaggcacauggcugcaaauuccccgugugcuguuuggcuucugggguccuguguagacgccccagccccgccugcccucuugggaugcagcugcccugggaugagcagacagcccucggcccgauggagcacgacuuauuuauuacgguccacacagggacagagcgccccugcuccagggaggaggcucaccggacccuggggcagagcugagcuugggacaccagcgggaacagggcaccccuucugcacugacuuccagaucaugguucucccuuccucccugaggacaccaaauuggaugagagcaaguuugagagaagaaugaaucaacugcuauccuuccccucaccccucagcccaggagggaaagggcauuuucuuuuucaucuuugaaaggcauugugggucugucuuuaaaguguuuacaaaaaaaaauuauauaaaaaaaaagucuagugucgacugguguuuucccucgugauguuuacagcuugcuguuugcugcccagccauaacccacucagugacagacgaacacagcuaaggccucgcugccagccuucugacggcgggcgagcacacggucucuuccccugccccaacuggcccucuccaccaccaacuucucuacuuuggguuuguuugguuuuuucccucuauuuuucuggcugguuuuuugcucuuuucuccccuugagacccuaauaucuugacuucauugccaaaaaacaacccauugagaacuuucuuccuacugaucccaucucuuuucccuucuuuccuccugguuccggucaguucagaggauuuaacaaucacaaguguccugcaaaaaugccugaacauuauucuuaggcccucguggauuuuuuuuuucagaaaacuuaaacaaaaaaagacuuacuaagaaauauguacagcuaccccuguuuucaggcacuauguuugagaacauuuuagccauugauguucacacguggcaucagcccaugcaagauagguuucuguauuuauauauuaaaauacaaaaaaaaacuuauaaaauguuuaaaaaaauguucaaagcuugggagaaaagcuuucuucauuagucaagguguuuugauaugguauuaaaaugucuaauaaaagauggcacugcgugauuuuauuuuaaugaaguguuauacaaucaagaaaugggggcaagggccugccccccacucccucaccuaccuccuuagcauuccuucaggcugcuacucggggcuccaggugugugaauugguccucagauagucaggccuggguggagggaguggcaagucaggcgugccuccuacaagcuuccuaaccucuuaagcaucauggaaccagucagcccucuguggagucauugugcuggaccucugaaaagaucugcaggggccaagauguugcagccaccggaggcugcaaggauguggguucuuccaggugugggcccagccccccuccuuccagccuuugcuccccaucccacguuccacucgcccugccuguuguucaguuugcgucucagugcugacucacgggcaugcuucauugaggcccaggaagaggcccugguuuggggcugugccagcucagagcccuugaaccagaaccaacugcucaggcucacaaaaguuggcaaaaugcgggcugggcaggcagcucggggcagggagcagcagugcaggccuggccuguguccccgugcccagcgggcucccggagcagcauuccagagccuccugcagagccagcgaaggaaagcucuagagggagacgacuccaccgccucucugcucugacccuucucaggcccgccugaugugcuggaccaucccccugcugccacggccccuggcuccgcagucacccuccaucagaugcuuccagaagcaccuacucugugcaagggcauucacaacaggccagugggcaaacgugagccagggccagcggagaaacacuaaagaagacucggugguucagagccugggucucagcgcgggacccgucuggggugaagaccuuggggcuguugugagucgguggcaggaacgugggcucuagacugugcauucaggcucuccuacuuggcagaaugaucuuggggaaacgacuucaucugaacuucagauauuucacaugugaagcggggacaaaaccaugcagcucagaggucccugugggggcugggggagcugcccugcaggucuuggcacaugcacagcaggcuccccauagcuuugucaccacaaagggcacuguucuauucacagcaccuccugcuucugccuggcaacugugucucccugugcuauauuuaauuccaccagcaaagcuggcgaggcagggcccagcccugaaggagaucuccuugccugaccccuggaccuggaaauggaggcuucaugugcccgccuuggcggcuuaagccugcugcuuuggcagugccaugggugagccgagcagcugugagguggguggggcagggcuguagcccacgccgggugcuauuccaggcucuaggggcuggugcucauccccacccccagcgacuuccguccuaccuggcaugcugcagcccucugccggcugugguguccucugaauuuggacccagguugccugcucuuguugugggggugggauuggggcugucuguguuucccagguggagcucauguuugugauccucuaucuggacagcucuccagaauccuguguugccccuguucugccuuucugggaugggagagaaggugagggagccggcgagcagguucuacccucucugcuaagggccuagcacacuuugaugagguuccuggacgugagacccucacaaagaccaaccauuccucuaauagccauuuaacgguacugcaguucaugggaaaauguccucauucuuaggagauagaugcuggauuauauaggugaaugccuucaagaaauguguaauuuaauuccaaauaguuccccccaaaauacacaaagcaaauaaggccaaaauguucauuguugaaucugcaguggcugguauuucagugaacaguguacuuguucuuucaacuuuucuguauguuuggaauuuuucuuaauaaaagauugugggaaauggucauuugcugagcgccuccuaguugccaggcacuggagggcgcaucaaagaagaguccuacccaggagggagagcgcagcugcugcaggauucucgccuggaagaguggguggcuggcuggcuggcuggaaggggaggggcgagagggcugucucggugaugagcacacgcgugcuggggugguuuggggagagggcugagauuugucaccagugagcccuuggcacggucucugcuccccaccagggcagcacgggacagaaacgucacggaggaguagccuccaggcucagguugguguaacugcugucggcuggagcccaguauuagcacggaggagggguuccaagaacugaaguuggacuggggcgucucagcgcagcugccucugccuaaggccuagcagccugccugagcacugacagcugaugggaggaggagaggggcggaggccagggagggcguggggugugacaugccucuuuccaaaagggaccgaaggcuagaggggcaaggaagaugagacagcacugcagguuccugggaccugcaggggauggaggacuagcuuggcuuccaggcugccaggacuuaccugacccuaggaggagguuugcccagggcugagugccgcaggcccugggcagaggagucgugagcugcagaugccgcgugguaucugagcuucaugauuucgggcgcccuccugugggcuuaggggggaacaacugccaaggucucaagacgggcuccggcccaagacaggggcaggcccucggguggacagaccuugagggcaaaacagcuggugguacgauacaucaccccaugaagaggugggugcaaaaauagucucaucucuguuucuagagacguggcagcugcugaggaacacauucaguguguucagaggcccgguucaggcccaguuggggagcccauccugagugacaugugccgugggcagguccucagcucugaggcggaguagcugggacagggaccuggguuccuuuccgaacccugagcaccaaccuccuccccaggcuauaagaagucagaggacagccccaaaacaaaggggucacugaccaaaggacagagacccuggagggggaggggaggaagugcugccugcugacuuccagguagcuguagguggguuucagguuuauuacagauuuauugggggaggccccaaggagaagaccuaucaucaugucacgggagcucacguuccauaccaggaaaggaguguuccugucaccaggugaagggggaaggguccugggaccccggcagugggaggccucggggaggggugucaucagagucuugaauggacccagacgcucucuucccgccaggacaggaugcguaggagcagagaggaagcagcuuugcugggaaccacccugggucguuuacugaaccaaaggcuccuggggccagccagagggccagggagguaacacggugcucaggcuucucucugggcccucuggccuugggcccagauacagugggcucgcuggcaggaagacugccucagcaucuauuuccuugcaggggccguggcaugaagaaaaguuccagaaccggcuccguagucagggaacuugugggcuaagugcucagacccccuucacagcacuuugccuggauucaugaggccuugggggucuagcacggccuugagcugccgcauggucuccacgcccacggcgcccaccuccuccugcagcagcugccgcuugcccauuccgaugccaugcucccccgugcacguuccguggagagccagugcccgccugggggcaggaaggagacauccucagggggcucccuuuccucugcccucagcucuuccccucccuggcuuugcuccuaccugcccagcuguucugcaaaagccuugacccugcccaguuccucggcgucaucaggguugaccagcaggaugcaguggaaguugccgucacccacaugcccgacaaugcuuccugggggcccagaggacagaacuauucuccagcccaguccuccucuugccuccugcugccccaggcucugaucagcccugacaccuccccaccucuccccagcagcagggugggcagaaccugugaguccugaggcauucagauccuccuuggucugcaccacgaucuccggcagccgggagaugggcacacacacauccguggaguagcccuggucagagggaagccuaugaguuaccccugccugauuggguguacggggucaccguggucaaggcugaggaugggucggagggcacugggcuucagcucuuggccucacacaaggaaauaauccugcucuucucuaggccucagcccucaccuccccccgacacaacacaggagaccaauggcccaggugugcuugccacaccuccccuguggcucccacccccaagccccaggcugcugagccuuugcauagcugccuggagcccagacuucccuuccccagguuaggcuaacaucccccucucuaucaucucuuccuccaggaagccuuccuuccauguacagcucccaagagcaccgcaccguucccaugaccuggcucacaggaagggcuuuugagggcuuagcagacaacugugcuuucccuguagacgguaucugaacagcuggguggggcggucugcagcccuuguuucuagcgccugcucagccaggcccagccccguuguugaggcucagccugcugcucugugcaguagagugguggguugaggaaaggguuugugggccgagcugugggccccaucuguaccccagccccagcucaccuugcagccuggccgcguggccagggcugcguaccaggcauugugccgugcuguccaaagccggcugcgcuccucggccuccuuggcccaggagaagucagaggcuccguucugcuggacuaucuccucugcaguuggggaaggggggcugacaccgggccgccacugaggcagcccacccugcugccccacuccaccccagcauaccugugcgcugcagcugcuccuccagugccugcugggagccauggaacuccaggaagagugugggcgccacuaagcaauucagcuugcuguaccuguugcaggcauccaucaugacuucauccaggaacucuggauccagggagauggcaggccaggugaggccuggccuucccagggggccucuuccagggagcccacccugacugcccccauccucagcucaccaaugcgggcuacgggcacugcagccuggaggauguguacagugcuguccacagcagccuggacacuggggaacgcacacguggcggccacuguggccucaggggcagggugcaggcgcagggugguggcugugaugaggcccagcguccccucggagcccacgaagagccccgugagguuguagccggcugcacucuuccuacgucccagggacacacaaggugaguaccaggcugugugaugagggauuucuggccagaagccgaagcuggaacccaagacaccgaccccaggcacugaggucugggcuggccucccucgggcccaguuucccuggcccagugcuuucugcuccacaaagccagucggccucaggcagggagagcaaacccuggucccauccacuuuggcccagcugacagggcuucagagccugaggaagccuagccugccaaaccagggggccgccaggaggugcuuuucacagcccggucucugcagggcagcccgccagcagugcccagggccagagcccgggccccccgcagagggcgcucaccggaaaugccggccucggcccgccgugugcagcagccgcccgucgggcagcaccaccuccagguugagcacguugucccgcauggugccguagcggaccgcguugguccccgacgccccgguggccgccaugccacagagagaggcguccgcgccugggucuggagggcggcguacagaaggcagccucagggaccggagguccuuucccucgggcugggggaggaagguccccugaaccccagacacagcccugcucccacggugcccucagggucccaggaaagguucgcgaguccuacccacgggaaaccagaggccgcugucccgcaggugggcguugagggcuuugcgggugacaccuggcuccaccaccacagagaaguccuccugguucagcuccaggauucgguccauaugcgucagguuaacgcagacgccgcccugguuggggcaggugcuaagaccacugcagaccugggucucugaccuggccacguccccggaccacaccccgcggguguccccccagcagccagaccagacccccagaggcaggcagcccacgggcgggagcagacccaaggugccguguguggcgggggaggcagccacaggugugccaaggugugcugggaccauccucgggccgggcgagggagccccacuguaccugcacagcacagacgccacccucaagcccggugccggugccgaaugggaugaugggcacaccuuggcgauagcacagggcugccagccggcugaccugcuccacguucuggggccacaccacagcaucaggagguucgcaccuagaaccagacccucagcgauuuagcggggcgugacacccucuggucccgagguguugcagggccugaggcuacagcaagcgaggggcagagaacaugccagagcaccccaaaacagaugagugaggaggaaggcaacccagcacccucucucucagcugggguugaauccagaagacaggggaggggcccgcgaacccucccauaccugugcaccgacucaucgcgcccgugcugcucucggaccaccgcggcaguggacacgugggagccgcccaccacggccuucagagccucuacgaagucccugcagagcucucccugcagggaagaaacacacugccagggucccccgaaagacacauggggccacagcccugccccagugucggggggagggcugggggcuggaggcuggagugagccuccccugcgcccgccccgcugacaacauccuugccaggugggcccacuuuaaacaaacccacuauccagaaaugccucuuuuccaaacagagccauugggggucaaaguuuccccucagaaaaaaacgccaccagaauuuuuuuaauguuuucuuuuuuaauaaaaacagggucuuacuauguugcccaggaugguuucaaacuccugggcucaagcgauccaccugccucggccucccaaagugcugggguuacaggcgugagccacagcgcccagccauccaaauaaaaaaccagaauucacucuccaaaaaggcuaucagcaggguuccuucaauagccagcccagccugagcaaccgaaaagaucccucacuuccuccuuucuccagggccaaccaagcaccaccccagccacagggaacucagagcuugauaagggaauuagggggaggaaaagcuuccacugcccccuccccacucuacguugccuggggcuucugggcccuucguggggggcggggcgcggcggggcgggggauguguuucuucccauuuuacagaugagaaauggaggccaaguuaaggacagagccuggccuggaacccaggcccuuuccuucagggccuucuuccacagguguguuuuauuccaggggcauccauuugacucccccagccccacucaugguagcaguggggacucagcugaucucacucuacacccacccacaguugccacaggguaagcccagugcccuuuugcccaaggucaggucacuuggugcuggggcgucacagagcccaggaaacuugggaucagaacccccugcuccccgcuccccaccucaucccuccagaggacuucucuucucucccgguaccuuugccuucugggagcaguagccccuccaggggaacagcucccagguugcagaccugagcagucgggccauagccaggcacuggccagagggugugagcacuggguggcagggugaccagucagcuacuguggcagcagcuacugcugc

SEQ ID NO: 15824 - RNA, 20018 nt, Homo sapiens
aaaaguaaagagaagagacaaauggcuuauuugguaacaggauuaaaaagaaauuuuuaauuccuugucucucuucugauggcugaacagaacugcggugucaaauggaaagcagcacacaagaauucccuugcagaccuugaucuuucgcagaaaugcaaagacgccugaguuauacaacuugcaauuauuauuuucuagacagaagugccaacuguugugcuuuccaguguaucagugguugcuacauucuccuucuugucuucggguuucauggcaggaaacagaaguacuuccugugggagauaagaauguaccuugaagcugagaagcacucucaacauuuuuucacagcuaucuacccauuccucuugccucuguuguuaccaccaaaauccagagauuaguauauuccagcugaaaaggcucauguguucuuuuauuucaacucagacccucucaaguuacagaugacaaagaacaaaugcauagcacugccuagggcacuaugucaaaaggaugaauagacgcauuucuaugaaaauuugauuuccucaucuauaaaaaugggaaacaacaguuucuacaccucauaaggcugacuuaauuagcugaaauaaugcacggagacuucccuggauccucaagaaaugcaaacaauuaguauuccuucugccccugguaggaaaaaacccaaauccuuuaaggucagaggcucuggcccuccugugaguggcauggaacuccucugccugcuccucuucccagcccaaagcccuuccuuaauuuuauccuccaggcccaccaugcccuggcuccaacacaaugcagcuuccucaggaagugugcucuguggaggguugcuacguaccuugauguuguuggaguccgugagaaacauggcgacucgaucaaugcccaugccccagccagcuguggggggcagcccauauuccagggcaguacagaaguuuucaucuaugaacauggccucaucaucaccugcagccuuggccuagaagaggaaagagaaccaaaaggugaccuucuucuaagauaucucagugugugagugaacauguuaccaggcuccgaggugggaguaccaucauuccagagaugcuccugacacucaggacuugcugggaauucauuuccuaguaacuccaagaugcagccguuucuuucaaagaccuggaggucaggacugaugaaaucgaccucagaacacauacaaauuucucugaaagaaaacccuucugcugcuuggggcucugggacuccaaacagguuaauucucagagacugugacaauuacaagagucuuucucccauuuccugaaaacagcccugucaacaccugcugcaggcagccuguggggguucugucuucuccauucaucucuaccuaccucccagcccuaagccaccuuaauacauguacaaucuaagaaaauaauguucuugcuuggcaaguguauuuucaaggcaagcgucacgcuuuccauacggagauuaauaaugaaguuccucuuauguacgacagacucaauaccagaugaagucaccaucuugaaaugugacuccuccagcaagccuauggcuuuaucuuucacuucugaagucaccaagaacguauacgcugacacagaucaggguuaaggcugguauuuccuggugaguuggcacagcuucugcucacaguccccuuucucaccuuggccuguucuucaaaaagcugccgcugccgcaugggaucauucagcucaguauacgcauugcauaucucuuucuucaugacaaacagcucaaagcgcucagucagacccucuuuagagcggugccuagggacaggagaccaaagaggaggcugaauauagaggccccuaaugagcuaaauuuuguuuuuucuuuuuuuuugagacggagucucgcucugucacgcaggcuggagugcaguggugugaucucggcucacugcaaccucugucuccuggguucaagcacuucuccugccucagccuugaguagccgggaucacaggcccaugccacuaugccuggcuaauuuuuguauuuuuaguagagacaggguuucgccauauuggccagguuggucuaacgaucaaacaucuaauacaauaauugaauucuaguggacucaaaaguguuacugauugcagucagaagccugcaugcagucucagcaacaaaucauuugguacaacggugaggagggugagagagaccaggaagguuuaaugaucuuccuaacaggccagcgggcagacuguuaaaauggaccacaccucuugcauucaugcccauguguagucuccuucaccuggacucugcgcuggcaacaugucuugguuuggccaauggguuaucaccagaggcuugauacguguuugcacaaugaggucuguucuuuuggaagcuuccccuuagagcccaaccaccaugcugaagggaagcccaggcugugcugccagacaggccacaugaagaggcccuggaggauaagaucguauguggagugaccacguggaggagaaccaaagugcccuggcagaauccccaguugaaaaaaagccacuuggguuacccuggucaacaccacccagcagaaagaccaccagucaaaccacaaaaucuugacaauaaauuguuaacaccacuaaguuuuggggcuguuaugcagcaauagguaacuggaaucuuaccauuuagccaaagggcucauuaucugugggugaucacagaugaauguaggauugaugcaagucacuuccaggaacuccccaacaagcuuaaugagaaagcaaagcagagucagucaccauuucugaauaguauuugaucgucccagcccagacagaagaucucagcucccauccagauggguuuauccuauagcuuuuuauuuauuuauuauuauuauuauuauuauuauugagauggagucucgcucugucgcccaggcuggagugcaguggcaugaucucggcuugcugcaaccuccgcauccugguuccagugauucucgugccucagccuccugaauagcggggauuacaggugcccgccaccauacccagcucauuuuuggauuuuuuguagagacaggguuucaccauguuggccaggcugguuucgaacuccugaccucaggugauucaucugccucggccuccugaagugcugggauuacaggugugagccaccaugcccacccuacccuauagcuuuuuaaaagcuggacgggauuaacugagaucacacacauaaauuauuuggcacagagcuuaguaugacaguuaaaagucuguuaauucucuuguucucucucuaggguuuuccugugaagcugcagaaaugaacucuccccagugggguucauuuucccagggaagagggaaccauucagcaccagaugaggacauguacaagaaggcagggccuucucaccuugucaaggagccuggcugugguccgagguggagggcauucaacagcuuuugccacacagauaucaucaagaauuuugcgaguuucugggacacaaaugcaaaaguuagggcaggagacaucacacuagccaaguaaaaauguacauaaagagaauagugugggaaauucuagcucugacccaaucaaauucagagcugaacaggaaggagggccuuacaacggaggagugaguguugucacuuuaccuucaguuucaaagagguucguuucuggcagcuucauccccagggcuuucucaagcucuucuaccauguugauucgccggaaggguggggugaagucaacaucguaggcuuggcccucugggccaucugggugguaggugaccuuguaacugccuguaauaugcuucaccaucccugggagagaaaccuguuauuuagcgggaaugaaauccaggcagcccuccucugaaagcagcauaccaaccacccgaugaguaugagagagagcaggagucaccugaaaccaucuucuccgugauuuccaugagaucgugauagucugcauaggccauguagaacucacagguggugaacucaggauugugcgucaaaucaauccccucauuccggaacuggcguccaauuucauaaacccggucgaugccaccaaccacaagcaucuaacaacaacacauggccacggucaugacagcuaaucuuuuuuuuuuugagauggaguuuugcucuuguugccuaggcuggagugcaauggcaagaucucagcucaccgcaaccuccgccuccuagguucaagcaauucuccugccccagccucccuaguagcugggauuacaggcaugugccaccacgccuggcuaauuuuuuuguauuuuuaguagagacaggguuucucuguauuggucaggcuggucucgaacucccgaccucaggugaucugccugccuccgccucccaaagugcugggauuacaggcaugagccaccgcgcccggccccaugacagcuaaucuuguauuaacagcucugggaaguuucagucuccaaaagccguaacuugguuuucacagguuagguauacucucaggucucuggucaaauugccaagcacccugcucucuuuauacccuuguaguguggauaguuaccccuuuuuuggcugccuaggacuucucgauacucuuccugucuugggcaucccccaucauugagucugaaccuccccaaggaagcagccucucuugggguuaggcugcaggcgugugacccaagcuccaccagucagauacacuugugagacuucagcauggaaacuacuaacaaaagauguggguauugcauagaauucauucuggugaagggggccagucacacguagcuuuuagauugcagagguccuagcggcaaugacuugugccuagugccaggauuaugagcuguaguaacugugccuacuaggaaaauacacuggguucuccaugagaacagcccauucuaauaugacucagaaucauuccuaguuguauaguuuccaagccugauucucugauccuccuggggacugugagcuuccucuauguugggauucacucaggaugguggcagaaauauuaaagggaaauauuggggaaaguuauaaggaauagucacaaaccuuuuggaaggccgaaagguuacguagcuuguaauaacugaacaggcugaaggcagccaguucuuaccguacagcauuaggucauaggguaaauacuacggaaaauagaggcuuccccaguuaagucuguuuacccuaccuccauuaacuaaccuuucagccagauggcccucuuggggggagguugaccaaagauacugcucccuaaugguauuuacuuuagaccaugguaccuggacuuuaauaauuccuagaacuccucucuuacgauguuaauuauccacaaguguguuuacucaaagcuucuguuguuaauucuauacuaaauaaaugccuggagugagagcugcucagggucggccgcaaugacaaauacaccucucuuggugugcaggugaucggacacucagcaggacuggcaaaacagaguaucuguguuucaguguacguuuuauucauccaucguuuaggucagggucugcaggcagacccccgcagcuaaugcccucuugugaggagcaauaccucaccuauagagcugaauaaauuuuuauuuugcuuaaacuaguuauaacaguuucuguugucugcaacuaagaauccugaauaauaaucuucaauauuuaccugggaauuugacaagacaucuuuauagugauuugaagauacuuuuuuuuuuuuuuuuuuuugagacgaagucucauucugucacccaggcuggagugcaguugcaggaucucggcucacugcaaccuccgccucccggguucaagcaauccuccugccucagucucccaaguagcugggauuacaggcacaugccaccacgcccagcuaauuuuuguauuuuuguagacacuggguuucaccauguuggccagguugguuucaaacucuugaccucaagugauccauccgccuuggccucccaaagcgcugggauuacaggugugaggcccgcgccaggccugaagaugcuuauuuccaacuuccacagacagauuaggcucuuucuucugugaaagacuuaaaucagaucuaauccacguaagacuuuaucuuaaaaguuuuaggggaaccaaaguagguaaggagugccuguauacaugggaaagacaaccccuuuggucucugcccuacaaugcucuauuaaucuuguagagaaauucuggaaguguuacucacauccacacaccugacccaucagaacacuuucuuggcugcuuuacucucucuguuccucuuauuucugacuauacccaucuagccagugguauuccagcuuucugcuucuuuaagggaaaaggguguacuauuacugacuaccuuaugauagaguucuggagcaauucucauauauaaguucauguccagcucguugugauaagugaugaaaggcuuggccacggcucccccugggaugauguucaucaugggaguuucaaucuaaaaaaggcagggagaaacaucaguccuuagauaaccagaggccuuggggacagaccaugcuuugcauguaauauagucuaagccuguuauaccccaaacuaaauguuaauaaguucaacaguaaugugcaagugcuugacaaaaaaggacacuaugauuuucuacgacagugucucaauuucuauuaauaccuaauaucauuaauauaguaccacgaacuuucacaagcuguaaauuagaaucuaaauggauauagccuuucuugaguucaauuugcaguauuuauuuaauuuuuuuuaagacggagucuugcucuguugcccaggcuggagugcagcagcgcgaucucggcucauggcaagcuccgccuccuggguucacaccauucuccugacucagacuccaaaguagcugggacuacaggugccugccaccacgccuggcuaauuuuuuguguuuuuaguagagacaggguuucacuguguuagccaggauggucucgaucuccugaccuugugaucugcucaccucggccucccaaagugcugggauuacaggugugagccacugcgcccggcccaauucccaguauuuauuaaaaauuuaggcuggucugaagguagugaguuaucucaacugauuguuuaaaaaaaauuuuaacugcuuauauuguuugacuuauucuacuucuagaaauccauccuacagaaacauuugaacauguguauaaagaugcuuguuggaacaaauaaugcagcauuaagaaagaguaucuaucuaucucauacaaagagauccagaauaucuuaagugaaauaaaagcagguccaucacaauacacauagugugacuucauucauauuuaaaccaaaaauaaaacuccuccaaaauguuuacauaugugcacuccaucugcaacaugcauauguacauacguauauaugcccaguaaaugguguggaaggauacauaucaaacucaaguuuggguagggaaguuagucagaaggagugaaagagcacuuucaguuuugcuucuauuuaauuuauuguuugaauuuguuuuaugguacguguguuugccuuucucauauaaucaaaaaauauuucuuaaugcuacaaaaaagcaaaaugacgugaauacauauugaaugugacaucauuagcauguggauggcccuauaccuuguccauuaucuuggaagucagguccugccuuccuaaucaggacaagguagaacagagacgauggcaagaaaaggggacauucucauuaggcaugaaggauccugacacaggauacgcuuuggaaaaggaaggcaagggagaggaggaggcaagcauugcaaggcagcucaucacgucaggcaaggaacucuccuuaccucuaggaaucccagcucaucuaagaaacuucuuauauaugugaugaucuuagagcggaugauaaauuucugccucacaaagucauucaggaucaaguccaaguaucucuggcgauaccuuguuuccuaaaccaaaagcagcaguuagaaaucacugguaugucugauccaaagguaugauaaaacaaacagaaagcuaggaggccacagcuaggaggccaagaacgcuuaccuugucuuugaggccaaagugaagaugagguaacauaugcaaacagggagacagcagugugaucucauacggaaugaugcucagcucacccuucuugguuuuaccaggauuccccugaacuccaauuaugucuccccgacgcaguuuguuauuaauaugaauaaauucuucuucugauuuauaauuucugagugaaaaagaaauguaauucaguaacaacaauucaaaugaacacugaccacuggucuccucuggaacccucacucaacuguuaauaccuaguuaaugugagcccaagaaggacgucagauucaggggccacuauuaaaaaaggacuauccuuuacuuuacugucauauaacuugagaguagucauuacuuuacaggugaccagguggccacauuauccucuucucagccuuccccaaccaugucccacuccuucuuacucuaacuucaaauaccaguaagaccacaucagccuauugcuguguugcucuaggccaaccaagaaaggucuauaacuggguauuucgagauaccuggaauuggccaugacuugcaacuucacccccucuccucgaagaucauagaagaugagcuuucccccagaagcucuuuuggcauggauccuaccuagaaaaagaagagcaaaaauacugacugacagaaccagaagucauuuuaugguaucagugucaaaaaaaaacucccucugcauuuuuuuuuuuguuuuuuuugggacagagucuugcucuguugcccaggcuggagugcaguggcacgaucucagcucaaugcaaccuccgccucccagguucaagugacucuccuguuucagccuccugaguagcugggauuacaggugcacaccaccacacucggcuaauuuuucuuuuuuuuuuuaaaguagagaggggguuucaccauguugcccaggcuggucuugaacuccugggcugaagugauccacccaccucagccucccaaagugcugggauuacaggugugagcccccacacccggccugcauuuuuuuuuuuuuuuuggucagggcacaaugcaaagcaguacaaucugauuuuagcuugagguuuaauccccaucuuuucccucaaaccaacaauguccauucaaaccaguuaaagacaugcuuucaggaucuagcuuucaagauuaagucacuggaugccuagaagaugguggugcugguagcagcauaguuuuuggauuucccugaauccucacauaaaaauagaaagcacagcuagagaggcgaagcgaaaaauccauggacaaaauuuacaacaaaaugcugugggaagacguugccaaggacccccaaauauaagcaaggaggcaaaccaccaagagccauaagaccucuauacggggaaaaagcaguggggagaaaugggguaugggagggaucugagaacuggaaagcccccaaauggccaaagguauccucuggaaaaugugaaccuuuuccuccaggcucacugggggagagcagcugaaacagggaggggauguguccguuuccauacaggugaggguugcauuaagaagaucuaaaggaggccaggugcuguggcucacgcuuguaaucccaggacuuugggaggccgaggcaggcagaucacguaaggcugggaguucaagaccagccugaccaacauggagaaacccugucucuacuaaaaaaaaauacagaauuagccaggcgugguggcgcaugccuguaaucccagcuacuugggaggcugaggcaggagaaucgcuugaaccugggaggcggagguugcagugagcugagaucacggcauugcacuccagccugggcaauaagagcaaaacucagucucaaaaaaaaaaaaaaaaaaucuaaagggaaugaggaguagagcccacagaaacccucucaacagccaggcucccuucuaggacaagaccguaaaaacuaacaggacaaggaaaaaagagaccaaaaaaaaaaaaaaaaagaagacccaaaaaaagugaggaagaagaagagaaccaggaaaucucaaaaaacaagcugcaguauuucugaacaugccacaaaaacaagagggagcucacuggaaaaacgaaaccgugcuuccuuugaacauucaggaaaacugauuucauguaaauguaagcaacauaaaagcacugggcucacauaccauauaaaguuacuuaaaaaacuaaaaauggagagauagaaggagaauaacaccccucuagacaaaauaaaagcacucaagacagacaugcuuagaaaaacaaaaaguuccuuuuuuuuuuuuuauuuuacuuuaaguucugggacacaugugcagaacacgcagauuugucauauagguauacaugugccauggugguuugcuguaccuaucaaccugucaucuagguuuuaagcucugcaugcauuagguauuuguccuaacccugucccuccccgguccccccgccccuugacaggccccagugugugauguuccccucccuguguccauguguucuuauuguucaacucucacuuaugagugaguacgugccgugaaaagcaaaaaauucuaacuuacuauucaaaaaugagcugaaagacaugaagaaaaagacgcaaaacaugaaagaacacaaauuagaacuagaaaaacuaagaaaugaggugauaacacaugaaagaauuagaaauaaaguaaaaaaucuuucagaaaaugcagacuaagcuauaaggaaauaauagugacuaaauacaacaaauaaugccuuaagagaaacagaaagugaaaaggaggauaaaauuuaaaaaucaaaguauaaagaaagauaaaaaggauuugagauaaagugacaauuaucgaaaagaaucaagaugauccaguaugcagauaaaagucccaaaggaaauguaaagcaagaaacagaauaaaaacaaacaauuaaaauaaaaaagaucugcugggagcagcggcucaugccuguaaucccagcacuuuggaaggccguggcagguggaucaccugaggucaggaguucaagaccagccuggccaacauggugaaacuccgucucuacuaaagauacaaaaauuagcugggcgugguggcaggcgccuguaaucccagcuacuggggaggcugaggcaggagaaucgcuugaacccggaaggcggagguugcagugagccgagauugcgccauugcacuacagccugggggacaagagcaagacuucgccucaaaaaaauaaaaauaaaaaaauaaaaaaaaaucugaauacacagaugugaaaagaucucagagcacacuguguaucugagaauacugaacuagaauaacuaacaucaauaaauauuuuaguggcaggguguggcggcucacgccuguaaucccagcacuuugggaagccgaggcagguggaucaccugaggucaggaguucgagaccagccuggucaauauggcgaagccccaucucuacuaaaaauacaaaacuuagccgggcgugguggcaggugccuguaaucccagguacucgggaggcugaggcaagagaauugcuugaaccuggggggcagagguugcaguaagcugagauggcaccacugcauuccagccugggagacagagugagacuauaucucaaaaaaaaaaaaaaaaaaaaagauuuuaguaaaaucacugcacuuuaaagaagaaaucuuuugggcauuuagguccugccagaaauucucucugggugguaggauuaugcguaaucaaaaccuucucucugugcuucuuugacuauucuaaauuuucuacaacugauaguuuuacuauuuggugggagagggcaaggaaaagaugugauuuuuuuuuuuuguuuuuuaaauuuaggaaaagaagaucucacccaagauacuacaacuccaaaagagcaauguucuagaaauacugucucagugcaaagcauucuuaggccaaagacuggaauucuuagaagccugagacuucuaccgcugauucuugcugaugaagggaauccuuauagagaaagccccucucuuuguagcacuaccucaucuggaauaugauuccaugucucagggcugcucugcuucuuucuguauagauauaauggcacuguccuuaguaaaguagcuucagacacaggcuacuugagaacaagaccaacccagaccuucccuugugcuacugaagccgcaggccuaccugcugugggaguucagugauuugccagggagaguuccuaccugccaccuuuaaggugaugucagucaggugauccccaggcugcaggugacuauauuuuuggaugaagucagugagugagaugucuacauggaacuuguguggguaugggucuuccccauugaccuucagcugaugaauugcuugacugcggauuuuguaguauugcuguuaaaaaaaaaaaaaaaaaagcccuucagaaguugaaccuggucagaccaguggggcccaccuagcagagggcaguauucugcccccgagugaccccaauacauuguuuucuuuaaccaagaccucugcauuacaggauugaauauggagugagauuugcacuuaaaauaugcagggcggccagaggccagcauuucaaaaugcaagagucaacaaaaagaaaaaccugaguucugccuaaaaucauaaaaguuuaauuuuuaauugguacagguggccuuguugucacuuuuguagaccacauuugcauggugagucgagucacuuacguucuuaacugcuuauguucuuaacuacucuccuaccucuggcgacacaucagacuuuuccccaaggcauggggccuggagaauguaaacaaggaauacucuacagcagccuuucucacaaagcuuuucugaugcaacuucucaacucugcuguuucagggggaaagcagccucagaaauacguaaacaaaugagcacagcuguguuccaauacaauuuuacuaguaaaaccaaggaggggcaaggugugguggcucaugccuguaauccuaguacucugggagcccgaggcggguggaucacuugaggccaggaguucaagaccagccuggccaacauuaacaggguguaguggugugcgccucuaauaccaguuacuugggaggcugaggaaggagaaucacuugaaccggggaggcggagguugcagugagaucacaccacugcacuccagccugggugacagaaugagacuuugccucaaaaaaacaaaaacaaaaacaaaaaaccagggagggaaggauaaagugggggcauggagaguggguuuggcugguggacuguaguuggccagccccuggucuaaaguaaaccucaggcaaucuuuagagagacacuuucccuggggccucaaggucaagcuaauuccaaggaagguuaauucacuugaaugcuggacucucucaaaugccuuuuggggguugacauaaaaaacacucagggucugugccuuuaaccagaugcagugggagacccucccuuaucccuggcagugaccucaggcguacuggucccuccuacuguccagucccaaagaaucugccagaagccucaucagaagcuuuccugugcccaaccaugcugguggcccagggaacucacauuuggguccacgcucucuuccucaggacccacaccauuaucaguggugugguugguggcagcagcaguggcuuggcuuagcuguuucucacugagcucuuucuguuuggccuccuucucugcuacuuucuucucagcuuucaggcgucucuucagcucacuguuggaaagaugaaagcguucaauguguuagcugccugaagaguccucuauguucugccccuagcaacuuaucaaaaacaugaaucgcccaggagaaacgcucuugcucaguucuauaccccucaauuccacacccacagcucagcucaaguagcuugucacuaaacucuuuaugugaaagacacaaagggaaaaauaagcuuagaacaaagaugugaaaaaucacucucagucucugcuugccagucucagguccuuggcauuaggucccaacuaaaaccaagauguaccaagacaaagaaaauccuaugcauuaguuuugaauaggagaaaagguuuucuagaaaauuagaauaggcuuuucuugagcuaauuagguuagggagcuccuugaggacagugacugaaucuuaguuguuuaguaucccccuagaaggugaaguuccaacagugccaggucuuuuuuuuuuuuuuuuuuuuuuuuuuuuuuuuuuaugagacagaguuuugcucuguggcccaggcuggagugcagucacaaucucagcuuacugcaaucucugccucccggguuucaagagauucucgugccucagccuccugaguagcugggauuacagguguguaccaccacagucaacuaauuuauguauuuuuagugagacgagguuucaccacguuggccagacuggucucaaacuccuuuccucaagugaucugcccaccuuggccucccaaagugcuaggauuacaggugugagccaccugaccccuccaaugccagaucuaauacaugauaaggcaacaucuccagcccucugcuacccccucucucuaucccuccccuaagagugaguuaggaugauaguaaggaagagccggcucuuuagcacucaaggagaccuccccuaccaacagucucuccaagaauggcugucagcauuagucucacuuugcccacuggagccugacuuagacaacaaaauagaacggugugcaaagcaguauaguacaggggguaauauaccaucuuuguagucaggcugccugggacuaaauuccaacacacuugucaauuaugugacuuggacgagugaauuaacuucucaccugugaaacgaaaauaauaauagacaacccccaccaguuguuaugguguguaaugagauaauguuuguauaaagggauuacccugacccuggcauucagcuaaccaaaugugagcuuucuagguaucuuuuaguaucuuaacccuuuacucucugugccucauauagauuuaaauacauuucugguuaaaucacuugguauccaaacucuugauacuuaucacuugaaccugaaaaaccaaaguaaugcggacaacucugagcuguucuguaugauauguucaugucucuuauagucugaauuugcuaucugaaaccagaaacuaaacagauugguguagggagggauaucuuuacuauucaaagacaauuuauggaucauucuuucaaaccgcugaacauaaucaaauauucugcaauagugaaccacagcagaagaucccaagucaugcccgcaaacauucuggcuucaggacacauccuucauuuucgauaugaauuuagaauaacuuuaaaaaaugaauugagguuuugaaucuuucaccuuuuuuuuuuuuuuuugagacagagucucgcuguguugcccaggcuggagugcaguggugcgaucucagaucacuguaagcucugccucccggguucacaccauuuuccugccucagccuccggaguagcugggacuacaggugcccgccaccaugcccggcuaauuuuuuugguauuuuuagugaagaugggguuucaccguguuagccaggauggucuugaucuccugaccucgugaucugccugucuuggccucccaaagugcugggauuacaggcgugagccaccacgccuggccgaaucuuucaucuuguaaaaaagaaaaacagauucugaaugguuucaaaguugacagcuuuuucuacauauaaugucuuauaacauuuguaaagacaaccuuuccaaaacacugugcugguguuaucaugcuauaauucagucaguggacugcuaagauuaggcugucuaguucuucuagaauuaagauaaaucuguuuuccacucaaccaggugcuccucuuaaaucaaaucaaucuuaaggauaauccaaaaagguccuagggauagcacuaagacuagaaaccaaauuaaucucaagagcacacaaaacuccagaaagacagaaaagggaaauagcuggcauuagaaauuauuuguucaaacaaagguuuuguucuuagcacucuucuagaauaagauccacaugucaucucaagacucuaaggagagacgauuugaauuuauuaaagagaaaaugagaaaggacuauugguuuugguauuagggcuccuuguuuccuuagcaacaaguccaaagacuuagccagaggcuuaacggaaaaugaaccaaguaaggaaauaauuuuugcuuccagagcaauaaagaagguaaugggcaccaaccuucuuugaucagaaaaugacuuguccuugugaggcgcugugaaaggagcaaguugacccagucgcaguucccugugaccccacucugcccaggagguuuugcgcagggacccccuaacaagccuuacagcagcuugcgucaacauggcagagcacccuggaacuaaugauuaccaccaccuagcgggaaacacagagauguggugucagaugggacagacaguauacauauacccaaccaacucucuuauggguuggggagggggaccaugcuucuacuaccuuuuagucccauuuaacuuaagacugucuuaacugauagcaacccuguaacacucucugugcuacaacuguaacugacaauguucuuaguccugacuauggaaaaaacaugcauaucugggguaaagccaacagcaaguuaauggauagcuuacagguaaaauugcucacaacauccuagaauaugggaacaggaugugaggcacuuucugaagcccugaagugugguuucucaccuggagaggaaauaccuggccacaagauggcaauaggaagcauauaaaauaagaggaaacugucacuaucaauugcaaacucuagacaaagauaaaugcaagccacacaaaaauacgugucaaagagaagacuuguuuggaacucuaggaacaaggggaaaggagaauuucaggaagguccuuagacugcguuauguuuauacauuaucaacacuggaaggcaacagaauuacagagaucaccuucuuuaccguguucaaauaaauuugaggaggcuauuucacucgggcagggagcacaucugcuuuuaaacuuggagucaauaccuggcacaaaauggugcuuacuaaaaauuucagaccaaggaauuccccagaacaauaaacggaaggaaauguuaaucagaaaaaaauuauuuuagcucaugguaacgagaggaauagacaucaaugacagguaagacaacgugaguagugcugugcagucaggauacagagcauggacuguggagucacaggccugaguucagauccgugcuccagugcucuggaucacugcuagacuauauuuuaggaaugcacacuuuaauagugcauuuaauuacuaggaccucaguuuauuaauuugaaaaauggacaauaacuccucuugcaagguuauuacugacacuagacagaaagcuuguagagaucuagcauugugccuggcacagaaaagcuggucaaaaaaguaguagcuguauuuaauuuuagaaaagucagugaagcagggagugguggcucacgccuauaauccuagcgcuuugugggguugaggcggacggaucaccugagcucagcaguuugacgccagccugggcaacaaggucaaaucccgucucuacuaaaacacaaaaauuuaaccggguguuguggcaugcaccuguagucccagguacuugggaggcugaagcaccagaauugcuugaacccgggaguugcaaguugccgugggcugaaaucgcaccgcugcaauccagccggggcaacaacgacucugccuccaaaaaaaaaaaaaaaaaaaaaaagucaguaaagaggaauuaaccaguuuuuuccguuuaccuaaaaacacacucugaacuggaaaccgugcuuucaccugugauauacaguccuaaaguucaauucaauguaauugauuaucauaggugguuugaaagaaugaacuaaacuuuaggaucguauaucacagauauaccacauucaauuaaauuugacuuaauaaagucaagucaauuuucucuaagguagcaguccaaagaccagguuccaaacuuuuauggaaguccaucggauugcucuaauaaaggacaauauauuaagguccuacccaacuauaaacuucgacaauuucucuuauacuuuuucuaagauauuugaagcacaaagccagggacacaaaaggaaacaucaggccaggggugguggcucaggcucacgccugucaucccagcacuuugggaggccaaggugggcggaucacaagguaacgagauugagaccauccugcccaacauggugaaacccugucucuacuaaaaauacaaaaauuggccagccaugguggcacacgccuguaaucccagcuacucgggaggcugaggcaggagaaucgcuugaacccuggcagcgaagguugcagugagcugagaucgcgccacugcacuccagccuggcgacagagcgagacuccaucuuaaaaaaaaaaaaaaagaaacaucauuucucuuuucuuuuucauucagggucuggcuccgucucaguaacuccuuggggaaagcgauggagaagggcucgcucacgcagcacuucuggcagucccugaaggaccacuaccucaagucucccaggcuggagugcaguggcacgacuucagcacacugcaaccuccgccuccuggguuaaagcgauucuccugccucagucucccgaguagcugggauaacaagugcgcgccacggggauuaagcccucucguaugccucuggaaugguacuauguaccaucuuccuagcaaugauaaaacacucaauuaccuguguucugugguucaaauggggaacgcuaaugagaauauaagacagccaguuaaaggguggcuaauccugacuuaucuauguuaaccuacauacuccagggauuugggagugguuaacaaagauaucaggcugaauuaagauggucucuacuguuagacguugaucacuuaauacucacagguaucuacugaauaacccauacggguagaugcaugacaguuuuagaacugaucccuuuuaauacauaacguucagaaugaccuuagugaggcccagaaaauuuugaaggucuuucugaaaagcuaggguauuuaacauuucuccaacuuccacguuuacugaguggcucaacaaaagaaugcauuucucagaaaggaggaugaagcuaagcaggaaguuucgcuuuucuuuucugauaacucuuaguucucguccuaguuccuccuccacagucucuuaacucuaggaguaugauagggagcaucccgccggugccagcugggaacggggagccggcgugcccgggguaucccgggguacguggucugcagggcgcagccaccacgucucagcaugugcguacccacgagagccggcaagaaggccccggcacagcagccuuggugggaaccucgcggcgcuucccagcccagacucuccuaccgcaaaggcuuuaaagacucgcagcgacacucacuucuugcucaguuucggcucgcugccauccacuuucaccucggccgccugcacggccgccaucuucccggagggcccgacccaaaaguaaggaggauaguacguuaauuuccaggucaaggugcgaagccccaccucu

SEQ ID NO: 15825 - RNA, 1385 nt, Homo sapiens
uuuggacagcaacuuccccagaguggugccuuauacaacuccagggagcacugucacauagacuucgggugaauggcuuacccuagaguuguacaaugucacaggcugcacuacuaacaaaguagccuuugaaaaaauuaucuaaagacuaguaaaguugacuggagcauggugccuuuuuaccucucuuuucaggagcuggacagaaguuuguauuacaggcucguagcaccggagguuucugauggagcagacaacuugaggaaggccggccuugcugaacacaguggacugaccgggucuggaccccucccccacaggugacugugcacugcagcagagagaagaggaaggagucagaaacacucuacugaggucagugacaucaaacagaaggaauucccaugcuucaugacauuaacaagaugccugcugaugaaacagauuggcuggagccaggcacaugugcuuacaguccacagcaucuauccuaacaagugugaucccuuugaucugauuagaaggguuuuaggcaaaugcuaucuaucuagcccaagagugugugucucccaguuaagugacucacucauaaagaagagaagcuccagaaauacagaagcugcucuaagaaugcagaaacaaauacagacacaccuagggaguuaaucacaggauuuaaagaauuccagacaaucugugcagcugcaguaguggaggacauaguucaaaacugggacagaaaaagaaauggucagagacagcucuggaauuagguccucggugcccagccacauucugaguuggcaugacagaguuggugcuucuuaggagucgcugauuucagugugcaauuaaaaauuuucaaaaguagacaacucaacugucuuucuuccagacagccauaugaaaaauuuauaaagauacuucauaacaaaaggaaaaccagggaaaaauguagcccuuuaaauggauuuuucuuauuuuaaaaaguuacuacauuaauuuuucuuaaauguacauaugcauuauaauugacuguaguuucugucucaauuaaaauuuaagggcaagucuuguuaucaaauuaucuaaacuaggaguuuguaaacuuuuccuuuaaaggggaagauagauaguaaauauuucaggcuguauaggcauacggccucuguugcaaguacuccucacugccguuguagcacuaaagcagcuguggucaauauauuaagcaaaugaacauggcuacauuccaguuaaacuuuauaaaaacaggcagguauugggggagcagauuuggcuggguggcaacuguuugcugaccccuuaaucuaaauaaacuuauuagagucaauuuuaaaaagaaauccccagcaauauguguaaca

SEQ ID NO: 15826 - RNA, 4469 nt, Homo sapiens
auggauaguuuuuauuuauucacgucugagauuccguugugugaaaaggacucauuuuauaacauuacauauucauggcuugggauggaugggauaaggaacuuauuauuaaugugucacugugggaaacuuacucuaguucauuugcgaaccuuguuaaauucgguguggucagcagacccggugaaguuuuggauacauucucuuaacagagggcaaagaguuugcuguugcuuuuccuugauucaguaaaacaaguuuaaaucuuauuuaaaucguuugaaguagcaauuugaaaggggaggaaaaaaagggggauggcagagauuaaguagagagagaagcuccgauuuucuuguugaauagccguguuuccucagcauucuguagauuuuuggccagguuuguguaagggaugaacgacucucuauaaaaugaugucaggauccuuucuuuccugcccauugccauuucuagcauucucuccuugagggaaguugcaguuuucucccucuguguauucauccuucugaccugugcuccggauuccagggaguucucaauuuggagcucauaccgacaucacagaauuccuugccugggacaaauagagggaauauuaacauagcaucuuguaaaucaaagcugggcagggggugggggagggcacaguggggaaccuggcccaaucugcuucagugugagcuugguaagaaggaagcauauguugcauuuaguucucugcaaagacaggcgcugcucucuggcagggacagcguguaggguuugcaugauuuguggggccguuucauguuugcacgguuuggcuuggcuugggacucggccaguggucacugcaguuuaacagauuccccccgggugugaaggaaagcgagauaaaugcaggaaaaaggauacauuuugaaaucuggaaauuuuacauaacaggcaucagauuugaagaauguccaaaauauuacgaaucauagcacaaccuuugcuaacaccguggaaauuuuugaacauggaauuuguuaaugcugacuuggcccaccaugggguuaaaaaaagugaauuucuuuuugauaaccaaggugaugaucuuaugaaguugaugauggggugugaacggugugagugggggacaaagcaaugaaauaucccuuaaaaugcauccucugaugauguuuccauaaugccaaacauuuguuucucuccaggaucucauuggcgguuugcugguauuauauugccauuuauauuggaaaggcaggcagugcgaaaacuguagucuauuaagaguuugugaguguguguauguguauacagugaaauaauaucuaguguaaugugaagugacagucaaaauuacagcuuuucucuugccgcaaggguacuucucugccaaguauaguaauauuguuguagcaguguucaagguugucagcaauucuggcuuacucugcagagagccauaauaguguguggaaggaaggagcuuccugucaggggaaauacuauaauuuugauauauauuuguuggugccaaacugcaauuaaauaggagguguuggaagaagguuuuauuuaaccagcuugaauuuguuaauuaauuagcaaaaacuuaucuuuggaaugcuucaagaaacaguucuauguuguucucauaacuuaauuuuacacaacugucuuuuguuuguaucuuacagaaaacaaaauaccacccuccgccagaaaagugcagaauaaaaauuuuccacuagcaaaagaaggaaaaaauaaaagaucuugaauagucucaucaauuacaucuucuuuuguggguauuuccuggucuuuucauguuuugacuucuaucucggugaucugacagacauguacgauuugcaacaacaucuauuauaugauuuaauuuauaccuuuaucaguuugcaguuaugcuuuacgacucuucaggugacuaaagaaaaagaggguguuuuaaaguguguguguuugugugugcguguacguguauacauguguuuuucuguguacauaaguguguguguuuuaaauuguuugaaaaacacuaguccaucucuauuguauuaucugagggaugcuagcucguuacuugggauaguaacaaguuucuuggugacaacuccuccucccauugucaaggaagacugaggaugucaccagaguucgcugucaauggcuauucagaugaaaaauaccuucuuuuugaauaaguagaaaaaccaugggggauugaaauagcaauaauauauuaaaagcuccaaggcaguuaugugugaagaaauaaagaacagaacagagagauuguguuguuuuaaaaagggcuauuuaagagucuugaaaagaguguguguguguagggggacaccucccucucauauuaaguauuuugcaaauuaaaugaguuucauucuccuauaaaauaugagucuaaucacauuuuauaugauuguaaaaugugucuacuuuugucucuaucuuucauggaaaaaagaaauauucccaaaguauauuauaaaaaauaauuaauaagcaacuuuucaucauuauuuucugagguuaauuauuacccuaagaaaucaauuucaauuucuucaguuugaaagacucauuugugaugggguguuuccaaaaagagaguuaguuaaaugcuauauggaagccuucauucccuaaagaaaaugccucugcugcuggcagugauuuauccagagcugucucacccauuuaugccccaugccaggagaauguauggaaaauguaauagagcuauuagaauccaguguaguagauugguaauaguaaggaacaacaguugucuucacauuguuaaaauaaaagugagauacccuuuaaucuucgcaaagggaaauaacucuucugcuaacccuccugcccaaccugagaugaaguaucaggggaugcaguauggauguauuuuccugacgauugguccuucuguccugggacccaggugugagugcauagggaaaagggaggagaaauuuaauccuguaacuaucuccuuauggaaaacaggaaaccacagaugaaucaaaugaauccguuuccccucuuucugauccucugcaaaagucaucaaaaucacucuguucucaccaggcaacuggaguuucgucagcugagucuagaguguuccaggcaguuacagcuaaucauggcaggcucuacccaacugggggaacaauuuagcuguugugggauuucccuuuaaauuaaauauguucuucagguacaguuuuuuaaaaccaguuuuucucccccacuuuuaaccuacuuuaucguccauugcugggccuagaauugcauguccauuggcauggcugacguuauauauaaauauuuggaauuguaguuguaaugauagauauuauauauauuucacauguuuuaagauuaacauauuaacaguuugugauauucaacaaagaaugcaauaacuucugcgaaacagguaagagaaacaaccagucacuugaucuggauauugagacguuaccuguaggauauguauuaggcuguucuugcacugcuguaaagaaaugcuugagacuggguaauuuauaagaaaagagguuuaauuggcucacaguuuuguaagugguacaggaagcauagcggcuucugcuucuggggaggccucaggaaacuuacaaucauggcagaaggcaaagagagagcagcaggugacauggugacagugggaagugacagagcguggggugggggugggaggugccccacuuuuaacccuuuuccuguuuaggaaaaaaaaagcgcagcucacugccagcgcucauuuaauuuuacauaaacaugcucuuugaagcugaagcaaaugugaccgauuuucaaagugauaauaaaauauaaaaacaguucuuggaaauauuucugaacagaacuaacaucagaaucaucugaaucaucagaauuguguauuuuggaaaaaucggauucaucaaaugaaucuucagccaacaacuguucgagaauuauguuaacaucacaugcaggaaugcuacauuuucucggauuugacauuuucagugauggagaacuauuauauuuuguaaauggaaauaccacuacuaaaaacagaaggcuauaaauagaacgauauccuucguuuccaaagucgauaugcuagagugaugugaaaaaaauaauaaaagcgagauauuucauggcaaagcgaucucaggguaaacacugcacaccaguaaguauucuuggggcaaaugggaaaaggguuaaaaugaccagaucuccagagaucucacucacuauggugaagacagcgccaagccaugagggcuccgccccagugauucaaauaccucccauuacggacauguuucaacaugagauuugggcggggacaaauauccaaacuauaucaggaucccagcagacuggguggg

SEQ ID NO: 15827 - RNA, 4469 nt, Homo sapiens
cccacccagucugcugggauccugauauaguuuggauauuuguccccgcccaaaucucauguugaaacauguccguaaugggagguauuugaaucacuggggcggagcccucauggcuuggcgcugucuucaccauagugagugagaucucuggagaucuggucauuuuaacccuuuucccauuugccccaagaauacuuacuggugugcaguguuuacccugagaucgcuuugccaugaaauaucucgcuuuuauuauuuuuuucacaucacucuagcauaucgacuuuggaaacgaaggauaucguucuauuuauagccuucuguuuuuaguagugguauuuccauuuacaaaauauaauaguucuccaucacugaaaaugucaaauccgagaaaauguagcauuccugcaugugauguuaacauaauucucgaacaguuguuggcugaagauucauuugaugaauccgauuuuuccaaaauacacaauucugaugauucagaugauucugauguuaguucuguucagaaauauuuccaagaacuguuuuuauauuuuauuaucacuuugaaaaucggucacauuugcuucagcuucaaagagcauguuuauguaaaauuaaaugagcgcuggcagugagcugcgcuuuuuuuuuccuaaacaggaaaaggguuaaaaguggggcaccucccacccccaccccacgcucugucacuucccacugucaccaugucaccugcugcucucucuuugccuucugccaugauuguaaguuuccugaggccuccccagaagcagaagccgcuaugcuuccuguaccacuuacaaaacugugagccaauuaaaccucuuuucuuauaaauuacccagucucaagcauuucuuuacagcagugcaagaacagccuaauacauauccuacagguaacgucucaauauccagaucaagugacugguuguuucucuuaccuguuucgcagaaguuauugcauucuuuguugaauaucacaaacuguuaauauguuaaucuuaaaacaugugaaauauauauaauaucuaucauuacaacuacaauuccaaauauuuauauauaacgucagccaugccaauggacaugcaauucuaggcccagcaauggacgauaaaguagguuaaaagugggggagaaaaacugguuuuaaaaaacuguaccugaagaacauauuuaauuuaaagggaaaucccacaacagcuaaauuguucccccaguuggguagagccugccaugauuagcuguaacugccuggaacacucuagacucagcugacgaaacuccaguugccuggugagaacagagugauuuugaugacuuuugcagaggaucagaaagaggggaaacggauucauuugauucaucugugguuuccuguuuuccauaaggagauaguuacaggauuaaauuucuccucccuuuucccuaugcacucacaccugggucccaggacagaaggaccaaucgucaggaaaauacauccauacugcauccccugauacuucaucucagguugggcaggaggguuagcagaagaguuauuucccuuugcgaagauuaaaggguaucucacuuuuauuuuaacaaugugaagacaacuguuguuccuuacuauuaccaaucuacuacacuggauucuaauagcucuauuacauuuuccauacauucuccuggcauggggcauaaaugggugagacagcucuggauaaaucacugccagcagcagaggcauuuucuuuagggaaugaaggcuuccauauagcauuuaacuaacucucuuuuuggaaacaccccaucacaaaugagucuuucaaacugaagaaauugaaauugauuucuuaggguaauaauuaaccucagaaaauaaugaugaaaaguugcuuauuaauuauuuuuuauaauauacuuugggaauauuucuuuuuuccaugaaagauagagacaaaaguagacacauuuuacaaucauauaaaaugugauuagacucauauuuuauaggagaaugaaacucauuuaauuugcaaaauacuuaauaugagagggaggugucccccuacacacacacacucuuuucaagacucuuaaauagcccuuuuuaaaacaacacaaucucucuguucuguucuuuauuucuucacacauaacugccuuggagcuuuuaauauauuauugcuauuucaaucccccaugguuuuucuacuuauucaaaaagaagguauuuuucaucugaauagccauugacagcgaacucuggugacauccucagucuuccuugacaaugggaggaggaguugucaccaagaaacuuguuacuaucccaaguaacgagcuagcaucccucagauaauacaauagagauggacuaguguuuuucaaacaauuuaaaacacacacacuuauguacacagaaaaacacauguauacacguacacgcacacacaaacacacacacuuuaaaacacccucuuuuucuuuagucaccugaagagucguaaagcauaacugcaaacugauaaagguauaaauuaaaucauauaauagauguuguugcaaaucguacaugucugucagaucaccgagauagaagucaaaacaugaaaagaccaggaaauacccacaaaagaagauguaauugaugagacuauucaagaucuuuuauuuuuuccuucuuuugcuaguggaaaauuuuuauucugcacuuuucuggcggagggugguauuuuguuuucuguaagauacaaacaaaagacaguuguguaaaauuaaguuaugagaacaacauagaacuguuucuugaagcauuccaaagauaaguuuuugcuaauuaauuaacaaauucaagcugguuaaauaaaaccuucuuccaacaccuccuauuuaauugcaguuuggcaccaacaaauauauaucaaaauuauaguauuuccccugacaggaagcuccuuccuuccacacacuauuauggcucucugcagaguaagccagaauugcugacaaccuugaacacugcuacaacaauauuacuauacuuggcagagaaguacccuugcggcaagagaaaagcuguaauuuugacugucacuucacauuacacuagauauuauuucacuguauacacauacacacacucacaaacucuuaauagacuacaguuuucgcacugccugccuuuccaauauaaauggcaauauaauaccagcaaaccgccaaugagauccuggagagaaacaaauguuuggcauuauggaaacaucaucagaggaugcauuuuaagggauauuucauugcuuugucccccacucacaccguucacaccccaucaucaacuucauaagaucaucaccuugguuaucaaaaagaaauucacuuuuuuuaaccccauggugggccaagucagcauuaacaaauuccauguucaaaaauuuccacgguguuagcaaagguugugcuaugauucguaauauuuuggacauucuucaaaucugaugccuguuauguaaaauuuccagauuucaaaauguauccuuuuuccugcauuuaucucgcuuuccuucacacccggggggaaucuguuaaacugcagugaccacuggccgagucccaagccaagccaaaccgugcaaacaugaaacggccccacaaaucaugcaaacccuacacgcugucccugccagagagcagcgccugucuuugcagagaacuaaaugcaacauaugcuuccuucuuaccaagcucacacugaagcagauugggccagguuccccacugugcccucccccacccccugcccagcuuugauuuacaagaugcuauguuaauauucccucuauuugucccaggcaaggaauucugugaugucgguaugagcuccaaauugagaacucccuggaauccggagcacaggucagaaggaugaauacacagagggagaaaacugcaacuucccucaaggagagaaugcuagaaauggcaaugggcaggaaagaaaggauccugacaucauuuuauagagagucguucaucccuuacacaaaccuggccaaaaaucuacagaaugcugaggaaacacggcuauucaacaagaaaaucggagcuucucucucuacuuaaucucugccaucccccuuuuuuuccuccccuuucaaauugcuacuucaaacgauuuaaauaagauuuaaacuuguuuuacugaaucaaggaaaagcaacagcaaacucuuugcccucuguuaagagaauguauccaaaacuucaccgggucugcugaccacaccgaauuuaacaagguucgcaaaugaacuagaguaaguuucccacagugacacauuaauaauaaguuccuuaucccauccaucccaagccaugaauauguaauguuauaaaaugaguccuuuucacacaacggaaucucagacgugaauaaauaaaaacuauccau

SEQ ID NO: 15828 - RNA, 15282 nt, Homo sapiens
ugagauuuauucaucuuugguguacuuucuuuacuaaggcagguuguagacucaugaaaccuagaaggaguugaaaaauaaggguuaggauuaaaaaaaaaaacuagugaaaucaagacaccauuuugcuuaauugaaggcuugcggaacauuaaagcacaacaaaaaccuaauucuuugaguguuucugaggccaagccuuuucccacaaggcacuguguacacgguucuggaagcucuccucuguuugcacaguagucacucauccugcucucgggcucugccugcagucucuuccucugucuccgaugucacucuucucugucuucuucagaagcugucauaugaccuccagauuucucuuugacucccuguauuaccauuagaagacaucuacacugggaaauugcucaguuccuguuuuugauuaauauuuuaucagccgcaagaggaaaugguauucuauagcaacacuaauaaguaauugagcagaugagaugcucuugcuagcuuugguaaaaagucggggcaagguuacaacagaggagcucugaugagacuugggaugauaaagucaagucgaauaucugguaggguuaaaaaucuaacagugggccaggcgcaguggcucacgccuguaaucacggcacuuugggaggccaaggcagguggaucacucgaggucaggaguuugagaccagccuggccaacaugguaaaaucccgucuccacuaaaaauacaaaaauuagccaggcaugguggcaugugccuguaaucccagcuaccugggaggcugaggcaggagaauuguuugaagcugggaggcggagguugcagugagcugagaucgugccacugcccuccagucugggugacagagugaaacccaucccccaaaaaaauaaauaaauaaaaauuaaaaaaccuaacacugguacgagaagaaauuaugcucuaaauccuucuuugagcaguggcuuacagaccuaaauuuaucaaaggugguggcaguaauaguaauaauuaccaucuucauuuaaaggcacguaucuaaaccaaaggaccuaaauaaaauauuaauuuuucauaguguuuaauaugugccaguauauauaaauucaagguaagguagacagcuguaaacuggauccccugcuguacccagcaaaugcugagagcccugcuuccccucuuguauucaaauggcucuauaagagaggaaguaguacagcuaucaguaacaaugccauccgguaauuaccgaaucauaaauguuuggggagcugaaggucacgggcuuaguagcaauucuagucugauguuugauuccuugugaauuuuaaaugcuuguacucucuaucugggugaugguguuuuaguugccaguggacagucugauggaggugggggaagaguuauucuuccauauuuauuuuucuccaccuugggugaaaaaacuucgcuuuucguaaugugguacagugugugcuucuguaaauggaaaugguuucagcacaucacagucaugcuucccuguugaaagaugcuccguuuucccgcauacaugauguccagcacaacgucugauuuaugagagcaugacccugggggccucuggaacagcugcucacacacucccuuuaggaggcccaggcucucaggggaggcccauagugcagcuaggagcuagaguuuuaggaugaagaaauuacagguaagaacacagccccauuuuaagaaauaccagugauuucuguuuuuccuuguucuucuuucccucaguauuuuauuaacaugugcuacuauacaaauacacaauucacuuaggacucuguuucguguggaucacaugggagcuuucauuaaauuguggugauuccaaugugagugguuaucaagucaacaucaaauaacaugaaguguguuuuagucggcaaacaucacuuuguaauucucugauguguuuggguugauucccuucuuucugcucuuuuucucuuuauaaaguaaacauuuuuauugcaaagguacugcuauuguuaguuucuaaaggcacuugucauggugugacuaauauuagaagcagacacagccaugaugagcaauacucuuuuuuuguuuauuuuuguuguuacugcuguaagccacuuucuucucccucuccauuaaaaugcaacuuaauugguaaaguuuaguugacuagagauuucauuuauuuauuuauuuauuuguuuauuuauuuauuuauuuauuuguuuguuugagaugagucuugcucuuuugcccaagcuggagugcaguggcaugaucucggcucacugcagccucugccucccguguccaagugauucuucuaccucagccucccgaguagcugggauuacaguugugcaccaccaggcucugcuaauuuuuauauuuuuaguaaagacgggguuucaccauguuggccaaacuggucucaaacuccugaccucgugauccacccgccucagccucccaaaguacuuggauuaaaggugugagccaccgcgcccagccuguauuuaucuuuuuaaguaacaaaguauuagcauugugauaaauaauauuuaauauauaguaagggaggucaaaguaugaacuauuuugauuuuuuauggguuuuuuuuuuuuuuuuaaagaaugcguugauuuuguuuuucuuucuuuuuuuuuuuuuuuuuugaggcaggccuuaggucuggcacccaggcuggagugcagugacgugaucaaggcucacugcagcuuccaccuccugggcucaagcaaucuucguguuucagccuccugaguagcuggaauuacgggcucaugccaccacacuuggcuacuuguuuaauuuuuugcagacauagggccucacuauguugcccaaacuggccucaaauuccuagcuucaagcgguccuccugccuuggucucuccaagugcugggauuauaggcaugagccacuaugcccagccaaauuuuguuuuucuuuucuuuuuuuuuuuuuuuuuuugaaauggagucuugcccugucccccaggcuggugugcaguggcaugaucucggcucacugcaagcucugccuccuaggcucaugccauuguccucccucagccuccugaguagcugggacugcaggcgccagccaccacgcccggcuaauuuuuuauauuuuuaguagagacgggguuucaccaugcuaaccaggauggucucgaucuccugaccucgugauccaccagccuuggccucccaaagugcugggauuacaggcauuagccaccacacccggcccagauuuucuuauaaagucaaaugggagauacuuguuugcaggaaauaguucuuuugguucuuacuuuuccauaaggauugagucucaaaaugucugguagcauccacugcauuuuguaggggacaauaacaaagaagaugccagcaauaucuucuaucuuuuccaacauuauucaccucucccacccaaggacaauggugggcuggacagagcauucaaugaccgagaaucuaccauaagcuacuagggccacaucuuccccuuucuucucccccagguuugucccauuuguacugacucugacccagguugucaugacuugagacucacuagaaguuucagaaagaugcacacugcuuuaaaaaaaaaaaaaaaaagggcaaggggaggugugagaagaaaguauaauucuuuuucuucuaacgggagauauaaaaaucauauaagcaugauuuaucauuugauuggaacauuguauuuuaugguugcagagcacauguaucauccuaucugcuucugacacccaguaagcagcucuggcuuuuauaauuuugaugaaagagguuuccuaacaguauuucggugugcaugcucacacaccagcccuggucaucagugaacagauucuuccaggucuucauuguagcggaagaaagugagaucagagaucccgaggaagggcuucaguuucaccaguaguggagcuagggaguagcggggcagaagccgcaggaagucagugcaggacgccggaggccacuccuaauugcuucauguguuguugccgugcugaugaccuuggaggcgcugcugguccuggauccuugcgaccuuuucuuccaagaggaaauguggugcugagccccccuuccacuggcugugacaaagaaggaccccucaugugggggccuaauucuagugaauccccaaagguacauguugaaauagggaaaaggcccaggugaggcugucuauguaauagagaagauccauugcaaaaugaaaauaugggguucuagccaggggcagggaacuuaaucucccuuuuccaugggcccaacaccugaaucuagggcaaacaggugucccccagauuggauccucugcucuaggacacauucuuguccuagagcggguugggcaagaggcuuuucucucagucaccagccccaaacccuguggucuugccagcccaggacgugucaagacugcagccuuugcugaccugugaccaucuccaaguccaugcccaggccccuacuaggaguugagggcaacaggggcagugggucucuccugcuuaggaaauuuggguugaggguggcagugaucuugaggggggucugggagggaggagccagccuggccuggucuggccuggcccagugugccagcgagggcaggugcaauggcucacgccuauaaucccagcacuuugggaggccgaggcagguggaucaccugaggucaggaguucaagaccagccugaccaacauggugaaaccccaucucuacuaacaauacaaaauuagcuggguguggugaugcacaccuguaaucccugcuacacaggaagcugaggcaggagaaucgcuugaacccaggaggugagguuguggugagccgagaucaugccauugcacuccagccugggcaaaaagagcgggguaaaaaaacaacaaaaaaaugauguaggaaugaacagaugaacaaccccacacaaccuaaggacgacuuugaaucaauucuucuaagcugguagcagaagccaccuuuccauuugacuuguaucucgcucuuuuuuucuuucuuuuuuuuuuuuuuggagacagagucucacucuguugccuagacuagagugcagugguaugaucucagcucacugccaccucugccuccuguaaucaagagauuuuccugccuugggccccugaguagcugggacuauaggcauccaccaucacaccuggcuaauuuuuguauuuuuuguagagguggaguuucgccauguuggccaggcuggucuugaauuccugacuucaagugaugagacugccucagccagccaaagugcugggauuacaggcaugagccaucgcgcccagccagacuuguaucucuuaaugaguuuaacuacauuuaaccauguaugugucaguccuacuaugcaccuuacagcucacuaacccuguuuaauaauguauguuguuacauuuaaucuuuaugguagccucaugaacagguucuugaucaggagugauauugccugccagggaaugcaugucaauaucuggagacaucugggguugucaguucaggaggguagaggauaggggggaaaaggugcuacuggcaucuagugggcaaaggccagggauagugcuaaggauccugcagugcaaaggaccaugcccaccacaaaauaucagcagugcccagguugggaagcucugugccauugugcaaagauucaagguggcuaugucacaggacugguacauguccuuuuuuuuuuuuuuuuuuuuuuuuugagacggagucuugcucugucgcccaggcuggagugcaguggcguaaucucggcucacugcaaguucugccuccuggguucgugccauucuccugccucagccucccgaguagcugggacuacaggugcccgccaccacaccuggcuaauuuuuuuuuuuuuuuuuuuuuugcauuuuuagucgagacaggguuucaccguguuagccaggauggucucggucugcugaucucguaauccgcccaccucggccucacaaagugcugggauuacagacaugagccaccacacccgcccuacauggguauucuaacccagucuagugauaguccaaccuccuguacuaugaguaauuagcaaagaauuaacagcagaagaucgcucucaccaaagcccauccagaaaguggcucguauucaaggugcuaauuaggguguuuuguugccaguaaaaacaugagucagauuucaugauugauucaugaugacuuuaaaauuaaugcugcuguuaucauacaaaguagugguaaguggagguaagagaauguuuuugcuuugggguacuaagucaucguuauaauaaacacacaguaaacccauuuaucucaggcuuaaugcuuucuuguuucuucuaagcacuucuuaggugccucugggcuuuuuaacauucuuuggcaguuguaauuuauuaauugauuuuuaaauuuggccggugaaaaugaacuuuagguagggguuugaggaaaaugaaaaggccuauuuguuuuucaguggcugguucuucguguucagcauuaaggauugguagaaaucaggcaaccucuauguaaccucagccaucuuggauucccagcuuacucacaucauagauggagagucaguuguuuagaaaaaaacuuucuuuuuuuuuucuuuccuuuuucuuuucuuuucuuucuuucuuucuuuuuuuuuuuuagggagggucuggcuguauugcccaggccggaguacaguggcacgaucuuggcuuacuauagccuugaccucucuggcuccagugauccucccaccucagccuccugagucacugggacuacaggugcacacuaccaugcccagcuaaguuuguucauuuuuuguagauacagggucugacuguauugcccaggcuggucuugaacuccuggccucaaaggauccucccaccucagccucccaaaaugccgagauuauggguaugagcuacuguacccgaccaagaacuuucuauuauauagauuuuaauuaaaaacaguccuguugaguggccucuuuaucaaaugcauucucacauaaccucauagaagugagcccucuuacugaauuauguggcugggguucuuggguauguuuuguucuauuuucugguuggugguuuucuuucugucgggucccgugggcucuuucuggaccucuucucagaauguuuuucguuuuuuuuauuuuuugagauggagucuugcacuguguccugggcuggaaugcaauggcaagaucccugcucacugcaaccuccgccucucgaguucaagcgauucuucugccucagccuccugaguagcugggauuacaggugcaugccaucacaccuggcaauuuuuuuuuuauuuuuaguagagaugggguuucaccguguuaggcaggauggucucgaucuccugaccucgugauccacccaccucggccucccaaagugcugggauuauaggugugagccaccaugcccagcccucagaguguuuuaaaaugcauacuauuaaauaccuaggauuauaaagggagccagcuauacuuacauauaguucucucugugacccuguagaaugcacugaagcaaaaauaacagguaaugcuaaucauaaaguuuuacaaaucuccugaagagucuuguugguuuccguguugaugaagcaggaaauuucccugaccccuuugcaggcaggaaguggagugcggaugcuggaacuagcuggcugcuuuggugccaguagaggugaacugcacucacuugaacccccugcacuccaccccuucugggaggaagcaugcaggugagcaggugcaggagccaggguaaaugcuuuugggcacuggcaggaaugaacucuguacuggcccugggauagcaucuggcaggggaugcccgugaccccugaaacccuaaaaggaguguuacagucagugcucuuuuaguuuugccauccacggacggcuuaaguguuaacaguucaguggagggucagcgugacagccuuuugcacccacaucuggguucuuguccaguguccaggaggaacgaggucucaugagcaaauuuuaaggauggcagaugugggggauuuuauugcugaugaaaguggcuuucacugggaagauaagcuaaaaagaagacaaagcaggaagguaauuuuccccuggagcuaugccaucaagcuguucuucugaaguccagccgcuucucuccaacuguggucucuaauuuccagcugcuucuccucuuuucuucaaugugccagcggagccugggguuuuuauggguacaggauugggggcaggccgggccaugggugguuguggaaaaggcaauauuugaguggaaaaacagggauauauguucucacuuugggccacaguuccaggcuugaggauggggcccucaccacggaccugcccucuucugcccagaauuucccugccuccugucccuaucauugauaccugcaauucuuuguacauaugaaauuuaauauggugagauuggcaucuagcugcugcuagagauagugcucauaauaauuuuuaacauugauugaguguggauaauaauccaggagcugugcuaaacguuuuacaacacauuaucucacuuaauuucacaacuccauaaaguaguuuucacuuaguugagggaugaaaaaaguuaggcucugagaauugauauuacucugcaaauauggaauuggaauuucaaagcaaucuauggucuuuaucacuucuccauuaacuguccuuguuuuauuaaugcugauuacuuuuugauuugguuugguucuuuggaguuguuugcauuucaugagucuuggcaucuuuuugguagagaaccuugcuagguucucacaauguagaaauuaagcagaaaacagaggucucaauuugccuuuucagcgugaaugcagacucuuacauucagugcugggagucuuucuugagggacagugagagcgaggaaggguuuccauucuccgagauggaugguugcauuaguauuuauuuccuuuuuguuuuuccuuaggaugagaaagaaggcaguggagcccuuuuccuuagguuagaaugguucuguugguugaauugugcacccuguuugguugaaacaauuggacaguaaggaugugacuauuauuguugcucucuaauacuuuauuaugucauaccaaaaauuaucuuuuguauuuugcuaccaguucuuuuaguuucucuuacauguaugaaguuggauaguuagaaugagaugaaaauaaaugggcugggcgugguggcucaugacuguaaucccagcacuuugggagucugaggcaggugaaucacuugaggucaggaguucgagacuagccuggccaacauggugaaacccugucucuacuaaaaauacaaaaauuuuuuuguauuuugggauucgguuuaggugaugugugucuguaaucccagcuacuugggaggcugagacaggagaaucacuugaacuccagaggcagagguuguagugagccaaacuugcacaacugaacuccagccugggcgacagaggaagacucugucucaaaauaaacaaacaaauaaauaaauaaaaauuguuuaaaccugccaacuacaauaacuuuuucagucucuuucucccuuucccaccuucccaaaagggugggaaauuuuuaaaguaaaguaauaaacaaauaaguuuuggguugggcgggagauuaguuagagacaggaucuguaggucagaagugguauuugggggaguagggaguuuuuuuuuuuuuucuuuuucccuuaugcauuugggaguggaagagcugucagauucugaauuuaguuagauuuauaaugcuagagacauucagcagucugccuuucccuuucuguuauaaaaucauguuuuuauugaauuacauuuuaauauugguaucacuuuaaaaugaaaaugaguacuugcaaaauguauuuuugaaggaguuggguggugguggggggaugccauuuuggcaacagaugacuucgguucaaguccucucucugucucuuacuugcuuuguggcuuuagaccagccacccacucagagccuugaaauccucaucuuugaaaugaccauaguaaguuccugccuaggcucuccccugaagcugaaaugcaugaacaugcuuuguaauuuuuuuuaaggauugauacuagcuaggguguugauaagaaacagcaggcauaguuacugggugauugagaagaguuuaacaaaagacuguauuagucuguuuucaugcuacugauaaaggcauacccaauacuaggucauuuacaaaagaaaaagguuuauuggacuuacaguuccuuguggcuggggaggcgacacagugauggcagaaggugaaaggcacaucucacauggcagcaggcaagaaagaacuuguguagggaaacucucccuuaugauaccgucagauuccuugagacuuauuugcuauugugagaacaccuugggaaagaccugccuccaugauucaguuaccucccaccuggucccuccugcaacaugugggaauucaagaagagauuuggguggguacacagccaaaccauaucaaaaaccauuuauaaaacucuaagcagccuuaaaggaaaccaccaagggaccaaggccugaugaagcaagaguaggagggaacagaugcuuggauagggcaggugagucacaggcugaugggagcugccaccgucaguagagguccugaugaccugggagggugggagccagacagaugggaguauccuagccucaguuccuuuccauccucagaacuccucccagugccucucaauggcuaaaccaaccaaagguuggagcucaaggaagcuccugaggcuaucuuuacaggucagccaguugggaacagaguugacggagaggggacaggaggugacuagauuuggaaggaaaauuagaaaacuuuuggccgggcaugguggcucaugccuguaaucccagcacuuuugggucaguugagucuaacauagggguguccaaacuuuuggcuucccugggccacauuggaagaaaaagaauugucuuuggcugcacauaauauacaauuguugaugagcuaaaaaaaaaaaaaauccccaaaaaaucucauaauguuuuaagaaaguuuaugaauuuguguugggccagauucaaaguuguccugggccgcauguggcccaccagcuaugguuuggacaagcuuagucuacagguucuucaagaggggcuugagcauuugaaagacuucuagugggagagaucacaagguacaacuagaaaauccugggcuggccugagaggcagaccugugauuauuuugcucuuugaaaguuguccuucugcacccauuuuccccagaccuaaccucgauuugugcuccaggucugagcagaaauguuauucccuccagaaagccuucccuggauguugagggaugaaguuguaggccccucccgaaugcguccucagaacucgcugguucucguccucgcccucagcauacuugcucauuguuuguuuccaucucuaucaucucugugagcccuuugaggauggauguguguccaucuuguuaacaguuggcuccccaguaaccaguacagugccagauacagaguaguaacccuacauucuagcguaggcaaauauucuaguauuugccaaaacuagaggaugaaugagugauggguaagagaguucucagaaaaauggauauaaacaauauuguaaaucauauuuggaaaauaaauauuagaaucauugaaucccugaguuauagaaaaauuuauuaauagcgcuaucuggcuacuuuuuaaaguguggacauccucgauguauuagcuaugcaucuguggauaggaggcuuacccacucugagucuugucaaauaccaaacacaggaaaacaauaucuuccugagaauguugugaagaauauaucauccagucagagugaaucagcuugcccagugcuuggcauauagcugcucaagaaauauuaggcauucuuuguuauuauaaauccccuuuguauuuuaaaauccucauguaucacugaaacaaccaacugaaaaccauugagaggcucauggugaaagaagacagacaguguaauuucccuggaaacucaauuuugauucagacguccacagcaucucauuucugccuuuaaaaaauuucaagagugacauuuuggcaugacuggacucacagguggagaagguaugacaaacauucuggaaaucuuggaaggugaaauauagggaagauggccccuauggagguucauugucccccaccuuauucuaaauaaugacuuucuuaaaacuacauguuuugggggaauguccugcaauauugcuuuacaucuuuuuauuuuuuuauuucauuuuauuuuuuuugagacagagucucugucuccaggcuggagugcaguggcacaaucucagcucacugcaaccuccaccucccggguucaagcgauuccacugcccugaucagcuuccugaguagcugggacuacaggugcgcgcuaucaugccuggcuaauuuuuuguauuuuaguagagacuggguuccaccaugguggccgggauggucucgauguccuuaccucaugaucuguucgucucagccucccaaagugcugggaugacaggcaugagccaccgcacgcagcguauugcuuuauauuuuaagacuauacacugauauccccgagcacccaaguuccuguccgcugguagaauucacaaagcugguuuuaugucuccuucucuuccucuuccaguguugucuuuucccugcauugagauagcauugcauggagauccuuguacucuucgaacagaggcugcagauggacacaggaucugcucagggagauaagaucaccugcuaauucugcuuucuccaucagagucugaaugaucagugauggggaccagagcuagguuaggucucuggaaacgcccucugucugaguccgggagauggaugauauggguaaugacuugcugcuuuaucuucucuccaucuccuuacagcagcuccaacuacugacuuuuauuguguggcagcuaauuguaggauucuauuucuguaaagagaaggcaagagaggaaugcaguguccaccaucccugcagcccuuuggcgccuucccccucccauuaccuugaaguagagggaaaggggacgacagaagaacccuuagaaguaagacuuuuucugucucugaugccacggaccuuugaaauauuuuuuugaaaagaaggccucccuuggcugauaccuucugacuguuagugaauaaaggaaguuuaaacaaucucuucccuguaaucauuaaucucgucuucuuuguuacaauguauguuguggucuuuguuacaauguauguucacgaauuccuagaacacuguucccguuggccaugggaucaggggaagagagaaggaagagagaaccagacacaaguuggagggaauccaucuccagugcugcucagagguaugaccuagagcaagggguuuaggcuuucuuggacucauuuuccucgguggugaaguggggauaauuuauugacaguggaccgugagguucugcgcacaaaauucguugcauagcaccugauacacacaaagcuuucaggcaagguuaguuucggguauuuccagccuuagucuuggcugugggagccauaauggaguuguucagaaguuuacagcuaguguuuauaaauugcuugccauggggccuuguauacaguaagcauucauuaaguguucccuccuauuauauccuuagguuuaagauacaggcaccacaacauaaaccacccccagaguacacaugcauggguguaauuuggugccauucuccucccuuuugcccccaccaaaaugaaguuuuuaguguaaaugucauguagauuuuaaccaaagguugauuggagggucugaguuucucagcuaaaugaaggcaugaggacuguaucccuccugaagggugugaucaguuccaugagaaagaagcugcgagcuguggggcauccaagauaauguaaucugccccgggguccugugagggacuggccgacaaggcaggcugaaugcagccuugcccacugagcuggguucucucugcuuuagguccucucuggaggugaagagggaaguccgcugauuguuuuucucuuggugcaacuucgcaccacccuuacauaucccaguguauaugguagccaaggacaguacuguuugagccucccccauuaagugucaacauugaaucaaugcaaucccaugcaaagaaagcugagcaugggauugugccgguuuagccagcuaaaguguggucucugaugcugaucaugacuaugaaaagggaaaauggaggagaaugaugacgaaggaggaggaggaggaaaaggugacuugccucuagcugauguggauuauuucucuuuuuuaauuuccaugucuguguagcuucaucauagaucucagcuuaaggacaaugaaagucguuuauugaguacuuaguaugugcugguugcagagccaagucuuuuuuuuuuuuuuuuuuuuccuccuuuuuugagagagagagucucacucugucacccagacuggauugcaguggcacaaucucaacugacugcaacgugcaccucucagguucaagcaauuaucaggccucaacguccugagaagcugggacuacaggcauguaccaccacacucagcuaauauuuguauuuuuaguagaggcgggguuuugccauguuguccaggcuggucuugaacaccugaccucaggugaucugccugccucagccucccaaagugcugggauuacaggggugacccaccacacccagccagagucaaguauuucaaguauuagaguugucugccugccucccugucucccugccuuccuuccaucuguuuguuaucugacuuaaucuuugaaauaacccaaugauacaugauaugcauuuucuagguagauagaugaaggguuaggaagauguaacuuguccuaaaucacgugucuucuaagcgguggaacugauuuucucacugacuauagauguugagcccauuaaugugauaccuacu

SEQ ID NO: 15829 - RNA, 3749 nt, Homo sapiens
uuuuuuuuuugcaagccucagcucuuuccaggguuuugucuccuaacacucuucuuacagaagcagugucaguuuccauuuguuuuagggugggauggugcaucaaagaacaccacaccugcaaaaaacaacuaaauuagaaagaagccauguuucacaguucacagggggaucuacuaccucaagaaaaaaaaaagucgaugcauguuuuuuuaaaauguuauaaacaaauuuuuaagagauuuuuaaaaaguggcuuaaaguuuuugagaaauuuaccuauuuacacguccaaugccaaccuaggugucaaaugggcucaccugcucugacuuaaaacagguccagcaggguuugacuugaccuagagacuggaugccaaacuuagucccacucagacccuuacaaaaugcucauuuccaauuuccaaaauauacucaggacuagugcaucuguuugcugugguggcuggauuauauuguugucaucuauagcacagguuugccacaguuuauaugagacauggaauuuuaaaaucaaauugucauuguguguuuaugcuaucuuaaaacagggcuggaagggaaacuuucagggcaucaagguaagcuggcauuuaaaaagagcagcaagagugaucuuauuaaaauguaaaucaggucaugucauuaugugacuuaaaaccauccaguaccuaccauggugugugggggugaaagcccaacuccuaccauagcuuucauggcucuaugugacccggacccaucugcaaccacuucugcuuugcucuuuucuuuccagcuacaugggccugaucucuguuccauaaacaggccaagcucaucuccaccucaagccuuugcauuugcuuuuccuucugccucggcuggguuuucuuccccagcuuuauggggccaccauucuuauugcaguggagauucccauugacugaaauauucacucccuagagugggccuucucugagcacccugauuaaaacaggcccauccuuuaccacccucuaauccccuauccugauuuauguaacuucauaaugcuaagcaauaccccaaaauacgaacuucuauuucauuuguuuauuaccuauuucccccguaaaaauacagacuuuauaaaggcaaauuauugacuuguccuguuuacuuugacaucccuagcaccuagcagagugccuggcauuuaguaggugcccaauauguauguguagguauagguccaaaggccagagagcaugggucacaagaggaaaugaaauguuaacauggcccaaguggacgaaauucccuuuguguguaggugcacaucuauaugugaguguguuuguauacaugugugugaacauguauguuugcacauguacaaauguauuugugugugugugcauguuugugcacauguauaugugcauauaugugugugaacacccuuggcaagaggugaguccagaaagaaaaucagagaccagaugaggagggaauuguuaggugggguaagaaguuuagacauuaaacucagagcaauggggagcacuucuaaacucguugcuguagucauucauauugaggagucugcaggcagauuggaccuaguguucaaaucuugucuacuaccaauugguggacuuaaguagguuacucauccuguuggguuagaccucaguuuccucaccuaaaaaugggaguaauaaaagugccucccucauagaacuggugggaagaaaugaaaucagugcagaguauguuugcacggugccugguauggcauaaggaaucagcaacgguuagccauuguggccauuauuaucgguaucacuuuuccaaaacugagguaagccagagaauucccauggggaggaauugcugaugggcccagauaggcgaggggaggcggggaaaacagagagagccaguggcacuuugguuguggagaaaguagagacuccauuugcagggaaacuccuggaauggguggcaggugccuucucauaaacuggagcaauacacugggcuucugcccuguuguccuccaaccuccuauuagacaggguuaaaaaacaauccaaaaaaucaugguagggcugguuuugcuaaaaauaaaccauaggucacccaguucaugaagaaaaggaaguggaaaacuggcauaggaggaugggucucgcuuacauagggauccucuccauuuuccuggacuguuuucagaccaaccacaugggcacauguggucucucuccucucuccaaacaguaaccacauggacaugagcgcccucucccauuucuccaaauaguacguauggcagagacugcucccuacuuaacaaaacuaguucuucucccaggcacaucaccaggagauauuucccagaauccucugcaguuagacguaccaugugaguguguucaagccagcagaagagaggggagaugacaaagagccuuuuuggccuggcgcgugagggcuuccuaggcaauacuccauggucuuucuuucccaucugcuggcugagcugacauggcccgaggaugcagacaaguauggagccaucggguaaaggagacuggguucccaaguugucccuuggaggagagcugccguagagagacagcugagcagaaauacucacaauagacugguuauaagcaaaaaaugcauuuuauuguguuaacccacugaaauuuggaggcuguuuguauaguaacuaaccuacuuaaguaaauauaucaccucuaagaaaguaucaugugaguguucuuacaaaauccuacagccaucugcauucaaaaagugaugaaugacauucaacacagauaaacaaaacacacauaagcucuaauuuuuauaaaaguuacuaaacaguuacuguuaugccuacuuuauagacaacaaaccaaaaguucaaaaaguucacaaauacauguguuuuugguaccaaauuucacauccuuucugccaugugccuauaaguacaucaguagaaggcagccagggagacucagauuacuacaaguuuggagagcugaaaaagaaagaaagaaaaagaauaaaauguuuuuauguugugaaaucgaucaucuacauaucaacaaaaaguuggaaaauguugugaaggaagagccacucaccauaaaaagcaaagcuuuaaaaugccuuuggauaagguuagcaagaaauguagaagaaaauuuauuauaauuuuuuaauguuuuaaaguaagacuuggagaaacauaucaaggucuuagaagguagguucaaaauauaacccuaccccaauuaaacuguagauuccaaggaacuucaaucaagauucuaaaugauuuuuaaaugaaaaguugaauccaaacauugcauggaagaauuaauaagcaaaagagcaaauggauuuuuuuaucccuaauugauagggagagaggcuacuggcuuacucuauuaaauauaaaaacauauuccuuaaaaauaucauaauguugcaggaauggacaaauagaguaauagaguuccaaguggaauggguuauacaugagaguuuaguauauuaugaagguaacauuucaaauuagguuggaaaagagagcuuauuuaauacauauugucgggacaauugguuauccauuuuucguuaguuuccuucagcacuuuuauagacaaacguacaugagaucuuuuacaucucaguagaggaucuuucuaagcauaaugcccaauccggaaaaaauaaagaaauaga

SEQ ID NO: 15830 - RNA, 1117 nt, Homo sapiens
uagcccauucuuuuuucuaauggguggaauucgggcaaccgugggcucuaggggcacaaagaccccuaaugggcguaguggaaauucacccacaucucuauaaacucagucucucagcgaaccagaucagggggauuaacugcacaaugagaaaugugagacacacaaaacaagacaauuacacccucuuguccucaagaaaacgaugugagugcaauuacagaguaaucuaucaacagauaacagaggaccacgcacguggccucccagaggccugauguaaucacaguggcauuaugggcuuauagguaaagagacgaacuccgagcuugacgugacaaguuuuccaggauaauuaucacccguaccugccugcaugugaagacccauuucccgcaccagcucugaccucgcugaaugauuacugaaaugccuuccugugcacacuguaacuggccacugcucccaaggaccauaagcucuucacagaggggugcacugagcuggccaggauaggacuggaaacuuccaagugccuuccaaggcuguccacuguauucucugaaaucugauuccgcguccuugauaaaguuaucuugacggcuggcugcguggaacucacccuguacccagccggguggauccguccccagcauucaaggggaaaguucugucuguucaaguugccaugguccuucgcaagccacgacaggccaugggaagccgagucgaggcgccgugaucccagguaugagucacccuggugaaucagcuguguccguacuauuuuuuucaagcugugguuuucuuuauaacagagacuguguuguucauuuugcagccagaucuagaaagcuucuguaugcugagaaaggaggccuacuguacuauguccacuagacggaaccuaaaagguccgccccugcuacaggccgcaaggaauguucugaaacaauccauggcacagcugcagagcuauggaaggggccugaacccuaacucucaguaccuggauggucucuggcaagacacugcaccucucugagguaaaacccucaacuuguagaguuauaaaaauucauucauucaagaaaguggcuuucaacuaggggccauu

SEQ ID NO: 15831 - RNA, 883 nt, Homo sapiens
uuuuuuuuuuuuuuuuuuuuuacaaauagcacguuuuauuugccacuauuugaagucugaacuuuaaacagauucuuggacuggugguucauauccaucagcucguucaacuuuagcaccugucucguccccaguggcuuuuccagaacuacugccuucaccaugaagcuccaugagcuuucccaauucaaacuugggcuucuucagcauuuuuacuuuucuaacgaagacaucauggagaggauaaauagauuggcaagccuuuucuaugucuuuuccaaugcugucuggaaucaauuuauugaccacuucuuucaagucauuugucugcaccucucggaucaugauuuccaucaucuucuuccggauuuggcggaccuguuggugcugagcauaagaggucuuccguaucugauuuuugcguuuuuuaguaaaaccaacacagaacagacgaagcaaguaaccaucgguagucuugacaucaacgugagcuucaaucauugucugccauuuuuugaccauggaacacauuuugucacggguaagauccaugccauggaaguuagucaggcaguuuuuacccugaacaucuucaguaaucagcuugaauuuucuaaaugcaacuucaucauucugcaaaucagcaagacucacuucaaacacacgacccuugagaccaucagacgcaauuuugguuccuuggguccuggugacgagcgucuuuccaauauuucuuauauugaacauagcaggugcuuucacaucauaccaaucuuucuuagaaaauggaucaaccacuuucuucuuggcucccuuuuugccgccuuucguaaggcgcuuguucuugccaacagccauggugcuggugagagagccaaaaagc

SEQ ID NO: 15832 - RNA, 30027 nt, Homo sapiens
guuuucugacccucucaucuuguaucgcagguugaaaggauuguagacaagaggaagaacaagaaaggaaaaugggaguaucuuauccgauggaaaggcuacgggagcaccgaggacacgugggagccggagcaccaccucuugcacugugaggaguuuauugaugaauucaauggguugcacauguccaaggacaagaggaucaagucagggaagcaguccaguaccuccaagcugcugcgugacagucgaggcccgucgguugagaaacugucccacagaccuucagauccuggaaagagcaaggggaccucccauaaacggaagcgaauuaacccuccccuggccaagccaaaaaaaggguauucaggcaagcccucuucaggaggugacagggccaccaagacggugucuuacaggacuacccccagugguuugcaaauaaugccccugaaaaagucucagaacgggauggaaaauggggacgccggcucugagaaggaugagaggcacuuuggaaaugggucccaucagccuggcuuggauuugaaugaucauguuggagagcaagauaugggugaaugugacgugaaucacgcuacacuggcggagaacgggcucgguuuguagcuuuucuuucucuuggguuuggcucuggccauggcgaaaggggagcucugccuguagccuagggacauacauaagacccccaccuccauccccgucucuuagcuagccagcaauucccccuucaucucucucaccuagagcuuuguggacucggucguaggcccauguugguuacagacccucaugcauguggggaggcuaagccucugaugcuccagccaaggucuggaauggguccaaaguuccagacucuuauuucaagacacccaaggccaugguaaccccucuagacccacuucccugagggcagcucaaguccucacccccaggacccaagacacguguccucagcgggccagugccucccagggcacagugcagagcccuugcuugcagccucaucaugcccccagcaguguagcccagagagguagggucuggguugggguccgugccgucuucucagacacaguguggacuuggaguucaccacgccagugccugugcuggagccucuuguccuucugcuaucucuagguuggaugauugaccuauauuagguccugucuuagucuguucaggcugcugucacaaaacaccuuagaauggguaauuuaugaaaaauggaaaucuaauuucucacaauucugaaggcuagaaguccaugaugaaggcaccagcagaugcugcaucgggugagggccuguuccucuuagcuggugccuucuguguccucacaugauagaaggggcaaggcagcgcccaucagccucuuuuauaagggccacuaaucccauccacaaggauggagcucuuaugacuuaauuaccuccuaaaggccccuccucuuaaugcugugacuguguuguggcuuagguuucuucauaugaaauuuggcagaacauaaauguucagacuguaguggguccuaaaugcugucuugaccucauccugcacuaauucuuucgauuggcagccucuuacucuaacacagccugcauauguuguguuagguuauggaauuccuccuuuuuccaaagucucuguaggcaaaauuaaggaaacaggaggugaugacccauguaguucauacucccaaacaugagauuuccuguguggucacauugccccuuaccugaguccuucauggcaucagucuuucagguuagcugcuugugccaguuaugugcagucccucacuucucagacaccugugugucuaccugguggcauuugucucuuuggcugccagagacccgagccuuggaauguccagaaaucuuacaggaguguggacaaccauugcccaacagggcagggccaucagauucccugaugaaaccagggugcguguggagaccgggaugcuuggaugcagggggaaugguuagaagggcucacagaagguuggggugaugaggccaacacacuucagugugacgaugguagauuuggaguccagaacgugcagagcuggcuccccugcaagagcuugcugucuuuagguacucuugcugagaaaucugagcaauccguguugaggcuccucuuucuccagagagaggaauuucacccaaacaggauuuacuuagcaucuuugccccagacugacucacguuuccgucucgggaucccugacgcugacgugacugugccugugaacauauguaaaagcuguuuguuuuagaaauucaucucucggggagaagugggcucguguaaauggggcuuggcauaaacacccguguuugauguugcugugacggcugcuggcgguggcggaguucccugucucaggaaggguggcgaggggagauuuuguggcccuuugggugcaggggcaaggcucuggcgggguucccugcauuccagcuguuagcagcucccugcccugcucauauggggcaaucccaagaguaaagcaugagggaggaagauuugcugacuguagcugacagucugcagugugaaggagagaagccagacucauagaggggucuacaugagggugugccucuugugcugugcaaucuucugcggugaggcagagcugcgagcucugugcucuucacccuucggcuuugcugaugcccccugguccaugaccuggugauaaggcaugguaccccacaagcagggaaaacaggugagggccaaccuguugagauccguugauuguccuguuagcuccaaaaugcuauucuagaccuuucuugucucucugaucucuuaucuuccucauauuugccugacguuguguguucucuacucccacuugagccaaugcuggccucuauuuuguucuguuuugucuguuucaaaagggcccuuuugcuuaaucacaucccauagcacuggugcccguaagguuaaggcacugguucucagauucugcauguauuagauuaucuggcaacugaugagagaugcagaucccauggaaucugauuuccuaagucuaggguggagcccaggagauggacuuguuaacaaacuuccugggugacucuaccgcauuuugagaugagcuuuguggccaaauguguggggggugggaccuugaaguuucacaucaggugucaauuuaauucaauucaauacugauuuuuuuuuaugacuuccuaagaguuauucaccaugcugggugcuugaaguagaguaaugaagagauagguauggacuuuucccucugaaacuuauagcuucccucugaaacuugccaggaaguuggaaugccggccucuggccccaugcugagaaggcgcccgaggcuggcuccauggaaggaguaacacauauuacauacaugugcauggcuucaccauacccacaaugacgucuucuguggucacucgugugauaauugucccagccaccaucagccuuucaccuucuagucagaacuagcuuguuagccaggucugggggaacugggaagaggaaaagacugagaauccuugcuugagagagaaggagaguguugaagagagugguuugagguuccuggacaagacccaagacaggggaugccgugguuccagaauuuuucagcaacaggccagagguguaguccagcaaaacguguuuccauguguguuuucagccagagggaagcuuugcugaagccaguguucaggcccacguagcccugaauguccuccuucuacccucuucccuaaccucaccuucccuuaucuggacuaaaggauccagucuccaggggcccaagggugagcacuggggguuugcagcacaaaggagggcucaucuuagcccagcagaagggguugggggauccuggcugcaguugcacagcauuuguuuugggggugggcuguugcuuuuuauaugguuuuagcuucucuuuggugaguuaagguucugcauacagaacagcaacuuauguaacauguuacucauuuacugcugacuucccugaucuacuguggaacaaaugcuaaauuggggcuccggcgggugguguuuugguuucagacugcgcuuuuuccccagcaguguuuguggggcgugugcagcaguucuacacugcucuugauucugagucuucucugauaaugaguacuggcuuugugguccggggcccaucugccucaguaucucuuggggagcuuguuaaaacgggcuguaucccaguugaaugaaucaggaucucagggggcuggagggguggguucugcacguucaugcugaauuguaacagccacagguguguacaggagcuccagcagauguguuuggucguaagagaugguucauagauccaucuguugguagauccaucuuuacucccuggauuugaagcuugugagaaggaaugugaucugguccuucaaaguuuuaaaaccugucauaguuucucugccuugcuugcaguuucuacuaggcaucucucucuuuuuucuaaaacuacgcgaguuucaucgguacagaaaagcugguggguuugcuaacccuugcugugguucugccuuggugaacugcuuagcacucgucuaaacaggccaaagcaucaguguucuauggauucacacgagccuuuacucugugaaacgucccuaacuaggagccaucguuucucuuugagcccuagaauagcauaaagacuugcagcguucuccaaauuaccaggaaggugaugagcaucacuguugaugccagucuuguggccccauguccacauuucugaaaggacguuuaagauccuuuccuugcaucuugaugacuguugucugcugcacagacguugcaucucacacauugcaugauucaguguuugcagaauuaucucuaccauugaacgagucauuccacacaacacacacacgcaacauuugccauuuucucuccauugaucuuuuaaaaucgucucagcuuucacuucuagaacauuuguuuaucucuuccuacucacucuuucaacaugauuaucauuuuucccuuuauugauuauaauggauaaccauguuuuaaaggcaguuggaaacuaagcgcaagcaaugggaaguggccuauggcuuuugagaaucuaggggcucccaaacauggauccggcgucagaaucccuuggagggcauguugaaacacagacuguuggguguaccuucagcauucugauuuaguagguguaguguggagccugagaaucugcaccuccagcagaaguuccuagaugcugcuauugguccagugagcccaguuucagaacuacugcucuagacuaaugagcuccaagauggcggagaugaaaaugcagaugguguugugccugccagguggugguauugaggaaacuugaagugcuugugcucugcaccuggaguuggcauucauaagacuuuguaaagagaaaguuugugaaaugaaaagcuguaagguugaaaguuuuagaguauaaguacuucccugagaugaggccuuggaguuuccaaaguaccuugugugauccucauggcagucgugagagguaguuuuucuacccauuuuacagagguggagaccgagguuacaaguguccagguuggaauuaggagagaaacucaggcaauuugacugcaaauuuaacuauagagcuggccucuauaccacggcccagcuggauuccaggcaguagaauuuccccaagcccugauuacugacagagacauuuugugacugggggagggucaggagugcuuggugguacaggauguacuucuuugacacccuccuuguuuguuuauuuauuuauuuauuuauauauuuuuauuauuauacuuuaaguuuuaggguacauguguacaaugugcagguuaguuacauauguauacaugugacaugcuggcacaaugcacccacuaacucgucaucuagcauuagguauaucucccaaugcuaucccuccccccuccccccaccccacaacaguccccagagugugauguuccccuuccuguguccauguguucucauuguucaguucccaccuaugagugagaauaugcaguguuugguuuuuuguucuugcgauaguuuacugagaaugaugauuuccaguuucauccaugucccuacaaaggacgugaacucaucauuuuuuauggcugcauaguauuccaugguguauaugugccacauuuucuuaauccaaucuaucauuguuggacauuugggcugguuccaagucuuugcuauugugaauagugccgcaauaaacauacgugugcaugugucuuuauagcagcaugauuuauaguccuuuggguauauacccaguaaugggauggcuaggucaaaugguauuucuaguucuagaucccugaggaaucgccacacugacuuccacaaugguugaacuacuuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugguggugagcauuuuuucaugugucuuuuggcugcauaaaugucuucuuuugagaagugucuguucauguccuucgcccacuuuuugaugggguuguuuguuuuucucuuguaaauuuguuugaguucaucguagauucuggauauuagcccuuugucagaugaguagguugcgaaaauuuucucccauuuuguggguugccuguucacucugaugguaguuucuuuugcuguacagaagcucuuuaguuuaauuagaucccauuugucaauuuuggcuuuuguugccauugcuuuugguguuuuagacaugaaggccuugcccgugccuauguccugaauaguaaugccuagguuuucuucuaggguuuuuaugguuuuaggucuagcguuuaagucuuuaauccaucuugaauugauuuuuguauaagguguaaggaagggauccaguuucagcuuucuacauauggcuagccaguuuucccagcaccauuuauuaaauagggaauccuuuccccauuucuuguuuuucucagguuugucaaagaucagauaguuguagauaugcaacguuauuucugagggcucuguucuguuccauugaucuauaucucuguuuugguaccaguaccaugcuguuuugguuacuguagccuuguaguauaguuugaagucagguagcgugaugccuccagcuuuguucuuuuggcuuaggauugacuuggcaaugugggcucuuuuuugguuauuuauuuauuuauuuuuauuuuuauuuuuauuuuuuugagauggagucucgcucugucgcccaggcuggagugcaguggugcaaucuuggcucacugcaagcuccgccuccugaguucacgccauucuccugccucagccucccgaguagcugggacuacaggcgccugccaccaugcccagcugauuuuuuuuguauuuuuauuagagacgggguuucaccguguugggcagcauggucucaucuccugaccucgugguccgcccgccucagccucccaaagugcugggauuccaggcgugcgccacugcgccuggccgacaccuccuuguuuauugauagauggguauggugcuucugagccugaaacgcugugacuaacuccaugccacucaaucugaaaaccuagauaacaucaucacuuccauagagaaauacaacucaacaaaacagccuaaaggagggcuagaaagccugaagagagaaauaacuauuaaagaaauugggccaggagugguggcucaugccuguaaucccagcacuuugggaggcugaggcaguggauagcuugagcccaggaguucaagaccagccugggcaacauggcgaaacccugucucuccaaaaaaauacaaaaauuagccaggugugguggcacaugccuguagucccagcuuuccagggagcugaggugggaggaucacuugagcccaggagguggaggcugcagugagcugugauugugccacugcacuccagccugggcgacagagcgagacucugucucaaaaaaaaaaaaaaaaaaaaaaaaauacauugaauugguuguuaaaaaguccucagaagaaguaagaaaggaggaacacaaggcccagaggguuuugcaggcaaaucuaaacguucuagaauagaucaucugaccacacauucuagagcagauaaccccucccuuauccaaaugauuauggagaacaggaaaaugggaaaauacucccaacuccugugacgaggucaguaugaccuggauuuccaaaccagacaaagagaggaggagaaaugcaaauuacaagucaaucucacuucagaaugcaguagugaaaguccugaauaaccuucugggcuuauuauaguucccuugauacuuccucaaaacuacgacuguuucagaaacaucucauuccuugcccugaacuugaccccaguucauugccuuuagaaucaccacugcuucucugggugaggagcuugucccagaagaggcccagggaaacugguucaggaaggcucugacugucaucggcaguggccccacacuaucuggugaaccacugagaggucaggaaggguguucccggggcagccucuugucagcacagguauccauguauccacuucccugagcccagcuguucuuccugacccacuucaaguacccacccccaggccaacacacuuucacuaaccuuuucaauuuuuaaaagcagaugauuuuuccaagucaguaacaacaaaaacuugaggguuuuuuaaucuuuugucuuucacaggguggcaaguaaggaaggugugcuaaugaacuaacuuaaaacccuuugauguggugguguuaagacccuguccaacuuggccaccgcccuaugcacauggaaagugccaggcugugaugggaaauccgacucuuuaaccaggagcaacuugaccuauggcagauccaaggggagaaucgauucuccccgcuuggcuccugaauucuggauuugauuuuggugcccagaagaggaugauggagucuugaccacugucaagguuuagaaaccaacuaauugcuuuuccuaccugcucagcugucguuuuccucccucaauguccuuaggaaagucuuaggcacuguuugcucauggcuauccaucaggggacuuccaaaaaggguauagugggggaguggaagcgauccuccccaggagcaagcaguaagcggguacagugucuguagagggcuccaaaacaauaauaaaacuucaccuccuaaugucggugaaaagccgcucuccuuauugaggguuccaaaacaauaauaaaacuucaccuccuaaugucggugaaaagccgcucucccuguugaggguuccaaaacaauaauaaaacuucaccuccuaaugucggugaaaagccacucuccccauugagguggaucccagggccuuccuccacccugacuccucacacaaagcagccagucuucaugaaugaugaugauaaugguggcagcggugguggugguggugaugguagcaauaguagcuaacauuucuugaggucuuacugcagguaacgccuagcucuuuguauuugaucuacuaaaugugauuuaauuuccucagugguucucugauggagcaguuuaacaacauagcaacauaacaagguuaccugggaucaaccuuguuuauagauggggaagcugaggcucagcaaggguaagacacagcacugagagaaggaauuaggguguggugccgggucuggggaugcugaagcuguugggggucugugaccaguuuuguaaaugaagaaagguacuucagggauucagguugaagccaacagaccuuucccagaugccaagggcauuguucuggccaacaccccugggccugccuuugaggcaucuucaguaguaucagagaugcugacuuggcauuccagggagguggaaccucugguccuggugauuuuccuuagggccuuagauuaaaacacacacacauguaugcauguacauacacaugcacauauucacaucacagauguacacaucacacacucaugcacacaucauauauacacacacaccugcacaucuaugcauuguaaaggggacucccucaauugucaaaguuuauuucaaugcuagaagaaauggcaaaaaaaggacaaagaucuucaccaacugaugaauggauaaacaaaaugucgucuucccagacgacggauguuauucagucauaaagagcaaugaauaguggacauaugcggcaacguggaugaaccucaaaaccacauaugauaugauuccacuuaugucaaauguccagaauaggugaaucuguagagacagaaaguagauuagccguugccaggggcuaaggggaggagggaguggggaaugacugcuaauggguacggcauuucauuuugagcaaugaaaauguucuggaauuagauuauggggacaguugcacaacucugcaagucacacuaaaaaucacugaauugugcacuuuauaugggugaauuuuauaguauguaaaauaaaucucaguaaagcuguuuuuguuuuaaaaaaaaggagaagaaaaagaagcuagcaaguaggaugaaaaauaacagcuaccguuucccuacugcuugccaugugcaagggagccuucuaaaugcucuccaagaagcugugcauugaauuuccucgacagcccccauuucuacacuggaaaauuaaugcuuaaagaagacacgugcauugcuugaguuaguccaagugucacagaagguggagcuggaauggaaccacagugcccacucgugaacccaggcucccaugugggaaaucgagguacucuuagugaaccaagggacgcuguauuaguucccuauggcugcuguaacaaauuccucccaacuugguggcuuaaagcaacaccaccuucuucccuuauaguucuggagucagaaaucuaaaaugcauuggcagggcugugcuccuucuggaggcccugugggagaauccauuuccuugccuuuuccagcuuccagaggcugcacguucuccucggcucguggucccucaucucuauaaccuuugcauccauccucacaucuccuucucuugacuccaagcccccugccucccucuuacaaggacuuaugugauuacacugaaccaaccaagauaauacaggauaaucucccaucuccaaauccuuaacuuaaucccauucacaaaguccuuuuugccaugucagguaccacauucauaggucccagggauuaggauaugagaucuuuaaggauuugcuauucaucccaccacaggcauuuaggagaguuugaggggaagaaaggguaugcauauggguuuguauucuugaaugggcaagaaaccugcugguaacaaggaaauguuaauuuugucgucuagauuauuaaaauuauuucauuuaagugcacuugcacaucugugcauugugaaggaaacuaccuuaauugucaaagcuuauuucaaugcuagaagaaauagcaaaagccacaucaaguagauuauuucauuuaagcgaaauaauuauuuuguuuaaaugaaauaaucuacuugguguggacuuugauauaacuggaaaguguugaaguugacuuaaauucacuuguugauuuuuuuaaaauuauuuauuuauuuauuuuugagacagagucuugcucugucgcccaggcuggagugcaauggcaugaucuuggcucacugcaaccuccgccucccggguccaaacgauucuccugccucugccuccugaguaggugggauuacaggugcaugccaccaugcccggcuaauuuuuuuguacuuuuaguagaaaugggguuucaccauguuggccaggcuggucuugaacuccugaccucaagugauccacccaccucggccucccaaagugcugggauuacaggcaugagccaccacgcccggccucccuuguugauuuuagagaugggagcaagcagcuccuccuacaagacacaaaacacuuaucuaauccuaggaugcauuucuauacgacaguuacugcaugacaguguuuuguacaagccagcgugagccuuccuagugcccaaugagcugcuguuaauaaugacaauaacagcaauugcaccaacaacagauauuuauuaagcccuugcuaugagucagguguuggugggcuaaggauguuacauuuagcagcucuguuaauccugacaauucuaugaaguagguugucuuuuuaucccugguuugcacauaaagaaauggaggcuuuacaaaguuaguuaggcagcuggccugcagccuccagaugguaacaagguagagccagaauugugguccucuuucuuccuuuccuuuccuuucuuuuccuuuccuuuccuuuccuuuccuuuccuuuccuuuccuuuccuuuccuuuccuuuccuuuccuuuccuuuccuuuuccuuuuccuuugcuuugcuucuuuccuucuuuccuuuccuucuuucuuuccuuucuuucuuuuccugggcauuuuaaaauggcuuucuuacaucaccuuauccugugauaucugacuguaucauuagaucuuaaucacacacaaagggaaagccuguucuacucaucucucucucucucucuguguguguguguguguguguguguguguguguguaacauuuuguaugaaaacacuuguauuuugauuuuucugcucaauauagcguaugucuguuuccgucuauuuccauauugggcaacucuucauauuggaauuuuaguagugccauuuauauguuuucagaaggauauacagguugaauguccccaaguccaaaaucugaaaugcuccaaaauccagaacuuucugagcaucaaaaugaugcuuaaaggaaaugcucauuggagcauucaauuaucagauuaggggugcuuaacugguaaguauaauacaaauauuccaaaaucagaaaaaaucagaaauccaaaacacuugugaucccacacauuuuggauaagguauacccaaccugugcaauauuugauuuauguagccagucucuuguuguuggacauuuagguuaggucuaaacaucuuugguuuucuuucauuuuuuucuggacuauuuuucuagacuagauucccagaggcaggauuauacugcuaauuuuaccauauccuucuaacuccauccaaaaaagaauaauaaccagugaggcauaauuuucuaguuuugucauugccuugccagacguguguguuuaaggggaacaagaggagccucgguaucguuuauuugcauuucuuuagucuccacugaagcugagcuuuuucucugcaugcucaaguacucuuuguaacuuccucuuuguggcugguucacuccugucuuuugagauuggggagaauucagauacacagggaagagguaugguauggcaaaggaggagagcccagagcauguuugcugguuggugagaagaugcguuuggggcaggggcuggugugcuuagggaaagacuugggcgacagcugaaagacaggcuggggccaggugcaggaggggccuggguggcagggaacccccuguuguacuuguggcagccacucuaaugcaggucauccauggaaggacugguccuaaauuuuugaugaacuggcagaaauaccaaaaucugguucuggccccuaugucagccacucuggccuuccucuggcuuguccguaacucuguaccacccucuuuaaacccacugggcagcucggcugauagacauucuccauuaagggcugccccagacaccucuacuaccuauacccaccugucugcucccuggagagcuauuaauaaggagcccagggugugggugacuccagagaaacaucaaagaaaagagauuugguaggggcugcggcaggagagagaagccuccacuggggucagggaugccauagaggaaagucacaacccuagacugguuagaagaggagaacccaggagacaaaauccugaggcagccuucuuuagauauucauguuauuccaggugguggaagaacagcuggugaggcaagccccuguguauagagccccuuuuaucuuccucgugcgcaaccugacuaugcuguguauagagccccuuuuaucuuccucgugugcaacccgacuguggugugguguuccugggagcgccagccucgaggccucgauucacacuuuuuauguugcaacauggcuucucuuucuuucauccugucccagaaagaaaaucgagacccuggggcaaaaugagccuggaaauagguuugcgcaccucgugucauuaagacguugccguccacggagccccgggguucucugagggccuccuggugagaagccagauggguggacuccagcgcucccuucuccaugucagccacaguagcugcuuguauuaguccauucucaaguugcuaaugaagacacacccgagacuggguaguuuauaaaggaaagagguuuaauugacucacgguuccccagggcuguggaggccucaggaaacuuacaaucauggcggaaggggaagcaaacacauccuucaugugguggcagcaaggagaagugcugagcaaccgggggaaagccccuuauaaaaccaucagaucucaugagaacucacuucaguaucacaagaacagcaugaggguaaccgccccccgugauccagucaacucccacugggucccucccaccacacguggggauuauaaaaacuacaauucaagaugagauuuggguggggacacaggcaaaccauaucacuccuguuuuauuuguuucaugugaggguuugucaugugcuuuuguugagggaaaagaagacaggaaaugagaggacuuaaagcauauuucugaauacaccaguuuaauaaaucugcccaccaguggcaugagcuacuugaugagguuguugugccccaugucuuggguuguuuggguggacuuaggcagacuuaggcagagggauuccugcauggagacgggugagauuagguggccucacaggaccgagucagcuccucagagcaugugucuggcugggcagggucguggccgcucugcagucaagacccucauggugugcacucacucuccucauggcugagccaugugucaccacagcccaugugugcagaaauacucagcucauuuuuggaggcuccuuguccaaguuccgacaggugcucagggagcuuuugcagcgaccaugcagggagggagaacacaggcucugcuuucagugggggcaccugccugaggccacaaagccagccagaggauaagaguuagcugucuugcccaccgacccuccugcuuggccucucucgauguccuagcucccaauucuggcaucccccggcugagggagauccagguacugaccucugauuggcuuucauggcuccacgcuuacaccugucuguucccugcugccccagaucugugccaccaucucccaccaucugcuugacgcggcuccuuguccccacaagacggcagugagguggaggggggacaucuaaagggccacuuccgacuugguucugaggaccauuguccugagucuuacagugagggcagagccacuuuccaugguccguggggccucugaguccugggcuguggggccuugggggucaauauaucgucguaucugcuuccccuucuuggcacuuugcuggaugcuuccucugcucggccaggccggucaccuuggccugucgucuucccauuaccuuccagugugcagaaauguggcacccacuauugacucuucuccuuuacuuuugcuuguguuaauacuuaaaaaaaaaucuuuuacugccauuuuagagugguuucaagaaagaggagacaaauuugucagugugguauaucuaggucccuaaaauguucuucuuuuuuucuuuacuuuuuccucuccucucuucuccucucuucucuuuuuguuuucuaaaguuacaaauaggugaguuguaaaaaauucaaacaguauggaaaauauaagcauuuaauuuuaauuuuauuuuuaaauuauuauuauuauuugagauggugucugacucugucgcccagguuggagugcaguggggugaucucggcucacugcagccucugcuucauggguucaagugguuguccugccucagccuccugaguagcugagauuacaggugcccacccccgugccuggcuaauuuuuguauuuuuaguagagacaggguuuugccauguuggccaggcuggucucaaacuccugaccucaagugaauuuccugcuuuggccucccgaaaugcuggggaaaauauaagcauuuuagaaauuaaagucuccauauucucccuucccaaauccuauuuagaggugacuucuguuaauguuuccuuauggaucuuuugggacuauucucuaaguuuauauauauguauauguauuuauauauauuaaaucuauguacuuuauuacauaccauauauuauauaugugauuauauuacauauuuacuuaaauauuuguuuguugagugaugaacaggaauuaucccauuucuuucucucuccauguauguagguauagauauguauauaucugucugucaucugucugucuauucauuuauccauuauuuaucuguuagccaaggccucaccaaguugacauccgaguaaagauugaagguggugagaacaccuuguccugcaauuucuuuuuugacuuaaagccugucuuggaacucuuucugagucaggacguguggaacggccucccuguuuuuggcugcuugggauuuacggugugcagggacuuaacuguuccucugugauggccaucugggcugccuacaaagggaccugcuccugccaaaccuggcuagggccagucuuuguaaugcuuuuccaggcccuguuguuuuaauuuuaguuucuaaaugugggugagcaucuucucauguuccuuccacuugugucucucccugggcauugcccgggugccauccugcuguggaaacagugguggcgagucaggggcauucagccauguugccuggaacaaaugacccagccucugugggccagauucuuaauuuauaagaugcagauauucauaccucacggguuggggguaaagaauaaaugaauucguuuauaggaagcccuuaacauauucgcuggcuugugguagacauuugauaaauauuagccguuauuucaauuuuuucccccuuuuuccaacugggucuuuauauuuccccacuuguuuuuaaaaucacuuuacauacaguacacauauaugaauccuuuccuauguaugcuaaccaguacucauaaaaugacugccauauaccaggaacuguuuagacaaauaacugcaauaccucaugcugugauggagacaugcagaagauauuguggggccauagguaagggcaccgaagccagcuuaggggaaggaauuacugagggcuucuuggaggaggugaugcauaaguggaaucugauaaaaugagccgaaaugacugaggaaaaaggcagggaugucaggaggugaugacagcauguacaagggcauagagcugagggacagccucugggugccuguugacacaucacaaagaauacagcaguccagccaauucuagagcagccugcacgggaggcugagcuccagggaauuccucggguagucaggcuugucuuaagaaccagauagauggaagcccaccccaucugucuguguucugcaugugugacucccucugucugaaugccucccgcugugagcccucacgugaguaguaaccucugcucauccugcaggucuggcucaagcagcaauucccccauggaaaccuuugcugacugccagcauagcucaguuuccguuuuuauuugcacacauggaaugguguuucuugguugacagcacugaccucgguuuguaguggucacacugauuauucggguaaucucugccucuuucacucgaucagaagcuccacaggggagggauggucuccauuuuuguucacagcuguaucaccaacaccuaacaaugcugggcacuuagcaggugcuuaagaaaugaaugagugagugaaugaauagaugaaagagaggacuuaaggagccgguucugcuuuaagauggggguccugaggccagguccacccacugcaaacccuucugacaucugucaaagcugcccauccccuggcccagucuuuccuucucuccuugaguuguccuggguguuggcuucacagccucugcucaugguaacauguccuggaaagcccguauuuugucagggcucuucacagcaacgacaggauucccuucccauuggcucaucuggugauuguugucgccaucugccacgauggcccugcuugcuguguuccucuucccuuuauauucacgaagccacaguagacucuuaauaaagcgccaggcucccucccccaugaagggcauugugaguucuuuucagcagggugcaucucauuugggcugcagccucuguauuuugcgcaguucuuugcuaugagagagcgaaugcccaaaucauguaauuuaugaccugccuugaugguaacauaggacaugaaauugguggacuucuuaauagacgucccaguuacaggaaguauuguaagauuucaccuuuaaaauugcucucauuuugcagguagcauagaggcgaagaaacugauaagagcaggcagguagaaagaggcuccguguguucaaauacaaacauugccucuuagcaucuccaggcaggucuuaccagcuuuugagccucacuuuucaccucuguaguccgggaauagcaagccugccagaaaggaugaagcaguggguccuggcgccucaugagucuucauuucucuucuccuuugucagacuccgcuucagguggagcuuccugcuuugcucaagaaugugcuuuucuaccccacccucagccugcccugucguuuuuucauugauccuaggauauuagguuuuauucuguugcauaagccagcaaggcgaaaucaagagggacagccccugggugccuguugccacaucacaaagaauggguugcaggacaguggacucuguuacuuuugugacuuuuccauggaaguuagagucuugaguuuuucaccugccaucuuggugacagugccacugaguaggagguucugccuccgaguuuguucuuucuucuucuguuccacuguggaccucuggaagcuucucccaucuucaucuccuuucccgauucccucccacuucaccacccuugcagaaagagggucuguccugaguuccuggagguuuagcaagacaucuccaucucuggccuggcuuccaccaguaacuccucauauuauuagguuggugcaaaaguaauugcgguuuuugcuauuuuuuuuuuuuuuuuuuuuuaauggcaaaaaccucaauuacuuuuucaccaaccuaauacuugguggcagugaaugagaaacaacuggucacaagaucuguugagcccucgugugugccaggcauggcauugagugcugaggauacagcccaacucauauuccugugggaagaacugaggaaagagccaaauauuccagugaacugugagcagguacggcagugcccuacaugaacguggauaccaccgaagcaaggagauuauagacgcagcuuccaccugaaggaugcauggagcuugaucaggcaaagaggagaggggagaguguucuagacagugagaacuauauuuuaauuaagaagauuuguagaaaauauguaacaucuauuucaagcaucauuaauaaaugccauuuaugauuucuucaugaaauauuuauuaaaugacugcugugagcuaguauuguauaccuagaagcaggucucagcaugccucguucuggggguaugaugaguaaggcaagacagaguuuagggaagaaaacaaacaaauggggaaaugacaaauacauugacaaucuccauaccaugucaaaauagccagcauuuacugagcccuugcuaagccaaacccucuugcuagcacuggcaguuccucaguuaauccuagcagggagggucauuacccuucccauuucacggauauggaaacugagguauaugcaggugaaauagcuugccuacagucuauuagucaguagguggcuguuccaggauucagaucuaguuguccuggcuugagaccuagauuccuaaauucuccuuuucugcuucuugagggacagggcuaucugggaggccagaagagagcuacauuguauuuggaaaacuuuaaaaaauuuuuagcguuuugagaucauuuucuccccuacaguucacuuaaagaggcauuugcuuuccccucacuaugugguggggacgaaggcuguagagaugaccagccgugucuuccaaagaacucaaagcuuauuaagcugauuaagggaucagcugguccccagugaccugcugcaaagcugagcaugcgaacucaggaaggcccaggacaccggagcccuggggaugggcuguucccggcgcuuggggaggaagagacagcugucuggaagagaagcauuucaaguggccccggaggauuagaugugugaagguggacggaaaugacauuccuggccaagggaacagaggaaguaauggcucagaggguggaaaacucaguuucggagaaccucagacaguccuggaaguuaagguguuuauggggcaagagugggaguuaaggccagaaaacaggaugaggccagacgauggaggcaugugaacuuuugagcaggggaguugcaagaaaaggugauaaaaaugaauuuuaaaggaaaucacuuuauacuuugauacccuacagaauauuuugccacauaccaggauccuggcauaauagagcuuuuggaguuagcauggccuuggaggguuuuaaugcaggagacaugauuugauuuguagaaaaaguuccuuuuaaucagguuaguuuuguauuuugaauucaugcuuuacacugcugaaugcuuuaaacauuuaggcggggcauaguggcucacaccucuaaucccagcacuuugggaggccaaggugguggauugccugagcucaggaauucgagaccagucugggcaacauggugaaacccugucucuacuagaaauacaaaaauuagcugggugugguggugggugccuguaauucuagcuacuugggaagcugaggcaggagaaucacuugaacccaggaugcggagguugcagugagccaagaucaugccacugcacuccagccugggcaagaagaaugaaacucugucucaaaagaaaaaaaaaauuuagacaucugacagugaacaucauaagauuacuuagagguguuggauguagugauuagauaaucugagaaccuaaacuuucuuaaaauucgaaguguauggauuuuaucuggcauaauuuuaacaugccagaugacaguuaacuguggcuaagauuuuuuuuuuucuugaaugcaccugugaauuugagcccugcuauugcauucagguccugagagcaaggauucuguacaugggacuaggggcuuuugguuccacucaacuguagaacugaugagucuucucuuuuauuuaacucuccccuccaccucaccuccugacaugauugaugaccggaagugcucaagcugaacucccccuggguuggucuguucucucuguuaauuguaucugcuccccaagaugauaagagugauuggaacacuggggagaauggacuggaaggaaagugcuuugcaccugugucuuuuagggggcuagaaggagacccccaacaccacaauuuuuuuauccuaucuuccagccucuugcuuuuuuccccuaugucuuuugaucaagagguaagaacuucuguagguccuccauuguaagucuaguguuuauucauuuauucacucauucauuuauucaacaaagaaugacuugugucguucuuugugcugggccuccgcugguucugaagguauaugaauaacuaaaacagcccuugccuuuaagaauccaucugguggugaggagggagccagacauuugagaaaauccuugucaagauguggaagguauccaugaugauuuuccuacagugugauucccuucacuguccaguacgguagccaucagccacaggugguuagaguuauauuucaauuaguuaaaauuaaaaaauuaaaauuucaauagccauauguggauuccaccuacuguauuagacaaugcagauauugaacauuuucaucauugcaggaaguucugaaucagacuguaagcucuuugaaggcagauccaugucugguucugcccauccguauaccccaggugcuaagcaucuggugaacacucacuaaguauguacugaaugaacaugggagaggauaauaaggagaguaaaagaaggguguacaaacaaccagaagagagaugcacugcucuggaagaaugugcagaagagauaucccuggagcuccaucaaaaaguaggggacuuuuagcaaguggggaagggaggaagggugcuuucuccaggagggagaaugacucuggucucacuaacuuccuucuguguucugaugucucaagccacacaagguguuacuauuuuguuugcaauggaaggaaaauucauagcacucacgcuguguucucuccuugggugucuuugagaggugggaucucacucagagcgccagaugugauauaaauacgaguuagucaucuaggugugagaucaacuggauugcagaaaacaaguguuuucacguaugaggccaauacaaagcuuugcaagcauguuugacacauggagacuucaugaucugugagugaggugaauacggaaugcaccacuaggaacauacuaggaacauuauuaagaauuuggcgugggguauguugugauugcuggagugaguucccccaccugauuguuugcucaugcagucauuggaugaacacuggguuaagcaugcgguguccucuaggcacugcgcucuguguugcagacacacaggugaauacaucucaggcuuaucccucaagaggccacagucugguagggucuucaagcagguguauggaugaugauaacauagugaaaugagcucugcuugguaaagcaucacaugacacaggaaucagauguggcauccacauuuucuuuccuccuuuguucagcaaagacuaggcucuggaaaacaaaagcagaacauccaucagagccaacaccaugaagagggccugagaccagggcuaguuucagugucuugaugcucgaauccagcaucaagcuuggucaagaugcuggaguuugacccucaugcuggcacuucccaguggcauggccuuggguuuugguuuucucauccuuaaaauggggauguaaacaguguccuacagggucgugaugaggauggaaugagacaaccugugugaaucccauaguaggcacucagcaacuugugaguauugcauaguugagagaaaggacucuggggaauaugccaaagugacacuuggagucuccauuucacacuguugugggggcagguguagaucacuucuacuccagcugcccauaauaaucaaggagccacccugguuucugaggauggcuguguuaagugaggaaccagaauggauaauguaucccucaauuggggauagcauccuucagcgaucugucuaaacuuuuccucccuuccuccaggccugaagggaauguggugguguucuguaccugggguuugaaauguucuugguggagaacuuggacaugguuccugugcccugccaggaguggcuguguuuucugaaaacuuauuugcaugguagaagugcccuacggucuguccuugucugucucaggcucuguggccucaccccaaccccagcccuccacuuccugcccucucagacagcuuaccccuagcucaggggcagcugccccuguaucuuuaaugacaaguuucuaucuuuccuucugugucuugcacacugcagugaauucccugacaccuuuuguugcugcauguagaccacugugcaccauuucuugauuccccugggauccuucuggcauuucucuauugauugggcaguuuuucuuccccucuuugcugaguugagaucccucuuucugucucagaguuucuccucaggaaaucuuacacacaucuuuauuauuuuauccagugugauuaucucugucuuuuaauaugaguuuaauauguucacagaauaauguaauuauugagauauuuggauuauuucuccuauuuuagguagcauuuuauuuuuacccauucuuguucucuguucccucucucauuccuauuuucugaccuuuuaaugcuuuucacuggauugauacauuuuauacauuccuucuccuugggcugacucagaagcuagcuguagauuguauuuuuaaacuucagcacacauacuaaaguaugaucuuuuucuaacaaauaugauguccucuuacugaauuuggcaagaugcuuccuucugcuuggcuuucaguugucauugaacaugucucuuccacaucuuacuauuauuuuauacacccaacauuauuaaacaccauugauuauuauuuucacagccaguaauuacauuuacuaaaauuuuaaaaaucuauuuuuuuacccgugucuuccucugaauuaaauuuuugauuugcuaaguuucucuuaauuuuuuuagagucugugguagauaaauuuucuugguguuagaacaccugaaaauguccauuuaugugguccuuuaaaugcugcuuuagcuggguauaaaauugguugacaguuauuuugucucagcauuuugaugaauaguagcucauuuuuucaagccucuguuauugcuguuuucagucugccauuccuuuuugacaauaugauuuuucugucuaugcuuuuuuuuaagaacucuuuacccauggaauucuacaguuuaucauuaauauuauuugucuguguguccugcuugguacuuagagugcucuuucaaacugagaacuuuuucuuuuugaguucuacaaaaaguucagcuauucuuuucuuagaguuaucccuuauauagaacuuugauucuuaucugcaggauauuuauguuuaaaauauauuuaacuuuuuauuuugaaauaauuucaaacuuacagaaaacuaugaaggacccauuuucugauuaaccaguuuuuuuaacuuuuuucucucuuucugugugugucuguauauguauauguauauagacacacauauuuauaauauauacacauuauauaaacuauauacaaauuguucuuuuucuguaccaucugaguguagacuauacauuaugccuccuuaccccuuaauaucuaguguggauauuuuauaaaaggauauucuuuuaaguaaacacaauguaguuaagaaauucaagaaauuuugcguugaugcaauacuuuuauuuuagcccacauucaguuuuuuugcuauuaccgcaauaaugucuuuuagauauuuauuucuuccaauauagaauacagucuagaauuccaugaugccuuuaguugccaugucuguguagucuccuuuaaucuggaacaguucuucagucugccauuguuuuuaaugacgcugacauuuuugaagaauacaagcuaguuauuuuacugaguuuaucuaauguuucuucaagguuagauuuagcuuaugcacugaacuagcugauaugaugcucuuccuucuuauccaucucaucugucuguucauccauccauccgucuguccauccauccauccauccauccauccauccauccauccauccauccaucaccucuaucgugaguacaaauucaaggauucuuacuuuaugugacaguuuauaaucuauuacugccauuauuuauuuuacuauugaaaacauccaagauuuggccagugggagccccuucaagcugccuuauaugcccuuuugcaaugccuggcuauucuuuugaucacuuccuauuuuuagguacaauaagauuuucuagcccaaaguauaccuuaccugcccaagcccuggaagcagccauuucucuaggagcccuuguuuauuuuagugggauuguuauuuagaaaccaacaugugggaucuacauagcucauugcuauuuggguuucauuucuucuaagccuuuucagcugacagagcuaggaaauauguauaauuuuuaaaaucaugaauucuuaccaauaccuaugauccauuuuaaccucacuggauucuuccuugccucucugcaucccauauuuguaugucuucuuccacagagagaauccuauuucuccacaauaucauauauuuacucauuuucucaauccugaacuacucauaaaauaaucuuagaauugcuccauucuuaccacagugaaaagcaaacccacuaagaagaguucaagauuuaucuguuguauauucauaauauuauauccaaaaguuauuuguauuuguucuuccccucuccccuuuugaugugguuauguuauuccuuugaaagacgauuagguuuauuucuuucucuuuucauuuaguuuauuuccaccccccaucuuuauugcuuuuauuuuauaucuuaacauguuuuaacauacuuccaaaaauuaaaacaaaaagauauccucaaagaagggucaccucuuccccaucccuuuuacucaauuuucccugccaaccacuugugauaaucaauuucauuguuuucugguuuauucuucuugugauuuuuuuuuuuuuggaaaaaaaagcaaauuuauguuauuuucccaucuuuuuuuuuuacauuuaaagguaaaguacuuuuccaccuuucuucucuuuauuggaauguauacuguguaaaccacuccauauucauagagauagcucuuucuuuuuuagagcgacauaguauucuauugugugggugcaucguaguuuauuucaccagucuaugcuugcacauuuagguaguuuccaguauuuugcaguuauagauaaagcuacaauaauuuuaugcauauauauauuuguaccauuggaaguacaguuuuccuguuaaauuucuagaagugggauugcuggguuucgugagaguaagugcauaaacaguguugucagauacugccaaauuucuucccaucacacuuguaccuuucuguaucucccccacaaugaagauaaugccugacuccccacauucucuguugcagaguauauugucaaggucuugaauuuuugccaagcauaagaugcaugagaaaugguauuucaguguaguuuuaauuuucuuuguuaugaguuuuaaugugcacuauucuuuuggguggauuuggagccauuucuucuauuuaagggccauuuuuguguaaugcuguggauuguuuguucugucuuuuguucauuuuuuccugaaggaauuuuuggucuucuuaucuucaguguuuaaaaguucuuuacaauuggggauauuagccuuuuaucugugauacacaacuguuuuucccaguuugucauuugcuguuuaauuaguucuuuaugcuauucacuguccuuguuuccuuucugucugcuuuuguuugaacauuucuuguuuauuuuaaaugaauguuuuucuugcaucugagcauuugaaauguuccuauuuuaaaguccuugucaaauuguuucaugauguuaauuuaauuuuauuuggaguaauucauguuuugaguauugauuuugcuggcuuguuuucuaagcgugagcugucuacaaguuuugguauuuuggugugcaggcucauuucaagagcaaaguuucuguuuuguuuucguuucucguuccuucucucucucucugauaguuuuguguucgccucuaccugguccugagauccuaauaaagccuuagccguggauaucacaucccuugguuacuguuuuacugccuucaggguggacagcucacuucauccccuggcuuccagcucuaagccugggcucccccucccaucuugcagggaagacuuaguccuuguugccuuugaagaacccacaucuucccuccccucucccaccccacugacugcuuugugucaguguugugccucucauacgcagagaugauuaucucguuugugagcccggcuucaucuuauugacucucuccuuuuguauuuuaucugucgcuucuguauguuuggaacaggggcacggugucagcacgugaguuuauggagccuucuuaaugggaaauacuccuuuguacgcuaaaggagggaauguuggaagucuugaggggaacagaaggaaggaaacuagcaugaugggggcuuuccuauuuuccagauauguagcaugcaccauuuccuuuacuucucagcugcccucccauuucacacgcaggacagugggggcacagaacaggcgagcaaguuguccagcccugcagcccaugagggggaugugggaucugaaugcaggcagugcccccgacuggacgucacccuggcuuuugggcucagcagagcaguuaguccccucugugccuggaaugccuaaucuuuggccuaggccugggugugggguugggaguaggagaggcaugauuagggacacucaccaauuaguuccuccuuuuugaaugccuugguguccuccagcugacauuggagaagugccuggagugugcugggcacuuuauugaccccaggucaguucuuuaauugauugaguucaaaacagcccgaagaguagguacuuuuagccccuaccuuuuaaaauacuaaguaagauugaaucucauuucucauauuuugugggaacaaggagaccaaugcucaagagcucguguggcuuccuugcuucucccauuagcaaauguagggcugggauuauuuccauguccucugacugcagagcccuaagcuuccacaguuccaacauguucuguuucucacagcgucuucccugccagcuuguugcugucacucgggaagcaugaugcuccugaaggagagggaccucgaggacugcucggugagagggcagagucugaggggcucuggaggcaccauuccccugcgucuccuggagagaaggcccguuucagccacccgcauccagaauugcacacauuuugaauccaguacucaaggaggcucugaucccugcuuggcucagagguguugcaucuuucuaaguuuaucggagaggcgagcccaguguccuggcagaggguaggagggucucuuugccucugcuaguuucauggcuuauuugguaagauggccucagggcccucgucucuucgggugcuucuccacccuguugcgcuaauggaaagaccaugagauuuggguucacgaacaccuccccucccugcaucacucuuuaucacaucacccuauuguuuuccaaucuguaauuuuuuuagguauuaguuacuuguuagcuuuucaucuccccaacccaaagcaagcuccaugagggcacaggcccuauuucucuacuuucuuuuggauccccaucaccugguagauaccuagcccauaggagguggcaaguaacuagauuuugaaugaaugaaugaauaaaaugaggagauggcuggcuccaauccuggcucuuccauuuacaaucucugugacuuccagcaagguacucacuuuuccuuaucuguaaaauggacuaacuagaauggcaaauguauaagacuguucaauaauugacacccagccuuagagcugcuca

SEQ ID NO: 15833 - RNA, 5443 nt, Homo sapiens
aacccagugguugagagcauaggccuugguggcaggugcaucugggcuugggggcuucugccacacuuacuacucugugacuugggaagcucuuaaggcucccaaggcuccguuucuuauguggaagaagaauagcaggaggacucaccucugcggguuguugugaggauuaacugggugaugacuguaagcagcugggagagugccuugugugcagugaccacuguugcugccaccaugauuaugucaccucucaacaugggguggugggaggcccuguggaugaggccaaggcugccugcacugagugucccaggccuuauagcuuuccacauucucacgucugcugccacaugauauacaaguaaauguauuagaaguugguguucauaaaauacuuuuuuuuuuuuuuuuuuuugagauggagucucgcuccgucacccaggcuggagugcaguggcgccaucucccaggcucaagggauccuccugccucggccugccaaguagcugggacuacaagugcacaccaguaugcccagcuaauuuuuuguauuuuuagaacaggugugguuucaccauauugcccaggcuggucucgagcuccugagcucaggcaauccgccugccucaaccucccaaagugcugggauuacaggugugagcauccagccagaaaaugauuugcuuucuagacccauaucaccucucuccaucuacaucucuaguauuuaaauucaacacaauucuagauagcugaaacagcccaaaauauguguuuagaauacuuagaguuuguuauaaauaacccucuguuuagaauuugcccagugaaauucucuaauaauacuuaaaacucuuuacuaaaguugaauuuuccuuuuuuuucauugaaauagcaaagguaguaaucuguauuggucaaagaaacgagauaauuccuagaucucuguuuuagaccaguagaccuaacugugcuuucuuaacuuggauguuacaugaaacuuaaaaacaaacaaauauguguuacaaguacuuguguguacgugcauguguguuugugcaugugucuguguguguggaacuuuuguaccuuugcauaaagaagguuauuuaacaaagugguacaaacagugaacuacuuaauccuucuaugguaucauacacuucuuuuccugguuagguuaugagacuggcagagguaggaguauauaaugugcucagcuugucuugauuucaauaagacauuugauaaagucauucuugaucucugaaugugaaaaggaaguagaacagccgggcgcgguggcucacgccuguaaucccaggacuuugggaggccaaggcgggcagaucaccugaggucggcaguuugagaccagccugaccaacguggagaaaccccgucucuauuaaaaauacaaaauuagccgggcaugguggcacaugucuguaaucccagcuacucgggaggcugaggcaggagaaucucuugaacccaggaggcggagguugcggugagccgagauggugccguugcacuccagccgggcaacaagggcuaaacuccaucucaaaagaaaagaaagaaagggaaguagaaguaggauuuaacaaaggaccgagaagucggcugaauagccagguucagacaguguuggcaagaacggaucuuuggcaagaucacuuaaggugagcuacucuagcagcauccuguuugacauuuguauccauaacuugaauaaaaauauagaaggcaaagaagagugcugggcaagauguguuggguguuagaucugcaauacucuucauaguguaauggcuaaauguaaagucuuacgucucgguucaagaaagcacguugcuauaugaaauuucagaaaaaaguuuuguugcggggggugggauauugaucauuugaacauaugccaguuguuucuccugcccuaggggagguuggcacggcaaccuucccacuccguagguggguagccuugcugauggggcacgucgucaccaagggaccugauuguugucaugguuuugucuuguccuccucccuggugaaagucuacugcaguuuuauucucagcucuggaaggagagggaacgagccucugccuguguguccugaccccucuugccuuguuuuugaucugcucaggccgggugcaguggcucacgccuguaaucccagcacuuugggaggcaaaggcagguggaucacuugaggucaggaguucaagacuagccuggccaacauggugaaaccccgucucuacuaaaaauacaaaaauuagccgaguguguuggugggccccuguaaucccagcuacucgggagguugagggaggagaaucacuugaccccaggaggcagagguugaagugagccaggauugugccacuguacuccagccugggcgacagagggggacucugucucacaaaaaaauaaaaaauuaaaaaaaaaggucugcucagaaauaggggaaacacgggaucaagaucauuagagauuuauaggcugggaugcacaccaugucuucagagcuagccggcugugucuucuccccguuucuuucacuggugaauaaccuuucguuugaaccagccuugauuguucucuccauguuccacuguggcuccccauggacacugcuagguggaaucucugagaaaacaggcacuucgcagucggcgcaucuuucucugccagcuuagggauugccgucaagguggaggaaggguauuuuggccauguucggagucguuguuuuuacucacucuucuugggauagcuuucccacccugcccucugcuccucugucccaacccucuuccagccugguuuuuuuacugcuugaauuauguauccaaaauaaaaaggaaaagaaaggugcaguuggggcggguuguugggggcgaggagaauagcccuucugguucuucagaccacauaauggccagagcaugagccucacagaucccugagcagaccugcauacuagcacuuuccacaaccagcuggcccuggcugugagagucagaucuguccccaaggcuccaggucagaacuuggacccaggugccuucugaggcaccgccaaggacacaucccagcgccuuaggcaccuguaggcuagaaugacaccuuccaggccagccccagaggcccucagggcucccccuccaagccgggagggcaggcaggcacaggccccgcucacuaccucagcacccagugcagccccaggcucccggacgugcucggcccgguggccucuugugugacaggcccucugccaugucuguccgcagagccggguggggacccuccguguggguccuccucugucccuuugcagcucgcauucgccagagcggagcgcagcccuuguuuccuucuuuccucuucagcucugacuuaaaaacacacuauguuccaaaucguugugggaucggaaacuagaacugcuuguuuccaggagagaccaccuuuucauauuuuuuuuaaaaggaauuugugcuucaaaagaaacuccaaaaaauaaauuuauuguuagucuagcauaugcucauugaaauugacuuauguuuuauuuuaaaaaaucauguaggaucugguacauggggcgggcaaaaggguaucaucagcuuaagaaguaaagaagugagccuuccauuugugugggugauaacaucuuuuuccuagaucguaccucaaaauucaggcucuccaugaaaacaaagauaaucugaauaaaaauuguguguugggaaauguaucaagugaccuucaguuaagaaaagcacaggcuguuuauuagcacaacuugcuucauuaaauaauucguggcuuuuucugccacugggguucuuuucguuuugaauucagcuuguguuugguuccucggucuuguaccccuucaguucgccggcgacguaauggugauacccuuuguuuuuuguaucauaccuuuugugaauugugacaaccaucccguaaucauuguggccucagcagaaguuuugaacaaucuuugcagccacuguugggguguguaccagcagccuggaagugaccagcagagcugacaaaagcacccccugcucugcccaccuccgcagaguccuguccucaucagaaacgguaucgcggaugcuccucagguaggcguaggcagacuucauuguguguuagcagugacagugaugucuguaccuaucugugagugagacccauucaugacacacuagaaauguguacauucuuuuguuuuccaucacggguauaggucuucugccaugaaagagaacuaucaaggaaauuccugaaaacaagauuuguaaauucgauuugacccucccaaauucagggcugcucuuugcaguggucccuggcccagcagguggccggcguggcuccuguuggcucaugccaguguugugcuggacccucgaguaugugacugucacccuuguccaagacugguuuuuaacagucuugauuugucauuuugaugcuuugaauacuauaaggaaaaugccacgaauaccauauaaauaccacaccaaucuguugaacauaucuguguuuucugacaugggaccugcagaauaguauuucuuuuaaauccugcaacuuuauuaucuaguagaauuccaaguaggucugcuuagacacauauucagugaagauuguauugugugugauauuauccuaucuuuaauaaaguccuacuacugaaaaacagggauuugcaaugaaaaucauagcuaaauaggcagguuuagaaaguucaaaauauuggaagugcuagaaggcugcaacuuguaaaauuguacuccccaaguucaguaggauaguagagaagucgugcuaaguugauuucauugaaaugucacgucucacauccugugguccaaagguacuaguuuguuuuguggaauaauuuucuguucacuugcugauaagaaauuuagcagucagaaguaauuuuuaauuaauaaccuuucuuuuuaaaaguugcuuuaugguuuacaaguaauacugaugcaaaaaggauuuguuaaccuaaauuaaguagcacgcacuuuguuuacaugcuucaguauauugugggguuggucccuucucacgaacccaggaccugugcuuggggaacauuuugccaucaugcuguucucuuguaccaaggaucagugaaaguguuuuaucuuuuuuauguaguuuguauugacuggauuuuauaacuguaagaaaacagaaacagaguguuguauuuugaucugaaauuuguguaugcuaaaguaauuuuguuuuauguauuggaaguucacuuaaaaacuugaaauauuuucuagaaggguaccacacaaaaggaaucaucuuuaagcuguuuaauuaaccuaauaaaauaauuugauggggaaggcauucua

SEQ ID NO: 15834 - RNA, 1624 nt, Homo sapiens
uuuuuauuuauuuuuuuauuuuuauuuuuuuugcuucugcuucuucccgcaccagagugcugugaaguaugggaccggaggggggaaagaaaagaaaaccaaacaacuaaaaacaacaacaaaaaacaaaacacaaaacagaacacacucacacacacacgaaauaaaaccuggcacggaaaaugaauuaagacuggaacccaguuucuuuuuuuuuuccuuuuuuaaaaaaaugagggcauaguggggggguaauaaagucuaccuagcaaaguauaaaacgacaaaagcaugguuuccauugaauaagauuaaauauauauaaaacaaguacacugacugugggguagguuuggaggugccggaggagggaaguauuugugcuaaaccaacagaaaaaagggcuggggggagagggggaccccaaauaaaccaucaacgggcuguucuguacagugagggcuuauuaagaaaaagccgacuguuuauaaaagaaacggagguugguuugucuucggagcagguggggacagaaggagugucuucguugcaguggucacaugugggggguggcgggggugggguggggagggcagucggacuggcggaggcgacacaucucucuuuucccaagagaccaugcagagaggcgggcaugcauggggccacgugaagcacacgauggcagggggagcccaggggugacagagucuccguuggggacaggggacagcaaaggcugacagggacaggagcucccuggggguggggaacagcucuuuuaccgggguggacuggagagggcggguuagcagccucccauucaagucuaaaaggugccgagagaaagagcuugggccuuaguggagcaaggggaucuuaaucccuccuccuccagccugagccccaccucgugagggaguuggagacauuuggaaaucagaaacgcacaguggugggugggggagugggcagacagacagacagacgagagagcauuagcauagagaauccauuacgaaaaagcaauuaauuuuuccaaggagguucuuuuuuuuuuucuucuuuuuguugucuguuuguuuccuuuaaaaaaauaacaauaauacuaccacuaacccgacagcugacugguuuauacaguacuacacgccaggugggggcgggagggcgguggggucgggcgggggggacggucaaagacuucauaaauaagaggcgggucccagacccgcaauuugucaacaugucuuaaauaggugcauuauuuaaaucuuauguacaacaagaaucacuuugcauagcaauggugaggacacaggacgggugcagugaugugacugggucuucuugucccaagggcggggggcgaguucgcagcucagcucggagccucuaggaagaaagcauccuucguccggcccgcaaugguggcaucggaguugacuuuucccacacgacggcaucaaacacaaaggcaaagaaaauccacaaagggucccccaccccccagcccacccccaaaccccuccccgacccgcugaugcuccucuuguugcuacaaaguccacuuuagaucaggucaaagguuccaauuacgaagcuaaaagaauucggcgggggc

SEQ ID NO: 15835 - RNA, 34481 nt, Homo sapiens
acacagcucuucccaaccaggguuuauuuggcgccugggcacagugguggcuaccuggcuagguugggcacuacaggggcaugacuccuacuagguagaagaaugucaccgaagagggcaggguguggucagugugggucaugcguggccaugugagggguaggggagaggccaggaccaggaggcaggggugcuggcuccaggaagccgcccccuucaaccuugggcuucaccaggaccuggcagcacagacacugcucugccuucucaggugggggcaggggcggccuccuucacuuaacaacagggaaacaccuucuuguggaggauggauugaaaagaagcuucugcaccaaagugucugucuagaaaaaaacgggauuuccuucacaagaagaaggggcuggugggcuccuccacgggccucugggaggcugucagucccgucccaccgugcaccaagcagcuaaaaggagagagacacguuagagggaaggagugcgaaugugggcagccucguagcuggugguggucgucuugaaugacaggucgggggauggcuuugaguccuugugugacacacagguccuugcuggucacccaggugcaaaccacacaccugggaagggaaauucagucuggcuggaaguagggggccguggagggggugcucuggugcaagcucuggcaggcauaccuguauguggggccaccucagggcuggcucugagccuggcauugguggcaggagcugacagugggcccacagcaagcaggcaaguccccgggagauauggggcagccucuaggcucuugcccuucucuccagucagguggccacugcaguuccaggccuuugcccccuaccuggcaccaagauccuggagagggccucaggcuggcucaguguguccaccuugacgugccggaacgccuuacacagggggcucugcaggugccugugacgcagggacaugugugagucagggguggcaggaguggagcuccgcguguggcuccccuguuaauccuagcucuagcccaaaauggggagcuuaucaauaagcacggggggucuuuggacucagagccuuugugggaaggugagggggugcccagggaggcugacucuggggugggcagugagcuucucuuuuucccugugagcuauaaaugggcagcgggauccccccacucauugcacagagccucuaccucccccuuuacccuagcaggaggaguggggccauccucugccugggacccaugacaacacagaagcugcgaaggcuuuuagucccucguuuuaugagucacugaaguacggacagggaggggacacucucacuucucaugaccgccccuguucccacugggguccugaguuugucagcaaaccgugaguguuuaccagggaagcaggagaugggggcaugggcuaccccuaggccccgcuuccugccuguggggucuggcgcaucagcaauagucuccacccucucccagaugugugcugagcagaggacaaaggccuaaggcccaucagagcugcugacacccuaccccaucuccgucccucguaccgggcacucagcuggaggggagguuagucgcuggaacaauugaucacauggggacugagucaccuucuagguuaggcccucaacucuacagggugguaaagaaggcagugccucggcccccagggcuguuccaggaggacaaggugcucuaggggcacagaagcaacccuggggaaagcaggaaagcccagcugaguguggugggggcucucacuacccaccaagagcuccugccuccaccaggguuuacugacgcaagcaugccagcggguagaugccucgggaaucugcugacuggacucggccuuacccuccccuccaaggaugccuggcuccaggaagacagcccccccacuucccucugucucccucaccugcuguggggacccagcaucucaccucuuccacgccuccucugucucccagaacucauagaugacaaaggugaagccaucugagagccucacggcagugaugcugcaacaggagauggucggggggaggaggcuggagcucaaccaaggccaccucagugcuguuccccugggguggccugagacccaccacuauacacaacggcugccuucaauguuucuuccugucuugaccuccaucgagacucgacagggugaccccagcacagggaauaaggccuggcuucuuauaguggccaacagcuauuuauuaaauagaaucaaugcaguguaguuuuucuuuugagauagggucucacucuguugcccaggcuggagugcaguggcacaaucacuucagccuuccaaguagcggggacuagaggagugcaccacucggccuaauucaaaaacugucccaauagagauggggucuugcuauguuccccaugcuggucuuuaacuccugggcucaggcugucuucucaccuuggcuucccaaagugccaggauugcaaacuucagccacugugcccagcugaaaugucauguuaaagugugaacauuuauuuaaacaaaaccagguggcuggaugugaugguucacgccuguaaucgcagaacuuugggaagucuugaggggucgaggcagguggauuacgugaggucaggaguucaagaccagccuagccaacauggcaaaacacugucucuuuaaaaaaaaaaaaaauaaaacuugcugggccugguggcacaucccuguaaucccagcgaugcaggacacugaggcaugagacucauuuaaacccucuggugagagguugcagugagcugagcuuccacuacuacacacucacuccugccuggacaauaaagcaagauuuggucucaaaaaaccuuuaaaaaucaaaaaaccuuuaaaaaucaaagcaucuucccucuucuuccuucuacuuguccucucauuuaauccuugcaacacccccacugcacuguaccugaccugaccaaaggaggcugaggggagggggugcugggccacagaggaaggggcugcaggcaagucccccauugcucuaugggacccaggggcccgcacucacgucauuuuaaaggugcugauagucuaugccgccccagaauccucucugcaagugcacuacaaugaggaagccccaagugaccauaaagcgggggccaaaagcuggggaggaggggcuacagugcucagccuagaggaaggggccgggcuggauuccaucuugggguggacacaccuccgugcagcuuuaggugcaccaugccugggaaguagaaucucaccuggcucuccaggcuugccgucuccaacucgacaaaccagagccucuacguccaccgugccuccucuccacagcgcaucgggguggcccuacuucacccuggagccucccacuuauucacguaauggaaaaagaucaagucuggccccugcuccugugcagucuguccuccuggaguggaguggguccugcccccccauccuggcuacuuacucaagaauggccccucguggccacgccgagucucgggaacggccgcacuccugcccaggcuacuccuccccucgugcuacaggucaggcuguugucacucaagccucagugcacagggggcccaagaagaccccucucaaagacccugugcuaggaccuggccugccugguucacagccauguccccaggcaauggggugaaugagugugugcucuggggauggaagaaagcccugggaagggaguugggcagagccuugcugcagaaacggggggcgggggaccacuaccagcaagaacaaagggcuguugucuucugcaacccccuccacucuggcccuggccacaugccuuagcuuuaccaaggagcuacaucagccuggugggaugaacaggaauuugaagguaaggccgcuugccccgcccuggacaucucagcacaucagggggagaagggcaacuacaugacuugggcauuucccuucagcuaccgacucuccucuccuuccucagugguuaacugagcaaauacuacauucugggccuggacuuaagugugcaggaaccccugugacagcagcagcugaggcugacugagcgcacggggcacaccaggcccagcuggagcccuucacacuugagauucacacacuugauuguauaugcacucaugaucaccccagcaaggaguccugggggugguccccccuuuacagaugaguaagcugaugccagggagaugaagacaccugccacauuugcuuggcugggaggaaccucaguagagaccugaacccacuucuuacgcauccagcugugugugucccuggggugcaacuuguacuacuuagggcaaagccuaguccugcccuguuccuccacugccaggcagagcucccugccaccaucccacccacgccucggcagcucacucacuggaagcaguuccucacgccaguggucccccgcagauacuggcgcagagaguccagaaacucgcucaguugcucggggcacacggccaucuccugccggaccagcugcaggugcugccgggcacagcaggagucaguguggggcuccacgucaggccuucucccuaaacaccccaucaggcccccaugaccucccuuccucggucaaaauaaaauaacccucccccacuuuucauucuuacccaugaauggauaagaauggacuaaaaaugggcuaagaaaggacuagaaccucaagagcccagugcagaaguagcccccaaaaauggggaaaacagacgagguuguuuacagaggccccauccauguccacaaccaccugcacagccuccagggccuggagacacagcacauccacugacaagaaaaacucauaguugauggacucagcauuuucacaucacugucuggcugaucacuuugcucuaugccaaaccuuuuuuggaucaaaguccaggagccucugggccaggugugguggcucacgccuguaaucucagcacuuuaggaggccaaggugggcagaucaugaggauaggaguuugagaccagccugaccaacauggugaaacccuguccgucucuacuaaaaauaccaaaaaaauuagccaggcgugguggcacacaccuguaaucccagcuacucaggaggcugaggcaggagaauugcuugaacccaggaggcagagguugcaguaagccgacaucccaccacugcacuccagccugggagauacagcaagacuccaucucaaaaaaaaaaaaaaaaaaaaaaaaaagguccagggagccucaagaaauacccccggaguuggugggguggcuccugugccagggcagggucugggugccaagcgcugggcgacaucuccccuccugguggucccaagcagggagagcggggucaggggcauugagccacuuggaucuuggcaguccuggcauggguagggauguggucccagaagagaggugggaaggggccucaccauguuggugccaucuucaucugacaggcgcugcugcaggucgaaccacagugccugaaacaauccagcacacagugaugcuagacccagagccccacuccgccccggggagccaggagcucugggaucccuggggcuguugggagcucccaaggacccggcccuguugcacagggcugggagaccaacgcuaggaaguggcagagacucccucuggccuacagggggccuagaacauguugcuggggugaggauggcuugggagaggcagcaagggggacuccagaggccugaguccaagaugcugggguuugccacuaugaugagcaacagcccuuagauucccuguaacuuauaauucaccccaaaucauaacccccagcaccucagggaucuaauggggugaacuguucucucuggucuuccccagacucuaagcuagaugguuuacaaauacacaaucuuccagacuccccagggaaggugcugccccacuguaaguuucggucuccaggaaccacaucugcucuguucgcccacgacuggugcccacacagggcugagcccccacagaagaucaacagucacuaugucacggcagagaaccccggcucugaaggcacgaaagccauguaagugucagagcgugggucugaacccagugugucuaccugacgcacaggcucaugcugcugcuuccuucagcuugggcaccccacuaaccaccucuguggcuaucucuguccauccuccaugaggacagaccaucuacgggagucacacagggcagccacagguaaagcacgccagcuaauaaggaaaacagcagcagguggaugagucuguguagucaccaccgugacguucuaaauguuugagcaagggaccuugcacgcucauuuugcacugggcucuguaguagcugauccuggcaaggguacugccuucugggggcacacagcaugaacacgccuugguaaguggugaaggugugccuggcaggaacaagucuguuuccaugguuuuacaagcauacgugagggguccuggggcuggaaaagccauaggaggaugaggagaggcacuguggccccuguaucugccccauucuucucccagccaggggccccuagagccuccauccuuccagcccagaggcagcuccgguuggccggugaagggcggggccugaagccaggcccggauuggccccugcugaccgcccgggccaguuagaggcuggggaggaggaccuggucccaccccgucuccaggacgcccagguacuccgugguuaccagccagccugguuguuagggcgacggugcucuaaaaauaagcuucagagucucccucccgaggcgcccgcugaguuguuaugacaaccgggccacgggguccccuccgagccgcucccgcagcuggcuucaggaaggggguaacuccaccucagccucaucccugcaggaggggaaguuugagcuuccucccucggacuucauuccacgucagccucugucucccuccaugcggggagccccuuguuccugcccccaugaaugccugagaacccccaaacuaaaaguagcaauacccuuuacaaaggguguaaaaaaaauacacaaaaguaggagaaacauaaaaccaccucaaucccaggguucugagagcucaguuaccuuggcuuauguggguauacgggugugcugugugcauguggauagguuuggguaacagaaugccucauaauaauugcuaacauugcuaauauuaaaugcaagcuacagcaccgggcccugugcuaaaccggagacaucauuuugguucauccuaacgacaccccuaugagggaggggucccaugcuccagguuauuuucuugauuaucagaggaggaaucuaagccucagagaggacaagucccuggcccagggucacacagcuaugaaguggcacaaccagaauucugacugauaccugagcccaucugucuguaggcccuaagacaaacuuuucuuuccaccaaauggucauauugugagcacucuaucccgagucacgaaacauuaucugaaaauguuuucuguaagggcugugccauuuucuaucaccuguggacgucccauaucacacuuaauacauuugcuacugcuggucacuuccuuccuuguuuugaaacucucucgaaucaucacgucucucuuucauccuggugcugccuuucggccaauaucugcuccagccacuucagagcaaagucuccuugaagcuagggccuugcaacacgggacccugcugaccacccucugcuccuggagcugcuccugcugccugcaggcccgccugaccccccaacacucucucuucccaggcgccccuccuugggccugaacaacacgagcaucccccgggguuugauccuuagcuucguccucggcagcuccacgccccaccugggggaugucuuuuucaugguucccuggccccucugcagcccagacuuuuguccugaacuccaggcuuaacucugcacucccucagggguuggaaggaguagacgccguggucaggccagggcuuacuuugcucuccagccucccaaucagcucugccaagcggcugaucugggcuuccagacccucuuccuuugcauccuccguggcugcgguagagaaagagacacacagacuucaguggugggcaggacgagggcuucggggggaagcuggaaacauccagccccuccaggggcaucaaacuugcucaucuccccagucccugucagaggacucucagaacuccucgggacccccagcugguacccccaccagggcccccgcuuucucucaccagauggaagggucuugccuuguuccauagccaugagcuugugguugggggcagaggcgggaguggggcuuccacaccaggucugugccgcgcuguggcuggguuugaugugguucugucugcaguuuggaugggaacacacacagaccauggcgguggcuucagggcccuuaccacuuccagcaucuuccacaggcauuuauuacgcaagacaguggacucacacaugcacagaacuugcaucauggccuuuguuuugacagaggaggaaaugagguucuuaaagcaggugacucagccagggccacgcagcuagcugggcagagcugggauucgaauucagcuccauucuaggaccccacggccuaggccuuuuccccaagagauucaguuccagagugaggcugagccagggacccacccccacucuaacagcucgaagcuuucgggcacguguagagcccaagcuguggagugaccaagucccccucccucccucaugauaggcccauuuaauguuuggugcccucuggggugggggaccugguuucaagaccccccuccaacacauacacauaaaagcgagaccuaaagagacacugacagucgggauguaacaggacagaaacugugauccugaccugggccuggccccaucucccggcccuggacaccccucuccugugcauacucaugugcauacacaccccugcgugcccugacaggcacagcuagccacaggcagaggcagacacacacacacacacacacacacacacacacacacacacacacacacagcucaccuugcacuguguccagcacauaguagggacucaaaaaugcucaaugaaugaccaaauccucccaugcaaaaggaugcugaaaagcuccuggcagacauacagaaacacagacacucccccagaagacacacagagugcccugugcacggccccaacacccgcuuggucucugugcaucgcggucuuggugcauucuggaauuugucucuugugaaccuugaacacuccgccaggcucucccccuugcggagggagcaaacucgacucccgccuugggaggggagaggcuggcagagucuuuauggugucaaucauggcuucucuauaaaccagcaggaaauuaaauguaucccucagaccaugacggguugcucagggcucccgggugguggggucugagccaguagccugugcuagaggugacauccugggagacuguccuggggcugggaaacaggauaguccucagggacccacagccuagagccaaacuagcugagauuuggggaaguucgagggaggggcauguguggaacagagguaucacgacaagcugccccgucugacaacauccccaaguaagguccccaccaugggggcagguggguguaacugcugacgcgugauggagcugacccagugugggaagucugcccugaaaacugcgcagccauacuaucuguucugcggcaggagaaaaacagcaaguuuuucaucaagauaguaacaggaaaacccaggaaaucuaagugucagcuuuuuucacagcgauggcugcuaauucuggggcacccaagaaucacaagacugaccacaugugcagaguucugggcuccaguccagggauucuagccagugaguauggccaggagcccaggaauguguauuuuaauuuucccaggugauucagcgcaaaugcucagaucaaacucauuugggaaacagugucucagaguuaccuucacaaucaugucugaucaggaccagcucuucaacuacgaagaaacacacgaucaaaccccagucccccagcaaaccaauauccugguccugagguaccucucugccuggaaaauuaagggcucaaucgagcuugggugccgacaccuggcuguuucccucaucuguuugcauuuucucuuuuucuucugugucaagcacaucagcuguucugggaagaacugagcaaagaaggguuuuucucaauuugaaacagcaaauggaggugggcggggggacgggugcucguguuccccgggagaugggacugcugagccacgagaaugucgcuccucucuaaauaccaggucacaccccuaacacagcagccaccaccuaggaugggaccccagaugcauucccaugguuccaagcacacaaacaaggccuaacacaagaccagaaagaaacacuccucuuucacgucucuuucaguccuccugagaaacucucaacuugcuacuacugucuucaacaccucucugauuuccccccagucucucuuuuuaacagagagguggcaagccucaggauucaagcuggaucguaaacaaugacaggugcuuauuuuuacaguuacuucacuuacggcaugugaugccgagagugcaguuauaaccauaugccauuuccuaaacugcuuucuaauuuucaaaagugggcuggggugugguggcuccugccuguaaucccagcccuuuggaagacugagacagcaggauugcugagaccaggaguuugagaacagccuggccaacauggcgagaccccgucucuacaaaaaaaaaaaaaaaaaaaauagcugggugugggugggacuacaugccuguagucccagcuccuugggaggcugaggugggagaauugcuugaaccugaguuggagauugcagugagccacaauggugccacuguacuccagccugggggacacagcaagauucugugucaauaaauaaaauaaggccgggcuccauggcucaagccugcaaucccagcaccuggaggcugaggcggguggaucacccuaaagaccagccuggccaacauggugaaaccccaucucuacuaaaaauacaaaaauuagcugggugugcuggugggcaucuguaaucccagcuacuagggaggcugaggcaggagaaucgcuugaaccugggaggcggacguugcagugagcugagaucucgccacugcacuccagccugggugacagagcaagacucgaucucaaaaaaaaaaaaaaaagaaaagaaaagaaaaggaaauagaaaaagaaaaaagaacgaaugagagaaagagagaaagaaagagagagagagaaagagaaaauaggcuagcugugguggcucacaccuuucaucccagcacuuugggaggcuaaggcagguggaucacgugaggccaggaguucaagaccagccuggccaacaugacaaaaccccgucucuacuaaaaauacaaaaaucagccaggcaugguguuacacaccugcagucccagccacucaggaggcugaggcaugagaauugcuugaacccagggagggagagguuguagugagccaaaaucacgccacugcacuccugggcgacagagcgacacuuuuugucuaaaacaaaaaaauaaauaaauaaauaaaacgugggccaaacaacagaauaguucugcauaaacaauuagcauguggaugcagcaaaacaaauuagagucugggaaauggugucuucacuguauuaauaaauauguacaccaggcauucuccugagcauuuacuaucucauucaauccuugcaauggcugagauuuuagguauauaauugugccuauauuacauaauggagcaccaaaggcacaaagagcuguggcaacuugcccaaggucacccagcucuuagguacacagacauccccaccaagcagcaggugggcacgugcgcgugcacggcauacccccaugggacccugcagggucucagagacucaccggagcuggcuggucuguuccucgauggccuccaccgcacucuccacugagcucagcagcgacuggaucugauuggccgucuccuucaggaggaagcgggucacaaacugguccacguugcucccacccucauauaccuguggaaggaagagaagaggcacugaggggaaaggggugggagggaaauuggagguggggucuagcacaggaguugggggaaagcuggugcuggugaauuugcuuugcaaagggaagggaggaccccacggccuccugggguccagucuuagaggcuguagcauuuccaacgcagaggcuagagguuuagagaccaaauuugaacccuggcuucaccacuuacuagcucugugaccucccagaguauaauggggucacugaagcaucuaucuuacaagguuguagcgaagauuaaacagcaacaugcguguacaaugcucugcacagggccugccacacagcaaagacucaaucaacaguaggugcuacaauauagaugacggugaugguggcagugauagugacugguaguuuuguuguugcugugacaaggauaaugaucaggcaagaagaauccacgaccuucccucccuccuuccuccugcaaggaggauuccuagggcuccuggaucuccaggcugcuacuaaggaaaaugacaaaacggaaucaaaagcagcugaagggaggaaagugcccggggcuuaguaaucaaaaggagguggccagagaggagccuggggggaaaucagagagggagucuuagcggaacucuggggaaaagacgaaaaagaaaguuuuuuccaaguuuugcucugugguguggaacagaauuuccaccucuguccugagauucugcaaggacauuucucaaggcuuuuggauccaguggagaugcuuugggcugcaaagacuuuacagcagaagggagaaagcucugcuuacccacgucgcucaaggacgggaugaugaaaaugaugcuguguugggggaucuugggucucccaaacccugcccugcucuccuggccuccucugccaagaccccgccuucccaagccaccugccccaggcaccuuggauuucugcccagucccuggcaaggcaaggaaaaacagggcucucaaggaaagcaaauuaaaccauccaucacucugacugggaauuaauuagcaauaauugcacaaugggaaacacggcugacagacagacugagaaacagaggaggaggaggggcacaugagaagacagcuaaggcguggugaaggugggcgacccaagccaccaagccgacagccagaccagggucugcuggggacagacccugacagaguacauggccaaaacuaugucagguucuuacagcuuggcagguucccgcagcugaauaaauggcaaugaccaaaaccacacaugauccagugaucaacagacuccagacacgcgaauggccaaaaacggacaugaagacauaacuugguaaaauauuuaaacacaaagcaaaaggcugcuagaagugaucagcagaaaaaugggcugaaguguguuaaaagcacccggaccagugacugaagauguggucagcgaucaauaaguguuacugguuagcugaauuccaaagaagacaaguuauuuuccggggaguaaaaaaugaagcuuuuccugauuucuccuccacaacugaaaagcagccuacauucccccauguaaagauacaaccccagauuugacacagggguacacgugccuauuuguuacauggguauauuacauaauggggggggacugagcuugccucagacaagagaccagcuccacagacuccacagggaaaggcucagguggagaaauuuugcauccaguggacaaguuacucauuuguagaacaacugggagaucuccagaaaccugcaaauuucugaaauuuuaccagaugagcaccuuuucugcaaacaaugcuuaagaguuuguccuaagucacuugggcuugaauuagagagaguucuucauauggggaaguuaugacaagaacuaacagcgaucacucaaauuaaacauucagguuacagagguuaggaaauaaaaacauuaaccacuaaugguuuaauuucaacuauauuggauuuagucaauaaagcauaggggaaaaaagccuaaaaucuuaaaaauuauuuuuauucccaaagggaagagaaaguguuaauuagcuaaguauaaaaauaggauuaagaaucuuaauaauaauguauuuuuuaaaguaacugaugaagugaaaacuaggaauuguacauuccaaaucauaauccaugauauaaacagggcagaccaccaaaagguaaaauguaaaagagaugaagaaagcauaaaaaaagggaagaauaaaacacaacagucagaccgaauaaagcaaucauaauaaaaaagguggcccgaauucccuuguauaaagacaaagucccagaucugauuaaacaagguccaucagaagcgcaccuaaaccaaagcagcacaaaggacuuaugaagaaaagccuguguaaagauucaguaaccaacugugauugaacagcauaagguacaauaucacuaucaaguuagaauuuaaaugagaaaguacugcccaagaaagguaggaauauaaugauaaaaggcauaaaguuauaacaaagacgugccauuauuaaaucuucauguacugacacagaauauagcuauggggacuucgaugcuuacagccaucuuauguagccauuuugcucuaugucaagugccauaaacugcucagauucuuuaacccaguaauuccccaacucugauaaauuauccucaagaaauagugcaaaauauggacaacuauguuugccacaagguauuaacuauguaauacucauaauagcaaaaacuuggaaauaaucuaauauaccuaacaaaagaggaaaaauaaguacacuaaaauauuuuaaaugaugcuuuugaaaaguuuuaguaacauagggaaaauguuaaaaaauuagguaaaagagcaggaaauagauuuuugaacacagauuauaaauuuaagaaauacacauaaaaaaaggcuaaaauguuaccagugguuagggauagugggaauuagaagcgauuugaauuuucuuuauacuuuacucccuaaauuuugcauaucaacuacguaccauuauauaacagaaguacuguaacaaaagucuauaugcgucaaacaacauggcuaaaaauuagaaaggaaaaccauuagaaacacaaagauuuaaugacaaaacgcaauuuaguaugagaaauuagcuaaccacugucucacagaacagauacauuagauaauaauaaauaaggacgcaaagggcacuguuagaaagaauagucaaagucucugaaaugggcaaaaaugacucuuggguuucuuguuuuucuaaguuuacuauuuuuucuaguuuaucuaagucuuuccuuauucaggagcuacuuuguuuuguuuuccaacauuuauuuauuugaaagauggauuugagaacuuguuacaggagggaagccaaggacagaaaguuggguuuuauguuuuauuauuuuuauuucagauucagaggguacuuaugccuguuuguuacauggguaugucaugguggggguugcguuucuaguguacccgucacccacauauugaacauuguaccuacgagguaauguuucaacccuaaccccacuccuacccucccuggagcaacuuuuaaaacucuguggauauagaccauuuauaauaauucaaagaguucucuucuggcuggccaugguggcuuaugccuguaaucccagcacuuggacaagccaagguggggagaugauugcuucagcccaggaguuugagacuagucuaagcaaaauagggaaacccugucucuaccaaaaaaaaaaaaaaaaaaaauuugccgugagugguggcacccaccuguguucccagcuacuuggaaggcuaaagugggaagaucacuugggucugggagguugaggcugcaaugaguaaugacugugccacuguacuccagccugggcaacacaacaagaccccgucuuuaucucuuauacagaaaugcacaggaaguuugucuggcacucuccacagggcaauugguuguugcccugggauagugaccauucaugcauuuauucaccaacugauuucggaauugcuauuuaccuauguauuagugcacaaguucuuucaauucuccuuugagccaguuccaguaucuuacugauucucauauugaguuagagaaaaucuuugggcugggcgcaguggcucaugccuguacucccagcacuuugggagacugaggcggguggaacaccugacgucaggaguucaagaccagccuggccaacagggugaaaacccgucucuacuagaaacacaaaaauuagccgggcgugguggugcacgccuguaaucccagcuacucgggaggcugagguggaagaaucgcuuuaacccaggaagcagagguugcacugagcugagaucacuccauuguacucuggccugggcaacgaaagagaaacuccguaucaaaaaagaaaaaaagaaacaagaaaaaauauuugauguguauuuuaauaccugcagaagagacauaauuuuaccuuuaaaaaaguaccucuuagcagcacguauuucauaacgaagaaaggauagcuguuuucagaucugcuaauucugcaagcacaauccacaucgucuuaagcauucaugagguaguuacaaaaacaaacacaaauguaauggaaaaaucucaguacauuaaaaaaauagaguagaaaccuuucuggucauucaauuuuaucuuaauacaaugaacugaaaaauaaaugagaacauaacaggcugcucaaauaauagguugaaaauacuacacauuaacaucugugauugcuaugggaacgccaacaguaauuuuuuuuuuuuuuucugagauggagacucacucuuguugcccaggcuggagugcaguggggcagucucggcucacugcaaccuccaccucccggguucaagucauucuccugccucacucucccaaguagcugggauuacacacaacugccaccacgcccagcuaauuuuuguauuuuuaguagagacgggguuucaccauguuggccaggcuugucuugaauuccugaccuugugaucuaucugccucggccucccaaagugcugggauuacaggugugagccaccgcacccagcaguaaccuuuuuuuuuuuuuuuuuuuuuuuuuuuuuuuuugagacagagauuugcucuuguuguccaggcuggagugcaauggcgcagucucuacucacugcaaccuccaccucccggguucaagugauucuccugccucagccucccaaguagcugggauuacaggcgccugccaccacgcucggcuaauuuuuguauuuuuaguacagacaggguuucaccauguuggccacgcuggucucaaacuccugaccucaggugaucugcccgccccggccucccaaaguacugggauaacaggcgugagccacugcacccagcccccaucaaaaguaaauuuuaaaaaugucaacauuaucaaaaaaaccauuccauuucacauaugaaaaagaacagcaaaaacaacaaaccuaaaguuauaagagggaggaaauaauaaugauaggagcuauaaauaaauaagaaaacaugucaugaaauuuaaauaaaugugccaggagcuuguuauuugaaacagcuaauuaaaacaggcaaaacugucaaauacaagguuuuaaaauguagaaaaaugggagaaacuuaagaugugagcuacagcagcacauuuuauuuuuuuauuuuugagagacaggguuucucuugucacccagguuggguugcagcggcaugcugugccucacugcagccucgacuucccaggcuccagagauccucucaccucagccucccaagaaggugggaacuacagacacaucccaccaugcucggcuaauuuuguuuuguuuuguuuuugguagaaacggggucccacuauguugcccaggguggucuugaacuucugggcucaagcgauccucccgccucggccucccaaagugcuggaauuacaggcgugagccaccgugagcggcagcagaucuuuuauugaacuuaaugugcauuaagugccugcgugugucaaacaauguuuuagauuuuuaaaaauaaucauaaaacauuccaugcaugacugauuguaaaaacgacuaugcccagggcaguuuuguuuaaaaauauuccgccgggcgcgguggcucacgccuguaaucccagcacuuugggaggccgaggaggacagaucacgaggucaggagauggagaccauccuggcuaacacgaugaaaccccgucucuacuaaaaauacaaaaaauuagccaggcguaguagcgggcgccuguagucccagcuacucgggaggcugaagcaggagaauggcgugaacccgggaggcggagcuggcagugagcugggacugugccacugcacuccagccuggaugacagagcgagacuccgucaaaaaaaaaaaaaaaaaaaccaccauauauauauauguauuuuacaauggacaagugaaaaaguugacuaaaaguagagaugaccuuaaaauaacuaugaaaaucauccccuccccuguuuaacacugagacccaagcguuauggauaaauucuauuuuuacguagaaaaaugaugcuauguuagagaagcugauucauacacagaacacauucaaaaccacuucacaaaaucauucccaagcuaucauccgaucuccacucccaauggagacagagauaaaauucuuggcucaugacaaggacucaguaaugugauaaaagaauaauauaccaauuaggguuuaucacagggagcgaaggauuguucaauuugagacaaucuaaaaauagcauccaccccaucaauagcuuaggggaaaaaaaucauaugaucauuuaaaaauaccaaaaggcauuugaaaaaauucaccaccacccuccuaagacaaaauggaaaaaagggaaugcaaaaauauuucuccaacaugcugacaaggauucuaaaauaagagcugguauuaauaugauaaucagcagagaaguacuagagaugcacucgaaaaucaggagccaaacaagcaugccuggccgugccccaccacgacguuuuagaacaugagagaaaugccacaggauagacagggaagcaagaggggcacguguuagaaugcagagacaacggcacucuuaauaacugaugcugcggcuugacgaaagcaaacagcacauacaagaaaagcauucaaaacaacaaccgacaagcugcauuucuacaaacaaaaaccacuuaggaaauacgcaagcaaaagaaaugccaaucacaucacaccuguaaucccagcacuuugggaggccgaggugggcggaucaccucaagucaggacuuugagaccagccuggccaacauggugaaaccccgucucuacuaaaacuacaaaaauuacccaggagugguggugggcgccuguagucccagcuacucgggaggcugaggcaggagaaucacucaaacccaggaggcagagguugcagugaggcgacauuguaucacugcacuccagccuggacaagagugagacucugucucaaaaaaaaagaaaaagaaaaagaaaaagaaaacaaaaaaaaaggaaaugccaaucacggaugcaacaaccuaucaucaccacgacugccacaaaaaaaccaccaaagaccaccccugacaucauacgcacaugacuuccaagagcaagaucucuaaaaccggucuaacuuguaucaguagacacugauggagaacucucuuauguuccugaaaagucugacugaagaccaagacgcaaccauggauguuacgaaugccucacagcauggcuaggacgugggccccuucuaaggugagaaaaccgaggcucaaggaggugguuuccauuucccagggucaucugugagcacauggugaccucacacagccuguuuggagcagagcuggcauugccacccuugucugggugacucggaagccugggaucuucccaugcuaccuucuaauccaccgccuauaccuugauacuuggggauaucaaacgauauucuacaaagauuaauacuugaagggagcaggucuuacaugguauuaaaauauacucuaaaacagcaagacucaaaacagcaugauacugggacagaaauggaaauguggaaucguggaggcccagaaugaggcccaacuauuguuagauauauggcaaaacagagacugucuaauacauggcggucacuaacugagaagcaugggaaaauugcacagaauggguuuuaauaucuggcugagcguacaguaggagcguauugauacaaaccagcaggugccuuugcuccgagcuugguccugcaugcucaauagcucagaggccuuacuuggcucaaucucugaaggacuucguaauucauaagguggaugucuccauuucacagauggaaaaacugaggcucagaaagggaaauaaccagcucagaucccucagccaggucuggcuggcuuuaucagcuaaguuccccggccucaaccggcagacaaggcugggcuuuucuggacucccaaagcucagggugcugguggcugcugccucgagcaccugugggucccucacccuugcaugcucccaguucccucaccgugggccuggaccagugugcccuauggcugcucucugcuccuggaugacugacucuccaguugccuccugggugugccuggagucucaugcuacacucccaugccuauugccaggucccugacucaguuuccccacucaucccagccagcagcuauggcugucuggcugugacucuguugaguucaccuuugugagccucuguuuccauagcugugagauaguggaggugacagcaaccacccauaggguugcugugaggauuaaaccaggugcugagcaucgagaaccugauaugggacaggguucagaugcaugaaccaccaccccccaccacgccccaccccgcccccucuuccagucuuguaagcccacccugaaggguacgacaccugucuggggaccccuuaagggcacagggugauugcggccacccuuucuaaggccccagcccaggaucaggccugauuccgggaaaaugccuccugcucccaaccagagccauucaccaaaccauucuauucccuucccaguucaucucagcugcuucaaagaggcccaggcaaagcccaccccugagauaggccucccuggcggccugucuucaaaaauccaggcauccuuaggcaaggguggaacugaagcagcacuggagcccuggaccccgggggccaccuacacccacugaccuucuugguauaacccauggccuucaggacagagugauucaaggucuccagggaggccaggacauccucauagucacccaugugguccacaaaguaaucuggggaaggaaaggcaaaggucaggggucacagguccugccccucccacucagcacuccugcaccucccaccugcgcuaccuccagccuccccugccucaggcccuucucauccagccccaucccagcauccccaucuuggucccagcauagccaggcaccuaccacacagcuccuugguguccacauggcugcagagacagacagaggcagagacagacagagacagagaggggguuagcaggccugacccugcacagccugcgaaacacacauccugccugcucuuugcagccugugugcuggccccacaagcuccgccuuacagaagagggugcagcagguaggugacacccccgccccugaaggcccacgucugucugaucccccacaccacccacccuuguucuguuuucucggagucugcugaccccaucaugaauaaaugacaccaaggggagggccaagcugggggccaggaaagggguaaagggacagagaguggggacccauuacugugacgggcugucagcaaagcucucaucugacccacugacccacccccagucgacccugccugcuggguccuggaguuccugggguuguggcagagcccuuccuguucuggucgcagccccugggucccauauccccauuccuacagccuggagaaggguccuguccuuucuugggggagcaggcugagcaugagccuaucccccauggcagugaaggagcacagaccggccccaagauaaggggugcagugcugggaacuauggugguucugcagcuuaggagcagauuugauaagcugaggcccucugggacuggcuagagauggucuggauaaggagcuacugccaagucaaugugcaagggacccaauacggugguggcccuuucugggccuaggucccucaucgugcucaguggagcccaggcucagcaaagcacaucuggacagaaggcuucuguggcccagugaaucugcacucgggggcucugcaugcucugucaggaggugccuccaaccuccaucucauauucagaguucuggcaaguccugcagaaagcgacccugucauucugcuuuaauucauguuucacaaaacuuuuugaugguuuguacacuguuuugggcacaaagucuauuuagcaucccaaggggcuaauguucguggcucacaccuuagguaauguuggggagauuaauccuaaaagucuuuauagagcuuugaccuuccauaaccgcgaguccucccugcacccccacccacccacacguacucucacaguucgacucucaaaccagugccuccuccucccuccgccuccacccccuccucuaccccgcugguccuaacacaaaaggcccugaaagagaaggucuaaaucaaugggcaccugccuggccccuucaaagcaccccaggaagcugcaguaacagcucagaaaucuccaucuggccccagacaguucuccauucugcagucuggagccugaagccauuucuuuaaaguggccuuucccagaggaugguaucugcuccacuuaccauaucccgguccccagccagugccccccaggacucucucagccgcagccucugguccaaaccaccacuguacucuaccccuugcacacugguuuggugguagcuccuuguccagaccaucucuagucagucucagagaaccuccgcuuaccaaaugugcccuaagcagcccuccagaagcuuggguccucaucacgcgaguaggccugagaaaggagaccagguggggcucugaucccuccugaaggugggguugaggagagggcucagaccucauccugucuggggaaucccaagaaaagggcaagauuggaggugaggcugggaagggucaaggguaagucugaguagaaucugcauuuuccacuugauuuagagauggguggagacagaguuuuuggcugauucugagaugcaggucaggguuaugacuggguuggagaaaagguuuaauaagcuauaaugauagacguaguguugaguuaggauucguguuugguuuaacacaggagucaguguuaggaugacguucaaccucacaguuaauguugggacugggaggacacacaggcauugggguuggggugagaacuggcugcuggcugaagauggcagaaggaugaagucauugccaccuucccauuuucauaaucccauguccacugugcaaaaccaggagucucuccuuaguuggccaugugcacucagaagacacacuugcgauaguagccaaugcaauaugaaucugcacacgccccauucaccccaggcagugaagagcugacuucuggauuagcaaauuuggggauuuucaguucuccugccccuuacaggggacuaggaacggacacuagaugaaaagaugccuccaccacagcccacacacacccccacucugccagccaggacugaagcucacuugguguugucagagucaaucgugugaaagagauccuccaguucuuucucauuaaggacgccaucugcaaagaagagcuggaauuccuccaaggacagcuucccaucaucugcaaggaaggaagcagagaaaggagcuggugucugcagagauaaggcugguggggcuagugcaugcacggcccccaaauccagucaauggccugacugacagaacaacugcagcucagauaaucccuacccucccagcuaauccccaaacuaaaagacaaauuccauuuuagauaaucccuacccacccagcuaauucccacacuaaccaguaaacuccaguacacagagaaucaugccucauccagcuaauucccagaccaaugccuguuuacagauaauccucaaacuaacaauaaugcaauagcuagcuuucuugggcucaccaugcacucaacauuuuccaugcguucaacaaauauagaguaucugcccccugccagugaauuuucucucaauuuacauggccaccuggaggcaggugcuauuuaagauaacccacugugagcaacuugucccaugucacaccaucgguaugaaguggauccaaaaaccagcagcuggaugagccaccacuccauagcuuccaaacgccaaguggucucugcaugcucccaaccccaaucccagccccuaagcccugacucucucagcacuguucuuagaguacagaagaacccuuucuucuccgccccaucuauguggcaaacuucagguccuucccugaggcagcaugagauggcugccaauggccggcaugagguucucaguuaccuccucucccaggccacagaugcagccaucuagaugccaagccaugcaggaaggaggugccaggccuggaggugccaacgcucuggccagaggcugugcuucugagguggagcuccacagaggggccuccacagcuccucuguggaggggcucuguggagggaugggugggacacaugccaccagucccacccaucgccucaccuuuucccuucacuugcaguugcucuggggacacuuuuggcccuaccaggaaggucuuguggguuuggaucagauugggccaccaggggagguggcuuaagaacaucagggacucugggaggcggucccuaagcuuccacccucagcuccuuccaccugaacagaccugcugagcaaaugccagcaagcucaucccccaccugcccugcagccaccuccccccuccucaaggaucuguuccuccuuaagagaaacuaugugaguggcauggaggucagagacaagagggagcccaugacaguuccuggcccccagccucucugcauaaaccccuggcauuacuuccagaggaucugcauucaaagcugggugcuugggacaagggcccugagaguccacauggcaccuuccuauggauuagaaaaagacucuccuuucucugccgagaggaugagaccagugucagugcacauguguugaaagcggauugcagccuggauuugaaacccuccauuuccucgggugggugcccuugugcagcgcacaaccugccuaacccgacauggcagacguacuuggguugagaaugagucauucuuaaacuuuaaaggcuccagugcuucugucugugcucccagcagcucugcuggagcucaacacagggugagagcauaagcucaggagaggggggguccucagaucuugccaagguuucaugccaccacuuuucucuuuaaccccauagagcauaaaguaucagagaccgguaaagaauaugaacgugugggcacggggggcuagggccaauaucccaagaugcccccaucgcagcucagauuucaagguuacagugggaagaauuucugucuuucaaaggaaaggccaaaaaaaccccaauccaaccacacaugcacaaaccaaagacccaaaaccuaacaacuaaaaguccgcaaagucagccacgagauaagugaaaucgaaguuguugcuuucuguguucugugacagaggaugccuuccgagugucuucggcaagccugaagauaaaacccaggaaucccaguguggagucacaccacacguggaguaccuuccacggacucacuccuuuagucuucuuaacacucacgacacagguaguacuaccacuuccauguuagagagggguaaacugaggcacagagcccuuaggguacuugccuagguccuacagcugaagcuugaacccaggccaucuggcucccaaguccaggcucucaaccuaauccagggguaggaucuuguggcgacaucgccaccuacccagcagggggugggugcuggcucaggcacccccacuuugggugaggggcagucaccaugggcaugacagggguugugagccccaaucccagccucccucuggcuggcucaucuccccacgugccuguccagguaccuugggcccccucugcacacagggagagcaggcagccagagaccagcaaggugcccccucggcacacagggagagcaggcagacagaggccagcaaggugcccccucacuaagcuuucggcugacauuuauccugaacgccugaucacggcccuaaugaauucacuaaugaggaaaaaacaugcccuacguaggcccccaguccaauuagacaggccaagcgggcccgcgcuggcacuuuugccagagaccccaagcgggccguuugcaggugucuuugcuaauuagcacaaacucacucucugucuccaugaccuuucaaaugccaagagccugucagccugucagcguccaugucccugaagggaaaugcugucugccacucagcccucugccacccccugaguuuaugucccaggcugccagucaggccccucaugcuaaccuucccauagggacugggcauccgguauccagcucagccaaacaagucucugucacaggagccacccugacagggcagcccugagccuuuguuccuguaaucucuaaguccuaagggcagccugggggguccuuugaguuugcaccccaucucccgcuccccugaggcaucccauccauccuuccuguggacacgugaggcagggcuagcgucaguguugagcaguccugugugugcuugugggccuaucggccuccacaucugcacccccugcacaccuguucucaucccugcacaccuguucccauccccgcacccacaccucccugcacaccugcucucaucccugcacaccuguucccauccccgcacccacgccucccugcacaccgguucacauucccgcaccaacaccucccugcacaccuguucccauccccgcaccaacaccucccugcacaccuguucccaucccugcacccacaccucccugcacaccugcucucaucccugcacaccucccugcacaccugcucucaucccugcacaccuguucucaucccugcacccacaccucccugcacaccugcucucaucccugcacaccucccugcacaccugcucucaucccugcacaccgguucacauucccgcacccacaccucccugcacaccuguucccaucccugcacccacaccucccugcacaccuguucccauccccgcacccacgccucccugcacaccugcucucaucccugcacccacaccucccugcacaccugcucucauucuuggauccacaccuccuugacaccuauucucaccccuacacucauuccucuuuccccagccauucuauucccacaccacuccccuaucuauacccacaccaagucccauccccacuccuacaagcuuuuaagcugcuguguugaaucagaaccugccugcaccgcugccccccgaccaugugaagaauaucacgugccaucuccgagccuuguuuucgucaucuggaaggaggguggggguugauacuucuugucucaggaggaucacaaugaagauuaaaggaaaaagcacauucaaguccuggugcauaacagacguucagugacugcuggcagccucccccagaccgaauucccugcugagcacagaggaaucaaaccccucuggacaagccacaccugcggacucccauuuccgaggcauuugaggcagagcagcggggacuuauugauaucuucaaugagcgaagccaggagagcaacuaucuauccucagacagcccucugaggugggugcuguaauuauucccauuuacagauaaggaaacugagacugcagaauuuggugacuugccugaggccagagccgguacgcggcugagccaggacuugagccuaggcagucaggcugggggaccugggaagcucuugcuggaacccgcaucucacacccacauucacccuggugacagccccuaacggucacauagugguggcugguaagauguaagccccaaggagaaggaacaggcucggccuuugaggaggcugcaguaaggaaacugagagucccacagcugugcucaggggguggacacauggccucugauggggggagccugcagcaaggacagaaccccaucugugcccgagggggccaggcaccaccugcccaaguguauacacugcaguggcuccugcagagcugcacacucaggaagccacacacgcacacuaacugcacacacacucgggaugcacagccauggcuagaggcccacgcuggacacacgcauucccaacagccucacgcugcugagucaccgagauacgcacagccacgcucucaccaacaaacacguccaccaagucuacagacauuuaccgaggaccuacugugugcuggguaucaggcccgggacaagggacaaacccaaaucccuaccucucaaccugcuggaggagccaggccagcacacaggcaaugacgcugagggcuccggcgaccccaucucagggacagcccccugauuuccccuccucaucuccaaggcuuuucaggccaugaugcuacggcuguuuuuccagagccacuucaucucccuacgucccucuuauuccuccucugcuccguauggaaucacugcugaugguccuucuuccccagaggccugggaguggucacugucaccccccagggaugcaggaggccagggugggagacucguuggaacugauuccagcccaggccugugcaccugcccucccaccaugcccaaggccuccaacuccacccugcaaccgcccugggugggagccgucaacaggaacucccagggaugaggcgggugcuggagacccaggccagagcugccacccucaacugcagcuugugcaggagaggaaccggggccagaggcguuggggaccaagggcccuggggcaggucacagggucucuguugcgugcucuuccccugccacaggcuugguacuugaugugcauuuucucaaugaaugaacauaccgggagcacgcgauucucuuuaaaaacauuugucacccacaccgccucucuggcuuuuccccaaaacccagggaaggaggcagggcaaguguuauugccccacuuuacccacgggaaaaccaaggcccagagagggaaucugucuugguucaaguccacggugaguugcguugcaacuguaauaaugauucugguauuuuuaagaaggugcuuuuugucagccgaggcucagcugggccgccuaaacgugcuuauucucucaaggccugggcuccuucugcaagugaagccccuccaaggagucgggagaaguggagcgcuaugaauuccguggccacaacaaggcgcugcucacauuuuuaaagaggcugagagagaaagggaaaagggccccggucuucaggagagccuccguuuccuucaugcagcugggcaacccuggggcaaauugcuuaaccucucugggcugcuauggugucaacagaggcaagagcacugacugcucagguugcuacgaugaagaacugcaccaaggcuugugaagggccuagcgugaggcuggcggcuuccuuucaaggaggguuucugggccccagcccgggcuccucugguccagcccagcuaggaaaaggccuaaaguacacccagcccuuaccacggccagucauuguucuuggcaucacagacaagacucacugagcccuugaguggagcugucccuacuaaguaggcccuacuaggauucccguuuuacagacagggaggucaaggcacagagcagcagcaggauuuggccuucuaacuucagaccccugcacuccaaaccuuuagguucaagguugcgcuugucuccuaucccugaucccuuccccaugaagcacgaggacagaaggaguggggcggccgucggccuggaagggaaacucaccauuuuuguccgcacggcggaaaaucugcagaaaagagaggcggagucagcccugggccagggagaggcaagcgcuuccugcagccucugaccggauacugggauccuucucuucucccaggagcagcuuaggguccugggaagcugagccccccuucccucucccccuccccgggcugggauccagggggaacugaugagggauguugcagacagaggcccuccccucacccacguggaagcggcugccaguaccaccagccugcucccagccacgcugacacacacacgcaggcccacggccaucccugcagguguagguccacagucaucaguccacguggcuucacccaccgccaaacgcucagcugcacacaaccacacuccgaaucagugucccagggagcgccacaaccuuuaccacugcaguccuuccaaaaccccugguguguuuccagggagguugggcaaaguccgacagagguguuugcaaggccuggugacaaugccagccacgggcaggacugcguuaauuuuggggugcaggaggagaaacaggacgccaagaguucagaaaagcagccgcagacgaaguuccggcugcauuaggcagggauggguggagggcagcuccaaggcuggccugaaccuacaagaccaggugccuccucguucugccuuuccagugacaucugaauccgugggacagagcugcuccccuuuccucaaggucuggcuggcaggugcugcuugccaggcugaggcucgaaggcagcuuuccgccccuuccaacaccaucgccuggagagcuuucaaaaccuccucagcccgggccacaccccagggugacugaaucagcugcugugaggcccacucugauuucagcauuuuuaaagccucccaggcccaauguugacaccugugcgcuaagaccuugcuauucacaggagcuguuuggguccugcaggagcuuguuugcaaugcaggaugucccaccuacucugcacuguaguggagucagaccuuucacuguaaccaguucccacggggacugauucaccagcacuauuuuuuuuuuuuuugagauggggucucgcucugucacccaggcuggagugcaguggcgcgaucuuggcucacugcaacuucugccucccggguucaagcaauucuccuguaucagccuuccgaguagcugggacuacagacgcccgccaucacaacuggcuaauuuuuguauuuuuuaguagagacgagguuucaccuuguuggucaagcuggucucgaaccccugaccucaggugauccacccgccucggccucccaaagugcugggauuacaggcgugagccacggcgcccugcccaccagcacuuuaaagccugagaaggaucccagcuucugcgguggcccccaccccaaucucaguggcuuguuuuaacaaggaggguacugagacccagggagaggcagcaacauguacacauuucccgacaccagggagggcugcuggggccaggucagccauggaggaggaggagguaauacucacucugacccuuccacccucuguccucgccuugggguaaaggacagaugcccucgccccccaucccuccaggcaacgagaaagggggcacccuuggucauuucuaggcaccugggcggugagacugaagcacagcuaugggagggccucucaaacaucaccccuccuccuggcugaaccucagauccccaagcccuccucaaagauccagccugggcaccccgcagccccguuccugacugggcaaggcuccucaaaacuggggucccuaucugggugucccagaucccccuugaggccaggcaccagguaggugccggcucugggcaggaaugcugaacacaugagugacauggcagggcugacaccugguaaugucagccagcuccaggagucugcaugagcaccucccgccccaccccccgcucaucacuccuuuuggcaggugaggagauggaaccucagagcccccacccugacugggcagggcuuccaugcagggcagcuuggggcugcagggcucugcccaggacuuucagugggagcucugcggggguccugaggaggggaugguuuggcugcaugggugugucucuggcugugugugcgugcguaagcgagugcgugagugugugaaugugugccugcgaguguggcacucuagagcucccccugcucuggccggcccucccagcccagaccccggccaaggguuccaggagcagggaagaggagagaggaagggagggaaucccccgacucacagggauccgcgauacacgcgugugcacauucacacacacccaccacucucccagaaauccaccacacaggcagaggcagcccccagccccaccccagcaggacccucgcugaaacacgcagucaacauccccagaagccuccuccaccuccuccuagcacucucugcugggagaaguccuccuccuccgagccgcccccugaagauuccucccucccggguggggcgggugggagggugaggugggcuucccagagaugggugauuugggucccaggggaguuaggaggggugaggggugagucugguccaugaagaggacccagcucucuguaggguagagggguguggggaagggaacagaggacuuggaauggaagggggcgggguggggaagaccagagggguaccagcucagggcugaugggcgauggcucuggcucaauggaaaggagacgagaagacagaagguggggagggggcuucacuuuuaaaguggcaguagcuggggcaaagggucuuugagcgugagaugaacgggggcucagggucuagggcgaagagaggugggcuagagguagggguuguuaggggucucagaaaaguaucgcuccggacaggauccgggauggagaggaggaggcggcuggacgcggcgaggggcuccggucccgcgggguaaaggguggggguuuggcuuggacaaaacuagggggacaguggccggguccgggggcucacggcuccccacugugggcaggcagggacuccgagaagcgccgguggaggggcggaggaggggggucucccgguccagggagaggacugggcuggagaccggccuggacguggcggggcugggggcucccgcuccggcacgcggaggggccgggggucuccugcccggguagggagggccucgcgggucgcggcgucgggguccgcccgaggggcggagggggcuccgggucccagcggaggccacggcgggggucccggccggcgcguacucacguccaggaugacggcggugcccccgcgcggcgaggcugggccgggguccgcgggggcggcgggggccagcgacucccggggcucgcccauccuggcgcccacccagcgcagcagcccgcccagcgcccggcccugcugcggcggcucccggagcagccugugcgcgccggcccugcacaggcgcgccgcccgcucgcacaucgcgccgcgcccgccgccgccgcccggaagcccgccgacccccgcccagcugcggcccgcccccgcgcgacccccuccccgcgcugcccgcgccgccccgcccucucucccgcugcccccgcggccgcggacaccgcggggacuggccggcgccggggggcgggccggccggaccccgagccacgugcccgcuccccgccgcccccacccccgccggccgggcgcggggccugaggacugcccgccggggcgaggggcgcgggcgcagccacagagggggcuacccggaggggagggguauguggggccugggggcggggcggcgccccuggggccugcuccccaa

SEQ ID NO: 15836 - RNA, 63139 nt, Homo sapiens
cgucaucaaagagaaaugggacaaguggaaagaguccguuacacaguaucuuuaagcuucagacggguaauacauauuuauugaaaauuuucuucaccgacaauggugaaaucaagaccucaaauuacaaaacaugguggcaggugauacuuacaaaaauaaagcgaaggucuauguuuuacagauuugugcauguuuccuucaaaucucagucuguacugucauuaaaaagaucauggaaucuauguuguuccucaugauggaauaguaaaaaaacugcauuccacugacaaaaaaaauagcuuugcuuccaaauagcacaagucuuuaaagugacuuuucccaacaauaaauauagaaaauagccuuuaacaagcgucuuuuagcuuggucaggguuguaucauuuguuuggaaaguacauccuuccccugcagucagaagaccccagacagccuuuccaguucucccgagucuuuggugcgcacagcugccggcgggaagucucacuggcggcagagccacuaagucccuccugacgggauccacaggaaucuucucgauguaccaggagccucugcccaucacaggagggcaggcccauguagaacagacucuaacaaaccugcagcuggaaacuggaucccuuuuaaaccagccgccaccacagcucggcucacccaccagcgccguccgugaaggcucucucuggcccucacggucagccaggcugccggucacaccgaaggggucuuuggcgggugaaccugcugcaugagcugcgggcgcuucacccugggcuuccuccgcuucggccugcucuuggccuuguugauuuguaccacaaagaaggccaggaccaccauggcucccaggaaggcaaagacaggaauggucuggcccaccuccugguuguagcggccaggcaugaucccuguaagaggacagccgguugaacaggcaggaacgccacagagcuaccaugacggccuuuuucuaugacggcuggauucaucagaaacuaaaugcgagcuaauuucacuagcugggcuugcagggcauacaucauuuuuaagccuuagcuaaaguaacccaggcuauuaauaaagaguggaugagagcaaagagcagccacuuccugugggguggaggcucgguggaucucugcugcccuuccucccugggauccccgcagacggaugaucaggcccagcuaugcuucugucacaaccuaccgaagggaggcccagaggcgcucuguguuucucuaaacacaagggaagaugggcacgucucuauccaggggagaaggaggggccugugguuccagcugagugggaggaggagaaagggggcguggcggaagaagcaccgcuggcagugccccgccucugggaaagcccuucauggaggggacguguggcugaaagccaggagaggccaucagaggacccugguucagaaugucaauacgacugggcaaggccaagggcucuggaauuuaccuucagcgcaccccgugaccuaugcgcaaggcccucaggacccuggcaccaccacgugguguccagggcuggacugcacagacaggggugccccuuccugaucccauuucuggacaauuccuggaacccagagaaacuccucuugguagcuauaaacucuuuggaagaguacaggggacucuagagcaaaagaacugcccaggcucggcuggaaaggccugguaccaauugccuuggguaguggagaagaaccugcccuaggcagucuauguagccagucaggaucccuggagagacagacaggaugagaccaccuaagggacacaccccagcucagucaagucccucccaggggggcagggcagagaacugaaggggccuucugggcugagggcugggagccagggcggcugcugccauuggcugggacccaaaccagcagacaggcauccuguaagggacguuaauagguggcuggcagaacuuucauaaagagcgugcaaguuacuuugaacauguuuaaguagaucacccagccguuguaaaauaaauucaaaugugaaaaucuagguagcauuuucuaagggaaacaacaaucucuuaaucugucaggccugcccuugcucaugcugguuugugccacaaaagaagccaagagccaaggccaccacagcucccaggaaggcagagacagggagagucuggcccgccuccuggggagggagggagacuccuuugaacaaaauacaggaugacugagcacaaucacaaagcagccgagaacucaccuccaggaaugucccaggcgccgcucucuccaggggacaagggccucacuugagggcgauucgaucgaaaguuggguaacaccaccuuguccaggucaauggagaguagcuucugauguuuccaaagguuacuucaggaaaauggauuaaaacaaaacaaaaauaagccauuguacuagucuagguacuagucuaggaaguucaacugaaacucaagacagagcaagugaucuacggggagaugugaaaugccauuugcguccacggccaccuaaaugccacugacagcaacuaugguggccguuuccacgucccgagggagaaagaucaaaaucaagucccuguucaugagauucuacugaguuuacaauaugaccagcaggagccuguuuuugcauaaagcuaaacaugaccaagcgccucgggaggacacuccaagcgaggcccuggaaggagccugucagggggaggagcugaagccugcugaguggaccugagccuggggcuaucgagguccucucccuaaggccuggagcagucggaggcaauggugauuccagaaccacugcauauaaggaagugggcaaacuggugccgggaaccagacagcaucuuugucucugaagaaaccacugucuccagggagaauacgaaacauacaaggaaccaacagugggagagagucugagcagcaaaacgugggguccccaucugccuugccugcaggcgggggacgaucaaaugaacgugugcgauuccugcacucuguggugcacaguaucauuauuaacucugggaucugaaaaacucguucaggccaauacaacuuagacccgaagaagacagagagguugauacgcuggcaacagcagcacagagcuugggaggacaccggagcuagagcgaagagcgcgaugggaaaaacacuacucuggcuuaagugagggggaagaauacaguaaguuugcaaauuaaaauuucucuauuuuucuguuauuuauucauuuggaaacugucagccugucucuuucacuuugggcaagugaaagcaaagacguccaguccuaucagcaauuaggcugaaagucaacgccaagcuggcgggcaagggcuggucugaguagagguucccuaggcaggcaagagagagacucccacucgauacucccagcucggcaacugccugaaugccaaugagcacucauuauaacccgcccuauuuuauaggauuuaauuuuacacuucaggcuuaaucagucugaaaguuaaacugacaguguuaaguuacggaaucaaugacauuuaggcuuuaugacuuuguagcugaauaucuaugggcuauauuuccauucuaacagugauauccuguuccagaaucucauucuuuggugauggcacuuucuaguggagcagucaugguaacaguccacacccauuaccaugugggugcuuuacagcauacugacggaaggacugaggagccaccggagcaggaguuccucucagggaggacgcugacacuuccacagcugcccuagguaugggcaccugaugccaacgaagaagcccaaagcgccucuccacuucacagauggaagccugcccccagcacugggcugacagcaucuggagcugucuccuggucucaaaucucuuuuggagacucagaauaugcgucgaucuaggucucuggggaccgagaauaauuuucaacaagauaugaaaagcaagauaaauguaaaacccagcagcguacugagaagaaggaauuacugagugauugugaaaaucaaauuccaggagcuguccauuaucaacaugcuggaugggccgguucaguaugugauggauuauuugaugugaacagguagauagccaaggauagaaaggauauuguuaucugcuucaaguccugaacaacacuguggagaauaauuggguuucuggaaauucagcuaacacuguucacugaguaugaauugcugaccauggcuggaauauaaaugcugguuugaaugcuaggcuaauagaagguuauaaauaaauaagaugcaaaaauggaaacuuaucagaaauguuuaaaugaugagaugugaacuggaauggaaaaguacccagugauuaagguucaggaagaaagcuacugaugagacaaugugaugauucuaccauuuuccuguguucuauuaagcauauucgaaaugaagacauacggucagugcgugguguguucagcacuuucgguuuaugaugaggaguaaaggcggaaggcagccucgccaccuucacacgggcacucuccucuucgccuuacaggacggaagguggccuccgucccuggccccauaccaucacuggaggaaaagaaggcaggcagggggccugucaagaggguagccuccugccugaggggcuggggagaggggccggguaccaggcggccagggggccucggagggcaagacuccugcuugauggggugggaggugugccugcccggccacggacacagcucugacagcugucccuggcuucauccccuuucucaggagaagcucccccuuucuucuuauauuguccuguuugggccagggacgucacagaaaaaguaaggggguggcaucuggagaaaaaggggaccagccaugccgagcugguccuagccacagagggaaacagcagguccaccucaaacacuggguacggaaaggaaacgaugcaaaugaagaagccgaguuagugagcuggagaagggauccaggcggcacugcaaacaggaguguggagacagcagcagaggucacagccugccaucggaggcgggugcuuucacccccagucacagucagcacaggacguaaugacacagaagcaugcucuucuuggacaggcugcaaccgcggcccccggggaugacagaagaagggaacuaucuguaucuuaucaucaaugucugaaacagggaacacacugcagccggcagcucuuaacuccccaaccacaggacuuagagcuccagcucccaugaaaucacucuguuggaucccagcuuuuuaaaaaagaauuaaccaaauguaacaaaaugcuaauuauccaaagcacuuuuuaugcaggauaccaccaaagagccuauuuccaaaggccaauacgagguucacuaaauaacugucgcaaaugacaagcuugaagaucugacaauucgauagugaugucaguaaaauuccauucucuccuauaagaaaagcaaugacucacaagccccguggaaagaguggaagggcacaggcggacacuaaccugggcgccgucucguuuaaaggcuguggcuuggcccaagacaagcguggacaggcugguagaggccgagguuuugggucucccaaaugggccuccagaaccuuggaguaccgaugaagaugguuuccugugguuagcagcaacaucaacaaaaaggaaaaucaucucuauuacuaaaaugcaaaggaaaaaggagggccuuauuaugagucugucugcuuucccacaacacagcacagagccccugugcucuauuaagcuauccuccaugagccgcaggagccacgccugauugguuccucccggacaauguguguuuccauugcugaaggugggugagaaaaucagaaccguucccuugaagaugggcagaugugugcacagcacuggcuggucaaacuuugcugaccaccacugacacacgcaaggcuacaccugcgaaaucuaagcuacagaccgguuucauggaaaaaauacuucucuucuaaaauauuuaauucucuggccaaauaaaaaaccacucugcauuuucaaaauucuuucuauuucuuagaucugcaccauugugccaaccacacguagcuacugagcaagugaaauaagguaucacguguuuaaauucuaauauucuucaugucuugggcucaaguauauuauuaaaauaguuucaucuguguuucuuuuuacuuuuuaaacgcagcuccuggaaaauuuuaaaugaugccugugguucccaugagccuucuacgggcagcgcuguaaggaccagcacaccagggacuuagacgcacugauacccaccccacuaagugccaagcagcuggcggccccacggcaccagcacaggccccagaggcggguugaggcuccaccaccacauaccgcccaggcgaucucaggcaguuaucuaauuucucucagcucucauuuccucaucuggaaacugggaauaauaacaucuauuuucacaggauuacugagaggggacagugagguaauccaugggagcaucccagccugcugcaugggaccuggcaagugcucuagaauguuggugauucuuccugaagaucuguaggagccacuguccucaccugugagagcgggacgguaaacacacucagaguggcgugagggucggggugcacgugggaaagcagcugcacacuggguccucgaucauggcccucuggggacuaaggauggccucucggcagguuagagccgcugagugcugcucuacccgcagccauuacgaaaaccacucagcggcgcacacaaacuggccccacuugcuggcaggcacagccacuggcugaaguagcaucauguucagcuggauccaauucccuccccaaggcauccugcccauccacucaccuuccauccucucuggagugacugagccugcuccacugggagggcgcuggcgguucccagagugacugaggcuaggcggugucaccccauacgauguguacuggaggagggcauccagaagccaaaagcagucugcgaagucaacaagccuguuuaggaauuccuuuuuuuuuuuccagacagagucacgcucuugucacccagugcaguggcgcaaucauagcucacugcagccuugagcuccugggcucaagugauccuccugccucagccucccaaguagcugagacugaaggcacaugacagcaugcccggcuaauuuuuuauuuuuugcagaaaugggucuggcuggucucaaacuccugggcucaagugaucuucuugccucagccucccaaagugcugggauuauaggugugagccaccacacguggcccggaauuuagcuuuuaagaagaaaucucuaaaggaauuuuuuuuaaguuaguccccaaaagugggggaaaugggaguucagaagucacgaguuuaggucaaaguaaauccaacauguuccagauuccccuauucucauaagacaugcauucucaguggcccagcccagccagauaagcacacacagccaugaccugaccagggcuccacucccagugccccaggguuccagguggucagcaccacuguccaccagguugcaccaacugccugagugccacacucagcuccucauggaugggggcagaauggagcucauucagagacagugagaccaugugacacccacugagaaaagaagggccugagagcggggucucaggggcaacagggagaggagaacggagggccauggcuccugcugcaucccagaggcucuccuggggagaaggaacuguacugacaccccaggggguggaggcaaggcucaacacccaugcagcaucuguucacuugagcugggcuucgagucggcagggcccugaccacuggaagugugacagcagagaaagggcaauuuguuuucagggacaccucagagucgaggcacugggcuagcaacagcucccguucacaaaggauccuuucugagagggaaggcgcaaccugguauugaaaccuggagcuucuguuuccaucuuguuucuccugugucugccccuucaaguuccauuaacaucaaccuggacuagacaagauccgugugagaaaaaugccauuaaguacuuuccucucauuaaagggcacuucuggucaagugcuuaaugccccugaaagaugaaaaaagcugccauuuuaaauguaaggccuaggaccacccucucaggcauuuacaauuuaauaaagacucuuaccaggagaucucaggucuuaaaaucucuguggaaauaaaacauuaaccuccuuuaacugugacuuuaacccucacuuuuaauuuuaauuuuauuuuauuauuauuuuuuaaaacagugucuugcucugucacccaggcuggagugcaguggcacgaucucggcucacugcaaccucugccucccggguucaagcaacucucccaccucagccucccaagcagcugggacuacaggcacacgccaccacgccuggcuaauuuuuguauuuuuaguagagacgcgguuucacuguguuggccaggcuggucaugaacuccugaccuugugacccacucaccucggccuaccaaagugcugggaucacaggcgugagccaccgcgcccggcccauuuuugauuuuuaaaaagacccaucccagucuagggauuuacauaaaugccaggaauguagucaacuucagccugaaacggaggggcacacacacaccucucagcgcacgcuguuagugccucauucuugucacucaccacccgcccugugccucgaguuccccaguggucacagcgcauuagaagguugccuuucaguccuggugucauuaucaucucaccagguaaaaacauggagcacuuuuaccauucuuucuccccuuuacaaaaugagaaaaauagucugugcccaaccucaagcccccaaauccaacggaugcaucgagagacugacauaaagacgcggagggaagaggacuggcaugccuauuugccuccccuucacgccucgagauaacaaacgcucuucacugauaaaggcuaagaaaagcccgaauuccaggucuggaaggacagccaagagccagcccuccaguaaaagagugagucagaccagagaagggcgcccccucguggcagugcccacaaaguccaggcagcacggcguaggaagccugggaggggcaggccccaaggaagucagggaagggacucuccaccacaacgcgggagucccgccuccgcuggccucaggaaggugaagauggagaagaggcaucauggccccaacaaguagcuuuguuuugcuuauuaaaugugugcacacucagacaccuaucaaaauauuccaagcaaucaaagugacugcaacaucuccagcugagccuggcucaagugaacagaugucggcugaucugccagcaucucacgggcgccuuuccagagacaaagggaagaaaggaucugagugccgaagucacaaaguccaucugcguuuuuccuacccuucugucggugacugucauccaagcaauuggaguccccauacaguacaauccggccuccacccucagcuggaaucugauaaagucccaaaauggggacguuuucaacaacugcuguuuccugcuuuaaaaccuccaauccugaaacaacacaacaaaaaacaacagccaugagaguuuccacugagcagugaguuauuuccugauauuucauccacgugacaaauaaaccacauuuacaaaaucuaauauucaauuaaaacauugcaaauuuuuagaauagaaaagccuuaagaauaagccuuuuagaauagaaaugucuuaagugccauugauuuguuuuagcaaaauucacuuuguguguauuuccguaucuauccacuuucauuuuuacuugccauggcaguacauaauauuuacaauugcaaaggugcugccucuaucuuaaaaaaaaaaccuaaauuguguccccucuuauuauccugaaaggccuauguuuucagacaccuacacaaagggcagccagcagaucuugcuaaacacacagguuucucuaugaauacagucauauauacuaauacccagguuucacguuuuauuaugaaaagcuaggacaaauguaacuaauuuuuaaaaguauguccacauauuuauauuuagguuuaagacaucgguuacauuaauuucacaaagacacauguuccaauagcacagccuccuaucuuugcccagaugacauaauuuaaaauuuguaaugaaucaagaagucaaaaauguauaaaugccacaggcagcaucaucaguggcaccaccagauaaucuaggagucucugccccuaauucaauugcuuuccucagcacuagaacaugauguacgucuucagcagaaucuaguauuguccguguugauaacaucugaaaugucuguagcucuauaaacgugacauucccugcucucugugcaggaauccuacuaggagcugaguagaagaaaaaauaggccauucuuuggaagagggaagcagucaggaaaaacuggaacacauucaccgccauuugccuugugguauuugaugggaguuuuauuucugccaucagggucuuuucugaucaggcauaacccaaauuccuauuuucaaauucuuauuuuguacccaaaagauuauucaacuuaaagucuuuaugggaauaaaaugccccuuuaaaaaauuucguuuucacacuguaguagaacaccuaaagaaagcacauauccuuaaaucuacuucugauucuccccacccaccuaccaaaaacaaggaucucccagaggguacaagccaaugagaccaccgcuuugaucccuuguuuacagcuagaaccugaagugauacugucuaugagaaaugcuuuuagaaagaaucacuaacccauggccaagugacugugaaaacaaucauuaugugccuaaaggugaaauauaaccuauuaaacacagauccaguuacugaucaaacuugcuuuugauaaaaggaaaaaaucccuuccagguaauauaaaaauaaguucuauauuccaguugcaaguagauaaggugagaaauccucucuuuucaucguuuucaacuaauaaaacuauccuuaacguccacguacagaaaauggcaacuuuagaagggagggggccucucauucugaaauacacaguaucaaacuugcaugacagaaacgaaucuuguacauuuucauuuuucuaaaaccuugguaaucuggcaaucacagaagcagaacaauuuauaaaggguaacaaaaaaauucaucaaguaaccuugaagguaguuuuuuuuuuuuuuuugagauggucucccucuguugcccaggcuggagugcaguggcaugaucuuggguaacugcaaccucugccucccagguucaagcgauucuccugccucagccuccugaguagcugggacuacaggcgcgugccaucaugcccggcuaaauuuuuguauuuuuaguagagacaggguuucacuguguuagccaggauggucucgaucuccugaccucaugaucugccugccucagccucucaaagugguggguaccauucaaguaauauugcaauaaauuuuaaaagaaaccaaaaugucgaaugggcaugggauuucuuauugcggugauaaaauuguucuggaaguagacaauggugaugguuccacaauuuuguaaauacacuaaaaaccaccgaauuguacacuuuaaaagggcaacuguuaugguauguaaauuauaugcaauaaagcuuuuauuaaaaaagagacagagaugagagacagagagagaagcgggggaaaagggagcgagagaaagaagaagcaaaaggcccaugaauggcauccuuuaccuugguccuugaaagucuguguuaucacgacgccaucuucuggaaacuucgcgaugcugcacccugacgcauaauacacuaggaaagaguguucaaagucaagggaacacaggaacgccgaacacuuuaauaaauaauagcuacucguuuacccaaaauacauucuucagaugcuauguauuuuuuuaauuguuuuuaaucuugagggaggagcugcuauugccuugucacacauaaaguacaaguaaucuccucaaaauucaaguaaaaaacacuacuaacaucagguuucugaauacauuuuauaaucaaagaaaaauacuauuaacauuagguuucugaauagauguuauaacucagagcagugaaaggcucaaaacaagcuguccagaccugcagaauggguaguaagaaugcuuacgacguuguucucaaaaccagcuaccaaaaccuuaccugugggggaacuuccuacacgggaaacacaaaguuauuucaugaauagcacuuuguaaauaauuaagaagcugugagguaguuccuauuugggacuacuacauaaagacucuaauagguggcacuaaaauuaggaauggcuacauaaaauauuuucauuuaaaaaaaaucuggacaaaacuagagccucacagauguacuuuugaaaauacuggugaguucuuuccacagacuccagcuaacugagggaucaccauucucuuucucaagaaaucuagacuucagagguguagagcuucugcucucacaccuaagaccacgcccucaggaaacagagccuuacugucaugguuggccagggugaacuccccuucauacaggccaucgcugaaccccauguuccacacagacagcagcucauucagagcugggauguuagcuccuccgguauccggcauccaccacugccugggaaagugguaacagacacacagggaacagggaaugaagacacuccauacacaguuauuuagucucugugacaaaacucaauuucuccugccacaauccaguccuuccacacuaaggcuucaacugaaaccaacugucuggguuuggguaaaacugcaaauuuaagugcuucggcugauguguagaauuaauuaaagcaaaauuuauuuuaugaaaugaaaaucaguacuuuaccgaaaugcaccagagauaacugcuuagccuagacccagcaagguucagugaaggagaaggagaugagaaagaagcauagaaauguucagucacagauucuaaagaaaccgauucaaaacauaaaggugauuauguuuauaauacauugggaguccuugaucccaauaaagggaaggacauuauucccuuugaguaaauuaauuacuauaaauauaaguaaauuaauuauuguaaauauacaauauuuaaauauacaauaauuuacucgaaauauucuuuaagaaacaguuccuuuggugcauuuaaauuuauauauacucaguaacagagaguggaaaagaauuaaacagaaguuuaaaccugaaguaucucauaucuaagauuaacaaggaaagacaaugaacccucuauauuauuaacaguacucauacucaauaaacaucuuacucuaugagcaacuuucaagaaccucucuacuguauaaaggacuauuuucuuuuuuguguuuuauuuuuucucuuugagauagggucucucugacacccaggcuggaguacaguggcuugaucucagcucacugcagccuuggccucccagguucaaccgaucugcccaacucagccuuccaaagugcugggauuacaggcgugagcaaccgcacucagucgaaagggcuuuuuuucuaaucaagcucucugaaugugucugugccaacuggaaagaccaccaacaggucaaaucaucacuuaaguauuugcuggguagaauuugauuccccaaaagucuuauccaaauaccaaugcguaucaacaguaccuuguguuuucaucauaaaacuucacuuuucucauaacagaaguguuguaccagucacugaagaugacgagcgagaggccguuguccacgucccuccggagcuuggcgaucucuucagggaaguacuccuccucacuguccaccaucagcaaagugccugaugaacaaagaaccaaagcugggaacugucacuucugaaugacaggacaccaccacggcagaaacagugucaccagguacaugucucagguuacugacaccuaacagucugguuugugccacccuguaccacuuuaaaagggacuaaaaaguagaggaccaggauccagcaauacacagcgacuaacugugaucugauuucacuuguggugcucaggauaaagauuuucauucacuugagaaggagcaaaauauauagcagagcugcuuuuaacuuaaagaaaaaagaguacgaaugucccugucuccaaucagccugucuuguauuucagcugaaugucacaccgccaccaccuguuucagagccucgccccaggcucacccagcuguggggcccacggcgcauacucccuugguagcuaucacugaaaacugggauucacuccucagacauuuaacaaacauccaaagugggcggaaagaccaucuggcuagcacagcagugccacuuaccauacugacuggcaucaaaacacgugaagggggccccgaggaccucuacaaaguagcccaugcuucucagaugcugguacauaucccugaaauugguguggaugugaucaccauuccugaaaaacaauaggccacagcauuaaaaugaucgaucuuuacuggcaauaaaggcauaucuggccacagggccggcucugcaagagcaccaugccauggcccacagagaaggccuggauggcuggcccacuggcacaggcaucagcuuaggagaccugugugcucuggucuggacacacggaaauggcugauaagaagaaaccaugugccuggcaggugcaugaaagagacaaaaugaccagaagaaauggccaaagacauguuuaauguguccuggaccaucacuguagcagucgcguucaaguaaauugcuggcaaccaucugugucugacagaagagcuuagcaaauagccgcgggagugcagggacgcuggaacaagccacgcagggccacggugcuaagacagcggcacagcuaacugauaucacugccacuggucaacuuuccauccccgucccucccaaaugagcucacuuuccuaugggacacuguauacacccucuaggggucaccucauucucaccucccagcagcacagacuccagguccucuccugcaggccaacgggcuugccuuggucuaugaacuucccaccacuuccugucuacccgucucuggucugagccccuccaaucuggcugccagagacaucuuauuuuaaaaggcaagucugacucuguaacuauccuggucacaucuuucaaugcuuccccuuccccuacuuucagcauggaguucaaacguaguccaaacauaaaagcagaaaugagcuuggcuaaugcaccaagagaaagucagcccagcugcccugcagggaacaggcacagggagagcggcuauggggacugcgggggaagcagugccagcuucugaagggcugcaugggucacaccagggggcuuggccgggugaggaagucagaauaggcagucacuggagagcuugaggcaaacuguguuagaauuuguuuuaagauuaccaagguugccagaagaggaguggaauuuagggcaacaacagcaacagcaguggcacucaggagcugcugaugugguccaggcaagagaugacaauggcauggacuagggugggagcagggagaaggccagagauggaaggauccaggaugcaguuugaggguaagacugacagcuuugcugacuggcgcaaugggagaaggaaggaaaagagaacuucaagcuuuuuacugcauaaucauacuugugaaaguuucaaaagagaagucaggcugcccuaagugcauggcaaaagccugaacaucucagcgucaucagaguccaggcuccacgagaagcugagcaacaucuuuccaagaguugcgggaacaguggugccuccucccaccacggaggcuggggaggugaagugcauccugugaggugcuuaccagucuaaagggucauucuucauccuuaaauuaucccuggggaaauagccagguggauagcggagguugugguacugaucccagagaacucucuugcuucgcgggggaguaggaauuaucuucaccuuaauggggagcuuuacuguugaagucuguucugcaccauuuuuugacuaaaaaaaaagaaaagaaacuugaaacgcccucauugugcagaaagaaacuuucagguuugaaaacaucauuucuauuuaucaacuuaaccuaaauaauuugaacacaagaauuuccaauaacaaaugucugaugaaagauucauguaucauaacuaaguccauucaaacacuuaaagaguuuaacaguuaaaauuuaaggcauauucuaucaauaaaaacuacuagagccucauaggauuaacccuacauuuccuuuuagagaauguauauuuuuggugcacuccuuuugagcuugaaaucugguagaaaacagucuucucugcuguuguguggccacagaacggcaagcccuagcacucacugacugagcuacuucuucaaacuccagcugcuccggaggcccuggaaccaucaauuguggccaucgaggauaagccuaucugucaacuguacuuccaauggagaccccaggcauuuggccugucccucccugaaaggugaugucaaacagcuaagaaaacaagccacuuucccgcauaucccuaccucugucucugcuggggaagccacagugaucaugacauggcccugagcaaugccuucccaggaagccgcuuucuuggucacagaaauggagauggccagguagcccgaccaaggccauaagaccgaggaguaggagaaggcaacuucaauguugucuccguucuguggcaaauagggcugccagucaggcugcaggaaaaagaaaucagacaaaggcuaaagugaaaagcuccaggagaaaacacguggaaaccagaaaaacucaauucuuaccaaaacugguuccgagaaauacuucacuaaauagggaaaaauaaaauuuauacacagauacuaaguaacuacaaccaaaguagccuauggacugccucggacguaucacuagaaaagucuagaaaccacuauuucugacagcuuccaauuuuauggagacauuuuuuuucuauuauaaaacaggaacuuuugucaaaaguucuuugaugaaaaacuucaucugacuaagagaacuuauauagaugaaaacucucagauuuaagguuauuucccaauuaguuguaugcuuuaaaaaaaucccauuaauugaaagcaguaacaugacagggacaccagcugucccgagucacauucugaagcuggaaagagguggccggagggaggacuggcucagcugcgagaugaccacccuucuacccuccaggugggagaaaagcagaaagggaagcgugagcagaggccaucuggaagagacgucaaugagagcuugcaacuaaccgguauuucagacgaaucuaaauuacucauuucccuccacaauccacacagccagaacuuacuucccaaguaagccaguggguuaagaaaaaaguaugaaaaagaaaaauaucuguaggauacggugucccaaauaaugaggaagaaaagggauuuuuaaagaaugcucuuggagccacugguucccaagugaaaaacuuucgcccaucucuuguaacacaucaaauuaacacagaugaaacaauuaaauauuuaacaaucauauacauaaaaauuaguagaaaaauaaaauggaaauuuuauuaucucucuggaaugauguuuccaucugcaaaacaauaaaagucacaaaacauaaaaauucaacuacaugaaauguaaaacuuuuacagaaggaaaaaaauccccaccacaguaaguaauauuaaagggaaaagagcaucaccuggaggaacauuuugcugaacacacagcaauggugaauuucucuaugacagggcgaucauguuaggauugauagagaaaaucccaauuccaggagaaaaaugggccaacgaaaucaacguguaacucauacaagaggaaacagaauucguaaacacaaccaaagauacccaccccacaaagaacugaagugcacauuacacaaggcgcccguuuuacccccaucuaagcugaaagcugaaagauguaccaccuagaauagccaaaugcccagcaagagaugaacggagaaacgccauguggccgacccgcccaguggagcacuacuccaacacaggaagcagcgcggcacugacagcacuacggcguggacaaacugugaaaaccugaggcugagggaaggaagccgggcacaaaaggacagaugcuauaggauuccauugaugugagaaguccagaacaggcaagcccacagagacagaaagcaggcugguugccaagggcugguggaaggaagaaggaguggcugauaauggguauaagguuucuuuuagggaauguuccugaaggagauguuggcacagccuucugaauauacuaaaacccaccaaacugugcgaccuaaaagggugaauuucacgauacguggauuuuaucucaauuuuuuaaaacacuaauggaauaaaaacacuuuaaaaggcaaaucaggucaggcgcgauggcucacaccuguaaucccagcacuuugggagggcaaggcgggagggucaugaggugaggagaucgagaccauccuggcuaacauggugaaacccgucucuacuaaaaauacaaaaaauuagccgggcaugguggugggcgccuguagucccagcuacucgggaggcugaggcaggaaaauggcgugaacccgggagacggagcuugcagugagccgagaucgugccacugcacucaagccugggagagagcgagacuccgucucagaaaaaaaaaggcaaaucacccagugaaggugugguggagccaucuucuccugaaccccacuggcagcagucuaagcugacauaacuccacuggacagaauuugguaggaugugccaagagccauccuugacuguucacacccucugauucagggagcaaauccagggaguuuauguuaaggaaauaauucaaaauaaaagaaaaccauauaugcaauaauauucagugaaauguuuauaauugaaaacuaccuaacaguucaaaggaaaauagcaaacaaauuauaauuuacuauuucuauauaaacaaccauuaagaaguauacuggugccaugcauauaguugaauuuuucuuuucuuuuugagauggaguguugcucugucaccagguuggaguacaguggcaugaucucggcccacugcaaccuccgccucccagguucaagcgauucuccugcuucagccucccgaguagcugggauuacaagcgugugucaccacgcccagcugauuuuuguauuuuuaguagagacgggguuucaccauguuugccaggauggucucgaucucuugaccucgugauccuccugccucagccucucaaagugcugggauuacaggcuugagccaacacgccuggcagcugaauuuuucaauauuuaugauauaaugagaaccaccaaaaaaguugugaauuuuugccaagugcacaaugauaacaaaaaaaauaaguauugcagauaagggcuggaaaagaauauuuaaaaaacaguggccaaguuaguaugcugaggcuggaagcgaguuuucuaugguuuuucccuauuuuuuauuauugugauagugucuacauaguuaagauuuuuaaaaauuuacaaaacaauauuaaaaaaaaaagaccguaucuuccaaacacauuaaaggauagaauacuggcuggugcgguggcucacaccuguaaucccaggacucugggaggcugagguagcuggaucaccugaagucaggaauucgagaccagccuggccaacauggugaaacccugucuccacuaaaaaugcaaaaaauuagccagacgugguggcaggcaccuguaaucccagauaccugggaggcugagccaguagaaucgcuugaaccugggaggcggagguugcagugagccaagaucaugccauugcccuccagccugggcaacaagagugacacucugucucaaaaaaaaauaaagaaugaaauacuacaacugggccuuuaauuauaggcgcaaaauuguauagaugaaaaaucaaauguaauuagcugacucaggagccaaacucaagaugccaaagcaaaaaaguaaaauugguuucauuaauuuauacccugacuuauucuguaacagacuuagcauauaacaaaucacuacuuccaauagcccugguacccuagacagggcuauuuccuuuuuuuuuuuuucccagacaaggucuugcucugucauccaggcuggagugcaauggcaugaucuuggcucacugcagccucaaccuccuagacucaagugauccucccacgucagccuccuguguaucugggaccacgggcacacaccaccaucccuggcuaauuucuuuauuauuuguagagacaggucucacuuuguugcucaggcuggucuuaaaguccugggcucaagugauccucucuccucggccuagaacuuuuccuuuuuuaacuucagcagaaguaacuauggccuaaaggucugggcugugucuaaguucaccaucaagucagagaccaagucagagagaaguuucaccuuaucuacaauucuuccugugacucccaugccguugaggauggugacauuaacaacugucggcauuccuccauaguagaugggcugggagcaguagggccacauguagggacacucagucagaucuauguagcuggggcucaaacugaaauaaagaauacaguguuagaguagaucauaugagaaaacuacaaugaagcaacacaacuguacaagacagaguuaacaaagcagaccuagcuucagaagggcuugcuuacagcgcugcccuaggcuggcaucugggaacuuggcucuggaaugcuccugcacagauaaggccucugugccagccugcugucuauacagacagugugaugugcagggacaccucugcuuuugcaagucuggagcuuugggaguugucacuggcagagaaugaguacgugaccagcccuaauggaaacuuggacuugagucucuagagggcuucccugggcaaaaacacguacacaugucaaugcagcuugcugcuaggaaaggggccagcucugugagacccugccuggcaggagagaggggagagcuuaggaagcugcgccuggauuucuccaggcuuucuccgugugaggcaucuuuuucccuuacagagccgcugugcauccuugcugugccacuauaaugaaucuuagcugggaguaugaccacaggcugagucccgugagcccuaaagcaccgagccugggagaggugcuggggacccugacauaauuugugucagaagugcugacacaagugcucuggcaauuauguugguuucaugguuuccccuuaucugaacugaguuuguguuggguucacaucacuccuagugcagcagcggugucagcuacgcccgaacaggugaaaagacaggaacagacaaauguuucagacaagacgugacccacgauggccucccugagagcaccaggcauacguggauccugcuucucaagcugcacccacgugcagugggcgggcggcucugcgcaacugcuucaccucauuacaggagaugccagccuuucucaaacagcaacuacgguauaaggaguacuuuuuauuaguuuguaauaacaaagauguaucugggccaacugaauugcuauuuaagaaaccaaauggaauaucuuuagggauacugugacuuucacaggcaguuauaaucaacacauaucacaguuaaguuaucucaacagauaccaccuucacaagucugaaguucaccaaaaaaagaaaaagaaaaggaaauagguacuaccuaguuuuaaaaauccugaauggaucggccaugugacuacaauuguaugcaucagcaaagguaucuguucuacuugaaauguguuuguaaacuuugcugguaauugugcucuguaaucaguuuaauucgacuacuaauucaacaugauuuaacuaggaaaccauuauuagcaaacagaauucaacaucauauuaagaaaacaaaauagcaagaccaguggcauuuauuacagauugguucaauauugggaaacucauuaauaucauaaaccauauauauuaauaggucuaaaguauucauaugauuaccuuucuagaugcugaaaaaacauacaaaauucaauccacaguccucaugaaaacgcucagaaaaacagcacuagacagauaaucuaacacaauaaaaaauauauacauauauauauagauauacacaccuuagggauaaauccagcaucuuacuuaacggagaaauacaagaggcauuuccauuaagauuaggaacaacguaaggauagccacucucuccccugcuguucaacacugugcuagauauaccagcccaugcaacuagacagaaaauaaucaaugaagccuuaagaauuggcaaggaagauguaaaacuaucuuuauuuccauaugguagguuaguacaccuggaaaacccuagagaagcaauaauaaaacuaacucaaacaauaauucagauagguagcagcauauaaaauuaacauauagaaauaaaaucaaccaguuagagaauauacaagaagagaaagccccaucuacagcagcaacaaaaagauuaaauacuuaaacuuaccaagaaauguguaaaaccuauaugaagacaacuguaaaaccuccuggaagacacacaagagcaaauggaaacauauccuuugcucuuagacaaaauaacagcauuauaaaaauauuacuucuaaguucauuuaaaauuugaugcaauugcaacaaaaauuccaacaagcuucuuucauagaauuaaguaagaugauaugaaaauucauaugaagaaaacaaacaugcaagaauagccaagaagggccgggugaagugacucacgcgugucaucccagcacuuugggaggccgaggcgggaggacggcuugagcccaggaguugaagaccagccugggcaacauggcaaaacccugucucuacuaaaaauagaaaaauuagcggggcauggggguauguaccugcaguccaccuacuugggaggcugagacgggacagucaccugagcccagauggcagagguuacagugagcugagaucaugcaacuacacuccagccugagccacagagcaagacccugcugcauuaaaaaagaaaaaaaaaaaaaaaagagagagagaaaagaaaagaaagaaagaaaagaauacccaagaaaacaacgaaaaaaaaaauuacaaggggaacuagcacuaacagauauuaaaacaugcuauaaagucuuuauaaucaaaacagugugguaccaguacauggacagacagaccaguggaacagaauggaaagcucagggauagacauaauacauaugaaaacuuaguacauaauaaagacaguaucucaaaucacuggggcaaagauggacuuuuuaaucacaagagcuuuaacaaauggguggccauuuggcaaaagaaaaaauuacaucccuaccuccaaacaauacacaaaaauuaacuccaaauggaucaaggaauuucaaguaaauaaaagaaagcaaacaaauauuagaagaaaacacaggugaauuucucuuuuaccucccucagugcagaaaaagacuuucuaaggacucaaaauacagaggcaucagcugaagaguaacaaaugugacuauuaaaaaacaacugcauggcaaaaacaccuuacacuaagucaaaagacaacugacaaaguggcagaaaaauccgcaacaugcaucccugacggaggguuacuaacacucauauaucgagaacucuaaagagggaccaaaaaccccauugaaaaagaaaugaacagacaauucacaagaaagcuuaaaaaaaaaaagcucuuaaacauggacuuagguguucaaacucacucauaaauagagaaacacaaauuaaacaauacugaaauaccauuucuuaccaaucagauuuguaaaaauaacaagacagagcacucugucagugaggcuuuggggaaaccggcacucacgcacacugcucacgcaauaccaaaaggcacaacccuuucacagagaaacaaagcaaugccuaacagagcuacccgaugcucucaacgcugaccagcagugcuaccuuaccuaacagagcuaccgggcgcucucgacccggaccagcagugccaccuuaccuaaguuaccugacgcucucaacccggaccagcagugccaccuuaccuaacagagcuacccgaugcucucaacccagaccagcagugccaccuuaccuaacagagcuacccgaugcucucaacccagaccagcagugccaccuuaccuaacagagcuacccgaugcucucaacccagaccagcagugccaccuuaccuaacagagcuacccgaugcucucaacccagaccagcagugccaccuuaccuaacagagcuaccagacgcucucaaugcugagcaggguaaauuuuuagcaauuuacccugaaggaacaccuccaacaaaacuaagacacacaggccugagguuauucacugcaaguuuauaauuacaaaauacuggaaacaacuuaaaagcccauauguagacaaguaguggcuuaaacgauuguacauucacaggauacggcugugaaaaaggagaaucucuacgcacugacguggagagauuuccaggacguuaagugaaaaaagcagaauccaaaacaauauccacagcgaugcuauccuucuauguaugugcucauuugugggguggugggggcagggggaaggauaaacccaaaccugaugucaugguuaccuaaggcgugugcggaagccugguagaaagaaugggcgagugggaacugacaugguuuggaugcucgcccccucccaaucucacgcugacguguaaucccccauguuggaggugggccuagugggagggacuggguccugggggagaccccucaugggugguuuagcaccaucccucuggugguaacugaguucucacucagcucaggcaagaucuggguguuuaacagucugggaccuccccgcucucuugcucccucucuugccaugugaugugcuggcuccccuucaccuucugccaugauuggaagcucccugaggccuccccagaagcaggugcuggugcuaugcuuccuguacagccugcagaaccaggagccaacugaaccucuuuucuuuauaaauuacccagucucagguauuuuuuuauagcagugcaagaacaaacgaacacauccuuagaaccacagucauguuucacacacccaauaacaaguuauaaucaacgaggaugugggggaaaucuaaaaaggaauacaaacacgaauaaaugaguccaacuguauuaaaaagacaccaaggaaagaauuaaccuaaguaacugaaaaaaacacuauaacuguauucuguagggccaaagauaaugacgcacugucacaaauacuauauucaaaaaacucacaaggacaugggcuagcaguuccaaagcugcucaguacguauacacuacaacuaagcaaauaagccaacauauuguggauaaugagagccaggcuucucacuguuggagaauggaguuagaaacagagguaacaugaccaucucuguaaauaagaaauaaauaaauaaauagaaacaaggauagggaaaggcuggaaugaacacugagauacuggcuggaaccuggagguggcaugaacucauguuuccaguacauacacagauaggcagauacagaagcagucguaugugucugugcacguguccacacguugccuagcucuguccgaagagcgcaguaaccacugugagcacagcagcuuggagcaccccgagugcccaggucuugauuucuuuagaagaggccaucagcaaagagcugcuuggagacagaacugauaccaaggcuagagcacagaggugcaugacaggacauccugugcugccaggaagacagaaagugcucagaaaaggcuggacacaugcugaaaacacacauaagccaacuagauggagcucccaacagccaacucggggacaauuugaacgacccacuaaaugauauuaauuauaauccacagaguaaaauaaauaucuauguguccacacugauguaaagaacugaauaaauaaaugggacagaaaggacagcucuuccuuccaggagaguuccaauuaaucaauguaaauggaaugaaggaaaaagaaaaucaucacgugucaaaguugucaggaguaaucaccaaaggcaagaaccaucaaggcaugcuaacaugagugaguggaaguaugugacgaaacaaggccaucucgaaacaugcccccacaagacacugagaagucacaaaggaaacacgggcugcacaguggagacaccuggcaggagccaccucuggccccacagggccagcagcucaggucuccucugcaggacacugcuggcugacacccgcagcugccacccucagguccucacacgucugugccaaggccacgcuuccccuggggcugcucccagccaaugacuaagcacacaggaggcaccagggcaggcccauucuggggggacacaggacuccuccaacaggcaaucugguucaaggauuucccaucagccaaaacuuuuucaggccugugcgagccucuuccuccccaguccuccuaacuuuucggugucagaucagcacugcaguuccugccuauucccacacccuucccuuuauccuucagaggcccucacuccccacauaucuuuugaacauguaauccuagcuugacgucugcuucuuggaggacccagacugacagaccacauuaaucaaaugaugaaaaugaauacccccaauaacaagaugaaggaaaacggaggaaccgucugugauuagaggaaaccaagaagacaggacaaugaaauccaaugugggauccuggacuggaucccagagaauggaccugugggacaaugggcggaaucugcgugaagccugcaggucagucagcagugcuacaucaagguucauuuccagacucugacgcucauacugagguuauggaagauacuaaggugagggaaagcugggugaaggacucagggguucucaugaacuauuugugaaacuuugcuguaaaucuaaaaucauuucaaaauaagggugaaaacaaagcagggcccaggccggacgggaguaccacaggagcuggcgagauguauguggucugcaggugaauuacagcacagugucaguguuuguaugacaguuuuaacagcuguacuccacucaucugaaaugguggcaucaggggaaacugggcaaccuuguaggacaacucucuccuauuucugcaaaauuucuguaaaccuaagauuauuucaagagucuaagaaaguaaacaacaaaagcaaaaaaaccacucagaaaucauuacuuuuaaccauuuauauuaaagaucacaucaguaagcgaaagcagcuaccaguucugccagcagcacccuguagaagcagcagcaaaaccucuccaagcaccccgagaauucugugcuuagucaucauuuucuguuuugaggcuuguauuuugugcagagggaaaauucgcccagagcccagugaaggagagaaagacccaucggcagggcggugcacugaccuugccuguggcuuguagcuguugaggaucugauaggcucugagcagaucgagcuugccguggccuugcucaaacauguugaccccggggagccuccgggcugacgcgaucagggccugcuucauacuggcgggauucaccagcucacgcuucuggacugugcuggaggaaaaaucaagaauugccuauuuucucucaguaaaagaauggaaauuggaccacuaaaaccuaaccuacaaacgugcacacaagaggccugcagucuuguuuaguauccaacaggugcuugucuggcacagccugcaugagagaaugagugcacacucaucucuguacccaauccaggacugaccacuccgcaaccuucuacgggacccacuuaugcuaaaugcaucaguaacacauauuuuugugauaauucaacuaaacaaccacauaggcugcagaaggcaugaauguauaggagguacugacuccucuggggagaggaagccugcuggucacaggaagaagaugccaugggacaccgccuggcugggagaaggaggagcacauucagauccuggggaggggccacgacacaggacuagcaggaggcacaggucugagugaggaccgccgccuccaaagccaauccuugccuuuuuguuuccagauugggaggcuugucugggaugagccacccugauggaugaugccuuucagaacgacauagaccuaaggccaccuucaguuucaccaugagaaugcaucugaacaagcuuuaacacacagugugaccuggcuaggaacuuagccuggugauacuagcguuacaacauccauuuuuguguauuuauguauuauaaauacaagugaauuuuaauuccuaaaauugaggugggaauaucaguacacaaaaaaggaaaacuuaacucuccuaaguuccuaaauauucguaugugaugauguuugguguuggagucuaggcagguuuucuaaaugggaaaucugacauaaguagaggagauaaaguagauucuuaaugacagaagaaaagaagugcucaaagcuaugggucaacaaucuuccuccucuuccugccuauaaagugaacucaaggguugcguuccacugccuuucacagcaucaucaggcuggagcucgggaggcccgccacugcugcucggcuuccauuaugagcgacugucacacacagagaucacaacggcaguuucaucugcugcagggagaugaggagacugaaaggcuuccuuguugcugaaaauaucuguacuuaaagaagcugcugggaaaaggaacaaccccucggcugcccgcuuacucaacagcagagagcugacgggcucaacagugaaggcagagcccucacuuccugcuaacaaucauggcguuuaggagaaaugaaccaguauuuucuguuuccagaaucaacaacauuagaagcugcagcccuaacugaauucucuccaccuggcaaauacaagugugcaaacaggccagguagcccacuauccaccuucccuccacucuguuccucacuugauauaacacuggagagaggaaaacaacggcaagagaagacaguguuuccagcaagcacaugguuauucuccaaaggccagucuggccaaugucaacauucucaagaauuuggcugcaaacuguaagggaagaacagagaaaggaggaaagagauggauaucuaccccuuuuuuuuuuuugguagagaugaggucucacuauguugccccagcugcucucaaacuacuagccucaaacaauccuccugccuuggccucccaaagugcugggauuacaggugugagcuaccacaaccagccaaguaucuagcuuuauuaaggauuacuaacaaaauaauaucuggcaucagaagcugaaaucaauauucaauuuacuuaaagagaacuuaaaauauaaagacauuuaauacuauuugccuauauuaauuaauuuuuaaauuagcauagaauaacuuccaaauacgcagaguuuuguguguuaucacaacacucaacuaaaacuucaucuagauagaagaaguacaauuuauuuuuggggaaaauacaguaacaagauaaaugccagccccaaagacauccuuuuacaacugagaguaaagaaacacgggccaccgaugaaagugagaacaugugaacaucaacucuggucuacucgcuuggagaacuuuauugauugauuggcugauugagacagaguguugcucugucacccaggcuggagugcaguggcacgaucucaguucacugcagccuccuccucccggguucaagcaauuuuccugccucaaucuccugaguagcugggauuacagccgcccaccaccacaccuggcuaacuuguaauuuuuaguagagacaggguuucaccauguugaucaggcuggucuugaacuccugaccucaggugaccugcugccucagccucccaaaaugcugggauuacaggugugagccaccgcacccggccuccuugagaacuuucuuccaguuucauuaucugcaagauuaagggccagucacuaagcuccauuccaacugcaugagauucagugagacaaagcagaguggugacugucagucccugguggcucugacauccuuugcuauagagaacauuaaaaggugaguccccuucacaaaaacaacaaauggguaacacugugagaagauggauguguucauucguuucacuagaguaaccuccuuuuuacuaucuauauguauuccauaacaucauguuguauaucuuacauauacgcaguaggauuuguuuuuuguuuuucuuuuuuaaagugaauccccaaggaaauggaggauauauggcagggaaauaucuuacuauuuguucccugccugauauuuaugcuugcuuggauauaaaaaucacaguucuagcacauaaaugggauauuagaaaacagaacacaaacauaaagaaacagguuauuuugccuaucagcacuuuguuuacuuaggcuuauaaaguguguucacauucacuucaucuaacuauaaaagaagugacuccuaccucuuugcagagaugaagaaggagagacagagcaaggcugugaagggccuaagcucucaaacccaagacagggcagaagcaagacacgacuccugcucugcuggcaccgagugcuccuguccugacgugggagcuacuggucucuagggggcagcacucaccucacuaacaaggugacagcaccugcaaccacuggagaagcaacacuggucccugagagggcccggcaccccccuuucacgccagaaccccgcacgccagcaccauaggugacaaugucagguuucaugcgaccguagccuccugguagcuccuaugaauaaaagcagcuugguugcuacaucucgcacauuggcauacagccgcaugcaaucaugagugaaucaaaucagaacagagauauggguuaguuaaaaacuguauaaccuuaggaagguacugguuuuagucugaaauucacuccaggccaggcgcaaggcucacaccuguaaucccaacacucugggaggccgaggcagguggacugcuugagcccaggaguuccagacuagccugggcuacacaguaagacccccaucuccacaaaaaauacaaaaauuagccagauguaguggcacaagccuguagucccggcuacucaggaggaucaccugagcccgggaggucaaggcugcagggagccgugauugugccacugcacuccagccugggcaacacagugagauccugucccccucagccccgcacccgccccccccccaaaaaaaaagagaaaaaaacaaagaaauucacuacaauacagaaaauaagcuuaaacgauaauguagaaaguaaauuuuuaaaaauauauuuuauaacaaccagaacaauggcaaaggcauaaagcaauuaaaagauaaguauuuuaauuuugcugacaugccagacuggaaaguggacacuggcuuaucaccaagaccagaaacuggaaacugcuuuaucucuagauaaguuaaaauuagaaauauguuagaaaaauuagaaaauuaaaauguaaaaaaacccaaacauguuucuuuacaaggaaaaaaguacacgguaugaguggauguuucaaacgguuguaaaagaggaaauaagaaaccacugagaaggaacaagauaaccacacgacuaacuugggauaacguuuuaauaaguacuugcuuaagcuucuuaagaauuggggcaaaacgaaaauuagaauaggaucucauauucugucagaaaacaggagcccaauuugaagggaagcccuuuucugaccaucaaacccaaggaccauggaugcacauacugggauaccgaguaaaggcauccuccacugcagcugugaugauggaaggacauuucucaaaugccauuaaaaagcuggcuggugaugaaggccauggacgugacaucucaucacgguuuggugaaagcguuuacacggggagcuggggacaaaguggaugacaucucaccacaguucggugagagcauuuacacagggagcuggggacaaagugguggaugcaguuucccauuauccggcagcacaaggaacaugcugagggagcguggaugggaggacacgcagccugcccugcacagacugucacaugagagaaugguccccagccaacaggucagcuccaggaagaggcacgugagugugggaggcggggaccccugguggggcugaguggcggggacgcugggggcugacgcugucacaggacaaaggcucaggcagaaggcuauccuguaaaguggcuacaguguggacgaggcccacaguguucccaggcaguugggaaucuuuccagggacuuaucugaggccuccgaguguggcaugugacguuaaacaccaagagaugcucugacccugaagaaugagaagggcagaugcuccccucggccacagcgagggcaaaggugcccaacugcuguucugcacgagcgucuaauuuuucaucaaacuuugacagguaaaggugggugaaugugcugcauaauuaaaccccaaacagcugaauuauuaacuguagcaguuauuuugaauuuguccagcuaaauacaauuguuucuguguuagcagaguugauauuaagcuguucucaaugguuucuccaacuucuuaaggcuccccucccccaaaaaauaucaucucaccuaccacugaggaggacugcuuaccacuacuagauaggguaaacgggcaggaacccaauucaccuaaaggugaguuccucagaaaucaauuaauaaguuaaacugggaaacaccgcuuagaaucagccggugcucaucacagcagcuguggacuugccagagugaaguggcagaugcugacggggcccagaucucucguccucacggcugggcaggcacucacagccccggcuauucccaugugaaugugagggugucugugcacuuacaaauacaccccaaggcucgucaacaaccggugccacuagccacaguaguuuguccagcuaaauacaauuauuuagcaaagaagagcguacccagguagucauuccccuugaagaaaagcgggcgauguuaucuucaaagucaaugccgccuacuccaaucacauccauuugaucagcaggguuauucagagugcuauauugagaccaaaaaaaaaaaaaaagaaaagaaaaagaaaaaaacaagagaaauaauuuaaaauggaugauucaaaccagggcgaauacucccagaacaaucuaacacuguaugagcugcuucugugggaagacgugugcagcuccucacggcuguccugugaaacgcaugauccugccacguucaugcugugcucacauuacgcccucucaccugcaacgccccuccuuucuucuccucccugucaacuuggcacacuggggcucaaggcucacguuuucccuccagcaauccaagccuuaagcaucuguacuugccuugaaccucacaacacuuaacacaaucacaauuuaucaccuaacgacacauucucacaucacuuucaaauuguucccagcacauucaucuuaacuccccagcuaaaucacacacuucuccuggaagaaaccauaaccacacauuuacaucugccaaggucaggaagugguaaguuuucgauugaccuguggugguguucuacccuccucauagggaacuguagaaggacuaucauuacucuguaaucuugagcuccuuagagucucuccaauaccuuaagugcacuagaucugcaaagaaauuauagugaaauaaauaauggcaaaaauguguaaaccguaaagucaagauaaagaugaaccauuugaaaauaugagacacucaguuauaaaacugcauugcuaagcuuuauuauggcuccacuaccaaaaaaaaugaacucuuugacaaaucaacaacuacauacaacugauuccaaguggcuuaagagauaauagcagcaugaaguucuccuucuagaguguguuuuuaacugacaauucccaacacaccgagaaaaagugguacugccuccucagcccacuggccaccaauauccuaccagcuggucauucagaggaacgaauaaugauuuucugaugacugaugcuagauguuuacacauucccaggaacucaaggagcagaggcugguacagaagucacugacagaaacucccacugaaguugaccaaaaaaauaccaccuucccacccuccucuaccugcuaagcccuauaaugcuuaguguacuuuaaacccuuaaaaaauaagggaacgcaucaagaaaucauugcugguauugaaaaggagggacgugaggcugcaggcuugcuggcaccacagagucuaggagcaccaagggcacaggacccagacaaagagaccacagcaaaggggaccggaggaugugugccucauucccagaggggcugacguaugcauguuacuguccucagaccagcccuggaagcagucccaccagaugcccaagcagaaaaaaccacacccaccacaagcugggcugccgugaucacaugccacguucugucacuucaacagccagcagguggccaggucugugugaggcagcaugagcguacacacaagguggagauggggccuuccuggcaaggcucugcuccuucaacacaccauaaacucacaacucugguaagaagcuacggagugcaaccacccacaaaagccacaggguuucagaacggcagccagcgugugacaaaacaguccgaacagcaugcgaaagagcugggaauccagacagguauggccaggaggaugggcagagggauggggugcggaagaccugagagaaacagaaggaggacacucauuccaggaagguguacauggggaaguggaagaucaaggugaacugagauuguggcuggaguuggccaacuacggcccaugggccaaaccaggcccacaccuguuuuugcaaauacagcguuccuggaacacagucauguucauuuacacauauaucacccgcagcugcuuucacacaauaacgccuaaaauauuuauuaucugacccuuuacagaaaaaguuugcaauucagccuagaauacugaagaccuugaaaaacaaaagaaaaauguggauuucaucuauuaggcaauaauaaacugcugcagauucuugauuagaaaacugcuacaauauauguuugaacaguagaaauacgcacaaaaaagaaaaagagcagcuuccauucaaagagcaucaucagcauucauggugcucucccccugcugucugauuucagucucauagguacucugcaggcugcucucuacucccaucacaggugagggagcugaggcucagagaagugacggugccucagccguaaguggcaggucggaccugucugcuuccacaccuaguuucacccauguccaugcuggaagagcuggggugggaaaagacucaagauuggaaaacaggcuaggaaacacugacaccuggugacucugaaccgaugagugccagccuugaguggggacaucagaaaugggaggaacauuuaaaagggagacaagaacaccugacgagaugacuuaauaacugguguuugucauggcagagcuauagcgaggguauguucaugccacuuacaucuauggcucaugauacguaucacugaugcgacagcaaaauccagaacccuggaccucuaacaagguucacgaucauuuacucaacuauuaggcuagaguccuaugaaugccaauauucacguuuucugauaugcaaacaugaacuucacauagcuucaccuugucuuaugcccuggauuuguguaaagcauccuacagaaacuucgagcacaagaaaugacuuauaaacauuaucuagagaauaaaaugaagcugcugguggaaagaaaacugagaccucuaaccagacaggagcguacuggcugggauucaguggcaaauguuucgcaucucacgcugcuuaaguuuagcacaaaggccccccugugacacuguccucccugccucccuccuaaaugaucccucucaucaacucccaaagcaccggccauguugccguuaggcccgccagcacuuccccugugaaugagugucacugugcucgcaccugcucuuucagagagaggcagaaaccucuuccguuugccucuuuacccggaugcuuugcacacagaucucaucaacacugcagaaucccuaauagauucacuuuucugauugauuuuuggggaaaaaaaguaguuagaauaaaaacuuuaggccucuaaauuacuauuuguaacaaaauuuuaaaaauauauaaauagaaggaagaccggccuugaggugacaacugcugaggugaguggugaguaccuggguguucaucuacauccuauaguauuuuuuuacaugaggaaaacauccuuaagacaaguuuuagacagacauaaacaaguaaccauagguagauacacaaacagauaacaauuuuucaguuauuuaagggggaaaaaauccccgaggucaucccugcuggggcuacuuacccauaaagagguccgucauugccaauagcagaaaccaugauuacauuguuagcuguuaauucccacaccuacaaaaggagcauuuauuuaaugaaaguaucccuuucauuaaacauauaacugucaaaaaaaaaaaaaaaaccauacacaacgucuaaaaacaguucuaaaaaagcagcacuggcccauuauaaaggcggaugugcuggcaacuugcauuuuuagaggauaccacccgggacggagaagcacgcagugcacagagcagaugcugacuuucuagucacuuugaggaaaacacgaauugcauguuuagguaagaaagaauuggcagggcaugguggcucacgccuguaaucccagcacuuugaaaggcugagguggguggaucaccugaggucaggaguuggagaccagccuggccaauucggugaaaccccgucucuacuaaaaauagcaaaauuagccgggcaugguggugugcaccuguaaucccggcuacuugggaggcugaggcaggagaaccgcuugaaccugggaggcggagguugcagugagccaagacugugccauuguacuccagccuggccaacaagaauaaaacuccaucucaaaaaaaaaaaaaaaaaaaaaaucagcaaggcaccaugugcuccuuaucaacaccuacucugaggccucuaacccacucaauuuaugacaugcaaaucacugaagcucacgucauuagccaucuguucucacaaagcugucaccaccuggaugaaaagccaccaacacacuagauaugaugcaaaguugggcugcgaaagagcaggagcugucacccaaaccccgugugcagugacuccacaaaccuugucaacaaacggaugauccaugaaguccgggccgccgaugcugagguuuaacacgucgaucuucuuuaaaauggcauaguugaaggcguccaaaaaccaagauguguaagauaccuaguuaaauauuauaacagucugcuuaguguuucaaucaaguuuuaaagugcuaggacaguuuuuauuucuaaggcucuuuuaaaauuacaaguaguucucuuaauuuuuuuuuacuuaaaaccagaaaugaauccugagcaugcauaaugcucuggagaguaaaauacaacacguagaaguucuaaguccuuggagcugaaccuaaggaagaggcagcuguguucugcagguggccuaucucucuaggugaaaugcacagcucucuacacaaagaaugccuuccuagauaacacccaagcucccaaccgccccucuccuacaaaaggacuuaucccaaggcacuucuauuaaguuaagcauuuuggaauaguucaacuuaucuaucuaaccuucuucauuccuaaacagacugaaggacaaauggcagcaguaacaguuauuucacaguauuagucuucugauguucaagugcuccuauguuccuuacaaaagcuucauuacuuuguggaucaccuuuagcuguugcuuuuuuaaaaaauauaaaauuaaguuuaugguaggaagagaagcaauguaaugauuaagauuauguuuuuaaagguuuuuaaaagaccagguacuuauauuuucucauauacaccaaagaaauucuacgaggagguauaagaaaggaacaucaucacacaggacacacgggccagugaggaaagaaccugcuggacggggacaggggugggggucucacuguguuaccuucugacauuucugagcuaugcauuaccuauucaaaaauuaaccuuaaaaaauaaauaacgaaaaaagaaacaaauacuaggacccucucccuuuucuauaguuuccaaaugaagagugaaggaacaaggcuuguaaacucccauuacccaacacaaugccaggugucgggacacagagguaaauaaaacagcucaaggugguaggaacccaaucagggaggcaagcacacuuauucuaucugcaauuguucuguucuaucaugcagacaaccgacccaggguacagaggccuggggaagccuggagguagagaagaaacaagggaaaucaaagaaucgucguaaguaguagccucggcagggucuucaggguucaacuuaggucgacacagugguuggugggagaagggcggagccacccaggaggcagaggaacaguaaacugagcaugcgugcugcaguaugaauggcucagcgucacugacgugcacuccuuuuacacaaguguguacaguccagugauucugcuuuuuacauuucaguaugaauuccucaaguuucaggaguccucaaaacaccuaccugauuauugguaaagacccugaaaaugugaaguucugcaucuggagcaaauccuuggcacucccucaugcuggcuaucacaccugccacgaaugugccauggcccaacccugcaguccauaaagaaaacaaucccauaaaacacacugaauagcaagugccaggacgcaacauuccaggccaugaguuccacggccuuccauuuccaagugcuggauagaggagggccucugcugcugcucuacgauccccuuagacgucacuggcacaagcaccccuuccaggucuagccacuccacgcucuccgggacagggagcugcccccacaccaggcaugcccacucucuccugaagugcuaccucccgacauccuaugagguauucagagcaguuucugccacaacaaaaagcacaauaacaccuugggcuugucugaauaauugcuggacagacuguggaaucaugcacuaaacacacucucagucgaucacaugaccacguucucacugcugcugagacccaccaucguccagcguucgcucguugguccaguugguucucuccuucacauuuuugaaguggggaugcuucucgcucagcccagugucaaaaacagcaacucuuacauuagcaccuuauucggaaaagaaagcaaacacaauuauguuugaagaaaucaucauuuuggauuuugccuauaaaauacauuccuuccugggacccacagaaaaugacauauuguggaaggccaaagcugcucagagcaaauaaguuaggucagcugcucccagggucagcuggcugagccaaggcuaagaaaagaggacagcaggagcaaugccaucaucugccgccaaauaagauuuaaggauaagcagaaaauccuucuagacccuccucaauugccaccagcacucaggauagaaccaccccuuccacuccuagcgggcuucucaaggcuccaggcuggcaccuacugauacuccccuucuggcaauuuaucacaggucuccaccccccaccuucucggaggcccugcaaaacacucacaaaccacacacccaaggagcgggacacaaaaaugggaaaagggggaaccauuccuauucccaauaaggacagcaauuuauucaaugcugcucauuuauaauacagcaaacucugccgcaaggaacaauuaacaccacaugcggcuaaucacaccuaagaaaaaucacugcagugugcacuuuucuauaauaguaagucuauuccagauacuggccaaagccaucaacaccaaugugaaauacaacuggccugucugaccaaaaauucuagaaagcaucuagaaaaaaaauacagaauaccuauaugacuuaacagcuaaccaauguaaagaggguaaugucuuucuggcaaaagggcuguguacauaucaauacuauguuaaauaaucuauuaaacugagauaaauauaaaaaucaaugcuacuuuuaaaaaaugcacacacaaaaucagaaaucauuugguuuggggggaauaaaaaauuauuucucaugacuagaaaauuuguuuugucaaggaguucucauaaaaagguaaaaccauggggagacacacauuuuaaugaaaugccaguccaccggguauuaaaaguugaaguaucucagauauuuuggagggcagggcgccaaggagaucaaaggagagguaagggucccuaagucaaggauauacgaaagacaccgaggcaaacugcgcuguccugggagcaggugaaacuggcuuacauuuagaagucaagguaaaaaucuucacauuagauaaaacaugaagguuuggucaugaugaaucagcaagggaaaaauccuuauuguucugaauuuuauuucacaggacaugaucauuaacacugcuuccuguucugaaacaaaucaucagcaggugugauagucaauuacuuagucacucugcauucaggacaccaaacucaagugauaaacuaauuuccguggaauugcccagaucagggaccaucuuuccccaagaagugacagacuucugcaggccugucggucagcgccaguggccggcagcgcugugcucguuuguguaugugucaauaggagagaagugcuccacagccuucccuucuaaccucagaaaugguaacaaaaauaagacacaaauggugacaauuaggaaagccacagaaacagaugccuggcaucacaggagucaaagaugaggaguacuuggcuaccuccagcuaaacaaauaguaagaagguuagauguggaaggcugcagggcuuuagcacuaggcagucccgaacauggaauuccugcaugucuggacuuuccgcgccuucccuggguaauagcacacaccuguauaucccauaagcaccuucccuggguaauagcacacaccuguauaucccaucugccagagcacaucugccugcagugucugggcaaccuggcgcgggauggcucucagcagccgucugcucgaaugccuucccguagcaugccagaagccagagcccagggagaggcuggcucuucgcaggggacgugaugauugccacuucuggcuccaccggguuucauugcaggguacuguggggucagcuacaggcaagggagagaaagaucagaacagaagagcaaaacgaacuacacgauacccgccaggcaaaacuauccuaaacacagggaggauuaccauuugccacucuguuugaaggaaagugggauuaucuucuuuuucuggaaggacagucucaaugcaauuauaauuauaggacguuauuuagcugucauauuacucccaaauaguucucuacuugaaauuuucuaaccaagguaaggcaaagaaagacugauuaaauuaaauaauaauaauuuuaaaaagcuaauugugauaauaaaaauaaagaaaaaccugauuuucaucagcaacuuguucucacugaaccagaagggggaaaaguuaaagaaaaugacccuaagcauucauugaguuuuauuuuuacuauaaguuucacuagauuucuugggcaggcaaaagccaucaaauaucaacaggacuuaaaacaacuguauauugcucaauauucucaauauucuuaucugcuagaauuucaccuuucaaaaacaaaaggacuacacaggagugagagacagggaauuucugagggugauggaauuauuccauaucuugauuuuguugguggauauuugaugguauacuuuugccaaaacuugccaaacuauacucuaaaaaggacgaauuuuacuaucuguaagucucuuuauuuuuaaaaagcggaggaaaaaggcaguaccacagaaauggccuaaggguuuucccuuaaccuuucaaagaccauguuauaaugaacaagucauauuucaaaucaguuuuaagaagagaaaaucuguaauaccaauacaguucucuuucuaaagcaaaucacugucauuuuuauucuagccuuaccaaccuacacccauguuaaguacagggaccuggaaacacauacagucacgucaauucugguaaguaaauauuugcacaguccaacugaaacgguucuuaauugaaauuccucugcugagucugaucuuuaagucaacagcaugggacaaugcugcaggugcugacugaagagcaacacugagaccaggaaugggccugcucugcuugacccugcacaggccagacuccaccuccaguauuauacucaguucagggcuucacagcuuucaaacaauuuagaaaaauuaguacauucaaaggaaaacacuuaaaaugaugaggggacuugaaaucaagucaccugaguaacuauggcaagaacugaggauuagccuggagagaaaaaauugccaaaagggacacaccauggguaucuucaaauaucaaaaagacagcuaucuucaccacaucuuuaacuacugucacgcagaaaacagauaggcuuugucuuauggcccaugggauagaaccaaaugggugggaugcagagugagaauggugucagcccaaaauaaagcaaaaccuucuacgaguaacagccagagaaacuguuaacauuugguuacuuacaacaucuugaacacucuacuaagcuuucuucauaugcauuauuucauguuaucuucaugacagccccacgagguagggaguaucaucuccauuuuaugaaugagaaaaacugaggcuucaagauggaaaagacgcuuacugcugaaggucacagcuaacuucaaggggcaugggaacgcagugggcaagucuccccucacaggggugucaggcacccggaacacacgcaguggagaugguguccaugggaaucccaucuccagagagucuaggauucuugugcuaaaauuaggcaacuccgugucuccuaaagcauucuagagcucuuuaagauaacugaaguaaaaaauaaagucaacuaaaauaccgcaauguauacauuuggcuaacuguaucagguuugauuggcuuuuaucuuccuggauuauuuugaaguguuacugcuuuuuaaggagaauaauacauaacaucuggaguagcagaaaaggcucugaaaaagucagacgccuuaaguuuacaccugguuuuacuaugaaaauuaaacuucucuucguguguguguguguguguguguguguguguguguuuguguguguguuuaaugcagcaaaaccucagaggcucuuaggccuaaaauaugauagacaaagaagaguaaaauuuuaauuucuucuuccuucugaugaaagaaaugaucguaaauaauaacagaacuagaaauuuguuaaccugauuuaagauaaacagggaaaaaaaacccuuuuccuuugguaacacauaucuuuggaaaauaucauuuaauaaauaugcaauuuacuauuugagacuaaacucuauuuugacaagcccaauuguaaugaaguaggaaagacuaagcccuggagaagaaaaggaaaagccaaguugcuuccaugcucacaccugcacagcugaugacuucaacgaacccagcugaugcaugaccauuccuggucaggaggcuuugacaaaaacaaaacgaaaccccaggaaaacauguuuugcaagagugccuuuaaaaaucgggcugggugcagugacucacgccuguaaucccagcacuuugggaggcugaggcaggcagaucaccugaggucaggaguucaagaccagccugaccaauauggagaaacccugucucuacuaaaaauacaaaauuagccaggcaugguggcgcaugccuguaaucccagcuacuugggaggcuaaggcaggagaaucacuugaaccuggguggagguugaggugagccaagaucgcgccacugcacuccagccugggcaacaagagcgaaacuccgucucaaaaaaauaaauaaauaaaaaggaaaagaaaaaauaaaacacacacugagagaagcgaaaugcaaggaagaagcagacacaaggacgcgucuuucagcacgagaaggcggccgcagccuugaagucugaaggcuuugagaugaagcuggcgaaaaucgcuuccaacagaaacaaagaucacuaccaucuacuacugcaaacccucagauuuucuucuaccagaacaguacgaagucucuuuuuaaaaaauaauucugcccccccaacaccgacccugcgcacuaaacaaaacuaaacuaaaaaauuccuaccaggaaaauguucacaauuagcaaacuagauggaaggaugcggauacucacuguacuauuuuucaacuacucugcaguuugagauuuucaaaguaaacagcagagagaaauuugccuacagucacaauacucacauucagcauacuugagggaacgaaagacuuuucguuggggcgugacccguuugauguuuggaugaucuucaaguguuagcagccccgcuuucuguuuuucuuuuaucugaaucaccucaaaaucacuaggguagucacuggauggauuguuucgagguauaauucuccaauugucuacuucacugcucuucagggcacuugaaauaaaugaauuucuagcuuuggcuguaaaguauccauugaaagccacaauauauucugaaaccaaucaccacaaacaaaaauaagauuuacgcacauacauuauaacauauacuauauuguaucuaaucuaaaaucuggcaaaagaaaaauuaucuuaaagcccacagcagacgagagaaaacacaaagacuaguuuaaguaccuagacagcugucugcagagcuuugaggaaaaaugaucuauauggggcugggcgcgguggcucacgccuguaaucccagcacuuugggaggcugacgugggcagauuacgaggugaggaguuugagaccagccuggccaacauagugaaaccccaucucuacuaaaaauacaaaaaauuagcugggugugguggugggcgccuauaauccugggaggcuaaggcaggagaaucacuugaaccugggaggcggagauugcaguaagcagagauugcaccacugcacuccugccuggugacagagcaagccuccgucucaaaaaaaaaaaaaaaaagaucucuaugaaucaccuaaccacaaagaauacaucauucgaaaccagauacccgugauauuuuuuuaaaaagcaaauaccuacagaaguuugaauacacaacaaagaaauguauauaauuuuuaucaaguaggaaaaagaaauucagagaacugaaugcucaguuaguguuucuuaaaacgaaaacaguaacaaaauuccagaguggauuaugugagacuauuugcucaguucuucacaucuggucacucaaacuuuagaacauaaacauucugcaccucccagcuccccaccuucaccaauuacaauggcaccuguuccaaagaaucaagguguaggcugggcacaguggcucaugccuauaaucccagcauucugggaggucgaaguggauggauugcuugagcucaggaguuuaagaccagccugggcaacauggugaaacaaaaaauaaaaaaauuagcugggcaggccgggcacaguggcucaugccuguaaucccaacacuuugggaggccaaugcaggaggaucaccugaggucaagagugcaagaccagccugaccaacauggagaaacgcagucucuacuaaaaagacaaaauuagccgggcaugguggcacaugccuguaaucccagcuacucgggaggcugaggcaggagaaucgcuugaaccugggagguggagguugcggugagcugagauggugccauugcacuccagccugggcaacaagagugaaucuccaucucaaaaaagaaaaaagaaaaaacaaaaauaaaaaaauuagcugggcacgguggcaggugccuguagucccagcuacucaggaggcugaagugggagaccacuugugccugggaggccaaggcugcaaugagcugagauggcaccacugcacuccagccugggcgacaagagcaaaacucugucuccaaaagaaaaagaaaagaagguguagguaaauaauucaugucaauuuccuuuuaucauauaagcuuacucuacugggaaaacaaacuuaagcaaaguuaacauucaugugcugugcacucaacccauuggaaauuuacuacagaaggccaggcacgguggcucaugccuguaaucccagcacuuugggaggccaaggagggugaucacuugaggucaggaguucaagaccagccuggcuaacaugcugaaaccccgucucuacuaaaaauacaaaaaaaaaaaaaaaaaaaggccuggcacgauaguucaugccuguagucccaacacucugggaggccaaggcaggcggaucacgaggucaggagcucgagaccagccuggccaauguggugaaaccccaucucuacuaaaaauagaaaaaauuaacugggaguuguggcgggugccuguagucccagcugcucaggaggcugaggcaggagaacugcuugaaccugggagguggaaguugcagugaaccgagaucgugccauugcacuccagccucagcaacagagugagacuccaucucaaaaacaaaacaaaacaaaacagaacaaaucaaaacaaaaaauuagccagggacgguggcagucaccuauaaucccagcuacuugggaggcugaggcaugagaauugcuugaauccaggagguggagguuacagugagccgagaucaugccacugcacuccagccugggugacagagugagacucugucucaaaaaaaaaaaaaagaaagaaauuuacuguagaaaagaggaacauguuauucagcaauagcuaauuuuauauuaaguaagcuuuaaaaaaauaggaugggaguuccuaauacuuaagacaacaucauuaccauauuccacaacuguugaugagaauuccaccuucaaagucaggugggaacagccagggcauggggccuuuucaaaagauuucuuuuccagucugucgcccagauguuucuucccacagagcaaaaccacgagcagaagcagccagauguugacaagcuucauggucacaagcgaauaugaucauaaaauugcauauauucaaaucacacuuuuuucuucuugauuaaaagugaauuuuuguuucagcuaaaagcugcaacauuacuaaucagccaucuuacagucuugcccaacauaaauaaaaguuaaaucccauggccuuuugugguucagccugaagagaggcuuucauuucuuucuccgcuucuucuccaucuuggaaauaaggcuucucucacucaggccgugacgacugaguccuguacuccauuuguaccacagaaccaacguccaaugggguugaucaaucaaccacugugagccaaucuaugaaacaaaaaacagugcacacagacauuaguagcaaacugacauagccagguaugauuuaguuguauuuauaauuuaagcaagugggucagccaggcaagguggcaggugccuguagaucagcugcuugggaggcugaggugggaagaucacuugagcccaggagucugaguccagccugagcaacaaagugagacccuaugucuaaaauaauaaaauaauaaaauaaauaagaggguaaaagagauauccugguuuuaagacaaauuaaugugccauacaaccaugaaacauauuauuucauuuuuauuuacuuauuacucacugcuuucacgggaaaauuuuuuuuaggcaucuucaaaaauaaaacaauaaaaucaaugagaaaaauggaaaaaaguaaggacaacaaaauaacaccaaaaauauuaagcacacuggaccugagcauucuagcagccaaagagaagaaggcaucaggaugauccuuuguucuguuucagauucuguauuuccuaucauuugcaacucaauccccagagcauuuccccaguuggcacuuuuacuucccacaaauuucaucaauuuuucaggcaaaagcuugguauaaagccuuacuuucugcuguaacauuaauaccuaacagcaaaguaauuucccuaucagugauauuuaacaccuucuuuaagaaacacuaugcuuuaauauuacauaguuugaaauauuuucuaccaauucuaugaaaagagcauaaaaggguuuacuguccugaaauuuauuuuaccugaaaccucacacuuaaagaaauguaaccugcuaaauguguuauaaaaccagauuaucucuuuacuggagugacaugagaagacaguuugugagggaaacuacugcuaaagaaaaaugucaccugaauauuaaauuaagcaugcgcacagauaucuuccaaaacaucugaauuguaagaaaaacugccauucuucacaaugaaaacagagcgauaguaaagaacaaugcuggcuguagcauaaccagaaaaacaguugcacagaccauacccggggcguaaauaauccagcaggguaggggauggguaaaugaagcaagagaggccuuccagugcuacuuaggauuuuauuauuauuauuauuuuuuuuuuuuuuuugaggaagggucucacucugacacccaggcuggaguggguggcgcaaucucugcacaguucacugcagccucaacuuccugggcucaagcaauccuccagccucagccucccgaguagcugggacuauaggcaugcaucaccacacccagcuaauuuuuggauuuuaauauagagaagcagucucggcauuuuguccaggcuggucucaaacucaggugauccagccaccuuggccucccaaaguguugagauuacagacaagagccgccauguccgcccacuacuuguuuuuaaaaagaaaacauuaaggacaaggaguuaagucaucuauuacaaaagguacuucaagcuguaaaacucauucuucuggcagaaacuggugcuucugaguuuuugguuucuggaaauaucaauaugugcuucuacgaguagaaaaacauugauaaaguaccgugagggguuaaaauauccaaaaaacguuuuuacuuuuacuaaagagggacuuucacugcuguacuaacaacugauccugaaaaacaagcccaucucuggcacuggcacuggcaacuaaggggcguggaacucaucagaaaugagucaaaguuuaaagcaguuacauccaccucgacaagaacaacaauaacaaugccaacugcaagagcaaaaacaaagagccaaacagaaagaucagaaaagcagagggcaccuaaagccacccuaacagguuugacagaaguuugcucaggaguaagccccuacuucuuaguuucuuuaugcuugauacauccagcaauggaguaccaaagaaaauaaugacaugaagcauguaucuagcuuaauuaaagacuacuggccgaagaagauaaaagccaguaauaacaguucucauaucacaguaaaugaauauauauuuaaaagauauuuauuaaaugcguuucucacucaaggcaggcuuuuuguuguuguuguuaaaaaggaaggaacaaucauuugagcccagagguuugagaccagccugggcaacguggagaaaccucaucucuacaaaaaaaacauuaaaaauuagcuaggcaugguggcgcgccuauagucccagcuacucaggaagauugcuuuagccuggaggguugcagugggccaagagugcaccacuacauuccagccugggugacacagugagacucucucuccacuuaaaaaacaaacaaacaaacaaaaaagccucuuaaaacuuuucugccucaagcuaaagaaucuaugacacaugugggcuccauauaacacaaauauaauuaaguaauaguacugagaaaaucuuagaccuaacuggguuaaaucaacuuuaauucaaccuguucuaaaauaauucacucaaagguaaagacucuuagguaagaaauuuuaacacagcccaugcagaagagauggcugauguucucuuacaacuuaggcagguacuugccuuuaaaagaaaugaaaagaaaggauuuggcgguuuucaaaugaaaaaaaggccaggcgcgguggcucacaccuguaauccugggugugauuccacuuuaggaggcugaggccggcggaucacuugaggccaggaguuagagaccagccuggccaacauggugaaaccccauaucuacuaaaaaccaaccaaccgacccaaaaaaaaaaauacaaaaauuaguugggcauuguggugcaugccuguaaucccaacuacuccggagggugaggcaggauaaucguuugaacccaggaggcagagguugcagugagcugagauugggacacugcagcagucccgccugggugacagcgagacucugucucaaaaaaaaaaaauaaauaaaugaaaaaaacucucuaagguaaucaguucuuccccaaauuaaaaauaauaauaaaugugggguauguggaaaacagagaaggcaauuauuaucauaagacauuuuaccuuaacucauucauuagaucaggcaauuuuagaauacuuaccaaguuaagauacuaucagguacuacagaacaaacacggacuauuagcuagucagggcacaaccuuccaagugugauguaguuaaauuuaaggacaacuaaacaaaaugcaggaaaugaaaaugugaaaggagaggcaggcauccaggccacagaugcugaacugacacacaguucucuccgggcugugaagaggcggcuucugcuggggagggggcacugcagcagcucuggaagaaucugagcucaguagcacugaaagaugggcgugagggagggaggagcagagcaucccaagcguggcaacacuggaaccacaggaagacacagaugugcacaaggaucagcacugcccagccugaggagggaggcaaggagguguccgucuagcgaggcugaaagacgaggggggaagagaggaccucaagcagguacaccccagccaacagccggaaauacggaccucuuccauccaauggcagugaagagcacagagauaaaacacagcccaacgacgagacugcugagcuccuguguucacccauccaacucaucuagugagaaacuacuaaaagccaggcacuguucuaggaguagggauagaguaaugaacaaaauaccauagaaaucucugaccucacggagcuuaccuuccagugcagggagacagaccguaacuaagacaaguaaaacauacaguauuuagcuggugauaaaaacuacauuugggaaggagagaaaacagcuaggcacgaugggucacaccuguaaucucagcacuuugggaggccaaggcggguggaucaccugaggccaggaauucgagaccauccuggccaaaauggugaaaccccaccucuacuaaaaacaaaaaaauuagucgugcguggcgacaggcgccuguagcuccagcuacucaguaggcucaggcagaagaaucacuugaacccaggaggcagagguugcagugaguugagaucgugccacuacacuccagccugggcaacaagagcaaaacuccaucucaaaauaauaauaauaauaaauaaauaagaaaacacaaagaaaaggaauaugacaagucaggagagggcuggguuucugcuacagcacuaccuacagcagcugcugagaaggggucuuuucagugaaggccugaaggaugcaggaagcuggccaagggucuggggaaacaggauccaggcagugggaaagcaagugaaaaggcccuggggcaaggaccauuccuggugugugugugaggaaagaaaggcaaagaggccagcgggaagcaagggaaagccaaagaugaaaucugaggaaaccgggagacagcccagggaaggccugcaggucacagaaaggacuucagcuuugauucugacugggaagagaaagcaugaggcaguccugagcacguguggcuuguguuuuagccagaucgcucuggcuucgguguggaagggggcacaggcugaggcagggagcaucuggaggacuuccguacaagagccaagggagagaagaugcuggcuuggaccagggcgggcaggggaggugauaagaggcgaugacauuacagauacgaaggcagaagugacagaugggcuguccaccagaugugggggcacacaagugaggauucaaggcaacaccaaggcugguugcccgacuggaccaguggugcuugccccuaauugagauggggaagacagcaggaaagcugacuugggagacaccagcaggagcugagcucugagcauguucaauuucggaugagccucagggucaagggcacggcuuagggcagaaucccgggcaauccaguaccuuuucuuucagagauggcaaaagacagagggcacaggaaagucagaaggaaaccaaaaucagugggaaauaauuugcaaaaggaaggugggcaagcugaagagacagagaccacuagcuuaguaacuggccccuuccagaaaagggccacacuagugagcgggugagccuggccgccagacuguaccuuaccaagccugucaacuccagcccaccugcucuagucaccaagccaccaguggcuggaaggaaggugccuucaaguguaaaaaucccauggggaugaaugauaaggcuggaaaugacagggacaaggacacacccccuugcuguguuuggaucucguggacuugcuugcguuccuaaaaggugagcuaaaauccaggcucuaucaagacuauuucaaaggauuuauggcucaaaaaauauggcaacagauccugagguuucuauaguuucccaauccuagaauaaggugguuucaaaauauaaauuuccuuuaaggaaaacaaaaaugccauaacgggggcaagagaccaguaaaugauggcagagggacugggguccccaaggcugagcuuauuaccaacccccgaacuccugggccuauuuuuuuuuuuuuugagacagggucccgcuuggucacccaggguggaggacaguggcacaaucaugguucacugcagccucaaccucugaggcucaagugauccuccuaccucagccuaccaaguugcacggacuacaauacggcacuauguccagcuaauuuuuuuuuuuuuuuuuguagagaugggggucucaccuuguugcccaggcuggucucaaacucccaggcucaagauauccuccugccucagccucucagaguguugggauuauaggcaugagccacugugucuggccugggccuaaagagaucuuguccccacagacucacuagacaagucagugaggcuuugcaagcacagacugcacuuuccagggucuaauacaucuauucagcugugacgaauggucccuccugguucucacuauacaaugcaaacccgaugggcacacuucccaagaugggcucaccacugagagguaagcagacaagcagcagcaggacaggcagacagagcaugcacacacagauacagacacacaaaccuaaggaaaagcacuguuuucuucuuuuuagauggagucucacuuugcugcccaggcuggagugcaauggcacgaccucugcucacugcaaccuccaacucccagcugaagcgauucuccugccucagccuccugaguagcuggaauuacaggcacacgccaccacacccagcuaauuuuuguauuuuuaguagagacaggauuuugccaugcuggccaggcuggucucgaacuccugaccucaggugauccagcaccugccucagccucccaaagugcugggauuacaggugugagccacugcgcccagcccaagaaaagcacuuucuaaagagugcuaacucugccuuuucuucuucccuuccugaagaauucugcugaagacaagaaggcaggcguucaugggagaauggcagaagcccacuacagggucuuaagagucugagcggagugaggaagguaugugaagggagaggcaccaggugagggggucagagccuggcaagugaagaaggcaccaggcaggcaguggggugauagcagugaagguaaaacuguuugaucaaauaaauauuuuacauauaaugggaugcggcuuucuuacugucagagaagaaaguuagaaauaugaaagagaaaaaauaaaugaaccauucaguaucagaacaaaaugauaaaugcuggucugaauuuaagguuuucaauacauagacuaacagauguagaaagaaagaaaucuaagugcacguguacgugcuacacacauuuccuagcuaucuccaaaaggguguggcagcagugaaaucccaacagcaaggagcccaccuacugcccacaauugguucuaaauaucacucuccacuaaaagaaccuaggcucuuuggacaaagaacuaguuccagucuggguacgguaagaacaagauggguuuggaacagugucacucaaugaggaaaggcucacagaaugauggggaaguguccaaggaacauggaagccaguuugguggggcccccacuaacaaaauccgggacaaucugagcaucacgauaaauaauaacagaucccaacccguggaauaaaacaggaaaacaggaguccacaaugacaugaaguuugaaaaagaaugagauauuuacaucaugucaaaaugcccaacugccaacaaaauaucucuuuucaaagggaaaagucauuuuacaguggagaagcuccaccaaguuguccaagggaagcaguaaugggacacacggagccaggucuacgagagcagaugcacugagaagagccggcaucacuucugggagguuccugacaaagaugcacaaccugaaaucaaaucaugagaaacaucagaccaacccaaauugagggacauucuacagaaucaacuggccuagaauuuuccuaagcaccaagguaaugaaaggcaagaaugacugagcuacugccccagauugaaggagacuccagagucagugcaacucaugaauccaaacuggauccaucugcuguaacaggcacucagggacaacuggcaaaacccaaguaagccugcccguggaucagaugguagugauguaucaagacuaauuuccugauuuugacaacugugcugugauuauguaagaagguccuugcuuggaaaauacacccacuaaaacaccgggggauaauggaguaucaggucugcaauuuacucucaaaugcuuuagagaaaaaaugguuucauacuguucgugcaaccuuccuguuagguucagccuguuuccaaaacaggcagaaaaaauaaguucuuuauuuacccucaccugccaaggacgcaugaggcugggcuauuuuaaauguggugacaggcacauucuaagccucuuauucagauucagucagugcugaucacugcauacauaaccagaccacacacgucagacagauuuacacucaucaauuguuacguagaaggacauccaaagaugggacugagcuaguuaaagggaaacuaaaagcauaucucauucuaggaaauugacagaauuccugaaaggauucaugguaaauuucugcuaacauuaaccuguguuucuaugauuuacauuaaacaaaucaaguaacauuuugacagaaaaaccugaggcacccccucuagaauaaaaauuauguuuauuaaguuaacaaauccaauaaaauaaguacucucauauguugcuggugaauauuaaaaaaaaacaaccuuuuagaauggcaauuuucacauauguauuaaaacgcuuaaaaaugaacauuaaaaacuuuucgucuaacaaauccaaaauaagaaaaacacucacugagcauuuaugauguagcaggugccauucuaaguagucugcaaauauuaacuaauuuaauccucccaacaacccguuacuacccccacuuucagaugagaacugagacccagaguagcuaagcaacuugccuggggccacaacaccagcaaguagaacagcugggcugagaacucagguggucagccuggcuccagaggccacacucuucagaggcaggucgccugcuuuccuaaaaucuccccuagggauucaauccaagaaguaugaaucuggaagcacauaaggcuuuauguccaaagauacacacugcaagauuaugagcaggaaaagcuggagaccaucugaaugugcauaaacaaggagacuggcucaauaauuauggucggugcacaccacagaacgccacgcagcaauuucaaaugcuccuccugcaguaggcugaaaaaugguccccacaaagaugcucacauccucauuccuagaaccugggaauguuacuuuacacacaaaagcauacaggccaaagggacuuugcagcugugacuaaaugaaggcacugagacaguauccucggugauccaggugggccaggugucaucacaagggugucuauaagagagaggcaggagaugacaacagguaguaauagaugugaugaugaaagcaacaggcuggcugggcacaguggcucacgccuguaaucccagcacugugggaggccaagucgggcagaucaccugaggucaggcguucgagaccagccuggccaacauggugaaaccccgucucuacaaaaaauacaaaaauuagcuagguaaugguggugggugccuguaauccuagcuacccggaaggcugaggcaggagaaucacuugaacccgggaggcagagguugcagugagccaagacugugccacugcacuccagccugggcaacagagagagacuccaucucaaaaaaaaaaaagaaaaaagaaagcaaucaagagguugagauaauuugaggaagaagucaggagccaaggaacgcagguggccuguagaaacugaaaaacaaaaggaaacugauucucuccacagagccuccagacggagacaacccugcugaaacuuugacuugagcucagugaggcggauucuggacuucugauauccagaacugugagacaguaaauucauguuguucuaggccacuguuuguggucauuuguuacaauagaaauauggggaaaugcuaaugaaauguuaaguaaaacaguucaugcaccacauaauccaaauuuuuacauuucaauuuuaaaaugugucuaugagcaaaaaaaaaaaaaaaugcagcugggugcgguggcucauuccuguaaucccagcacuuugggaagccaaggcaggcggaucacuugaggccaggaguucaagaccagccuggccaacauagcaaaacccugucucuacuaaaaauacaaaaaauuagcugugcauggugacacaugccuguaaucccagcuacucaggaggcugaggcaggagaaucgcuugaaccaaggagguggagguugcagugggcggagauaaagccacugcauuccagccugggcaauggagagacugucucaaauggaaacaaugacaacaaaaaaaaccacugaaagacacauaccaaaaugguuacagugguucuaccuuucaauuguaugauuacagauaguuaauuucugcuuuaauuuauuuguuuauagggagcauauguuacuuuuauacuuagauaaaacauauuuuaguauuuuuaaaaacuuuucaaauaaauugguucacuccuguaaucccggcacuuugggaggccgaggcaggcggaucaugaggucaggagaucgagaccauccuggcuaacacacugaaaccccguuuccacuaaaaaauacaaaaaaaauuagcugggcgugguggugggcuccuguagucccagauacucaggaggcugagacaugagaauggcgugaaucugggaggcggagcuuccagggagcugagaucacgccacugcacuccagcccgggcaacagagcgagacucggucucaaaaaaaacaaaaaaaaacaaaaaaagaauacgccgggcucgguggcucacagcuauaaccccagcacugugggaggccgagacgggcagaucacccgaggucaggaguucaagaccagccuggccaacauggugaaaccccaucucuacuaaaaauacaaaaauuagcugggugugguggcacacaccuguaaucccagcuacucaggagguugaggugggagaaucgcuugaaccugggagacagagguugcagugagcugagaucaagccacugcacuccagccugggagacagagcgagaugccaucucaaaaaaaaaaaaaaaaaaaagaauaaaucauacuuucugguaagagaguggcacaaaaauucaaauauauaugcuagauuuaauuuuauuuguauauauacuagagcuuaaaagggaucuaucuccuacaaauuguucucaaagaucugucuacagcuacuugccagccuaaggaaaagauagccuuugaaaauauuaaacuuuuggcuaguucauucugaaaggcuuauuaucauuuguaauaucacuuaacuuagagagccuacuuagggcuguuacuguauccacuaaauguuaacuggauuuaauuucuauaaauucuuuaugcagaagaccugguuaucuuuccauauaaaggcauaacguucaaagaugguauucccguaccuauggguuuuucaugagaaugauuacaccucuaauacacguauaauuaaaaauuuuugacaucaaguacuaacugaaaaagacaccguucaaauuauagaaauagaaaauaguauuuaaugggauuugaguagaagggagacucaguagaagaaauguauuacuugcgcaagcaacuggccuagcugguggcuagcauucuuugcagcucuuggagucucccacuuacaauuuucacaauaaaagaauaucacaaagauuauaauucugggcauaacuaaaauacaucugaaauuaucucuuuaaaaauaauuagaacauaauuuaggugagugaaaaugacuuguaucacccgacaaucaucuaauuaugcagcuaugccuugcuuuguaauaaacuaguuuacuaaaauagcuccaaaggagacugaauuguguuuagaccacgaaagguuacuauccaguccaauuaaaagucggcugaaaaacuaccaccuucagaacuaauugcauacuuggcuauauuaccauuguuuaacaggcuaacaauuaagucaugccagaccaaacuaugguaaaacaaaggugucuucccuuuuuuuuuuuuuuuuuuuucuuuuuuugagacggagucucgcucugccgccaggguggagugcaauggcgcgaucucagcucacugcaaccucugccuccgggguucaagcgauucuccugccucagccucccaaguagcugggacuacaggcgcaugccaccacgcccggcuaauuuuuuuguauuuuagagacgggguuucacuguguuagccaggauggucucaaucuccugaccucgugaucugcccgccucggccucccaaagugcugggauuacaggcgugagccaucacgcccggucgacaaagguguauucggguguauucuuacauccgaugcaaccauuuauucuggcacacuccauccaucagguggucuuguauuaaaaagaaaaaaaauucaucccaauguaucacuacagucaagagugagaaaccuuggucuguggugucuucacugccuacuguuucacacacaucacucuugucuccuuuuauucuuaccccuuagucaugcaguauuagcuggccacacauagggcaccuccaaacuucuaacuuccuuauuuuacuuuaaaaugccuuuccucagcugggcgcgguagcucacgccuguaaucccagcacuuugggaggccgacgcgggcggaucaugaggucaaggagucugaaaccagccugaccaacaugguaaaaacccgucucuacuaaaaauacaaaaauuagccgggugugguggcgggcaccugcagucccggcuacucgggaggcugaggcaggagaaucgcuugaacccgggaggcagaaguugcagugagccgagauccaccacugcacuccagccugggcgacagagcgagacucugucucaaaaaaauaaaaauaaauaaagcguuuccucaagcagaauuccgcagcacugauggcagcaauguacaguucaccuuagccuucagucuuccaaguuuuuuuuuguuuuuuguuuuuugagacauagucucacucugucgcccaggcuggaaugcagcggcgugaucuuggcucacuacaaccucugccgccuggguucaagggauucuccugccucagccucccgaguagcugggauuacaggcgccugccauugcgcccagcuaauuuuuguauuuucaguagagacgggauuucaccacguuggccaggcuggucuugaacaccugaccuugugauccgcccgccucggccucccaaauugugggauuacaggcgugagccaccgcgcccggcccagccuuccuaguucuuguuaaccuccugacuagaagagcucccacuucuucccuaggugcuucaaagguuccgcaagcucugcauuggaauuuucccuuuuuauauagaaaggaccaacucuugauuauacggggugccuggggagugcagucguuugacacgugucugggucaggucccagcucccauucucaaucaacaguuuugcugucauccgcaucacacauuagagcauaaaauaaacuuuuauuugucaaaaguguucugcauaaaugcuuaaacaaaaugugguauagccauacaacugaauauuauuuggucauaaaaggaaugaaauccugauucaugcuacaacauggaugaacugugaaaacaugcuaagugaaagaagccugacacaaaaggccgcauaucauauguuuccaucugaauauacgaaauagucauuaaaggcaaaucuagaaagacaaaguagaugaaagguugccuguggcggggccuggaaaugggcauugacuacaacugggcaucagaggucuugggguaacggaaauguucuaaaaguggauuugguaguggcugugcugcuguaaauuuacuaaaaaccacugaauaguacacuuaaaacagguggauuuuaugguauguaaauucuacuucaaugaagcucuuacauuaaaaaauaaguauaaauaauaaaagcggauucuccagauugaaaaaaaaaaaaaugagaggaauuacuucucuucugcaagcccuccuuuucguagacauacaauuggagaccuugacguuaggagggcuuaccuacacaguucagacuaaaggaugagucuccagaauucaacgcaggucguauuccacuccacguaauuucgaagugucaaucagaaucuaauaacuuaauuuguguagacaaauaggccaagauucucaggggcucaacccaauaugaaagguaaacaucuuaauaaaaauacugacgauccacaacggucuuagguagcgcaaccaugccaaggcgaggcaagauuuuuaagaagcuacagguuuaaaaggcaaucugguucugagaguucgccgaacagaauccccgcauuuccaaaaaccagcagcgcaauaugcacagaccgagauaaggcaaagaaucgacgucuuuuaaaccugacgccagcacugccccggaagcgcaccuagaauugagucugucuggaggcuccgggccagagcagggcguauuguuucacucggugaaugcucauuucacguaaagaaaaccaggcaacggaacaagcugccggagcgcgcagacccccgcagggccgcgguacaggcacgcuguguccaaacaagcgccggaggccccgcgcccaccucccccgacccggcccggcccccgcagcccucgccucggggccucggacgcaaccggcacaccugagcgagcgggccgccgccgcuaggcggagcgggucggggaggccgcgcgcgggcggcugacguaccugcgccgccgggagcucagggccggcgggcccgggauaacggcgccuccgcggcgaacacgccugggcacuccauucggggcuguuuacucccaacucucgcgagacugggcgacc

SEQ ID NO: 15837 - RNA, 22928 nt, Homo sapiens
gaacaaaacucuuccaaaggaaacaaacaacuacuuuuauuguuaaacuuucaauucacagauuaacuuucaaagguucauauuucccacguucuuuuuuuuuuuuugagacagggucucgcucugucucaaggcuggagugcaguggcacgaucuuggcucacuucaaccucugcauccugggcucaaaaaauucuccugccucagccucccaaguagcugggacuacaggcaugcaccacccugccuggcuaauuuuuguauuuuuuguagagacaggauguguuccccaggcuggucucgaccuccugggaucaagcgauccaccugcccuggccuuccaaacugcugggauuacaggugugagccaccgcacucggccccuauuucccacauucuuaaugacaccccauccacagugguccaaucaacuuucaaauuagcucuggggaaaaaaauacauuuaaugaaagcuagaaaaccuagagaaggucuugcucuucaucuuucacugcagcuauggacagcucggcaccacauuugcaccaaucagcauguuugcccauguccugccaaggagagaaguuuacaucaucacugacaagguguguucaccuauucucaucacguaacacugauggauuccauaccuaauuuaucaaucuaagacauuacuggaccacguaaccuuacauauaacuaccugaccauauuuucacaugaaguugcugcugcuuauuauacaucaaaguucacgucaauguggcaugaagucaagaggauuccaagcaaacuccaucaaaaccuuggggcucacagcaucucccaguguguagauuuucacaucuaaguucugaagacaugaucuaagcguggaagagcuucugaaguugaccacugaucuucugagugcaagucacaucuggaaauccuguaggcaaugucaugggcaaaauuguguucauaaaacugugcuuaggucugcuuaugauagauuaucacgucacgaaaaaaaugccacagaaguccagacuuuuaaccaaucuacuagcuucugcaucaguaucacaaugccgagcucugaauuuuaaaugugcacauauugucauauucauauagugacuuagaguuuucaaagcacuagguacaugguccucaaaaaugguuggcuuuauaugacccaaacuaaggacauuucacagguuucaauguuaacgcguauugugaggguuugugcauaauuaucuucacaccaguaaagguauucacuacaauacauaaauucauuacacaaaccaagaauaagcuucuaacuuauauugacagauaugucacacacguaauuuguccauauuuuacuauuccauaaauacuuacuauuucuaucaauaaugcuacuggaauggaauaauauuacauagaaaaacguaggaaaaccagauauaacaagcucuaaagggcuaaauuucaguuauaaaaugggucagaggcugagaaaucacuauuuauccacaagaauugccuuauaaaucaaaagaugacugcagguuucucuuacauauccaaaucuaggaauaaguucauuccauagcagauuugaaaaaacacaaauauaauguaggaaguaauaucauucauggcaaaccaacagcaugaaauuugguaggcuuauuuaggaugaaaaggaauaaucuagauuguuuuaauacccuauaagaguccauguuaagucacccugacaaaaaaucuuuuuaaaaauaugguaaccauaaauaaaguugcucaaaggcaccacacacacgcacacacacgguucucuaaugaaauaccaguugaagugcagcauuuucauuacagauagucaaacagcuagagcuauacaauacacacagauuuuuccuaauaguaccagcaaucuuaguuacaaaauaauacuuuucaguagucuuucuugaugcacauuuaaaaaccagcacaacuccucuagugaaauggucaauuucccuuaaaaaacaacaucugaaauuauaagaccugacaaaucauauuauauuucaauauuagacugcuguggcucuagaacaacagaaaagcguaacuuucaaacagcuuagggaaaaagcacugaaauguagaugucgucaaucagccucaggcauuauugauccugugccauccacacacccuuaagguuuuucacagcacucugacgguauuauguguguuuugcaaaugacgaaucaacaguaugcugaauaaucagcaaugaaacacaggagauaaauuaaauguguuuuuccaaaugucagaauaucgagguucccaggaguuggcaaaacuucucaaguggccauccagacucaggcugugcaggauaaggcuuccuuacguagugaacgguugagaauauuugcuccccacacccagagccauucaggcauauacugugcaaaaagaaacuaaaaaugaaagagaaaaagguuguaagguuagaacccaaaaucaacacugaaggaacaaguacacagaccagcacaugaaacccaccaaucacaacaaauacccaccaaucaaucacaacaaauacccaccaaucacaacaaauacccaccaaucaaucacaacaaauacccaccaaucacaacaaauacccaccaaucacaacaaauacccaccaaucaaucauaacaaauacccaccaaucacaauacacaccaaucaaacaaauacccaccaaucacaauacccaccaaucaaacaaauacccaccaaucacaacaaauacccaccaagcaaucacaacaaauacccaccaaucaaucacaacaaauacccaccaaucacaacaaauacccaccaaucacaacaaauacccaccaagcaaucacaacaaauacccaccaaucaaucacaacaaauacccaccaaucacaacaaauacccaccaaucacaacaaauacccaccaaucacaacaaauacccaccaaucaaucacaacaaauacccaccagucacaacaaauacccaccaaucacaacaaauacccaccaaucaaucacaacaaauaccuaccaaucacaaacacccaccaaucaaucacaauacccaccaaucaaucacaacaaauacccaccaaucacauuacccaccaaucaaucacaauaaauacccaccaaucacaauacccaccaaucaaucacaauaaauacccaccaaucgaucccaacaaauacccaccaaucacaauaaauacccaccgaucaaucacaacaaauacccaccaaucaaucacaacaaauacccaccagucacaacaaauacccaccaaucacauuaaauacaacaaaggaaaaagccuccagguacuacuguacugaauaccuacuuuugccuaagaucuuacccuagauucuacauggaacagaaacaugaccaccacccaccuacccgacuuucuguaaugaggcuggacuguccugcauguaaauacaauucugucuuuacuuaacgugauaugaacaaaauguucacugguuaagaaccacaaaaucggcugggcacgcuggcucaugccuguaaucccaacacuuugggaggccgaggcggguggaucaugaggucaggagaucgagaccauccuggcuaacagggugaaaccccaucucuacuaaaaauacaaaaaauuagccaggcgugguggcgggagccuguagucccagcuacucaggaggcagaggcaggaaaauggugugaaccggggaggcggagcuugcagugagccgagaucgcggcacugcacuccagccugggcaacagagcaaaacucugucucaaaaaaaaaaaaaaaaacaccacaaaaucauuauaggaauaaaucaguuggaacagacagacgcauacgugguuaguacucuaugagaaaacuggggcuugagggguaguauggaacaaaguucaacaagaaaacaggucagaaacaccaguaccuugggaugguaucuugaccuaugaugggggugcucaggggaccagggaagggaguccugcugaugcugcucugcuucagggucucacucagggccuuugugcuagcagcagacauagggcaaugucugaaaacaaauuuggucgucacacugggaguggaugcuacugguaucuaguggguggaggcccaggaugguguucaacauccuacaauacacaggacgcuccccaugucaaggaauuaccugcucucaaugccaacagugcugagguggagaaagccuacacuccucuaacagauuuguucagaaccgaaugaaaguucuaacaccguguauacgaaagagaagagagacaggcccuuggcaaguacugacauucuagucuugaacugaacugaugaaugauaauagaggucauucaauccucuugucaauaaauggacacagguuacucuccagggaggacacacccacacccacacacacacacacucacgcacuuugugaacaaaaucacagcagcaaaagcuaucagagaaauaugccauggacaaaacagcaaaggaugaaucaaaucuuugauguaaaauuggaaauaaaaaaugauaguguugaaaauaauuugaguaacauaaaaugaaaacagaaaguuuuaacaacuuuauacagaaaacuacuccaggaauuaaaucagcuuaacagaauuucuuggcagaaaaauacauucucaaggaaaguuuaucaaugugaacaaaauuuaauuuugaguaaacuguucguguuuuauaaacacagucaaaacaucuacugcaccuaaaccugauccucauaucuuuauuucuaaaaaaauuuuauggucagugacuucuaagacuacuuuuuagguuucucugcuuuucucaaguaauuaaaggaccuggaaacaacuacuuaaauaaaacuguuucuucuuuuuuuuuuuuuuuuuuuuuuuuugagauaagagucuagcucugucacccaggcuggaguacagugacgugaucagcucacugccaccuccgcauccuggguucaagcgauucucaugccucagacucccagguagcugggacuacaggcgugcaccaccaugaccaguuaauuuuuauauuuuuaguagagaugggguuucaccauguuggcaaggcuggucucgaacuccugaccucaggugauccaccagccucagccucccaaacugcugggauuagagaugugagccaccaccacgcccgaccaaaacugcuucuuauuaaucucucacuuuucauaaaagucauaauuaacuguugauauacuuacauguuuauuugguaguggcaaaucuaauacucuucaugcaaacagucccaaaaauaucuguuugauaauuaagaaaacuccgaauauuaaaaaaaaaaaaaaauucggaccagguacagugacucacacugguauuuuuuuuuuuuuuuuuugugagacggagucuugcucugucguccaggcuggagugcaguggugugaucucggcucacugcaagcucugccucccggguucacgccauucuccugccucagccuccugaguagcugggacuacaggcgcccaccaccacgccuagcuaauuuuuuuguauuuuuaauagagacgggguuucacgguguuagccaggauggucucgaucuccugaccucgugauccgcccgccuuggccucccaaagugcugggauuacaggcuugagccaccacgcccugccagcucacgcuuguaaaucccagcacuuugggaggccaaggcggguggaucaccugagaucaggaguucgagaccagccugaccaacauggugaaacuccaucucuacuaaaaacacaaaaauuugcugggcgugguggcaggcaccuguagucccagcuacuccggaggcugaggcaggagcaucacuugaacccgagagguggagguugcagugagccaagaucgcaccauuacacuccagccugggcaacaagagcggaauuccaucucaaaaaaaaaaaaauucuaaacuagggcacaucucuuuacuacaccagauaaaggaacugaaauauauuguaauagauaauuaugcauucucaaauuaauacuuacgaucacaauuucaaauaucuaagaaaguuacuuucuacaguacuaaaagguaccaauccuuugucaugccuaaacaauaagcuuaaaauaaaaauucuaugcuucuugaaaaaauuagucuaagacuauacagagauauuauuugauaaaaugguugcaugaaauauagcccuaucuugugguuuugugguuuuuuuggauuauauuuuucacugagagguaacccucaagcaguacuagaaucuuuuacuuugaaauucccauguaaauacuuaguauuuuuauaguccuaacauccacuuacagcagcauauuucuuuuuuuuuuuuuggaaacagagccuugcucugucgccuaggcuggagugcaguagcgugaucuuggcucacugcaaccuccgccuccaggguucaagcgauucuccugccucagccucccaaguagcugggacuacaggcacacaccacuaagccuagcuaauuuuuguauuuuuaguacagacaggguuucaccauauuggccagguuggucucgaacuccugaccuuaggugauccacccaccucagcuucccaaagugcugggauuacagaugugagccaccacaccccagccaaaguaguauauuucacuuuaaggugccacauagauugaacuuuugaaaauucuuaagguaauaauuucacaaaagaaaauuuagugucuuuggucaggcacgguggcucacgccuguaaucucagcacuuugggaggcugaggcaggcagaucaugaggccggagaucaagaccauccuggcuaacacggugaaaccccgucucuacuaaaaauacaaaaauuagccaggcgugguggcaggugccuguagucccagcuacucgggaagcugaggcaggagaauggcaugaacccgggaggcggagcuugcagugagcugagaucgcaccacugcacuccagccugggugacagagccagacuccaucucaaaaaaaaaaagaaagaaaauuuagugucuuaaccaaaauuauuaagugucaggcuuaagagucagaauuuacaauucucaucuuaggcuuuaaucagauuucucuguaucacugagauagguucaugaugcauuaaucuaauuaugagaccugaagcacacuccuaccugaauagaaugggaccaauauccugugguccuuuuggaaaucccaagaguagaaacagcaugaugugcauagacuuuuggcgaaggcaccaaccacgagcaccugugcagaaaguugcugggugcugucaugcugguggcuacauagaaagggauuagacucuguacaaagauuccuuuagaggcauauucauauugcaaggcucugcugaaguggucuaaauaagccuguugagacagaggggaggaaaagacuuuuaauucugggugaacuugaaaauucaggagaaaaaaagacuugcuuauuaucaauucaggaaaaaauacaggauaagcauaugugaguugcugacaaagaguucaacaaaucagaccaaacaacuguuaauaaauguucuguggcauuaggauuucaucuuccaguaaguaacaucugaccuuagaagcagaaaaugcagccagcugaggaguggguuugcagcaggagccagaagagaucgugacgauggcaccuuucuuucucuccaccauucccgguaacacaacauggaccaucaaacuagcggcggcaauguucacauuuaugaugucccagagcuuguccucggacagcugagugaaauacugcggguagggauaaaacacacccacguuauuuaccaagaugccaacgucuuuguccuucagggcuucucgaauuggaagguagaucucacgaccgcugcugaaguccgcaacuauaauaucaguuuccacuuuguacgugucggcuaugucuuuagcaacaaccugcaacuucuccucguuccgacuaaucaggauuauauugagaccucggcuugcuaacucuucagcguaggcuuuuccaaucccaucuguugcaccuaggaugcaagucaggaaaagugagcauguguauuucacggugugacccuuaaaauggacccaaaguacccccugucagguuuagucagagaaaaauucacacuagaaaucaagucgguucuaguaucuacaagucaaggacacuguugcugaaugaggaaugugaagggcgcaugcuauacacucucccagacauccugacacacggacagggaguuauuuuacauucaccauauugguuaggagacacaguaggaauuuguuuucaaacuacuaucuggcuugaaugaguggcaggaggugcuuuucugggaaaucuucauaaauuaaaaugaaauucaaaauaggugaagcauuucugaaaguggcaacacuuucaagacaauuuuaaaacagagaacaaaaaggaaaagcacauaguaggaagugggucuggaggaggacugggaacaggagagagcagaauaggaaggauaccaaucaugaggccaguucuuccuaagaugagagcaguaagaaaaugaaaugugaacauaaucacggcaggagccauaaguuuuauuuuuuuaucagcauguucccauaaaaacaccacauuaaauucaauagcuccuugaauaaugcauccgacuucacagaaaagauuauuuugauuauaaaguagguuaccgcugacaacggcccaucuuccauacugcuugaucaagucugcucugcuccccaggcgggggauaaaaugcagccugaucaggcuguaaaagucacagaugacagugaugcuuuuucuggccguauaccaggcuccaaccaaagcuagagcuuccauauagcaauugcaagaccuggcgauuucccuguacaagagguagaaacugucaacagcagccauggcaaccugcagggagagggaaagagagagagccucuuugauuaauaaauuaaaggaacauacacagucugagugaagacauccagcugagggcaucagaucuugucaauuguacguucaaauaacacuaacuuuucaaauguacguggcucacaguuucagucuaucuaucuaucuaucuaucuaucuaucuaucuaucuaucuaucuaucagacagagucucacccugucgcccaggcuggagugcaguggugcgauuuuggcucacugcaaccuccaccucccggguucaagcgauucuccugccucagccucccaaguagcugggacuacaggcacaugccaccacgcccggcuaauuuuuuuuuuuuuuuuugagacggagucucgcugucgcccaggcuggagugcaguggcgcaaucucggcucacugcaggcuccgcccccugggguucacgccauucuccugccucagccuccggaguagcugggacuacaggcgcccgccaccucgcccggcuaauuuuuuguauuuuuaguagagacaggguuucaccgcguuagccaggauggucucaaacuccugaccucaggugauccgccacccuuggccucccaaagugcugggauuacaggugugagccaccaugccuggagauucagccaauuuaugaucucaccauuuaacauccguagcuuauaaaguuacuuucuuccaaggagacuaaucaacauaacuaccagaaguuaccaaauucccacuaaaauucagguacuacacuacaugcuguggcuacagagauaaacacaauaugcucugugccuguaacaugcuccuagucuaauaauaacaaacacaaagcuucuaauucauacagcagagguacauguauuucuuugcuuuauucauaaucagcaagaauggaggaccuacuaccuguguagggacaaaggagaugaaacagagguggcacuaagacauggccuuggccucaaaagcuuacaauccacuggagacaaaacucagcuuucaaaaaccuuuacaucaauuaaaaaaaaaauuuuuuuuaaagagauacccuccaagcuuggaaaaauggcuucucaaaugacaauagagggagcacuccuccaucuucuaacuuaauuuguaaccauuauguugccuggucucuuacauuugaggaaagaaaaguccaacacaacucuguugaguguccacauagcaaguauauacuaagcaccuacuauguucuauguacugugauucaaaggauucacagaugaacuaaaugaccgucccuaggugaagacgcagacauuuaacaaaauaauguaaaaugccacaugaugugguaggugugugccugcaaucagagauaacccugcagaaguagacaaaggccaggcauggggggucuggccacagaccgagugaguggacuucauaucaggcuaaaccaaccgugugcauccugcgaaagacaaaauaucaaaacaacugcaauagacuacacuuauauuacagggaacucagauacacacaaacccaaggacacagcuuauauucuaaaaagaacaugauuuuaagccaaaagaaaaagaaauauaaaacuucuggggguggcaacuuuugaagaaaucccuuuaaaauagaaaaaaaaaaaaaagucuggauacuaagaaaauacccaacaauagcagcacaaauuagccuaaguuugagaaagaauggggaauucccuccuacuccacugcaguguaaucugagcucaacaaaguuuugcaaaguaaaaaaggaaccaagcagaagaaaacaaaugaaccacugaaacggaacacauacaagaauggcaccauauugugauaaaaggcauauaaaauaauuuuaaaacuauugaauaaauauauauaaauguguagugugaauuacaaaucaacaaaacguacacaagaaauaugacugaaaacugaagaaauggagaagcaguaggauuccuaaaugcccuacgauaaggaaacaaucucucuaaaaaagaaaguuucauacugguaccguauuaaguugauauugcugcuauauuaaguuaccaaauuaagccaauguggcauuaaguuuaaaaaauguuuuccucagccgggcgcgguggcucaugccuauaaucccagcacuuugggaggccaaggcagguggucaggaguucaagaccagucuggccaagauggugaaaccucgucucuauuaaaaauacaaaaauuagcugggcaugguggugggcacauguaaucccagcuacuugggaggcugaggcacagaacugcuugaacccgggaggaggaaguuacagugagccgagaucaugccacugcgcuccagccugggcgacagagugagacuccaucucgaaacaaacaaacaaaaaaguuuuccucaaaugaaaaguugggccccuuuauucccuacagguaaaaugcuguccacuggggcucugugcacagaaacucaccucccacaaugagaaugccaaaguucaucaugaaaaggaaacauuuuaaauuugacuaaguacauaaaccaaauacuuaagcuaaaaacaacuaaaauaaaugcuccuuugggguaauuuuucuuuaugaaccagauuggcugagaugaccuaaaauaugagcugucuaguucaacaaagucuuucuuuuuucugagcaaucuuccguacagcagucaccaauaccccuuacugcucccaaauccuuugauugacaauccuuugaaauauauucaaaguuagggcccccccuucaguguagcgaacgagcauaccuguuuccagaucugcaugagaggaagccgcgccaccaccccucccacaacccuccugcugcuggauaugcugaugacgggcacgguaucagaguuuucacacuggcuguagcccuugaacagucauaaguacuggacucccaaagacaggcccaaaacauuaauauccuauaagaacauuaaaaacugacauuccagccagggacgguggcucacaccuguaaucccagcacuuugggaggccgaggugggcagaucacuugaggucaggaguucaagaccagccuggccaacauggugaaaccugaucucuacuaaaaacacaaaaauuagccggguaugguggugacugcccagcuuggguggcugaggaaggagaaucacuugaaucaagcaggcggaaguaacagugagccaagauugcaccacugcacuccagccugggcgacagaguuagacuccaucucaagaaaaaccccaaaaaacaaacaaaaaaaacaaccgagauucuauguuagaccauccuaaauugugaguuccggaaauaacucauaaaaagugugggugccuuuugucauaacuaaucaaacacaaggccaugaggaaaguaaaugcaaaaacaauuaccuguauguaauuaccuguauguaccaggaccucucaagcaaaauguaauaaaauugggaauaacaagcuaugacuaaagaaaccuagacacuuggaauauuaagcuuauucuucuaauaacagguaggcauacaucuaggcuguuaaaacaguguuuucaaugaaaaaauagauacuacaggccagccacgguggcucgcgccuguagucccagcacuuugggaggccgagacgggcggaucacgaggucaggagaucaaaaccauccuggccaacagggugaaacccugucucuacuaaaaauacaaaaaauuagcagggcgugguggcgggcaccuguagucccagcuacucaggaggcugaggcaggagaauggcaugaaccggggaggcagagcuugcagugagccaagaucgcgccacugcacuccagccuggacgacagagggagacuccgucucaaaaaagaaaaaagaaaaaaaaaaaaagaaagaaaaaacagauacuacauaucaagaucaauggguuguagccaaagcaguauuuguggggaaaugaguugcuccaagccuauagaguaaggcucucgcuacaaaaaggaggucaggcaugccucauggaggaacccacacagauggaagcuuccuccuuaagcccgauuuuuuucaagaaucugaaccuuuuugaaguaaaugucuagcaaaaggcgccugaccacaaagggggccccaguuuuucugcuguggucguucccugcccuggggucucuuaccuucucucugccaguucugggccgucagcaguauguggcuccguccuucucuuaaggccaaucugugaauaaaaccaacaagaaacaaaugccuuuccucuuccucauaguucagcugggaaaacuuuacauuaaaguaacauccaagugcucaaaaauuaagaaaacacaacaauucuuacgccaugaaucucuguagaggcagcaaaccauguacuaggcaccaaguacccuccucucagaauaagaaaagcgccuggcgucugcugggggcacaguccaugcguccucaggcacagcuggagggugcccccuuuuccuaugccuuuuuuccuagggaacauuucaucaaaugggacaaaagcccauuccaaucccaggagcccuuggggaaacaccgcccaggcaccaggccggcaucggggaagagagcagccacagcuguccucggugccuuuuucugccuggugccugucuggguuucaccugggccucccacugccucacucugcacaccccuucuucagcuccaccugcagcguucccuggaacauccacauugccacgggcugcccuggcuucucuuuccaaauuccuggcagggauucuggcucgcccaccuuaguucaggugcccaccaccugucuaaucuccuggcaggguggcagggaggaaggcguccuacaguguuugggggcagccccccuaggcugugagugggucagaugcuuuaaggaggaaaugaaaggaaaccccugguccacauuuucccucuccuccaccacacacacugcauugcaacuguucugucucugaccaccccagcaggcuauaguccuccagggcagaggccagauucuacuccucucuguuucuccagcaccuuccacaauuccuggcacaaagaagcucaacacuaccaagucucuggcugcagcucacaggcagucuuccuguccagcgcucagcccucagcucaggagcggaccacccacaaauuccuuugauccuuuacagaaagaaaagcuugugugcuaaacccaccagggaccucccacucaggccagcagaggagaugcacccacugcagaggugaguacaggaaccuggggcugaggggcuucaagcccaucauggcccagcuucucaacgcccccacuagacaccccucaccucuugucaggggagcgccaucgugugcaaguaccuuaaacguguguuaauauuauuguugcuauguauauuuuaaaaaucacagagcaucaggggggcugauggcauucaaggucugguccucagccuugauggauagaaacccaaguucuucauuccuuagaggcagcucaagacaaagaaaucugacucacauccacaaaacccacagaagacugauacauucaaaugccaaguuaggaauggauagugaacaacacagcgaagaggccuaaacacacacggucacugguccuacagucucucgagaucuacauggaaaaccaaacuucuagaacagcaaugaaaaauacaaagugucagagacugaggacaccaucaugaauaaaccaggacuccgugccacccgguauacacagaagucagagaaagauaaacggagcaacugcaacaugagguggcaagggcgccacuggggugaaaugggucuugaagugugagcagaauuucugggcagagaggagggaagggaccucccuggcccgggcccauggagaaaggcucggcaccgucaagggucuggccuacucgggaaacauuaggaagucccccgcaugcacagcacaggcugugcuguccugugugacgccccaugugugcaggcgcacaggcgugaaggagacugggagaggcagacuggagaugccuucacgccagacuggagugcauggaccuccuccuugagcaccaagggagggagcugguggggcuuguuuaggaagguaacgcagcaggggaggaggggggcuccugagcccugguuacucagcuggggaugaaggagggccacacggagagccaaggcucuguggccucugcugcuccucagccuugccagacacuucacacauucacucacacccugaugggccaaagauguuagagaacuggaaauuaaaacucauucccugcucucaaucuucuuccccacccuucuguacaugauggaaaauaacauuuuucucaugacaaaagaaaucaguacuuuccccagagccaccaaauuucaaaagcucauagccucucacugaaacuuucaaaggaauuuaucacacauuuaagccuagaaguccacuuaggcauauguagauaacaagccucgucaaaguuacuuuagguaucugacuaguuacuguuuuguggcuugauuagcgaaagcuauuaaccugugcuacggucugagcguuccgccccacucccugauucuugucuugaaucuuaaccccccaggugaugguuuagaagggagggccuuugggaggcgaucagauaaugagggcuccaccaccuugaucuuggaccauucagccucccaaacugcgaaaaguaaguguuugcuguuuccaagccacccaguucaugguauuuuguuauagcagcucaaaaccaacuaaggcagccugcaaccuagagaaacccaugauguggaaagcaauacuaaaacacaguaaaauucugauucauguacaaucuaccugcaagaacuuauucuaaagcuuuauuuucuuaaacagagaguagaauggugguugcuagagguggggucaugggugggaaguuuuggucaaagggguauaaacuuucaaauauaaaaugcauacgucuggagagcuaauguacaguacagugaccauagugagcaauaccaaauuguaggcuuaaaaucugcuuagaggguagaucucaaguguucucaccauaaagaaauaaaaaaguaacugaggugaugaauguguuaacuaauuugguuguggugaucauuucacaaaguauacauauaucaaaucauguuguacaccuuaaauuuauauaauuuuauuugucaauuauacuucgaugaaguuggaaaaauauaaaauaauuuaaaaaaauuuuuaagcuuuguuuucucaucucugcagaaaacuaaaacaucugugaacaaaacaaaaccacaacuguccccaaacuaggaaaagaagagcaagucccuauuaucuuuuaagcauuuucuacuucuacagggcaggagucaucaaaaaccuacaggaaacguuacaacuacaaaagcgucacgggacaauuauggucaaaacugcaaguagcaaagucaccucuucaaagcaccacugcuguggccuguaacaugaucccacuccacagugaaggggacuccaccuagcaguguaaagggcaaucaacucaaauagaaaaaccuucauguaccaagaguucugggaggaaagucuuggcugaaacauggacauuaccaagcuauccaaaugcgugugacguggggcggguggugaaagaacacaaggcagacuggccaggguuuuaaagaagacaaagcaagcaggauggaaaaaaagacaaucaaagcauuagcgaacgacaguguggugggcacaguaauggccuccagggauaucuacagccuaauccccagacccuguaaauacgucaccuuauguggccaaagggacuccguagaugugacugaguuaaagacuccgagcuggggaggguggguccaaugucaucauguguccuuguaaggggggcaggaagaucaaagagagagagccaugugacuacaaagggagaggucagagagagcucgaguugagggugcucugugcugcugguuucgauaauagagagaggggugggucaccagugaaggacgggggguggccucuagaagcuggcagaggcaaggaaaaggauucuccccuggagccuccagaggaacacagcccugcugacaccuugacuuuagcgcagucacaaugacuucagauucccaucuccagaaggaagagacaucugugucauuuuaagccacuaccuuuguggcaauuuguuacaucagccacaggggauaaggauaaacagugggaggaagggauggaugaacagucaguucagcuuucaggacagcgaagagacaagcugaaaacucugcaaccucccuuaagccaaaaccacuauguguauucaggagccagaaagucucagagguuccugccaucuuugacugaccaggguagaccugagguccuccuccucaccagcugggauuauccagcuuuucaguaaggcuccagggcgauggcuguuuucauugaugaaaacauuuuuccaaauaaaucuuaauuuuuucagagugugaaucugucuugugcucaguacuccaaauccucuguucuuccugacguuucaagucccaugucuucuccuccguucaaucacuuccuaacaagcaccaacaacaugucagcccuggggagaaacuucccuuccugucccuucccuucccaggccguggcacugcccccaccucugaauuccucuccaccucucuuacccauguggcacuuagcacacacugcuuuggauucuauuuaaacacucaacuugcuuauaucuugguuucuugguuguccaaggagagcacaggccucuggagggcaggagauguauagaaaacgaauuuuucuguaacuaaaagaaauuuuuguuuuuaggccgagucuuguucugucuuccaggcuggagugcaauggugcaauuucugcucacugcaaccuccgccuccuggguucaagcguuucuccugccucagccucccgaguagcugggacuacaggugcccuccaccaugcccagcuaauuuuuguauuuuuaguagagaugggguuucaucaugguggucaggcuggucuugaacuccugaccucaagugauccacccaccucggccucccaaagugcugggauuacaggcgugagccacugcaccuggcaaaaauguuuaaauauauacaaaaguauguaaaaccuauuaugcacaguucaaagaauaauaaaacagccacuuagccaccagccuacuuaacaaaaccagugucguggaaguccuguaugcuguuccucugauuacagccccuccucuauccuggaggcagccucucuccuaaauucugggguagucacucccugacucuuuuaacaaaacagcuguauaccccaagcauguauucugaaacaguaacaguauugcuggccgggcgcgguggcucacgccuguaaucccagcacuuugggaggccgaggcgggcggaucacgaggucaggagaucgagaccacggugaaaccccgucucuacuaaaaauacaaaaaauuagccgggcgcaguggugggcgccuguagucccagcuacucgggaggcugaggcaggagaauggcgugaacccggaaggcggagcuugcagugagcggagaucgcgccacagcacucccgccugggcgacagaacgagacuccgucucaaacaaaaaaaaaaacaguauugcuaaguuucgccugguuuugaaccucacauaaaggaaccacaccacauggacccuuuggugacuuguuucuuucacucaacaucauucccgagacucauccaugccccugcagcuauauaguccauccuccucggcagcugcacaguaucucacgguucagaugcacugcaguucacaggucccccugcugcugguucagauacaccacgauucacaggucccccugcugcugguucagauacaccacgauucacaggucccccugcugcugguucagauacaccacgauucacaggucccccugcugcuggugcuaggcacgugcacuguuucugcugguuuugauuuacaguuaggaacagugcugcagggagcgcuuguccccaucuccugcacaccugugcaagaguucgcaaagggauuugcccaugguuuaacugcugguccacaugcauuccacugccaaaugcuuuugcaaagcggcagaacccauucacacucccgccagcagcagguucgugccacuccucaaugucacuggcugguagcguccaaagcuucaccuucugccaacaggguggcugugaaaugguaucucauuaugguuuuaauuuacauuucccugguuacuaguaaggcugcaguccuuuuuauauguaugugcuuucuguguuuuguaaucuaugaaaugcccguuccuaucuuuuguccuuuccuuuuuuuucucucagaauuguaagaauucuuuaaauauucuagauacuagcucucuguauguuuugugucucauuauagugucuuucaugaacuaaauguguuguuauuauuauugagacaaggucuggcucuauugcccagccugaugugcaguggcaugaucacagcucacugcaaccuccgccuuccgggcucaagccauccucccaccucagcaucucaaguagcugggacacaggcauguaccaccaagcccaguuaaauuuuuuuuguguguguagagaugagguuucaccauguugcccaggcuggucucaaacucguaagcucaaaccauucaccugccuuggccucccaaagugcugggauuacaggugggagccacugcaccuggcugaaugucuuaauuuugaaagagacaaauauaucaaucuuucugcuuuaggguuuguuuuauuucagaaaucccuccuuagccucaggucaugaagaaauuuuuucgaauuauuuucuagaaauuuuacauuuuugcuuuuucaguuuaagucuuuaauccuccuggcguuuugugauggugugaggcugggaucucacacaucuuuuuuuuuuuuuuuuuuuuuuugagacagagucucacucugucacccaggcuggagugcaauggcgcgaucuuagcucacugcaaccuccuccuuccaaguucaagcaauucuucugccucagccucccaaguaacugggacuacaggcgugugccaccaugccuggcuaauuuuuguauuuuuuucuuuuuuaguagagacggggguuucaccauauuggccaggcuggucuugaacuccugaccuugugauccgcccacuuuggccucccaaagcacugggaugugaccggccggaucucacacaucuuuaauauuccuccucagcaccugacaugcugcuguagacaacuuuauuuaauaaacagaaucaaauacugcuuuguguucaaagcucaaauuucacucuugagaaaaaaacuuaagcuuuucauacucugcgucagcacuaugacaaaguuagcauugguguaucaagacuuuuugggaugucuuuaccuucacugccaauuuuugguauaggacuaaacgcacaaugaagcugagccuaaagagcagcaacauggaauuagaaaccuggauucucauccaagauccaacacucuucaccaucaugucuguauuuaugcaguaagaauuaaaauauucagaguaccccacuccuaggcagauacccaagauaauuagaaacuuuugcucacauaaaaacuccugcuugcauguucacaguggccuacucacaacugccagaaggcagaaacaaacaaaauguccaucaacaaaugaaugaauaagcaaaaugugguguuauccacacaaaggaguauuauucagccauaaaaaagcaugaaguacugauacauacuacaacauggauaaacuuugaaaacauuaugcuaaaggacagaaaccaaauacaaaaggccguauguuguauguuuccacuuguaugaaauguccagcauaagcaaauccauagagacagaagauaacuuagggcugcugagggacagggggagaaaagagguaugacuguuaaugggguugggguuucuuuuguaggugauuaaauguucuggaauuaguuacuggugaugguugcauagcauugugacuauagcaagaacuacugaguuauacacuguaaaauggcuaaaaugauaaauuuuaugucaugcguaagucauuucgauuuuugaaaaccuacuuuaaaaaaaaguagcaccaauauguucaacucuguugcccuagaauauuccagcagugauuaaaaccacaaacuuggccggguacaguggcucaugucuguaaccccagaacuuugggaggccaaggcgggcagaucacuugaggccaggaguucaaggcuacccugaccaacacagcgaaaccccgucucuacuaaaaaaaaaaaaaaaaaaauuagcugggugugguagaacgugccuguaaucccagcuacucggaaggcugaggcaggagaaucacuugggcccggggugcgggauggcgggcagagguagcaggagcugagaucgcaggcaccauugcacuacagcccgggcgacagagcgagauugucugaaucaaucaaucaaucaacacccucccccucccccucccucucccucucccucccucccucucucucucucucucucuccuguggcggucagaguaaaauugagagcucacuuuaugcaaaagacucugcuaagugcuuuauuccuauugucucacuuuauucucucauuaaucuuauaaagcgcagucagacucucccguuuauagauggggaaauugagucuuauagauguaaagucgcacacccaagaccccacaacucagaaaggggcuaccugcaauucagauggagguauagcaaggcgcagaguccuguccagggagcccacugugagaccccccgacugccucgcagucaccuguacacaucauguugggaucgccgaggggcgcugcagcgauccgguuucuggggcugcgucuggguggcacguucagaacggggaccugccugguucuucuucccagcccuuccccuccagcacccggcaaggcccagucaacacgagcaaacucggaaauccuggcugaacccacgaccgcugcauauuuccauuuuagaaaaacacggcaacaacaacucaaaccaaaucguucagaaaugagaauaaagaagcaccgacaaaggaggcgauugcuggggccgcucgggggaggagccgggugagaggcugcagggagggcagggcaugcgccggcgacaacgggguucgcgguuuggggggcaaggcccgggggaagagagagaacaggggugcagcgccgcggcggggggcgugaggauggagccgggggaaggggggcucugagaugugaaggggcggggcuggggcuuuuuggucugaaggaaggagucucacgggacggagggacgaagauuuccuggggucaggggcgccaaggggcuucggggccggaugcagcggagggggcccggggccuggggggcguggugagagcucagaggggucucgccaagcagccggcuggcgcugaggggaccgaggaggggucuggggcgaaaggaccgcgagagggcgcccagggcgcggggggcgcgguaccugcaggccggcaaagucuuccaaaccggucccgccagacccgcgcggccgccgcccccgucucggccgccggagcugcugccgcgccgcgcccucacgugacccgcguacgcgccgg

SEQ ID NO: 15838 - RNA, 22928 nt, Homo sapiens
ccggcgcguacgcgggucacgugagggcgcggcgcggcagcagcuccggcggccgagacgggggcggcggccgcgcgggucuggcgggaccgguuuggaagacuuugccggccugcagguaccgcgccccccgcgcccugggcgcccucucgcgguccuuucgccccagaccccuccucgguccccucagcgccagccggcugcuuggcgagaccccucugagcucucaccacgccccccaggccccgggcccccuccgcugcauccggccccgaagccccuuggcgccccugaccccaggaaaucuucgucccuccgucccgugagacuccuuccuucagaccaaaaagccccagccccgccccuucacaucucagagccccccuucccccggcuccauccucacgccccccgccgcggcgcugcaccccuguucucucucuucccccgggccuugccccccaaaccgcgaaccccguugucgccggcgcaugcccugcccucccugcagccucucacccggcuccucccccgagcggccccagcaaucgccuccuuugucggugcuucuuuauucucauuucugaacgauuugguuugaguuguuguugccguguuuuucuaaaauggaaauaugcagcggucguggguucagccaggauuuccgaguuugcucguguugacugggccuugccgggugcuggaggggaagggcugggaagaagaaccaggcagguccccguucugaacgugccacccagacgcagccccagaaaccggaucgcugcagcgccccucggcgaucccaacaugauguguacaggugacugcgaggcagucggggggucucacagugggcucccuggacaggacucugcgccuugcuauaccuccaucugaauugcagguagccccuuucugaguuguggggucuugggugugcgacuuuacaucuauaagacucaauuuccccaucuauaaacgggagagucugacugcgcuuuauaagauuaaugagagaauaaagugagacaauaggaauaaagcacuuagcagagucuuuugcauaaagugagcucucaauuuuacucugaccgccacaggagagagagagagagagagagggagggagggagagggagagggagggggagggggaggguguugauugauugauugauucagacaaucucgcucugucgcccgggcuguagugcaauggugccugcgaucucagcuccugcuaccucugcccgccaucccgcaccccgggcccaagugauucuccugccucagccuuccgaguagcugggauuacaggcacguucuaccacacccagcuaauuuuuuuuuuuuuuuuuuuaguagagacgggguuucgcuguguuggucaggguagccuugaacuccuggccucaagugaucugcccgccuuggccucccaaaguucugggguuacagacaugagccacuguacccggccaaguuugugguuuuaaucacugcuggaauauucuagggcaacagaguugaacauauuggugcuacuuuuuuuuaaaguagguuuucaaaaaucgaaaugacuuacgcaugacauaaaauuuaucauuuuagccauuuuacaguguauaacucaguaguucuugcuauagucacaaugcuaugcaaccaucaccaguaacuaauuccagaacauuuaaucaccuacaaaagaaaccccaaccccauuaacagucauaccucuuuucucccccugucccucagcagcccuaaguuaucuucugucucuauggauuugcuuaugcuggacauuucauacaaguggaaacauacaacauacggccuuuuguauuugguuucuguccuuuagcauaauguuuucaaaguuuauccauguuguaguauguaucaguacuucaugcuuuuuuauggcugaauaauacuccuuuguguggauaacaccacauuuugcuuauucauucauuuguugauggacauuuuguuuguuucugccuucuggcaguugugaguaggccacugugaacaugcaagcaggaguuuuuaugugagcaaaaguuucuaauuaucuuggguaucugccuaggagugggguacucugaauauuuuaauucuuacugcauaaauacagacaugauggugaagaguguuggaucuuggaugagaauccagguuucuaauuccauguugcugcucuuuaggcucagcuucauugugcguuuaguccuauaccaaaaauuggcagugaagguaaagacaucccaaaaagucuugauacaccaaugcuaacuuugucauagugcugacgcagaguaugaaaagcuuaaguuuuuuucucaagagugaaauuugagcuuugaacacaaagcaguauuugauucuguuuauuaaauaaaguugucuacagcagcaugucaggugcugaggaggaauauuaaagaugugugagauccggccggucacaucccagugcuuugggaggccaaagugggcggaucacaaggucaggaguucaagaccagccuggccaauauggugaaacccccgucucuacuaaaaaagaaaaaaauacaaaaauuagccaggcaugguggcacacgccuguagucccaguuacuugggaggcugaggcagaagaauugcuugaacuuggaaggaggagguugcagugagcuaagaucgcgccauugcacuccagccugggugacagagugagacucugucucaaaaaaaaaaaaaaaaaaaaaaagaugugugagaucccagccucacaccaucacaaaacgccaggaggauuaaagacuuaaacugaaaaagcaaaaauguaaaauuucuagaaaauaauucgaaaaaauuucuucaugaccugaggcuaaggagggauuucugaaauaaaacaaacccuaaagcagaaagauugauauauuugucucuuucaaaauuaagacauucagccaggugcaguggcucccaccuguaaucccagcacuuugggaggccaaggcaggugaaugguuugagcuuacgaguuugagaccagccugggcaacauggugaaaccucaucucuacacacacaaaaaaaauuuaacugggcuuggugguacaugccugugucccagcuacuugagaugcugaggugggaggauggcuugagcccggaaggcggagguugcagugagcugugaucaugccacugcacaucaggcugggcaauagagccagaccuugucucaauaauaauaacaacacauuuaguucaugaaagacacuauaaugagacacaaaacauacagagagcuaguaucuagaauauuuaaagaauucuuacaauucugagagaaaaaaaaggaaaggacaaaagauaggaacgggcauuucauagauuacaaaacacagaaagcacauacauauaaaaaggacugcagccuuacuaguaaccagggaaauguaaauuaaaaccauaaugagauaccauuucacagccacccuguuggcagaaggugaagcuuuggacgcuaccagccagugacauugaggaguggcacgaaccugcugcuggcgggagugugaauggguucugccgcuuugcaaaagcauuuggcaguggaaugcauguggaccagcaguuaaaccaugggcaaaucccuuugcgaacucuugcacaggugugcaggagauggggacaagcgcucccugcagcacuguuccuaacuguaaaucaaaaccagcagaaacagugcacgugccuagcaccagcagcagggggaccugugaaucgugguguaucugaaccagcagcagggggaccugugaaucgugguguaucugaaccagcagcagggggaccugugaaucgugguguaucugaaccagcagcagggggaccugugaacugcagugcaucugaaccgugagauacugugcagcugccgaggaggauggacuauauagcugcaggggcauggaugagucucgggaaugauguugagugaaagaaacaagucaccaaaggguccauguggugugguuccuuuaugugagguucaaaaccaggcgaaacuuagcaauacuguuuuuuuuuuuguuugagacggagucucguucugucgcccaggcgggagugcuguggcgcgaucuccgcucacugcaagcuccgccuuccggguucacgccauucuccugccucagccucccgaguagcugggacuacaggcgcccaccacugcgcccggcuaauuuuuuguauuuuuaguagagacgggguuucaccguggucucgaucuccugaccucgugauccgcccgccucggccucccaaagugcugggauuacaggcgugagccaccgcgcccggccagcaauacuguuacuguuucagaauacaugcuugggguauacagcuguuuuguuaaaagagucagggagugacuaccccagaauuuaggagagaggcugccuccaggauagaggaggggcuguaaucagaggaacagcauacaggacuuccacgacacugguuuuguuaaguaggcugguggcuaaguggcuguuuuauuauucuuugaacugugcauaauagguuuuacauacuuuuguauauauuuaaacauuuuugccaggugcaguggcucacgccuguaaucccagcacuuugggaggccgagguggguggaucacuugaggucaggaguucaagaccagccugaccaccaugaugaaaccccaucucuacuaaaaauacaaaaauuagcugggcaugguggagggcaccuguagucccagcuacucgggaggcugaggcaggagaaacgcuugaacccaggaggcggagguugcagugagcagaaauugcaccauugcacuccagccuggaagacagaacaagacucggccuaaaaacaaaaauuucuuuuaguuacagaaaaauucguuuucuauacaucuccugcccuccagaggccugugcucuccuuggacaaccaagaaaccaagauauaagcaaguugaguguuuaaauagaauccaaagcagugugugcuaagugccacauggguaagagagguggagaggaauucagaggugggggcagugccacggccugggaagggaagggacaggaagggaaguuucuccccagggcugacauguuguuggugcuuguuaggaagugauugaacggaggagaagacaugggacuugaaacgucaggaagaacagaggauuuggaguacugagcacaagacagauucacacucugaaaaaauuaagauuuauuuggaaaaauguuuucaucaaugaaaacagccaucgcccuggagccuuacugaaaagcuggauaaucccagcuggugaggaggaggaccucaggucuacccuggucagucaaagauggcaggaaccucugagacuuucuggcuccugaauacacauagugguuuuggcuuaagggagguugcagaguuuucagcuugucucuucgcuguccugaaagcugaacugacuguucauccaucccuuccucccacuguuuauccuuauccccuguggcugauguaacaaauugccacaaagguaguggcuuaaaaugacacagaugucucuuccuucuggagaugggaaucugaagucauugugacugcgcuaaagucaaggugucagcagggcuguguuccucuggaggcuccaggggagaauccuuuuccuugccucugccagcuucuagaggccaccccccguccuucacuggugacccaccccucucucuauuaucgaaaccagcagcacagagcacccucaacucgagcucucucugaccucucccuuuguagucacauggcucucucucuuugaucuuccugccccccuuacaaggacacaugaugacauuggacccacccuccccagcucggagucuuuaacucagucacaucuacggagucccuuuggccacauaaggugacguauuuacagggucuggggauuaggcuguagauaucccuggaggccauuacugugcccaccacacugucguucgcuaaugcuuugauugucuuuuuuuccauccugcuugcuuugucuucuuuaaaacccuggccagucugccuuguguucuuucaccacccgccccacgucacacgcauuuggauagcuugguaauguccauguuucagccaagacuuuccucccagaacucuugguacaugaagguuuuucuauuugaguugauugcccuuuacacugcuagguggaguccccuucacuguggagugggaucauguuacaggccacagcaguggugcuuugaagaggugacuuugcuacuugcaguuuugaccauaauugucccgugacgcuuuuguaguuguaacguuuccuguagguuuuugaugacuccugcccuguagaaguagaaaaugcuuaaaagauaauagggacuugcucuucuuuuccuaguuuggggacaguugugguuuuguuuuguucacagauguuuuaguuuucugcagagaugagaaaacaaagcuuaaaaauuuuuuuaaauuauuuuauauuuuuccaacuucaucgaaguauaauugacaaauaaaauuauauaaauuuaagguguacaacaugauuugauauauguauacuuugugaaaugaucaccacaaccaaauuaguuaacacauucaucaccucaguuacuuuuuuauuucuuuauggugagaacacuugagaucuacccucuaagcagauuuuaagccuacaauuugguauugcucacuauggucacuguacuguacauuagcucuccagacguaugcauuuuauauuugaaaguuuauaccccuuugaccaaaacuucccacccaugaccccaccucuagcaaccaccauucuacucucuguuuaagaaaauaaagcuuuagaauaaguucuugcagguagauuguacaugaaucagaauuuuacuguguuuuaguauugcuuuccacaucauggguuucucuagguugcaggcugccuuaguugguuuugagcugcuauaacaaaauaccaugaacuggguggcuuggaaacagcaaacacuuacuuuucgcaguuugggaggcugaaugguccaagaucaaggugguggagcccucauuaucugaucgccucccaaaggcccucccuucuaaaccaucaccugggggguuaagauucaagacaagaaucagggaguggggcggaacgcucagaccguagcacagguuaauagcuuucgcuaaucaagccacaaaacaguaacuagucagauaccuaaaguaacuuugacgaggcuuguuaucuacauaugccuaaguggacuucuaggcuuaaaugugugauaaauuccuuugaaaguuucagugagaggcuaugagcuuuugaaauuugguggcucuggggaaaguacugauuucuuuugucaugagaaaaauguuauuuuccaucauguacagaaggguggggaagaagauugagagcagggaaugaguuuuaauuuccaguucucuaacaucuuuggcccaucagggugugagugaaugugugaagugucuggcaaggcugaggagcagcagaggccacagagccuuggcucuccguguggcccuccuucauccccagcugaguaaccagggcucaggagccccccuccuccccugcugcguuaccuuccuaaacaagccccaccagcucccucccuuggugcucaaggaggagguccaugcacuccagucuggcgugaaggcaucuccagucugccucucccagucuccuucacgccugugcgccugcacacauggggcgucacacaggacagcacagccugugcugugcaugcgggggacuuccuaauguuucccgaguaggccagacccuugacggugccgagccuuucuccaugggcccgggccagggaggucccuucccuccucucugcccagaaauucugcucacacuucaagacccauuucaccccaguggcgcccuugccaccucauguugcaguugcuccguuuaucuuucucugacuucuguguauaccggguggcacggaguccugguuuauucaugaugguguccucagucucugacacuuuguauuuuucauugcuguucuagaaguuugguuuuccauguagaucucgagagacuguaggaccagugaccguguguguuuaggccucuucgcuguguuguucacuauccauuccuaacuuggcauuugaauguaucagucuucuguggguuuuguggaugugagucagauuucuuugucuugagcugccucuaaggaaugaagaacuuggguuucuauccaucaaggcugaggaccagaccuugaaugccaucagccccccugaugcucugugauuuuuaaaauauacauagcaacaauaauauuaacacacguuuaagguacuugcacacgauggcgcuccccugacaagaggugaggggugucuagugggggcguugagaagcugggccaugaugggcuugaagccccucagccccagguuccuguacucaccucugcagugggugcaucuccucugcuggccugagugggaggucccugguggguuuagcacacaagcuuuucuuucuguaaaggaucaaaggaauuugugggugguccgcuccugagcugagggcugagcgcuggacaggaagacugccugugagcugcagccagagacuugguaguguugagcuucuuugugccaggaauuguggaaggugcuggagaaacagagaggaguagaaucuggccucugcccuggaggacuauagccugcugggguggucagagacagaacaguugcaaugcagugugugugguggaggagagggaaaauguggaccagggguuuccuuucauuuccuccuuaaagcaucugacccacucacagccuaggggggcugcccccaaacacuguaggacgccuuccucccugccacccugccaggagauuagacagguggugggcaccugaacuaaggugggcgagccagaaucccugccaggaauuuggaaagagaagccagggcagcccguggcaauguggauguuccagggaacgcugcagguggagcugaagaaggggugugcagagugaggcagugggaggcccaggugaaacccagacaggcaccaggcagaaaaaggcaccgaggacagcuguggcugcucucuuccccgaugccggccuggugccugggcgguguuuccccaagggcuccugggauuggaaugggcuuuugucccauuugaugaaauguucccuaggaaaaaaggcauaggaaaagggggcacccuccagcugugccugaggacgcauggacugugcccccagcagacgccaggcgcuuuucuuauucugagaggaggguacuuggugccuaguacaugguuugcugccucuacagagauucauggcguaagaauuguuguguuuucuuaauuuuugagcacuuggauguuacuuuaauguaaaguuuucccagcugaacuaugaggaagaggaaaggcauuuguuucuuguugguuuuauucacagauuggccuuaagagaaggacggagccacauacugcugacggcccagaacuggcagagagaagguaagagaccccagggcagggaacgaccacagcagaaaaacuggggcccccuuuguggucaggcgccuuuugcuagacauuuacuucaaaaagguucagauucuugaaaaaaaucgggcuuaaggaggaagcuuccaucuguguggguuccuccaugaggcaugccugaccuccuuuuuguagcgagagccuuacucuauaggcuuggagcaacucauuuccccacaaauacugcuuuggcuacaacccauugaucuugauauguaguaucuguuuuuucuuucuuuuuuuuuuuuucuuuuuucuuuuuugagacggagucucccucugucguccaggcuggagugcaguggcgcgaucuuggcucacugcaagcucugccuccccgguucaugccauucuccugccucagccuccugaguagcugggacuacaggugcccgccaccacgcccugcuaauuuuuuguauuuuuaguagagacaggguuucacccuguuggccaggaugguuuugaucuccugaccucgugauccgcccgucucggccucccaaagugcugggacuacaggcgcgagccaccguggcuggccuguaguaucuauuuuuucauugaaaacacuguuuuaacagccuagauguaugccuaccuguuauuagaagaauaagcuuaauauuccaagugucuagguuucuuuagucauagcuuguuauucccaauuuuauuacauuuugcuugagagguccugguacauacagguaauuacauacagguaauuguuuuugcauuuacuuuccucauggccuuguguuugauuaguuaugacaaaaggcacccacacuuuuuaugaguuauuuccggaacucacaauuuaggauggucuaacauagaaucucgguuguuuuuuuuguuuguuuuuugggguuuuucuugagauggagucuaacucugucgcccaggcuggagugcaguggugcaaucuuggcucacuguuacuuccgccugcuugauucaagugauucuccuuccucagccacccaagcugggcagucaccaccauacccggcuaauuuuuguguuuuuaguagagaucagguuucaccauguuggccaggcuggucuugaacuccugaccucaagugaucugcccaccucggccucccaaagugcugggauuacaggugugagccaccgucccuggcuggaaugucaguuuuuaauguucuuauaggauauuaauguuuugggccugucuuugggaguccaguacuuaugacuguucaagggcuacagccagugugaaaacucugauaccgugcccgucaucagcauauccagcagcaggaggguugugggaggggugguggcgcggcuuccucucaugcagaucuggaaacagguaugcucguucgcuacacugaagggggggcccuaacuuugaauauauuucaaaggauugucaaucaaaggauuugggagcaguaagggguauuggugacugcuguacggaagauugcucagaaaaaagaaagacuuuguugaacuagacagcucauauuuuaggucaucucagccaaucugguucauaaagaaaaauuaccccaaaggagcauuuauuuuaguuguuuuuagcuuaaguauuugguuuauguacuuagucaaauuuaaaauguuuccuuuucaugaugaacuuuggcauucucauugugggaggugaguuucugugcacagagccccaguggacagcauuuuaccuguagggaauaaaggggcccaacuuuucauuugaggaaaacuuuuuuguuuguuuguuucgagauggagucucacucugucgcccaggcuggagcgcaguggcaugaucucggcucacuguaacuuccuccucccggguucaagcaguucugugccucagccucccaaguagcugggauuacaugugcccaccaccaugcccagcuaauuuuuguauuuuuaauagagacgagguuucaccaucuuggccagacuggucuugaacuccugaccaccugccuuggccucccaaagugcugggauuauaggcaugagccaccgcgcccggcugaggaaaacauuuuuuaaacuuaaugccacauuggcuuaauuugguaacuuaauauagcagcaauaucaacuuaauacgguaccaguaugaaacuuucuuuuuuagagagauuguuuccuuaucguagggcauuuaggaauccuacugcuucuccauuucuucaguuuucagucauauuucuuguguacguuuuguugauuuguaauucacacuacacauuuauauauauuuauucaauaguuuuaaaauuauuuuauaugccuuuuaucacaauauggugccauucuuguauguguuccguuucagugguucauuuguuuucuucugcuugguuccuuuuuuacuuugcaaaacuuuguugagcucagauuacacugcaguggaguaggagggaauuccccauucuuucucaaacuuaggcuaauuugugcugcuauuguuggguauuuucuuaguauccagacuuuuuuuuuuuuuucuauuuuaaagggauuucuucaaaaguugccacccccagaaguuuuauauuucuuuuucuuuuggcuuaaaaucauguucuuuuuagaauauaagcuguguccuuggguuuguguguaucugaguucccuguaauauaaguguagucuauugcaguuguuuugauauuuugucuuucgcaggaugcacacgguugguuuagccugauaugaaguccacucacucggucuguggccagaccccccaugccuggccuuugucuacuucugcaggguuaucucugauugcaggcacacaccuaccacaucauguggcauuuuacauuauuuuguuaaaugucugcgucuucaccuagggacggucauuuaguucaucugugaauccuuugaaucacaguacauagaacauaguaggugcuuaguauauacuugcuauguggacacucaacagaguuguguuggacuuuucuuuccucaaauguaagagaccaggcaacauaaugguuacaaauuaaguuagaagauggaggagugcucccucuauugucauuugagaagccauuuuuccaagcuuggaggguaucucuuuaaaaaaaauuuuuuuuuuaauugauguaaagguuuuugaaagcugaguuuugucuccaguggauuguaagcuuuugaggccaaggccaugucuuagugccaccucuguuucaucuccuuugucccuacacagguaguagguccuccauucuugcugauuaugaauaaagcaaagaaauacauguaccucugcuguaugaauuagaagcuuuguguuuguuauuauuagacuaggagcauguuacaggcacagagcauauuguguuuaucucuguagccacagcauguaguguaguaccugaauuuuagugggaauuugguaacuucugguaguuauguugauuagucuccuuggaagaaaguaacuuuauaagcuacggauguuaaauggugagaucauaaauuggcugaaucuccaggcaugguggcucacaccuguaaucccagcacuuugggaggccaaggguggcggaucaccugaggucaggaguuugagaccauccuggcuaacgcggugaaacccugucucuacuaaaaauacaaaaaauuagccgggcgagguggcgggcgccuguagucccagcuacuccggaggcugaggcaggagaauggcgugaaccccagggggcggagccugcagugagccgagauugcgccacugcacuccagccugggcgacagcgagacuccgucucaaaaaaaaaaaaaaaaauuagccgggcgugguggcaugugccuguagucccagcuacuugggaggcugaggcaggagaaucgcuugaacccgggagguggagguugcagugagccaaaaucgcaccacugcacuccagccugggcgacagggugagacucugucugauagauagauagauagauagauagauagauagauagauagauagauagacugaaacugugagccacguacauuugaaaaguuaguguuauuugaacguacaauugacaagaucugaugcccucagcuggaugucuucacucagacuguguauguuccuuuaauuuauuaaucaaagaggcucucucucuuucccucucccugcagguugccauggcugcuguugacaguuucuaccucuuguacagggaaaucgccaggucuugcaauugcuauauggaagcucuagcuuugguuggagccugguauacggccagaaaaagcaucacugucaucugugacuuuuacagccugaucaggcugcauuuuaucccccgccuggggagcagagcagacuugaucaagcaguauggaagaugggccguugucagcgguaaccuacuuuauaaucaaaauaaucuuuucugugaagucggaugcauuauucaaggagcuauugaauuuaaugugguguuuuuaugggaacaugcugauaaaaaaauaaaacuuauggcuccugccgugauuauguucacauuucauuuucuuacugcucucaucuuaggaagaacuggccucaugauugguauccuuccuauucugcucucuccuguucccaguccuccuccagacccacuuccuacuaugugcuuuuccuuuuuguucucuguuuuaaaauugucuugaaaguguugccacuuucagaaaugcuucaccuauuuugaauuucauuuuaauuuaugaagauuucccagaaaagcaccuccugccacucauucaagccagauaguaguuugaaaacaaauuccuacugugucuccuaaccaauauggugaauguaaaauaacucccuguccgugugucaggaugucugggagaguguauagcaugcgcccuucacauuccucauucagcaacaguguccuugacuuguagauacuagaaccgacuugauuucuagugugaauuuuucucugacuaaaccugacaggggguacuuuggguccauuuuaagggucacaccgugaaauacacaugcucacuuuuccugacuugcauccuaggugcaacagaugggauuggaaaagccuacgcugaagaguuagcaagccgaggucucaauauaauccugauuagucggaacgaggagaaguugcagguuguugcuaaagacauagccgacacguacaaaguggaaacugauauuauaguugcggacuucagcagcggucgugagaucuaccuuccaauucgagaagcccugaaggacaaagacguuggcaucuugguaaauaacguggguguguuuuaucccuacccgcaguauuucacucagcuguccgaggacaagcucugggacaucauaaaugugaacauugccgccgcuaguuugaugguccauguuguguuaccgggaaugguggagagaaagaaaggugccaucgucacgaucucuucuggcuccugcugcaaacccacuccucagcuggcugcauuuucugcuucuaaggucagauguuacuuacuggaagaugaaauccuaaugccacagaacauuuauuaacaguuguuuggucugauuuguugaacucuuugucagcaacucacauaugcuuauccuguauuuuuuccugaauugauaauaagcaagucuuuuuuucuccugaauuuucaaguucacccagaauuaaaagucuuuuccuccccucugucucaacaggcuuauuuagaccacuucagcagagccuugcaauaugaauaugccucuaaaggaaucuuuguacagagucuaaucccuuucuauguagccaccagcaugacagcacccagcaacuuucugcacaggugcucgugguuggugccuucgccaaaagucuaugcacaucaugcuguuucuacucuugggauuuccaaaaggaccacaggauauuggucccauucuauucagguaggagugugcuucaggucucauaauuagauuaaugcaucaugaaccuaucucagugauacagagaaaucugauuaaagccuaagaugagaauuguaaauucugacucuuaagccugacacuuaauaauuuugguuaagacacuaaauuuucuuucuuuuuuuuuuugagauggagucuggcucugucacccaggcuggagugcaguggugcgaucucagcucacugcaagcuccgccucccggguucaugccauucuccugccucagcuucccgaguagcugggacuacaggcaccugccaccacgccuggcuaauuuuuguauuuuuaguagagacgggguuucaccguguuagccaggauggucuugaucuccggccucaugaucugccugccucagccucccaaagugcugagauuacaggcgugagccaccgugccugaccaaagacacuaaauuuucuuuugugaaauuauuaccuuaagaauuuucaaaaguucaaucuauguggcaccuuaaagugaaauauacuacuuuggcuggggugugguggcucacaucuguaaucccagcacuuugggaagcugagguggguggaucaccuaaggucaggaguucgagaccaaccuggccaauauggugaaacccugucuguacuaaaaauacaaaaauuagcuaggcuuaguggugugugccuguagucccagcuacuugggaggcugaggcaggagaaucgcuugaacccuggaggcggagguugcagugagccaagaucacgcuacugcacuccagccuaggcgacagagcaaggcucuguuuccaaaaaaaaaaaaagaaauaugcugcuguaaguggauguuaggacuauaaaaauacuaaguauuuacaugggaauuucaaaguaaaagauucuaguacugcuugaggguuaccucucagugaaaaauauaauccaaaaaaaccacaaaaccacaagauagggcuauauuucaugcaaccauuuuaucaaauaauaucucuguauagucuuagacuaauuuuuucaagaagcauagaauuuuuauuuuaagcuuauuguuuaggcaugacaaaggauugguaccuuuuaguacuguagaaaguaacuuucuuagauauuugaaauugugaucguaaguauuaauuugagaaugcauaauuaucuauuacaauauauuucaguuccuuuaucugguguaguaaagagaugugcccuaguuuagaauuuuuuuuuuuuugagauggaauuccgcucuuguugcccaggcuggaguguaauggugcgaucuuggcucacugcaaccuccaccucucggguucaagugaugcuccugccucagccuccggaguagcugggacuacaggugccugccaccacgcccagcaaauuuuuguguuuuuaguagagauggaguuucaccauguuggucaggcuggucucgaacuccugaucucaggugauccacccgccuuggccucccaaagugcugggauuuacaagcgugagcuggcagggcgugguggcucaagccuguaaucccagcacuuugggaggccaaggcgggcggaucacgaggucaggagaucgagaccauccuggcuaacaccgugaaaccccgucucuauuaaaaauacaaaaaaauuagcuaggcgugguggugggcgccuguagucccagcuacucaggaggcugaggcaggagaauggcgugaacccgggaggcagagcuugcagugagccgagaucacaccacugcacuccagccuggacgacagagcaagacuccgucucacaaaaaaaaaaaaaaaaaauaccagugugagucacuguaccugguccgaauuuuuuuuuuuuuuuaauauucggaguuuucuuaauuaucaaacagauauuuuugggacuguuugcaugaagaguauuagauuugccacuaccaaauaaacauguaaguauaucaacaguuaauuaugacuuuuaugaaaagugagagauuaauaagaagcaguuuuggucgggcguggugguggcucacaucucuaaucccagcaguuugggaggcugaggcugguggaucaccugaggucaggaguucgagaccagccuugccaacauggugaaaccccaucucuacuaaaaauauaaaaauuaacuggucaugguggugcacgccuguagucccagcuaccugggagucugaggcaugagaaucgcuugaacccaggaugcggagguggcagugagcugaucacgucacuguacuccagccugggugacagagcuagacucuuaucucaaaaaaaaaaaaaaaaaaaaaaaaagaagaaacaguuuuauuuaaguaguuguuuccagguccuuuaauuacuugagaaaagcagagaaaccuaaaaaguagucuuagaagucacugaccauaaaauuuuuuuagaaauaaagauaugaggaucagguuuaggugcaguagauguuuugacuguguuuauaaaacacgaacaguuuacucaaaauuaaauuuuguucacauugauaaacuuuccuugagaauguauuuuucugccaagaaauucuguuaagcugauuuaauuccuggaguaguuuucuguauaaaguuguuaaaacuuucuguuuucauuuuauguuacucaaauuauuuucaacacuaucauuuuuuauuuccaauuuuacaucaaagauuugauucauccuuugcuguuuuguccauggcauauuucucugauagcuuuugcugcugugauuuuguucacaaagugcgugaguguguguguguguggguguggguguguccucccuggagaguaaccuguguccauuuauugacaagaggauugaaugaccucuauuaucauucaucaguucaguucaagacuagaaugucaguacuugccaagggccugucucucuucucuuucguauacacgguguuagaacuuucauucgguucugaacaaaucuguuagaggaguguaggcuuucuccaccucagcacuguuggcauugagagcagguaauuccuugacauggggagcguccuguguauuguaggauguugaacaccauccugggccuccacccacuagauaccaguagcauccacucccagugugacgaccaaauuuguuuucagacauugcccuaugucugcugcuagcacaaaggcccugagugagacccugaagcagagcagcaucagcaggacucccuucccugguccccugagcacccccaucauaggucaagauaccaucccaagguacugguguuucugaccuguuuucuuguugaacuuuguuccauacuaccccucaagccccaguuuucucauagaguacuaaccacguaugcgucugucuguuccaacugauuuauuccuauaaugauuuugugguguuuuuuuuuuuuuuuuugagacagaguuuugcucuguugcccaggcuggagugcagugccgcgaucucggcucacugcaagcuccgccuccccgguucacaccauuuuccugccucugccuccugaguagcugggacuacaggcucccgccaccacgccuggcuaauuuuuuguauuuuuaguagagaugggguuucacccuguuagccaggauggucucgaucuccugaccucaugauccacccgccucggccucccaaaguguugggauuacaggcaugagccagcgugcccagccgauuuugugguucuuaaccagugaacauuuuguucauaucacguuaaguaaagacagaauuguauuuacaugcaggacaguccagccucauuacagaaagucggguaggugggugguggucauguuucuguuccauguagaaucuaggguaagaucuuaggcaaaaguagguauucaguacaguaguaccuggaggcuuuuuccuuuguuguauuuaaugugauugguggguauuuguugugacugguggguauuuguugugauugauugguggguauuuguugugauugaucgguggguauuuauugugauugguggguauuuguugggaucgauugguggguauuuauugugauugauugguggguauugugauugguggguauuuauugugauugauugguggguaaugugauugguggguauuuguugugauugauugguggguauugugauugauugguggguguuugugauugguagguauuuguugugauugauugguggguauuuguugugauugguggguauuuguugugacugguggguauuuguugugauugauugguggguauuuguugugauugguggguauuuguugugauugguggguauuuguugugauugguggguauuuguugugauugauugguggguauuuguugugauugcuugguggguauuuguugugauugguggguauuuguugugauugguggguauuuguugugauugauugguggguauuuguugugauugcuugguggguauuuguugugauugguggguauuuguuugauugguggguauugugauugguggguauuuguuugauugguguguauugugauugguggguauuuguuaugauugauugguggguauuuguugugauugguggguauuuguugugauugguggguauuuguugugauugauugguggguauuuguugugauugguggguauuuguugugauugauugguggguauuuguugugauugguggguuucaugugcuggucuguguacuuguuccuucaguguugauuuuggguucuaaccuuacaaccuuuuucucuuucauuuuuaguuucuuuuugcacaguauaugccugaauggcucuggguguggggagcaaauauucucaaccguucacuacguaaggaagccuuauccugcacagccugagucuggauggccacuugagaaguuuugccaacuccugggaaccucgauauucugacauuuggaaaaacacauuuaauuuaucuccuguguuucauugcugauuauucagcauacuguugauucgucauuugcaaaacacacauaauaccgucagagugcugugaaaaaccuuaaggguguguggauggcacaggaucaauaaugccugaggcugauugacgacaucuacauuucagugcuuuuucccuaagcuguuugaaaguuacgcuuuucuguuguucuagagccacagcagucuaauauugaaauauaauaugauuugucaggucuuauaauuucagauguuguuuuuuaagggaaauugaccauuucacuagaggaguugugcugguuuuuaaaugugcaucaagaaagacuacugaaaaguauuauuuuguaacuaagauugcugguacuauuaggaaaaaucuguguguauuguauagcucuagcuguuugacuaucuguaaugaaaaugcugcacuucaacugguauuucauuagagaaccgugugugugcguguguguggugccuuugagcaacuuuauuuaugguuaccauauuuuuaaaaagauuuuuugucagggugacuuaacauggacucuuauaggguauuaaaacaaucuagauuauuccuuuucauccuaaauaagccuaccaaauuucaugcuguugguuugccaugaaugauauuacuuccuacauuauauuuguguuuuuucaaaucugcuauggaaugaacuuauuccuagauuuggauauguaagagaaaccugcagucaucuuuugauuuauaaggcaauucuuguggauaaauagugauuucucagccucugacccauuuuauaacugaaauuuagcccuuuagagcuuguuauaucugguuuuccuacguuuuucuauguaauauuauuccauuccaguagcauuauugauagaaauaguaaguauuuauggaauaguaaaauauggacaaauuacgugugugacauaucugucaauauaaguuagaagcuuauucuugguuuguguaaugaauuuauguauuguagugaauaccuuuacuggugugaagauaauuaugcacaaacccucacaauacgcguuaacauugaaaccugugaaauguccuuaguuugggucauauaaagccaaccauuuuugaggaccauguaccuagugcuuugaaaacucuaagucacuauaugaauaugacaauaugugcacauuuaaaauucagagcucggcauugugauacugaugcagaagcuaguagauugguuaaaagucuggacuucuguggcauuuuuuucgugacgugauaaucuaucauaagcagaccuaagcacaguuuuaugaacacaauuuugcccaugacauugccuacaggauuuccagaugugacuugcacucagaagaucaguggucaacuucagaagcucuuccacgcuuagaucaugucuucagaacuuagaugugaaaaucuacacacugggagaugcugugagccccaagguuuugauggaguuugcuuggaauccucuugacuucaugccacauugacgugaacuuugauguauaauaagcagcagcaacuucaugugaaaauauggucagguaguuauauguaagguuacgugguccaguaaugucuuagauugauaaauuagguauggaauccaucaguguuacgugaugagaauaggugaacacaccuugucagugaugauguaaacuucucuccuuggcaggacaugggcaaacaugcugauuggugcaaauguggugccgagcuguccauagcugcagugaaagaugaagagcaagaccuucucuagguuuucuagcuuucauuaaauguauuuuuuuccccagagcuaauuugaaaguugauuggaccacuguggauggggugucauuaagaaugugggaaauaggggccgagugcgguggcucacaccuguaaucccagcaguuuggaaggccagggcagguggaucgcuugaucccaggaggucgagaccagccuggggaacacauccugucucuacaaaaaauacaaaaauuagccaggcaggguggugcaugccuguagucccagcuacuugggaggcugaggcaggagaauuuuuugagcccaggaugcagagguugaagugagccaagaucgugccacugcacuccagccuugagacagagcgagacccugucucaaaaaaaaaaaaagaacgugggaaauaugaaccuuugaaaguuaaucugugaauugaaaguuuaacaauaaaaguaguuguuuguuuccuuuggaagaguuuuguuc

SEQ ID NO: 15839 - RNA, 2225 nt, Homo sapiens
acuucauauuaguuguaaguuugggguuugguccucacccaaguuggaaagcuguuugcuuaagacauagauguauuauaauaauagaagggagggaguagaaagcugaugaacccuuguuacuuauagcaaacuuccugcuguuuuaaaugcacagagauuauuuuaucaacugugguuagcacgcaauugguauuuuuauuguucugccauuuuauugaggcuaucaagugggacuucagaccuggcucugagcaggaccacacguguguauuuauauugagugcccucacucaugauaaggugacuucauggagacccagaaacucacccuaagggguguucaccuuugaggugggcauccagaugcugaggggaagugggguccauccucugagguccaggggccuacuuugugagcucaguuguguucaccugugguucaguguaccucggccccuaagccaagugaucguucagugacuugcagcaaugugggaagugaggggaccccugccacaccccccaccacccccuguagagucacugaccuucauccuucacccugguccuccauggugcagcagcaucucaugggccuuguggcugucagagcccgugguuggaaccccguccacuggucccaaaccuggaggggcagcugcagaugagguuuagaccuccuggugucuccguggauucugagugcccaggaggggaggggaggggguggcauccuggccucuaggauaaaugccuggaguauagggcagcgccacgggcacuuggagacccuguccugcgcaucugccaagccuggcaguuuuuagaguuuuuugaaauguuuugauacuuuuugauacaauuugcuaauaacuguuuuguagaaugccugccgggguuuuccaccucaucccuuuccuccggccccuugauuugugcuggacaacaaauggcagcaccaggaccucgccucauguggcuuugucuuggaucuugcccuucuccaucgcugaugugauacagcucuagaauuucgugaaguugcaugcaaaguugcaugcagcccguggguaugacugucucaggcccccagcucauuugccaagaggaaaccuuaaccccccugagagggucugcguuucuucuagagcuccuaccucaguggugugcacagaguuggagacaccugagggcugguccacgucucaccuuugccauacgggucauuucuugaucaaauauaugacugggguccugguuuacucccgcccacccuuucuuuuaaaguauucuuaacaugaaauccacaaaagcggaaacaaugaaccauucuugcacuuuacagaaucauuguccuuagcuuuagagguuguuaauuucuuguuuuuaacaugaacagaaugugugguucugaaggugugugggggucucaagaaauuguccuuuggggccgggcgcaguggcucacgccuguacucccagcacucugggaggccaagggggacggaucaccugaggucaagaguuugagaccacccugaccaacauggugaaaccccgucucuacuaaaauacaaaaauuaggcagucguggucgccuguaaucucagcucuuccggaggcugaggcaggagaaucgcuugaacccaggaggcagagguugcagugagccgagguugcgccacugcacuccagccugggugaccgaguaagacugucucaaaaaaaaaaaaaaaaaagaaaagaaauuguccuuugguugccuuaguuaccagaguugaaugaauguacacauuucgguagugggggggcagagcggauaaccccuuccuugucuguuuccuuugagaaaggacacuccaccuuuucaaagguacuuaaagccaucuuuacagauugcuuguaauguaaggaaagagucauguccuuuggauugauugagguuaaaucaucaaccacuagcccccuuucaaaaucagcgagauauuugaugauuaagugauucauuggguauguucuggcuacugauguuacugaaaucugcaaucguguauguuuuuuaauuuguugcuuuuguauuuguaauuuuaugacauuucgaaguuucugugucuuaacucuuuuuaauuaauuuucugcacguugcuuuuuucucuuuguuuuuaauuccauacagaguauucaauucuugaaacacauuaaaauaauuugcuugcuagggu

SEQ ID NO: 15840 - RNA, 4226 nt, Homo sapiens
gguagugggugcuugaaaacuguuuggugaaugaauaauuuggcaaggcagagaaagaauucuaauuggaggaaacaggagcaaaaccacagagcuaugaaaggcgagguaaggggaauccaaaggagcaccauauggaagagaguggggaauguugagccuggaaagguugggagagccagaagguuucgcaacagguugauuuugugaccugugcugugguuuuguuuuauuuaauuuuuuauuauuacuauuuuugagacgguguuauucugucaccuaggcuggagugcaguagcaugaucucaacuuacugcagccucaaccuccugggcugaagcgauccucccaccuuagccuccugaguagcuggggcuacaggugcaugccacugaaacuggcuccuuuuuuuuuaaauuacagaaauggggucaggccgguugcucaggccugucuugaacuccauguugcucaggcuggucuugaacuccugagaucaaaugaucugcccaccucagccuccuaaagugccgggauuacagguagaccggugccacugcaccuggcccuauauauuauuuuaaaauuauuuaauuuuauuuuucaaggaauuuuuauuuagguuuuuaauuuuuuugagacagggucucucucuguuacucaggcuggaguacagugaugcagucauagcucacugcagccuugaacgccugggcucaaguaauccuccugccucagccucucgaguagcugggacuacagcuguguaccacugcgcccagcuaauuaaaaaauuuuuuuuguagagauagggucucgcuauguugcccaggcuggucuuuuaacucaaguguuccuccugccuuugccucucaaagcacugggauuacaagugugagccgccaccucuggccugugcugugauuuugaacggugauuccugcagccauguggagagucauuggaaucuagugacccuugaaguuagcguucugcagagguacaggcuagagaugagggcugccuaaauuuggguugugggaaaggugagaaggaucagagcuguaagugggaagugucgucauacauguaggaauggaggaauuuuguguccagaggcuaaaagguggugaaucaauccugguugcaugaggaaugucacugauuuggaaaaagacgcuagcucuauguuaagcuggugguuugguucaccgggaaacacugccguucauuugcagcacugcgugaggaggggcagucagcuagagaggcuuccagucucauuggagaccagcuuuuagaguucacugaaauguuuugaauucuuagauuccauauuuccaacauucaauuuauucauuacagaaugcacuuucuuaaacugagugcucuggaagccaguguauuuuaguggaagaacacgggcuuuggaaucaaaacaguucugacuccacccuaacuggcuguggaucugagcaaggcacuuagccucuaagacucaauuuugucauccugaaaaugagcucgugauacgccuggcuuuuagggugguggucacguguguaaaucuccugacaaacagaguagaugcucaguaaauagccuuucuucucaccuucaaauguuuuauguugucauuaacuuguaauugagggcuaaauguauuguuagcaugucauauuuucuuaguauuuugaacucugguuaaucuggcauuauaaaagcucauuuuguauuaaacagggaaacucuaggaagacagggaaggagguugggaauaccagccugauugaggcucugcucuucccugggacaggaugcuuaaugagguuuggaacucuagaguucuuuuuauuucuggauuuagauuucuugaggguuuaguuaccaugcugggauuuuuaaaaauagcugcuccauuugacugucaaaguuagguuguggcucucguacagggaugaaaggggaaccuuugggguacgaguaagcauuccuuggaggccaccucaucuggccugcgugcucuagugaggucccgcgcacauguuuucuggaccugaaguugugacuugccuacaggugggguuuuucucuucacccccgucucccucuuucucuauaacccuugugcauuucucuucuacuccuuuucugccaggcuccuuugggccucuggcccacuccccuggcagaucuuaucacacgccccugucguuugccuguggacuuccuuucuacuuuuucuugucucccucaagcacccuccuucccuuacuuauucacucaagaaauguuuguggagugcguggugaacccgggagugcuggggauacuaugaguaacauuccauugaggugauggcagaacaagcagccagggagaggcugcuaggaagggaggccagcaggcuccagauggaguggggcuuucuaggccaugguggugggguggagugggggguggggugggauuuuauucgcacugaaaaggcagugauugcaugagcuuagggaggggagugacaugaucugauuuacgucuguggaagaccacucugggugcugcaugggggacuggacuguugggugagcagaggcaugagaguagagagaggacuggucagcaggugaucuaagcacuccccaggugagagcucaugggaccuuggucugggcgggugaggaggugggagaaguggucggauuugggguagguuuagaggugcaccccauaggacuugcugaucagcuagauguggagagguggggaaugagauacaugaagggcggggccuuuuuuuuuggguguggugugccguugauugagaugggaaagaguggggucgugacugagugggggagguucugcuuugacccuccugcccuggaguuguuaaguggccaguuggauagacgcccuuagggaugcaucgucagccugagaguuuuccagauaucuuuuuuuguuuaaacuucgugaaacugagguuccccauuagcuccuuuguggagagcauguagaugaagggaaggccgaggacuaagcccgggugcucccggcguuuacauggguggaggagaaguauccagucagagaccggguguggcuagggggaagggaagucaguguugucccccaggccccucacuccugagacugguguucccucucccacuuccacgguucauugugugcuguguguguucccccacuuugccauguuuuugaucugcaguguucugauccuacuguagagugauuaaguauuuuaauaugaaaugcccuucuagaaaggucaggcaaugucacuauucaccguaugacuuacgugccagcauaucauugagaucuggcuugaguuggguuaauauucugguguggauuuuuuuuuuccuuaaaaguaauauucugaucuuuggauucaguaauuugaguagaaaaucaugguuucuuagagcaucauuuccuaugguaggauuugaaaggacaaacugaauauuucaugauugccaguugauggcaagagcacuuaggagcgcagucgccaucagcucacugcagugggucagcugagugcugcgcuccuuuugugaguugagggaggacgugagcucccucuguagccuuccccaccuugacucagguucccugacucauccgggcugguggcauaccugggauguggccccguuugcacggcccauaggaaccacugccuccggaucuuacagcgccccccuggacccagccucaguccugccccucacuuccucugagucuguuucucaggcuccucgggcccucagugcccugaguuucggucacuuggcuuaccaggccucuccuccugcccccuggacucugagguuggccucucccgcuugcaucuuggucuugccuucguuacucugcuuuucuagcccaucauccuggcuaaucuccagcccuggguaaguuuauggugcugggcugggcuuuuggauaaaaggaccagccauucccauccucuaugagacacuuaaggugucagcauugucugggcccugcagggugacaguucaggccccucuuggccgccgccucuccaccccauuuccauuuugcggucuccauaggcccucccagcgccgcagccccgcuccuccucucugcugagacacucagcacucgucuuccugagugaacugcuuucacuucucuucaugcccggguuuccccuuucuucc

SEQ ID NO: 15841 - RNA, 122316 nt, Homo sapiens
acacccgggcagccguggaggcuccggcccguccuuggucgucaauuaccucauuguggaucugccagggccaagguggccgaaauugccugggcgcuggucggagagagagccuuuugaucaucuugcggggcgggggggggaaagacugauuuuuuuuuuucgucgcucucgggaucgcucuucugccuuuauuuuauuguuuuggacauuuuugagcgccguggcuugaacggugcuuuuuguucauuccuggguuuuaauauuauuuuccuucuucaucccucucuggccacuauggaauucuaauuugaaccauguuuggauugaagccgccucuguauuacuuaccagguaagcgagccgugcgccucccugggucccgcgcggcgccggcgcgcccgggacccucccucacccgaccccccuccgccagacccccgagccagggucggggcauuggguccgccggugccccccgcagacgcgcgcggccucggauccucccgcugcggucaagcccgcggugugcgcggcuacgugcggcggggagcgcccaccuggcccgccgcccccaucgcgccgccgccggggguugcgcgucucgcuccuuuugucugccgggagccggcuccgccgcggcggcggagcgagcggccgaggcacuuaaaccuuccaaggugaaguaagcgccgagugugaaguuacuuuccugcaggccgccccgaucggguagcaugccccccccccccccaguccugggguuuauuucccucucccuccagccaacccccuugcgcggucucggcgcgagcguggcucgccggcccccccgccgccccccuuccugccugggauucccuggaagguuuuguuccgccgaggucggaggagggggccggggaagcucaggaggguauuuggcguggcuuccuguuuccuuaaccuuccugcgcggugacagccgcuugcccuguaacuuucuguuucggggcaagucgcgcuuucagccuggaggggaggggaggggaggggguugacagcuggagguuuggggagccccuccugaauucaccuuauuuggauuucuaaaccuuaaaaaaaauuaaguguaggcuacauggaagcuggugauccaggaauucaggcgagggagcccuggguggugaaccccaggguucuuccccaccgcgcgccgucacccccacuccugugcccccuggggucggggagaaacgcacaggccugccccagguggggccacgugacgcaggucaggaaggcugugcugcgugugacugcugguucuaggaaugagcugauuuuauuccucccucccuccgaguugaucucccuugagcuuugacacacgguaccuaaugaaggugggguguguguggguggggagggugauguggggguguagggaggagaggggaaguuccuaguuuucccauguugaggcuuuuauaaaauucugcagaagacgcugcccuggagcuuuauuucugaauuguuuugcuggggaagggugcacguggcccgguguucgguuucggguuuuuuuuuuuccucuguucagaagauccugucacuuuugcugaggcuuccacaccucucuggaguccccaggaggagcguguggggcaggaaggggccuggacaggacccagcucccuuggaucuggccuuugcugcccuaaccugggcaaacguuuucacugaguuaacagagcagggcagagggucaccagaguccaacugacuuaaaaaaaaaaaaaaggcaggagagacuccuccuggaggaaaucuguacuuuuacucuuuuugaguuucguggugucuguuuuaguucccaguaacugaccaggucuauguuuuuuucuugguguguaugccguuuugauaggaagaauauugaauauuuuccagcguuuccauuccauucuugaucuuuuuuuuuucuccuccucugccugaaaugcaaagcaacaacaaacagcaagcuucgcuuuucccucccuccccuagcggauccaauccaaauuagaaccgggaauccccaacuuaguaaaauaaagguuguaaggggagggcggagugagcccuugggaacucagagcuaucucucccaugggaagauuccagguaaaugagggcugggucugagucgcgcugacauucaucagagcccuuuagcccaaaaugaaacagauccucaugcuguaucuggguuuuucucgucugucuccccccgggucuguggcuggggaaagcagagagcuugugccuccccggcagcuaugccugccuuggaggcgcucaggaccagcuugugccaagaaugaaucuucuuaaguacagggcgucuucaaagcacagguguuuguaaucuacaccccucuucaccugccacuggaggcugcuggugcauauuuauucaucaggugaccgauuuucuguuuacacagggagacucagaaagaggaggaggaagugucaggcugggaaauucaaagccauuaaggaagaucagcccaggcuggaguaaagcccccaguggguaggcaggaggggugacuuuuguccugacccccagggagauuaagagaggucagaagugaggggaggggaggucggggcacaaguaaaucucagccuguggaugcaggcuuuccccgcauuauaguuuuuuuggugguuguauuuaaaguccccacugggguuuuacacuuuauugucuuaguguaauauucagggugagggcuuaccgggaagaacuauggucagggaguggcuucccagggcugggguuaacgcauugagagugauggaaacggcaguggccugguccucuuuauuuuuugagauggagucuugcugugucgcccaggcuggagugcaguggugugaucucggcucacugcaaccuccaccuuccagguucaagagguucuccugccucagccucccgaguagcugguauuacagacacccacgaccaugccaggcuaauuuguguauuuuuaguagagaugggguuucgccauguuggccaggcuggucucgaacuccugaccucaggugauccacccacuuugggcucccaccuugggcugggauuacaggcuuuacgugcccagcccuggccugguccucuugagugcucucaggcccuguuacaaaugcuuugugggcucucuguagaucucacuuccucucucugagguagcugcugccauccacccacuuaucagaugagcaaagugagacccaggggcucagcaauugcccagcuugggaguggcggagcugggacaugaagcuggcuucugucugccacacugaacugggaauaaggggguccaggugcagcagccagcauggcuugcuucgggccugugguucuggaugagaggcugacccugccccacagaggccugacaccauggugcucugcagccucuuggacuugguuucuaugccugaugccagaucccagacacugcagggagcaagggcccagaacccgccuguccagccauugccccaggggcaguucacagucaggcuggcaucaggcacccgcugcuccuguuugacaggugagaggacugaggcugggcaguagguuugaagucaggcucugccucuccugagcuguguccuugggcgggugacugauacucucaauugagucuguuuucccauuuguaagaugggauccauaauuguaucucccucaggaucaguguaaggcaagggucagcaauccauggcccggcccauuguaagucaaguuugauuggcacacagccacgccuguuccucuggcagcuuucacauuauaauggccaagcugaguugugagcagagaccaucuggacuggccacgccuaaaaucuuuaguuauugucugguccuggacagagaaaguuugcccacgcucuguugcaagaaacagaaugagcagguccacugaagauggugccugggaugaaguuagcgcuugucgagugauaacuguaauaauaauaauucuuauuuugucacggucauuauuguuauugagguagaauuauuugcagcaagucacagagcuuuuuuuucuucuucuucuuuuuuuuuuuuuuuuuuuuuuaugugagacggagucucucucucuugccaggcucgagugcaauggcgagauuucggcucacugcaaccuccgccucccggguucaagcgauuguccugccucagccucccaaguagcugggacuacgggagugcgccaccacgcccaaguaauuuuuuguauuuuuaguagagacgggguuuuaccauguuagccaggauggucucgaucucuugaccugccuuggccucccaaagugcugggauuacaggugugagccaccgcaccuggccaagucauagagcuucuuaguggggaccugaacucuugucuuuggaccaggccucuugccgccaugguuguagcgucugccucuuagugcuucuucacuggccagggggaaaugguagccgugaggggaugcuggcugcagggagagcaaggugcaggggcaugugugaaaggagauggggcuggugagugggagggcacaagcuguggccuccaccuuccugcaaauggggcgacugggaaauucaaacgggggucccuucucaaaccuuccucuguauguauguauguaugccuagauccccccuuuccugaacuccaccaggcugcuagccccaugcuggcgcagacugggugucuccuuuuuaccagacucagugccgggccaguaauaacgauccuaaaaaaaauaauaauaauaacgaggacugggcgagguaucuuacaccuguagucccagcacuuugggaggccgagguggguggaucacuugagcccaggagcucgagaccagccugggcaacaugguaagaaccccucucuacaaaaaaugcagaaacaauuagucgaucgugguggugccugccuguagacccagcuacucaggaggcugaggugagaggaucaccugggcccaggaggucgaggcugcagugagcugugauuccacgacuguacugcaaccugggugacagugagaccuugucucaaaaaaaaaaaaaaauuauucaugaggaagaggcaguggcugcuucgucuacuauucccauuccacgccagacacggugcuuccucagaacagcucuggaggugaggcuacucuuaccccccuugacagccagggaaacugagguacagagagauugaggucacaugugcgcuaaaugguggagcagggcgccgauccugggcagucuggcuccagagucccugcuucauaaauauuuguugacuguguugagugggagcuggccgcuggcguuggcagcggcgcccuccgagccccuuaucugguuccugucguuucuggagggaggacugacuccucagccaucagcugaccccaccccagccccacacugaacucugggugacccuggccuucccucaggaucacuguccacugcuagaaaggcugcccucggcccuccagggaggaaacugaggcccagagagagcuggggcuuggcccauagccaugaagccugcuggugguugcucuaggacucggggucccccuggaacauuuccccggccccagcugcccccggaggccagagcaagucauaaauaucucauccggccuguccuaggccccuuucuugaccauccugggaggggcuugcaggaggcugaggcuuccccugcugagagcugggguacccagagugaagcucggccugugggggccgcuggguucuauuucccacccaucuaaacugcuuccagaaagucaaggugugaggcaggggcucaggcccaccuggguuggggguggugucuggaggugaggucaggcuggaacccaacucccagggugcuuggagccgaggcggggacggggcacccgcagggaccaaggucuugcauagccucaggcuugucaugggacguuagcaaaccauagcuguggcgccggagccacccaagacccacucugggcgcagguuaggccuaaugggaucugacucagauaaaaggaaaacauggcuauuuuaguugugauugagaaagcugcuuauuuacagcucagaaacucagcggggacaggcauuucggcuuccaucuagcacuuuccaggcagucacuaauuaaucuuccgauaccccugagagauggggaggccgccacgguuccaucugucggcugggaaagccaggggcccuuuugucccagcugcagcccagcccuuuuccgaggggccuggucugguucccacccccccugcccaauuugguucucauuaagguuuuuuucuugcuuaaauguguuguuguuacgccaugggugggaaccugauauagucccgcuggaaacucucuucuuaucuccuugacucuggagacagaagagguuucuuuguacucugggagcaaauggucauuauguuaccuggauuccggggcaagaaugcguguccuucuacgcaggggaaagugcagggugggagcggcagguggcccaagccacacagcuccuggacagagccgggaaggggaggacgugucuggacuuggccuccugcuuugagccuggugcuccgugucgcuugcccaucuuccuccuggacauggacacguguuggggggagcggucccagggggguucccucucaccaaugucaagugugauggagucaccuggucuacccuggcauuguguagaugagaucacagcggucaggagaccucgcaggccuguugacuucaaauucucuuccuuagacuuuuggggagacuagggugguagaggcagccucuccaucaaccaggcugcguccugucauacucuuugugggaaaaucauuagacuguuguggcccuuaacguggccuuucaggaaggaugaugggauccccucuuaggggaccuccucagccaaacagauccuugucccugucugggauuguccccuuuugguggucuagcugcaggaucagcagaaauuuugaagcuguaggggcaccguguauucgaagggaagagggaguucgggggugagggaaucaacauccacaugguauccuccuccuccuccuccuccucuuccuuuuuuuuuuuuuuucuuuuaagagcgccauauagauuuaaaguccuuuuguuaauuuaggaacauaaaaccgugugauguauaguuugguuugcucguaaaauuacuaaguguggcauauuuagugcugugaaagcuugggguaaaaggaaaaaaaaucagugagaauuuucuuacaagucuuuaggggaaaauguauuuuuccggcuuuuucccacacaugccaggcccuccgcagcugggguuggcgcuggucguuacccucagccccaauuacagcugugcuggaagcugggagugggugcuggggcugggggauugcgggaguagggcacuggugggguuuggguaaagccagguccaggucuuaucuccagagggugaucccaccccauucuggagcucagcccugccggaagcccaggcccugaaggauccgggcagcuccauccucugcucccucccacagugagacaggaagcgcccucugaccaggccuggaccgccgcccagugggcauuuggcugcuugcuuaauggccuguggggucaggaagucacggaacauuggacuugggagggaccucagaggucagacgggcugucccucccuucucuggauuugggggucucguggucaccucaggcugggcacgugcagguccugcuccuggguuggaccgggcugugccacuguggcgagcuaggauguuguugcuuuucgcacagaacacgugccugugaccuaguccuguccucugaggacacagaccaagccuccccuucccaagcaccucccgucaggcccccugugagcugggcagggcuugcgccagugggugccgggcacugcgcugcgucaguccacugggcaggagcagcagaggagaucuauguuuuaucuguaagucacuuagggagcaaacagagagcugagcacagauggauugcucuggaaacucuuagaagcauccuggcagagggaauccaggaaggcuuccuggaggagguggcacuaaaagcaggcuuuggaaguauggagcuucgaggugagugaggcugggaggaaggaggcuaacacagugaggagggaggaacagaaauagggaaacugcucuuacaagacucagcacauuagguucaugucaggugugccgggagcugggcauggggccaucccugcccacguugugguguugguggugguguguggggggcauggauugaguaaucagggugacaaguacuggugcugagagguguguguagaauuuucugggcgugcagaggaaaacaguuugguuugagaugggggugaaggcuguguccaagaaggccacagagcggaggugacauuugagcucuccuuucuacucuggggaaacccacauuccucaccaguggggacuuggcagggaaggccaccacuccugccccguugcucagcagcacccucuagggguggggcucugaagccugugcguccuucagaggcaccauggggaccagaggguguccggcagcagggcccuuuccagaagccaaggaacaguaggagagaaugugcaggcagagggagccugugcggaagggguagcugugccugucaaaucuguucccugcuccucccaggcucugcaggccagagagauagaugcauuaggcccaguccuuguccucagacagccaggcgugcgggaguguggcggacgggccccuucacagcuucuggcaggaagcagagcccagaguuuagggguggggagaguguggccaggggauggugaagugugggaaugaagccggggagugggucggagccacgucuuaagagggucuugaaugucaucaagccggugacacaugaacucgauucuguugucagugagugggaaccuggguucuuaaaagcgaccaacuuggccgggcacggugccucacgccuguuaucccagcacuuugggaacccgaggcagguggaucacgaggucacgaguucaagaccagccugaccaacaugaugaaaccccgucucuacuaaaaauacaaaaaaauuagccgggcaugguggugcgugccuguaaucccagcuacucaggaggcugaggcaggagaaucacuugaaccugggagcggagguugcagugagacgagauggugccacugcacuccagccugggugacagagcgagugagacucugucucaaaaaaaaaaacaaaaaaaaacaaaaaaaccaccaaccaacccccugugcuuguuuaacacguguagagggagcgcaggccaggcacagggagaugccccugagaagcccccagagcugcauccucgugcagugcccacaccggcgaggggcccauggcgaagggucccucgagggaagcucuggagagaaggggaagggugagagagccagggcagcgagugccaaggcuguuuccuguggagucugcauguucaugagcccuccuggggaugccagugcccacuggagugagagaacaggccugaccccuucaccugacccuggacaccagcaggagauuugagagcaggcuguggggugagcggugcucgaaccaggccaaagccugagagaaggugugagaagaagcaggagggacccugggucucggccaugcuccaggaggaguugggucccgauggcgaggguuccccggguguccuugccagucuucuggugggcccuguggguuccagggcagcaggcuuuucugaggcugcagcgcugccuaagcacuggguuccauccugccucugcuccuuacuggcugugugacucugggcagguuccuuacccucucuggaucucuguuuucucaucugcuaaauggggccaguagcggagccugccuccuggggcugcugacaguguucgaugaguuaacuggcagaagggagggaccaagcgcuguaggacccugagcugcaauuaccauuuggguugauagcucccagcugucaugcucccagcugcacgccguccauaucuuggauuugagaaugaccuggaagagggggaccccaccugggagaccuggccaagucacuccugguggaggcagugggcugggcagggagggucuuugagaagcccagacuccugaaauggcuguccgccagcccaggccacgcacagcgccguggucacaaggcggcaaguucugaauaaguaaagaagaaacggaaucguccuggugaggucguccuggcccucucuccacugcgucccauguaaggaaagccgaacugggugaacccugggccccaggagucacuggauggagggcgcuauuggccagcccggccucagcggagaauuucuuuguuauagauuucuucuuccaccuccccaaccccagaagacuucagugucacccuuagugagugacaggcccacagccagugccccgaggccgauggcaccuugucucagacucuggggccuuugaaccggccccaacccuccccaccucuugucauucuuguccuguaauucauuuaggauuagcuuucagaccuccucgcugguccuaacuucugucgucuugguaacugugucaaccguuugcugguuucccgugauuaucugacaagagaaaggggggccggcagggaacauaaaagaagggaggaggagagaauggcggggucuuaauugaacuugcuguggaggggccgcagcggaagggccggccacugcaugggcaguagggggcggucacguaggccucucacccgcuccaagaaccugugucacugucggaagugucacggccuuuaucuuagaucuuaagggcccagggacaagguguuacucccgcccccacccccacccccacccccacccccaccccccuccgcccaauuucucuccuggaaaguuucacucacaggcggauuucaaccgccugugcugucuuuaugacagcacucaccacagggugccggccugucggugggcaggucagaccaaccguugcgggggaggggauggggcggcuggugggugggucugcaggggaccagggcuccuggcauggaggaagacuucaugagcaaguguguggucauaaaacaucguuuuauucucccagcugcugugcguuggaaauucagaaaggguguggugggguggagccggucucugcccagcuacaccuggggccucagcugggaagacugggaggcaaggugauuugcugugcagagucccgagucgucugaaggcuccucucacucaggccuggcaguuggugcuggcuguucgccagaccgcagccggggcucucaacgcugggacgccuccucguggccccucaguguggcaugagcuuccucaaaacauggcggccccagagcuccgaaggcaguggucccagcucacaagcggaaagcugcacggccuuuuagggccuagccucggagggaaggcuguaccacaccacauucuguugguugcaagugagggacaagccugcccauuuucaacuggaggggaguuaggcuucaucucuuuuuguuuguuugagacagggucucgcucuguugcucgggcuggaguguaguggugcgaucucagcucacugcagccucuaccucuugggcucaagugauccuccugccucagccucccaaguagcugggaucacacguaugcaccaccacaccuggcuaauuuuuaaauuuuuuuguagagacagagucuucuuauguugcccaggcugaucucgcauuccugggcuccagugauccuccugccccagccucccagugguguuaggauuacagacacgagccacugugccuggccugggcuccaccucuuaaugggggaaugguacccuucuagaagggcaugggguuugggagaugcaauugauguuuccucucuggaaaaugucaucagcuacacaugcuccacccacccacauccucugugaaguauguguuuccagagagugguagccuugccuugaggaaggaaagagguuccaucuucuuccagggucugcuucuggaguuuccugaagaccugugacauggagcuuugagggcagaggucuuugugcccugguggggaggcugguaggccuccggggugggccuccacagucauggcggcccccaauuucagguucgccagcccucugaaaauaauagugaggguugucucugaaaauaaggguguuguuucuugucacagaggcaagaugggccccucacuggaucagugggaagaugggagugccuuuuagggagcuacuaaugagcuaugucugauuuuuaugaaacuccaugguaaauuauuaauuugggccagaaaugaaaguguggaacuggauaggcucaugaauauucaucguugacuucaguacaggguugguugaucaguggcuagagcaggcagccagccucgugacccagauacgggcuuauuacccagggcggaggcucuugggaaacccuuccccauucacucccuuaguuucuugguccagagguggggcugguaacucacagcucauuagcaaaguugaagcucgaccagggcugggcuggggccagcucaagaugggagcagaaaucagaggguucuugacccccuggaucacccuggguucacagcggucuguucucacuuuggagcugcuguggaugagggugacgucugugcagaaggagccggaagcucccacuucucugccucuacuccccucuuagagccuccugggaaggauggagaccccuagaaaugagucccuuuaacagauaaucuuugguucuggaguaugaucaugguuagugucauugaggucacuuucuggguggcaugcaacggagccuccucccaaauucaagccuucuugaaauaguaaguuugcauuuuuuccaagaugguucugcugggauccuuuucuccccgacagggccaacccugccuaacacucuagccugcccuucucuaccuguccuccacaccuuuggccaggcuguuccugcugccuagagcgcugagcccaggugucugggaacggucagugcucacuccuguuaggaguggccgcucccugcucugugcucuuggguagauaguaagcaaccgugaccuaccacuguagcucuuuauuuaguagcugagccccugggccugggggccaaguggucggaugugaauucuugcuccgccuugaguccuuguguaugagacugugggcaaguuacugaaacucucugggccucaguuuacuugggugguaaauguggaggauaauuuuccugaggcugcugugagaauuaaaaggcuuuguacauuucaagagcuuaguguggugucuaggcugucaggaagggcggacuugcucuugguauuaucgucugugugaucgucaucaucacuggauuuccugcugggagagaagcuccagcgcaggaccuccugggacucccuagcucagugccagcacacacggguauaugcggaugacugccgucucguguuacguguguuuucccugcuucucaggaaccgaagaguuuacuacacuguggccguggcgugcguuggggaaagccucugcacugcaucaggccugugugggcuuugccagucucuccggggggccuugcaccugcccaccgccuggacagacccauuuguaauacaagcccuggagaccgcccaccucuguguggagaugaggccacuuccugccugagcccuaggggguggagguggggguuucaauccccgccucugucggaggaggacagagaaaagugagguuucugguggcuuccgggauuagagccaagauacaguugcggcccugaguucccaggcugaacuggccacuucuugcagugagcuuuucggagaagcagccgucgggcuagcugaguggccagauggaaugagagguugccugccagaguccuaggcacacaggcugguucugagggccccuuccaagguggggggaguucuggaugggccuggcccuuggucaguguccaucuucaaggaccuuggugcuggaggagguccucagagccucccagcaugugagaggcugucaagucugugcuuaggagagggagugcaauggggagaggaaagaccuggcccuugacccgccucugccagggauucucuggggcuuuggggguucccgcaaguggccugcuggcaggcacuucgagaacugacaccugcugugugacaaagucguggcacuugaucccagccugcagagagagucaugaaaagcaugugcgguuuuauuuggcuauugaaacccauaacuccaccugccuggcuuuucaucugauuuugaugccuuugacucagggcccugucaccucccagguucuagggcucucggagagagguggccagcgggucagaccgguggggugagccgcgugggaggaauaggaacgcaaauagcccgcaaccaacuuuguucuccuugcccugguuuggaaagagacguuggcuucuugcaagugcaacugccagggcaguuccugagcaccuguuggugccaggcccuggaggggcugagggggaggguggaaagucugucacaggauucucucgaagacccugccggacgccggaggaggcaggagcucagccgcaagccacugacuccaaguuucuggggguuggaaggauacagguaacuccaggcgcuuggaggauggaaaguuuccuuuuggcuggagugaucugggaggacuuccugcaggagguggugcuugaagcagauucugaagcguugguuacuuuugaaaagggaaggugggggaggugugaagaggagagugguuuuuaucucagcaugccacaaacuguacuguguacuccagugacccggaucuugcuaaaggggagguucggauucagcgggucugggaggggcccuaggcucugccuuucuaacaaggcacaggggaacuucccucccuugagccccggagucacgugcacccuuccaaggcccgggcggcaucagugcugcuggcccagaggccucacauuggauagccagggcacuggaccugcaccgccuaaugugguggccacuagcauagauccguggcuaucagaccugaaaacugaacugaucaaaauuaaagaaaaugaaaacuucagugccccaaucacagcagcuccaucuugagcccccaacagccacgugcggauggaggcugcucagucggacagugcagauagagagcauuuccauuguuccagaaaguuccaccggaccgugccaguccucagcccagaagcuggaaggcugggccugcaauccucggagcgauacuggcacgggccugggagcgucaccgggucuucucggggaggcucuugagagccuaguggggaggucuuugccguguuuggggccacagggaccuggagcagggaccugacugacugaccuuuugacauuaaacacaggaaggacugagggggagaaacaggucagagacugcaggaggccccagcaagggaggcagaggcgugggggcagaggccauggcggagcucaggcugcagagggucccugucgguggccaggcccagggaggagcuggcagcaagggacauguuuggaaucugagagacgguggcuguccaugaaauggggaagugaguugggcgugggggcacaaaccaccaaguggcaguuucaugaaggaaggagugguuuccauugucaagugguauuggauguggggaccagguggacccuggaggacaucaguacuagugucuagugaugcauacguagaacacauagcacacacacacacguacaacacauaccacacaccauacacacaaccacacccccccacaccccacauaccacacacacaccacacacaacgcacacacacacaccacauaccacacacaacacaccacacacacacugaauacuacacacacaccacauacuacacacacaacacacacagcacgcacacaccacauaccacacguacaaaacacaccacaccacacacaaccacacacacaccaacacaccacauacccccacacacaacacacaccacauaccacacaacacaccacacacaccacauaccccuccacacacaacacacaaucacacaccacacacaccacauacccccacacacaaacacaccacacacacuacacaccacacacacacagcacauacaacacacagcacauaccacacacacaacacacaucacacacaccacaugcacacaaccacauaccacacacaccacacacacaccgcacacacauacacgugcacacaacacacaacacgacauacacacacacaccaggcugugugugagcacagugugccuugccuucuuuuccagagcagguuaaaugaugugccugggaugggcugcuuagaacccagcaggggcugcuccggaacccaguucuccucccucgguuuccgagggcucccccaacccuaggggccccugcugcuccaggaccucauccgggaaaggggagccaaggggucauugugggcuuucuggaagagguguggggccuugucuauuaccuaaaggaaggcccacuuuggagaaccugcagaugaucaagucagggcauugcaagagaggaaucacacaugcagagggccggcagcccucugucgcccagacuggagugcaguggcgcugucucugcuugcugcaaccuccgccuccuggguucaagagauucuccugucucagccuccugaguagcugggauuagaggcgcacgccaccacaccuagcuaauuuuuguauuuuuaguaggguuuugccauauuugccaggcuggucuuaaacuccugaccucaggugauccgcccgccucggccucacaaagugcugggauuacaggcuugagccacugcgcccggcccaucccuuucuuuuuuuaaaggaugaagucuugcuauguuguccaggcuggccucgaaguccuggacucaagccauguucacuuucugaguagcggugacuacgggugcgcugcacugugcugggcuaguacuucauuccuuuucauagccaagucgucuguccuggccuggauagaccacguucuguuucuccaugcaucuguugaugacguucagcuugcuucuacuuuuugguuauuacgaauaaugcuguugugaacacuggcgugcauguuuuugugugucuguauguuuucauuucucuugggcauguaucuguagugggacugcugcaccuucugguaagucuauuuaacuuuuugaggaacugccagacucucuuccugagccucaguuuucccagcugugaaguggagcuguguccugggguccugcugguuuucuguaucaaguagcguauuuuauuuggaaacuugaaggagcugaaugaugucuuucauugcugcuauuaauagcaacacccagccaucacagugggcgcguccggagggggagccggcaggcgcacugguuugugccagucugggcccgggaagcauuucuccuccuccggccaccaguugccucagauuggaguuauugugagugaguguccucccuguguuucuggggaacuuccugggaacucaagaaaauguuuuccaaagcugaauuccauagaaaaagagaccaaagcugggaagggcaggugacagcugccacccuccuugugugggaauuucaggagaacucgggcagacguggcgccgucucuuuggccagagaagaagcaggacaucccaucagcucagcccccgcggggacuggcuugggagaggcccgcuccccacacauggcgggcgggggcgccaggccucccgucugguccugacaagcagcccccggagccugaguuuuucuuggaaggcguccaacuggugcagagcuggcuuggcccagcgcucuugugggagagaaaggaagccauugagggccggccguggaaguuguaaacuggauaaaugacccuccauagcaggcccccagaaugcuuuuccucugcucugcagugagaagccagccugggaaaaucccaguguucauuauucagcugcuucccagagaggacaagugaccugccuggggucacacagccaguuagaggccaaacuaggagggcucuucuugacacccggcugggucuuuccggagcucugcaauccaccugucugcuaucccaucaaaacccgaggcuuacucccugcgcgucagcaguagccgaacucugcgaaguugucccuuccgccucggacgaggccccggggucagaaagcuacaggaagugaccucguagaacacacccaaagccaggucauuccuuucugggccuaggucauuccuuucugggccucuccgcccggccuccagaggacaccugggcugugaugccaagagcccaagaaggcgcugguguggaaugugccagauguuuuuuuuccuucggaaaacacuguguccuguccgcugguggcucugcugagauuuggcuggucuccuccugugcuucagguccccugggucuccuccucacccagcuacagccagggugggaggcagcaggcaucggucacggacccuugggggcucccugcuggagccugcccugguuauauugggaucugcgcuccaggcaggcgggggauuuaacccugagcguccccucuuuagauugagccagcuugucuucgcacccucccgacaaggccgggcagcccccuugcccugccagcggcuugcuucaaagguuaauccccucgcuggggagcggcuccccgcucccccucucccccgccccccggcuuuuuacgcuccaguuaauuaaauguggcugccuauugucagaagacaaaguuggauauuuaucacaccuuggcgcuacagaaugucagaggcacgcacaguuugaagaaauacuggcagggaaugaggcugagcauauguccacagggccagggcaggcagguggcagccaccucugcaaccugcggugcucccagcuuuggcuguggcgagcagcuuucaaacgaggcacuccaggauuuguguuuacccggggaguucuggcggaaucuaggagaucugcuauccggcauaaacauccugguuccggagauuauuucauuggaaggaauuaaggaugccguuaaaauacacacagaccccuccuugcuucgcucuggugcugugugcccuguggggaccggcuucccucucgucuccccucucgucuccccucuuuucugaucuccuccuugggcuuucacauuuuauuuuuauuuuuucacuugggcacugcaaaaacacacggcuaauugcgauuucuuuuucaugacgggcgggaggggcauauggauguguucauuuuauaggguuuuuuuccucccccuuaauaauaaugcuuuaaagauguuugacaucuguaacuaacagcuggcauccuguuauggaagaauguccuuuuauuucaaagcagguugaacugucauuaauaguauaauuaggugauuaucacuauauagcagaaaacugcuuaauuguagagaucgcuuuucuaggauuccagucuuuuuaugguuauauuuguuuuagcuguugaauuuucauuauauuuuggcauuugguaugcugccucguuucuguuuuuuuuuuuuuuuuccccuuccuguuuuuuaaugugucugacagcugucuuugggagcauuugguuuugaaggugcuccugguguuagagcagugacgggggaguauuaccuggaagagguuucuuauccugggcccugcuuaacacauucugugccaggccagaggcccacaggagcaaggccaggaauaccggugcccuuugauuuaucugaucucucucuggguaauaguauggaauuagacauuuaacccuggagcuaagguugucuguuaagaggccagcuuuuacaaugcaauuuauuuuuauggugcguccuuaauacacaauauuaccaaaugcuucggagucucuuggauuccagagggaaaggcacauuuaaagggacauggucuccgauguaacuggaauuugaaaauaaauggguuuuccagacucuacgaggaaauaguuuaucucuuaacgaaggacuuugaaaugagcauagaggugggcuugcuuuugaaaagcgaagggaagccaaacgcugccccuuccacacuuuuggagccuagacguccuuauuggucucugcuagaggccugggguagaugcuggagcucggaucaccugacaucugggccgcaugucuuccucuagcaagucccgaauugacugucugcucucccgggagaagcuguccccagacccuuucuuccuaacuaagcccugccaagagcagggguauguuauggguauuacggggcauuuuuugaagggucaccuauucuugauguagaguuuuagaaacgcuuuucuuucccaaguguccaggagggacuaaaagcaguuguguccugggguugcaaaucuggguuccaggcuugcuuggggacugaugcccugguguguccuuggggaucauggugcuucugucuugcuuugccacugcaaagccuguggauuagacacggggacccugggucaucacugggcucucacagcuucucccaccccaguuuugcaacacugccugguuuacaagagcaggcaggcccuucccugaaugcaggcccugcaugggggcuuuaggugacccugucuugauuaucacagucaggacgcugagguccuggaggugagcugaccauccccaagcacccggccaggggcaucacagucaggacuuggguccuggaggugagcugaccuuccccgggcacccggccaggggcaucacagucaggacgcugggguccuggaggugagcugaccgucccugggcacccggccaggggcagaggcaggucuucuccucugcgguucucuucaugguaggugguggcugaugcccuugaaguuggggucccagaaaguggaggugcccagccugcccaguggugaucaccucgaggagggaggacgcgguccucucagggaaguggggugugcauucggggcacuuggguuuuucucugcugucccugcaagggugguggaggaagugcuucagggccagccagggcaggucugcugugacaaggaccccaccaccccacccagcagcuggaggacauccaaagaguccuccauccugggcuagccagagcugaagcuuauugagcgccuacucuaugcaguaccugcaugggcucauuucuccuucgcacuagcccaggaggcagcgcugcgauuaucccccuuucacagaggaggggcugaccccagagaggcacagucaccugcccagggugaguguggcacagaggucgagggucacccggcagguccugaucacccauccuaggaagggguggccuggcucuacccuugacucaggaacugauguuucuuucuacccuugcccaggaguuuuaggaagaagcccgggucccccaccccagcagggcagauaaaggcuuggguuccagguuuccccuuuuccacuccaguccuccaggggcuccagcauuuugcauuucucaguugagcugagccuuccaagccagucagcaguacaggugcugaugcccgauggccgugccuuugcagagcccggcuugcugcugugcgcuguguggcuccaggcaaguugcuuccccucucugagccucuuucuuugcugucagccaccugguguugggaggcugcagccuuuguucuccugcgaggaggcugcugaaaggccugcaguucuuccguugaauuccggccccucccagcucuccacucuggcuggcacccagcaggcuggaggagauuggcagggccucuccccaggacccccugagccgccccagauauugugcgcugacaccugggagggcggcaccgggacagcugcuugcugugcggcuucccccagguuuuauggcuggagggauaaauuaccccuucaucagcguuuucaccugaaugccauggauaacgguggcagccugucccgaacgccaggcuccaagugccugggcuccccagacgacagaggcacaagucacugggccuuuaguccuucuguuggcaggggcugguucccauuucacauguggggcagcuaaggcucagagagcuucucccccgccccucacaugcauggcccucccuuucccgacuuucucugucuuguucugugcaacaagcguguguuagcugugguuacuguuuuuauuuugcagggaggaacaaaagcuuaaagggcuaacugacuugcccagcaucccagggccaggaggugguagaugcaggaaucuaacagaacagcaggccaagugucccccgaaucaggcagcuucccugcuggaaacccucuugagaguaaaagccagcauucucugccuccacuaccccucaccacacauggccccaccucagggccuuugcacaggcuagucucucuugcucauucaggccucugcucagaugccaccuuugaggcucucuggccaccgugcaccccggucacucacccauccugcacaccugaugugcauuuuuuuuuuuuuuagcaucuuacugcgucuccucaacuggacuguaagcuccccccagcacagcgaucugguuugucuuguucucuguggcauccugaugcuggcacaguaccaggcacacagcaggcgcuuaaucaaugucagugggcugccacaccucucugcaggucaaaagcuagcaucuugggauuuaagguucuuucugcccuuaggccuaaauagucuaaaaagagagaacuugggagaaguggggugaccuugguggugucagcuuggagcuucugggcuugggggaacccgagugguuuaggagcaacgcuggucgggguggaggggacccuccccucuggguggggcuugggguaucagagggcucuacccuuggggcggggcuucugccuggaggguagaaugggguuuuuccaaaaacuaacccacccacuucuuuugaaauucuggcuggggccagcuugggucgguggcagacacagcaggucuuuguauccuuggaauccuucugaagccaacuuggggagggcgcuuuguauuguaaauuuccgcagaguaauuaugucuuaauguaugauaauccggccuggcccuggcgcugggcagccugugucugcagcgguugcugccggggacucacaggccgggcaggcaggucagagggacgcguccuggagauccagggccagcagggucgauccugaggggccugggggauuccccagaccuacgccugggagacccaugaagggcuuguguuuuuggugcggccucccgucucucuuccuagucagaguccuccaaggagccccaucucagaucccagucccggguuccugcugaaaguuccuuuucggucugggccaggaagagagucauggaacuaccaagucuuagguuagaacuagcccugaaagaucgucuaggcuuggcuugaaauagcuccauggauggggagcucaccccagucaaucagcaagcaguuauugagcaucuacuggcugcuaggcacuacacacuagucacuaaggcccugaggaaccagggcuaaacugaaaagacaaaaauccuggagcggcuggaacugacuuaguaguuagagaggcagacaguagacaagggaaauaaaguggaaugcauguuagggcugcagagaagggauacagcugggaggagggugagagaaggguggaguuuugaugggacaaccagagagggccucuucucucuuucugggggaagggcaggccaugugaagagaacagcagugcagaggccccauggcuggaacguggcuccuggacuauguugcuuggaauguucacucuguggauguuugcugagcuccugcaggggaagaggacauucugggcugucccgaugauguuccagucucacaguggaaaagcguguagggagagggagaaggggugagugcagagagggagagagcaagggagggcccuuccuggagaagcgggaggccuugggcagcagccggccagcccugaaggcuggccagcauccgaaccccgccaaggagggaggcugcgugcucucugccuccccacugaacugggcuccuuccugccauugagccucucagaccucugcucucagccagagagacuggguuuagacccauuugagacaugccccagcgaugcccagggacaccgcagccuccuguugggucacaaggccuggcugugguggcugacaucuguugguauccuugucacaggcugaauguuugugcucccccaaauucagauguggaagccccgacccucaggguggcuguauuuggaaauggagccucuaaggaaauaguuaugguuaagugagguucucagggugggccccugcucugcuaggauuaguguccucacaggaggagaccccagagagugcgcugucuccgucacgugagcucucggccagaaggcagccgucugcaauccaagcagggagcccuccacggaaaucaacccugccagcaccuugaucuuggccuuccagccuuaagaacuaugagaaaauaaauuucuguguuuaagccacgaagucugggguguuuuguuugguagccugagcagagaugcacaguugcugaggcccuggaggugacauccaggcauugagcucuugcccugcuggacauuaggucagagggacacuggugguuggcugauuuugccuuugaacagggaugguuuuaauaaggauuuggugaggugaucagccuguguguguugggagggcaucccacaugggcuccucucuccgcagcagcucuccagccuccuucagaagggagcuucaguggggagggggcugguggaggaagccccaagagagggggaggaucucuuucugccccaugcccccugccccuuacccaccacccaggaaaugaggaagguuggcagcuuggaagcagggggaugggaccuugaugucuucagguugcugggggccguacugcacggugucccuggcaacugaaugcagggcuccggccugggugggaagggucucugcugaagccggacgaacccuggggagagccuuuuaggauucggauucuggggagcugacggguuaucaggcccucuguuucuggagagagguuuaugccacaguuguggggagagaccccaaggcaggacccuggagagccugguccuaccgcucuccucuuccguagaaguucagcaugcgucucugugcaugcgcaugugcauaugugugcaggggacagagagacagguuugguccagcaauccggccguccuaaaugcagugugcauuucugugcucagggugaauugggcugaccugugaccuguccccuucagugagcucgcccuuccuugagaggagggcugcaucaggcacgaguggauggggucuacacccagggcugcggcuuccccugcugaaguuccugucccccacuggcugcauccgaaucuuaugggguucuagaaaacacaaacuuccuuggguuucuaccacccagcaaaucccagccagaggaucugggguggggccugggagucuacauuuuucaaagcuccccaccccaaguugggugaucagucagauugaagagacagauacugccagcuaccugggguggagugggugcuggcucuugugggauccgucuccugggccuccaucccugggcuccuggggcggaauuggguggggaaggaggcaagaggagacacagccacuuccgcaggcacgcuggugucaucgcacugaaaacuccaaaccuggcaaauguaagaggauucacuuagcacccgaacggggcucugcaaacauugccccuccucccccgaggugucggcacccccuggauuaaugugucucggcgagaagggagcgugccaguauucagugugaccuuggauccuccaucccuucgccuucggguggaacuccacugcagaagcuggcugcgguucaugggggauggggaagcccccacgugcuggguuccugggaaugcuaagugcaggagaggaaaugguguucuuggggccuuuuuggggacuggccagagcccggucacuugggaaagggugaagcuuccuuggacccgacauccccugggaggacccuccuuggcgaggggaggagcccugccuggcuugcuuccuggguggcuccucccucuggugguccucagucagcacugguggcauccccagagcugacacccaguucccccuuacgcagccgccuggggugccuggagcucaguccuccccguguugauaaauugagcuucucuucuccacgguucagggcgucgggguggggacggggccauccugcacaacccccccucgccucuuaaugccuuuucaccccugagagccugucugcacagccugcgguuggucggccgccuugucauuuagcuguuccgagccagugaucgggaggcagcacaaacuguggcauuugcugagcguaaaaauucaauuaauuccagaaggcagauuaaauauaagugaguuuuaauaauuugcuguaaagucggaggauuacugugggcacggggagggaagccacacaugcgugcuugagcaggcuggcacagucucggggaugccagccaggguggcuuccuggagccacucauuccuccccgcaggguacacccccagcucuccagaggacacccuccugcgagggugguguccugggggucucccgcuggaauucugggggacgguaggaaacgcuggcccagucuuugauuccaacccuguucccccgauuacaaggguaauaggcaggacauacagcgauucucaguuggggguuccuucuaggauccccagggagugagcugucugcccaggcagaccuggccaugugugcccugugcccugcagcucugccagcagccccugguccuguucccucaaacucaccuuucucugccugcuuccaggguccuccauagcugacggcuuccaggucugggccccagggugguuuuguugucauaacuuuuuggaaaguaaagcaguaucaagaaugggcugcagacuccucagauuccaaggcucucggccuuuccaggaccgccccccacccccauuccaacacacacacaaacacacacacacacacgccugaagucacacacgcaggaacucacacaugcucacacauucgcacgcaaacucacacacgggcccugugcucucccagcaugccagugagugagucaccuuccugcagcacccccauauucagaugcaugugagagugggggcuuuucaugccugccuuuugucuuuacccacugccaaaacacaaaaaaacaaaagaggaggccucacccgccccccguccuccuccugucgugccacgagaaaugaggccugacccagaaaaggcaauugcuggaggggcugucuggagccugccuccccggcggccucugcucccagggaggggagugagggaaaggaggcaggcagcuuuuauguaaagacagugaugguccagugaguacaaaacgcuguuucaaagccagcguucaucacuaccacuucccacugugaucuccauagauuucuuugucuccuucaauuggcccuaauuauggagcuggaggcugccugaucaguuucauucuugucaugaaauccugagggcacgcauggggacggggacacaggcucgccagcugcacagcccgcagacuggccuugggucuuugugugcgugcgugccggugcgugggccccugucuguuuggagaccuuccucccccucugcguguuccccaagaugccaggcugguucggggccccuggcuccccucuuuuugggcaggagggaguucccagugggccucccagcugagaacuggcuagcugggaugugcauaugguaggcaggcugggaugcuggcuaccaccaagaugaacaccugcaaagaugaaagccacagccaagcggagcacaccccgccuucccuccacgcugccucuaaugcccuaauuaugccguguuuguuucaguaauuuacacucuccggguacugauccaucaauagugaauguauuaccugucuccgugagguuugggagauccaggaugcugcuuugagaacgccugcgaagcaguaggaucggggagguggagcaguuucccccaccccucccucuccccgcacgcguucuuucucagauggcagcguuauuuggcgaaagccaucugaggcugguacuugguacugcuuuuccguucccccuccguuuuaugccuuuuuaauauuuaaaaccaucauugggcugaacgauaaaauucuuucaaaucaaauuuuauccucuaaucucgugcauuggcuucccucuggccggaaaaguuggugggagcagcacggcugagcaggguguggggguggcucugcaggauggaaacgcgugccaagguggaggcugccaagacccucgcccccugcacuccuucccccaccccuccagccccauccacaaccuccaaggaggcaaaccguggggccacguggcccggguugucacgguaaugggaugcgccagagauggccagggaaguccgaagaccucgucuuccaaggccaaauccagcguauggggcaggagcuuucacugacgggaaagaaaaguugcgaggacauuuucuaaaaggugaaaaaaaaaggcgugaucagcugcugagccguuugccgcuuuccaccugcuguugucucuggcgaggccacagaggaugggacaauaaaaacgugcuggccugcaggaaccccugcugcagcccugccugcccugcugugugucaccggcguccugggguccagaggcuucuacccauugguccccaagggcuccaggaaccagaggcccauccaggauggcuccaagcccugcccuggggcuuuccuucucucuucccuuuuuggcgguucuucuguauggcagccgagagggcauuuucagggugcccaggcaugaccccugagcuuggaggcccgugccgugagaccccauggaguacgcccaggacagcaggacucuccucugugucgccuacguuucuccaaacacucgcuuuggcacgugguugccuuuggggugucuuucugcccagcugggucuccauguggggaggagggagggagacuuuccugcccugucccagccccagucuagaccccucccaucauugcagucugcugcagggcccaaggggcccauccugguucuggaacucuuccugcauggccaugggcaagugccgucccuucucugggccucacuuuccuuguuuauagagcugacggcgaugacacgagcaucaucccacucugagagcuucccagccagugucuuaagugucugauccacauacauuuccuuuggcugcagggugcgacuugggaccugugugaggaguguggacuuggagccagccugccuagggucacuuccugccucugacaauuguuagcugugugaccuugggcaaguuacucaaccucucugugccucaguucccucacuuguaaauggggguaauagaagagccugcaucuuggugggaggugcagguucaccccaaggcuggcucccuuugagggcugggagggaagggucuguccaggcaggccucucuccccuacuuggccguccguucccugugucucuucgcaucaucauucugcugucugcaucugucucuguguccagauuuccccuuguuagaaggacuccagucaguggguucaggcccacccuaccccagugugaccucaucugaacuaauuaauuacaucugcaauuuccagaugagggcacauuuuguggcacuggggguuaggacuucagcguaagaauuugggggacacaguuuagcccaugacauagguguugccucggacggcggagcccuggccuggaugccuuuguccgugagguucccgagugccgagugccgggagggacagccccucuccuccagccccaucucucugaucucgccuucccaugggcucagcccgaaggcuguuucaugagcgucaucaucggucggcccugguauguuuguucuuccaggggcucccaggauggauccagucccucccgggagccgggccacaccagcugucccacugccaggccgcauggccaagagucgcagcugcuccuacaacgugcucacgggcccgacgccggcccccgcgcccccccgacugccgugcuccauggcuucccauguggaaaguaucaccccucccaccucugagagcagccgugugagacccccguccacagccccggcauggagggccucuuucuccugggcugcaggaaaccccggagccggugggcucuccuccgugcccccaggcccccuggcagccccucccuacucccccagcucaggcgagcucagugcagaaggcacaguagcuaacuuucuuauuuuaaauaauuccagcaugcagcgcgagaggaguaagugcccgcagcugccagggggcuggauggagcuguuuugauugcacuaccaugguugagagugaggguugguuacaggcuguuccuugcuaggcucgcaucaccccucuaagaugcagaauuguguguguggugggggcaccuccaucucuuguagccuggaggagacaauaguaggaugggccucggccucuggcgggaggguacagggugcuggucccagugugggcgcucuggucugaggacgaaacccccccccccccagaccagaccccauggucuggagggcccggccguggaagaugaaaacaggaaagagcggacgggagaaauaaagggggaaacggcgauguggagccccaauugcuagcagauggcgcugguauuaggaaaaugaaaauacaugcaguaaauuugcuauuagccaguguuaauuucuuaucccaagguaaaaaccuucccccggcccuggccguaccaucugcauguucauaaaacacaucacagcagaacugaucacggcagugugcaugugaggcuguggguggucaggcuucagagggggagggggagggacaccgugcaccugcugggcuccuggggacacagcgggggcuucacaccuucggccuagguacauccagguacgauccugggcgaggugggggcuucucagcucagcccaggcccccuguugguuuugccccaucacugagcagaggcuggaguauggguugcaaggauccccaggaagguucugccaccgagaacccucuccugccccagcuguuccucagggagccagugcuagagggcugggauacuuagucuggguuggcggauaaaauguuacaggacuuuccugccgguuggcaaagaggcuguuccucgcccuacccccaagccuucccggacccuugggcccccucccccagcccuucccgugucuggacggugaaagaguuaagguuuugcaggacaggcaggcaccaccuugcuucagccccugccuugccgggcugguuguuaaauguaacgucaccccuguggaugcccucggucaucguaauuggucaccuggcugucaccgucccccgccucucuacaggggaggcagugucucuucguccuccucuuuccagaggccaggggauucacugcugcacccaccccuuugguggugggcgacgcuguccuugccagcuucacuucacuggggugagccccucuccccagcuggccucuugcaucucgcucgauuccccaccaggagggcagggucagccaaagaaugcacccacugcuggcugccaccagcuucccagaacgcugcauucccuacauggcaucggccaccagccuggccgcucuugagggggucccugggccuugagagaggcagcacaugcucacuggcugacuggcccccccuuccccgcugcgggccuuggggggcccgugucccagccugggccugcuaggcugcuaauuaccagugugggaacggcuuuaugauccucaagggcccugaaagagccccccacaucuggucaauuaaugcugaaucuguaauucggaugacauacaaccccggccagugcuccaaaugaggcgauuaaagaaagggcucuucuccugccucgccagagaacaagcaaaaccgggggcuucuuuauuucucgggauugauaggcccugucugugaccuuugcugggacaagaaguauuaucaggaauauuucuguauuucccgacuuggcgggcugcauaaaucuccuaucaacuugggcaggcggcgaaaucugccguggccguuauuaacaaggagcacuuuccuggagggaggggggccuuugucagggggcccggggacgcuggagggcugaggacagcccagauaagcacccgaggccugcugccucccaaaacggcccucggccucuguaccuacugcccuggggggcagcugugcgcacagcucuggggaaaugagaguccccccagggacuuucacauguucacacucacacauauucacacacacguucacacuaacacauguucacacauauacucacacaucugcgggugggguacacuccugcaugccaggagggccaugggcugugcugacuuccaggcccccaaauccuccccuucccgggauccccguguacccgccucuccccucccucccuccucucugcccagcuggggacuuuucaggccccacccccaccggcuuccuagcaggagcugaaaggaacguuggugaccacucugcaccccagaccuccugccuggggcaugggagacccaggaugccaccugagcaccugcugggguggggaggguuuguggguggcuucuaggucgggcagggcccuguuucucagcugugcacacagguggagagggagagggcuguggaccugagagcccuggacgcugggcagagccuggaugcugggugggcagggccugggcugggugggagcuuugacacggcgcggguggagccugggcacuuuuggaagaacuccagaggagccauggcgggaaccugguggguugaguuucccuggcaucucuggaagguggggcggggggucccugguauuuguuuaccagcucuccaagugaauaacauuucugaagcaucgugccugagcaugugugacccaguguguguguguaugcgcauaugugugaaugucagugaauguguaugugugacgugugcaaauguauggcgguguauggaaugugaacgugagauauugugugugugugaacgugugaaugugacugugugaauguggaugacugaacaugugugaacuugugugacauugugaauguaugugugaauaugugugagacgugugugaaugugagugugaauaugugugaaugugugugaacaugugugagauauugugaacaugugacagagacauugugugugaaggaaugugugugaugugaaccugagugauugagcaugaaugugaacgugugugacauugugggaaugugagagugaucguguggugugugaaugcaugugugaaugugagacugugugaccugugugaaugaacaugagacgugagugugaaugugugaacuguguguuuaugaauguaucugauugugaaggugugugugaggcgugugauugaacauuugugcaauugaacgugugugaucaugacccugugauugugagcgugugagugaaugugugugacauuguguaugucacugaaugaaugugugugauugugugaacaugugugaccuugugugcgugugugaacgugugggcccgcgugugaaugagugugaacuugugugaacaugugugacugugugugugaacgcaugggcccaugugugaaugugagugugugugauuaacgcgugggccugcuugugaaugagugugagugugugagauugugugaacaugugugacauugugugugugaacaugugggcccgcgugugaaugagugugagcaugugugauugugugagcgugugugacaucuugugcaugugugaacgcaugggccugugugugaaugagugugugugugauugugugagcaugugugacauugcgugugugacugggcccgcgugugaaugaguaugaacaugugugauugagcaugugugacauugugugcaugugugaaugcgugggccugugugugagcgugugugauugagcaugugugauaugugaauguguuugagacagcgugugcgugugggagggauggaguguguguggagcauguguggcgggcccuuugugggagaaguggguguugggcucccgcccggccacgcugcaccaccauuuggcucugugacccuccgcagcucacucugccucuugggaccccucuuuuccguccuguaaaaugggaaccccguuuuccccagggcuagccgagaaucccugggaugaagcuugggccgcacucggugcugacaugcggugggggggaccagacgugcucucggagcuggaccagggacagcccacagcugugugcccuccuggggagcagggcacagggcauuugaggugccugugucccgagggccacccugcccuuuccuccuuacucuuguucgugugggaagagaugcuagggcagaggccaucgggacuuacagacccccugacauugguggcaaaauugggguccuucccuguaguccuagcagaagguccacggcuuucaucggauccagagaacagcgccugacccugggguugagguguaggggccucugucgggcccuccugguuuauuuccagggccccuggagguacccaggaguuuaauuguuuaacucuaguuuccccuccaguugcuacccugucacccccagccugaauuagaacugagggccccaacucagaaaguggggagaugaggcugguuaguuugggccaagagaagggagauuugggagcccaguggcucuaacuuuucucccgacucccagaugcggauggagccuuggugggaacugguucuuugcaaacagccaaccuuuugcuccucacagccuugcgggcucagcggugcuggggagggguccuggaggcagucaccuggcugucggcagugccccccguggcaagaccagccuccccucugacccugagaugggcaugggcugggggugcugggggcuccuggcugcaggcagaccagccacucaggguccggaccucaccgggacuccgucggcuccuuuucaaaaucaacuguuguucuuuguagaagaggcguuucauuucuucauucauuccauaaauggacagccagggacgguucugggugcuaggaauucaucaccaacaaaagacaaaaaucccguguuccuggagcugacuuuccggagcagcgcugucugcuggaacauucuacacugauggaauguucuagauccgcgaugcccaaaucggaagccuccagccacauguggcuauagagugcucagaauguggcuggagcaaugaggaucggaugcacucguuguauuuaauuuuaauucacgucaguuuaaggcuaaguagcaccugcggccaggggcaccccccgccccccgcucccgucaguacagagcuagugggaagagcuccgugugaggaggagcuuuucugugcagauuuuuucuuuuucuuuuuuucuucggguuuuuuuguuuguuuguuuuuguuuuuuuuuugagacggagucucucucuguugcccaggcuggagugccguggcaugaucuuggcucaccgcaacuuccgcuuccuggguucaagugauccuccugucucagccucccaaguagcugggaccaccaugcccagcuaauuuuuguauuuuuuguagagacaggguuucuccauguugcccaaguuggucucaaacuccugaccucaagugauccacccaccuuggccucccaaacugcugggauuacaggcgugagccacucugcccggccugugcauauuuucuucacugacgcuguuuccaagucacagaggccuucacacgugucugggaggguuuugcccgggcacuugcagggguggggugggaggagcauuucuacccguggccccuucuucugcuuaaacacacggcagauccagaaauuucucuccagcagaaugcagccccucaaggaugggggccuugguuacaucgguuuuuauguuuaacuuccacccagagcuuggcguuucaggggagccugaguugaaggcacaaaugcgugacaguuccugcucugcccuuuacaagcugugugaccuugggcaaguuacugaaccucucugugccucagucaauagggaugaugacggcaccccuugcagaccuuuuggaaggcuuaacuggaugagucacccuaagcauucggagcagugugggugggggcgcucuggguggaggagaccagcucuaggcgagggugccuggacucccucauggcugccucucucuccaggccccgccaccucuguucagccagcucugggagacuuggauugcauuuggcuauuggagagugucaccccaucuuuuaaagcugcagggaagugaaggaaucauccucucuaguccuuuuguuuggaaacugagcccagagaccacaagcaaacuggcuggggucacacagcugcugggucagucacagagcugggggcaaccgugggcauccuggucuaucgagugggucauugugguggcugccgccuaccuaaccaaaccuggucccacgggccagcucucacuguggggcagccagcuggagggacggggccagcuugccccaccccgccccuccccuccacagcagagagugcccuggcuccauggggcccagcacaagcucuggaggccacaggagugccuccccuccagggccuggcaaggcuggcucucugcagggcuggucaggucagcugccuugauuucccucucccaggggccugaugucaucauucaggggcagccuggggacuugagggaggaugcaguucccacugccuucucccguccuccccuccccuucccuugcuucuccuucuccuuccugcuuccacguccugacccccuggcccuccccagcccggccccuuagccuccccucccucccggccccucacucccccccuaccagggcugcccugugcuagcgccugccugugugaaugucuaaucuccaauuuuauucgcugggcuccagcccauuugcauaauccacacagucacccugguuuuaauugcccacaacucugcagaaagaucaugugguuaagugguaaaucauaauuagauaaauaauugguuuggccacagcaagcugcuuuuguuacaccugccaucugcuggacccguuuuuucuucuggccagaacaaugcgguucugaugacagagcaugcugcuucucucuucugggggggccggagggggcugaauggaggggcucggaagcagugccuggaaaauugcccgguugcugggguccgcgccuggccugcgcuucuuucucuccaagcgggcacaccacacacucgccauucauuacccggcuugguuaaugcaucagaguggcaaauuugacuucuuugcagaaaagggagggaggaaaggggccuggaggaggagggggaccagccagggcugcccaaggccuggccugccugccgguugucgguggccccgaugggccagggcaggaggccugcuguggagggccugggcccgaucccugggggguuggggggggggggcggaggggacaggcgggcagggguuggaaccgccagaccucccugccccaccgcggucagcuucuccaucugcucuccaccgaagccuccuuuauuuuccaugccccaggccccaucugugagcccugagucuccaggggaauuguggcucccuggcuggacggucgccuggccagggccuuccuuggggcugcuggccugccuuucaugcuguccuuccagcaagcucuuagcuccuagacuucaggaacgguuucaaauuguccuuccuucacucgcucccucacgcauacacgcacacauucauucauucagcaaacgcccguggagccucuuccuacaucagagugcagguucgaacuuggucuccgugggucagauggccgcugugggaugugagcaaguuucucagccucucagagcagguuucuuccucuguaacacaggagucauuauugucccugccuucugggccuauuaggaggaucaaaggacagaauguggauaaagucugucgagugacaccugcacgaaacacaggcccagugucuguggcuggugagugcgugacugcuggucaugcccgcucccggggagggcgccagcgccgcucaccuugggcaucauuggaggcccacgaggcugugcugaacaugcugaaggaagagguaccagugccaugggaagggcccaggaaugaggagccuuggaaagaaaccagggggccaggggaacaggcagaggggcgguaaggaagggcagguucucuggggccugcacaggccaggacguuccugucucuguugaguucggacuggcagguucucuggagcccacacaggccaggacguuccugucucuguugaguacagaccggcagguucucuggggcccgcacaggcugggacauuccugucucucucgaguacagaccagcacaugguccugcucucuggccccugcauccccuccagacugcguucuggaagcccugcccaggccucacacgcugccccaagggucuuuauuaccuggggucuucuagcauuuuccucuggagaaacucaggaagcauccuuucucugcauccuuucucuuugggggcccagcuucuccuuuucaguuugacagacacagccugaaugcccaaggccccucugcggagacuuagagacuuaggcugguggagaggguugugccuccuggcugagaaccccucagggcagauagcuggcucagaguccucauggucuuguugaucaggaaacacugguauguuccuuccugaaaacccucugaugccuguugaggagccucuaggacacguuccaugugguugggacuuuguaaugccagaucuuuucuguguuuuaacauuccuccauccaucaucuacccaucuaccuuucaucuauuucucucccucccucccuuccuuccucccauccacucacccacccauucauucaugcaccuauuccucucucuauccccacacccagccauucacucauccacccaaccaucuauccauccaucccucuauccauccauucccccacccacccacccacccacccacccacucuuccaucuacccacacauccauccacccacccacuuuucuaucugcccacccacccauuccuccauccacccacccauucuuccaucugcccaccgauccacccacccacccauuccuccgcccucccacccauuccucuauccacccacucauuccuccauccgcccacccauucucccaucugcccacccauccaucuacccauccacccauuccuccguccaccccugaacccaucugucccucaacccaugcacucauccacugucuauccguggucccuacauuuggucuaaagguaggaucuuuucucuggcagagacguggcugccucccccaccgcugcaucgcagcucgaaggacggaugcaucugcucuucucacaucagcaugaugguccgccuaacgugaggggagggggccuggcccaccuuagcugcagaacgcaucacugacuugggaaaugaagccucaagauaguuccccggggaggagcaguguucucagacuucugugacgcuucuagacucaagcuuucagagagacucccaugacagcagccgggcaccuggcucacuguguucaucaugugugugcucguguguucuggaauccucccaggaagauuccgccuucagguggcccaccuuguuuucuccauaagcccacauacaccucacagaccaaauaucauaaacguuggcucagaaaauuuaaguuguuucuguauucuaacauuaugcugcccaauacaguagccacuaucuauuuaugcuuaauuuuaaaauuuuaaauuaaugaaauaaaaucuagaauucaguuccuuugucacacuggccacaauucaagugcuuagaggccaugugugccaguacuggacaguucagauggacaacguucucuucaucauggaaaguucagccaggcacgguagcgcacagcuguaaucccagcacuuugggaggccaaggcgggcagaucgcuugaagccaggacuucgagaucagccuggccaauguggcaaaacccugucucuacuaaaaauacaaaaauuaucugggcgugguggcacacaccuguaaucccagcuacuugggaggcugaggcagaagaauggcuuuguaguuguuuuuuuguuuguuuguuuguuuguuuguuuuugagaugaacucucccucugucacccaggcuggaguacaguggcaugaccuuggcucacugcaaucuccaccuccuggguucaagcaauccucccugccucagccucccaaguagcugggauuccaggcgcccgccaccaugcccggcuaauuuuugcauuugcaguagagaagggguuucgccauguuggccaggcuggucucgaacuccugaccucaggugaucugccugccuuggccucccaaagugcugggauuaauggcgugagccaccgugcccagccaggagaauugcuuugaacccaggagacagagguugcagugagcugagaucgucccacugcacuccagccugggcaacagagugagacucugucucaaaaaaaaaaaaaaaaaaaaaaaaagaagaagaaaguucugucagagagcaguauucuacaaguuuacucacacagauucucuuuuuaaauuaaauuuaauuaauuuguuuugagagacaggaucucauucuguuccccaggcuggagugcaguagugagaucauaguucacugcagccucaaccuccuggccucaagcaauccucccaccucagccuccccaguagcuaggacuacagguaugcaccgccacaccuggcagauuuuuguauuuuuuuguagagaugggguuucgccauguugccuagacuggucucaaacucuugggcucaaguguucugccugccuuggccucccaaagugcugggauuacaggcaugauccacugcgccuggcuggauucuucaauaacuaaaagaugggccagccucagccauuacuggucucagguuagaucuuuuugcauucgcucuguaggagaaugagcugggaaucugauuugaacuuugaucuucucugcugcugugugacuuggguucaggugcuuaaccuuucuuacggguagagaucggcccucaggguauucagaaggguguccugcuucuuguggaaugguagagaggagaguggaaaauggaacauaaaauaccaaaaugacuggugcacugaagaagcgauuccucggaaccugacccuggacuguuucagggagguguaucccaucugcaaaaaucagugugcaggcaucggcguuuuucucucucucuuucucucccaggccugagguuugguuguuuuuuuuuuuuuuuuuuuuuuuucacuuucucaucucucagcagaguagggcuggacaagagggcccagaagguucuuugcagcuggcuccugcucucugggaccccaugugcugugccuggguuugccagcacccagcugcgcagggcaguucgggugggcugcccacgagagccggucccugugccuuggugcacccugucugugggcaucagcuuucaggagaaugcccagccccaucccagagccgcgugucuggcccuccaugcuugguauccugccuccaaacgaugcauauuagaaaccaacuuugaucuuucagagauugccaguguacuuuaaaacgaaugugcuuaagaaagcaccagcacuccaaauagcugagcaggaacuucuaauccguagugcccggaccccgggcucccucagccaccaaggagcauugcagcaaaggcaagggaagacgccuucugggcaggcaggccaagaggggcuccaggccacgugggccucccaaguaggcauggggcaaggguuugcaucccgcaaccauugagugcugggagggcuggcuuggcugcucggaucuuggcugucaccucuuccaaaaguucuguccagaugggcuuuguggugcggcccccucguccguucugcagccucuggaugaggacauggccccuuguuugcuggagcagggaccuguggucugugaucaaugacaaagcccacaggcggugauuggagcaucggggcagugguuggcacaagaaacugccaagccacaggcccugcuccauacccuccucucuccuacucccccucaauuauuuuucuuggauguugugaauuaaaucuuccaguaaccgcaggagacgucuucggguaaggcccacucacaucuucgugcgccgauagaaguuguuaaaugaauaauguugacuuacacuggggacccaauucucucugaauaaaauucccccuuugaguuacccggcgcuuccuggagaaaccauaaaaauaauaaacacaucucgauaucagagguuggugaugcugcuucagguucuuuuggagagagaggcgggggagaagaaauaaauuacaauuaauuuuuaaaagacgaucacgccacaggucagaugacgaggugagcuggugucauggggugguuccccagggcugagcggcagacacccccuuagagcugggacaggggcuaccuguggacaauacugauuccugggcuccgcccuggaccugcccccaaucuggaaugugggugagggagguggggguggugacacgggaccagcugguucuugugcagagugaaguuuggggaucgugagucaacggaaguggcaguggggugcaucuugggaucuggcuuccuggccgcgugcuucccuggccaccugugaucacaagccucuugcaucucaccucuguggccuucucuggaccugaagaauugccagaaaugggcugaggcaguuggaggagauggaagagacauuuaucacaggcccuacccucucuuccuuucucuuucuccuucucucccucuuaagaucccugaaccuggcuggacacgguggugugcgugucgccccagcuacuugagaagcugaggcaggaggauuacuugagcccaggaguuagaggcugcagugagcuaugaucguaccacugccagccugggcaacagagacuugccaccuggaagacagaugaggcugucaccccagucaugggcaaggcucugagacuuuuccucucuaaaaugggagggcggcagcuguccucccugugacggggaccuggcaaggucccuccugugugagccccuugaagccgugccuggcuaccccucugggucucuguggccuccgagggcggcugcggguauucucuaugcauugcagccagagagacacgggguccuuccucuuccaggcccgcuccauccacguggcuucuuugagcugagccugcuuuuaaggugccaccuuggguuauucacgggaacacucacagguggggucugagcgguguggggacuuucccaaggucacaaagcaguuugcuggcugagccaggaauagaacuccugagccgggcugugaucacccugugcccaaauggccaggcaggagggggcugggccuccucgaugcuuccaugugggccaaggggaggggcugggaagaugucacccaggccugauggggaaggccaggcugagggcucucucgaggaccacugucuuucgugggagaggagagugucugaacuccgggugagaggcuaguguugagaggcaguggcuggcuguggcuaagaaggcuguggugugugugucuuaagaucauuugggagccuuguuaaaaaacacacacacacacacacaccccaaacacacacacacacacacacacaccccaaaaacccagcauuuguuuuccugguggcucuuugcaaaacacuccagcuaugaagaggggaggggcuggcguagcaucgcagauguagggacucugaaggcugaugaaauaaacccauccuugucaacuggggaaaggcacucagcaauccaggacaagacggcauggugcggauccugcaggagguucccgcauccuuuuuuggcuggguuuauuuuggggacaggagggcuguuuggcgcugaugaggguuuguguccuccuaggggcuucuugauuucauuuagcucagucuccucuccaacggcucagcucagugagcgccuggaagaaagugagaaugccaaagcaaccccucggugggaggagggaaggucggcuuccaccaguggggggguuagagcugccauccaggaggacucccuggaggaggcagaauuuuaagccagggcuugaaggaagaggucaggguuugaauaaaggagauggggcucugcugggggaggauacagcaggcccagggaagggugguggggcugggcgagucuagagagacugugagacgcuuccagacgccccuagugcagucgugagggccaggagggagucucagaggggaaauagaccccagaggcaggcugagggagaggugccgugugaggggugggaggggagcagccccaggagaggaggcagcagggguggggcagccaugggugucugccaggcccacggcagucagggaacgugggagcaacuuuacuggcacugggagggauugcaggggccaggcugguggggaggaggccuuucagaaugggagcucaaagacaggccagaggaaggccaggcgggaagaggcucucuggcaagaggcagagcugaggcaaucagguagaaaucaaggugggggggugaccuggggacccacugccuccacgcucaccuucagcgcggggccggcagacacccagaagggccacaggcggcugacuaaaaaucuccacaccaggaacuucgagcgaugaaaacaacuuuguccaucuaaccuuuccuuuuugauuauuuuaauuuuugugagaccaaauuuuaaggacauaaacacaacaagagccgcagcagaggguuccuugcagccgacgugagcuagggagcugaggcccaggucuugaccccgcguccccagggcccgccuauccuguggugggugagggcagagcugcccuggacaccagggucuccucugucugcgugcaucgcuugucgagcccgcgagugauaaaggcaacugggacuugauuguccgagugacaguugugaucuuaaugaccggcaguagguuauuaaucaagacauuugucaggagcacugggaggcggcggggagggagagggagaagacgggccuggaggaagagagagugcaguucuagaagaagcuccuccgugguucagaucccagccccaccguccagggaaguuggccucuccuagguuugcagcaaggaugaaggcagaaggccgggcacaguaggcacuuaacgaaugcugauucugagcagccaggacugcugccagggccggguuagcagcacacagcgcccaggggguugccuggaggccgaggcgggggccaggcagggaggaggcggggcgggagcagcguguggacugauucacaggccugcguguccccagccagugcuacuugauacggaaaagaacuucgaaggcuuuuaacaugugguagaaaaucagggaacagggacccagaaauaaaaguuucuaaggaucccugggaggcuucuugggggcuaauggagacccuugggcccuggccgcccugggguucuagaaccgcuccuggucugccggugugagcgagcuccccugaccuugccggaucccugcccgacccacaucuguccugggccuagggugacccgcugcuccagaacccggccuccugggugcucucugggcauguagccuaucucugggugguggccuuggugggggccugagguguagguguccucugagccaguggauggaccacgaagccagaggaaagccccucacccagccugaggacagccgguugaucuuuaugaaggaagacaguuccucccgggcuuuugagugaaucacccaaauuuccgguccacugguguccaggcucagcagguggaaguguacucacugcugccagcgauguacccgguuacaggggcugcccuugcccucccccgcaggggcccacacacuggucucaggucaggggucugggaccggagcggggcgcuccgugggcagcuggugaccucugcaggccuugcuucccugugccccugccugggcugccaucccauccccuccaggccugccagggucacagcuggccgcuuuccagccgaguggccagguggcaggagcugccuugcagcccugcuuggagacagguguguucauuucagugucacgaccuccagcugcucagagcucacgaggcagcaagacccgccuuuccccugcaugggagaauugucagugaggacaaaaauaggucugcagcuuugagggagcucagcugggggaggggacauugugaaccccuccaucucagagcuuggguccacagagagggcaccguguccguggaagggggagagacgccgaguggggaaaguucccugggaggaaaaugugcugggucaugacuggcuucgcucgugacucugcucagcccccagugcccgagggucauccgcacagcccgaaagggaguuuccaggggaugcuucucuucuugaggcuucucuggaaacuacaggcccugcccugcaucuggccucucccagggacaggcagaggccuucagauuggauuuuuuuguuuuguuuugagacagggucucacugugucgcccaggcuguggugcaguggugcggucauggcucacugcagccucaaccucucaggcucaagccaguccucccaccucagccuccugaguaacugggaccacagacauguacccccaagccugguuauuuuuuuauuauuauuuuuuguagagauggaguuucacuauauugccugagcuggucuccaacuccagggcucaagcgauccucccuccuuggccucccaaaaugcugagauuacaggugugagccacugggcccagcccagauuggauuguuuuuaauugaggugaaauucauguaacauacaauuagccguuuuaaaggguacaguucagcggcauuuaguacauuccuaauaugcagcccucgucucuguccugguccaaaucauuuucuuuuuuucuuuuuaauuauaaagaaaagcgguauaauugguucaugguucugcaggcccugcaggaagcauggugcucacaucugcucagcuucgggggaggccccaggaaauuuacaaucaugagggaaggcaaagagggagccagcauaucacguggcaaaggcaggggcaagacagagggaccaaaaggaccaccccaaaaggaaacucagauccauuagcagccacuccccucuccccuccccuagcccuaagcaacuacuccucugcuuuuugucucuggauuugccuguuccgggcauuucauacaaauggaaucccccuuguuugucuggcuucuuccauccagcaucgugucuucaagguucaucuguguuguagcguggauuagcaccucaguccuuuuuauggcugaguaauaguccacucacuguauggauaaaccauguuuucuucaucuauccaucaucugauggacauguagguuuucacuuuuuggcuaugaugagccaugcugauaggaacauccguacaagguuuugcguggacgcgaagguauguuucaugccucacuguguaucaggccccauuccuuucuguggcugaauaauauuccauuguacacagagaccacauuuuguuuaucucuuccccccguugauggucacaugggcugauuugauaauuuuuaaagaugcaccuucugaggcgggaggauccuugagaccaggaggucgagacugcagugagcuaugaucgcacuaccgcgcuccagccugggcaacagagugagauucugucaaaaaaaaaaaaaaaaaaaaaaaaaaaaaaaaauauauauauauauauauauauauauauauauuuuuuuuuuuuuuuuuuuuuuuuuuuuuugagauggagucucgcucugucgcccaggcuggagugcaguggcgggaucucggcucacugcaagcuccgccucccggguucacgccauucuccugccucagccucccgaguagcugggacuacaggcgcccuccaccacgcccggcuaguuuuuuguauuuuuaguagagaugggguuucaccguguuagccaggauggucucgaucuccugaccuugugauccguccgccucggccucccaaaguguugggauuacagaugugagccacugcgccuggucugcuaucaguaucuucacacuuacagaagccagggacuuggguggccggcugggccccacccgcuguccugcuccccuugccuagugaccagccaggggccggcaggggcugggcucacgcaaguugcuggugugauucuuggagugugugugacauuccaaggccucuccuaaugucggaggagaaaagaguuccgcugcucucacucuaggcccaaugucccagggcagaaguggucuaagugaccgaccucccugcccaucuggucuggcgccgagaagugcuuccucguaaaacuuuauuugucugugcugccaccuuuccacuuccuccgcacagcaaauguaagggaaugcuucugagcuccagcuucgucccaggcacugggcauggcucucucuauugucuugucugguccucaccaaagugggggcagggggacacguuccuugcagggcagcagcuaaggaaacgggugugcaguggguggagauuugcccaguccggcagcuugacugccauguccauccucccccugcacccccgggggggccaccggcugugcucuccaaagccacauuuuaacguuugcugucuggguggucauugaaugggguuaacacgucuggccccaggguguuuuuagagguaagugguagagagggugcugcccguagcgagccggauaaacugaagaccgcauuguaggugaucagaagccucaaacagcaggcugggcucaugggcggcccaggagcugagacugccuugcuuggacuggagauaguuuccugaugggaagaaaaguugcaaggaggagacccugcuccccucugauugcugccagugaacuggaccuguuucugccgugguuucuguugaguugacaucauugaaagcuacccaugugcccaucgggcuuggccgccagccccugcccuccuucucaccuccaccacagaaguuucggcuccugcccuugaagucugccguggcacagcccacuccagcaggccugccagguagacgggguucucagcgcccugggauuuuauaaaagccugcuaaaaucagaccacuccggaacacaugcucucccggcuuuacaucacccauguugacaguaggaaaauuuggccagguuucucucaaauaugaaaaaugggaacuaggcaugugaggaaaugaaaaccuggcauccccaccccagacagcaggagcgcugggaaggcagggcggacuucuccgagcuccacaaccucauccgugcaguguagugaugccagccugcagggcccugaacgcggaccuggucaggugcccucacacagcugcacugucuggaugugcaggggauggaacggagggcuucaggccaccagaggcggcuccuggcagaacgucuccuugccaggaaggggccacuuugccacugagucugcccgucacuggguccuggagcuucugggugacccgggagagggacagguuguggacagcaguugagccaggcccaccaccagggugcaggacccagccuggaugcccugggaucccuguggcuugccuguggcagcccaaguggacgcaagcucuucccaggauuucagacaccugggacacuuagacuuggccagggccgucuggcuagcaggggccaacuugucucccagacaguaacagggcaagggguauguguggggggugcucacugguggcagaagcguccaaaacucccaggauucucugccccccaucaaggguccgagcgcugcucccccagcccccuuccccugccucggccuggccccgccauauaaaguuuaaagguuuuaaaugcaaauauuucuuuuauagaugccagcugucuccagagagugcguuuccuugcuguucaacuuuacuguccaauuagcuucccauaucuggauacuggagagccugggguggggggggcgggagggaggagggggaggggagcugcaggagggaggagagccauggcuccugggccagcucuggagcuggaagcugcccucugggaccuguaucuggguuggggucagggagcccaggucauagagugggugccucuccagaggugggggucacccguuucagguuuccccgcuccaguaggagaggcaggagcuggggggcgguugguagcagggguauucuuuucugauuuagaaaaauaaaagccagcagccccgacgcacacggcuuccuuuuacucccucucccgcccgcuuuccagccgcgguggcggcguccccauucaccagggcucggcggcgcucacaaagcgaggcaauuagaauugaaaaucuaugcaaaacagcuguuaacugauuguaaaggagugcagcugugugcggggugcggauuggaaccaggcgcugagagggcaggaaguguggggcagcccgggguuaagaggaaaacuccucaaagggaguuagccgggccuuaacccuuuccuguuccccuagaggugaccugggcuacugagggccaccugagcugcugggguggggcucccccagcaucccuggcgaaucugguuccuccccaagagggggcaggcagggagaggcgggcgcugcuuuccccucucucccuccagccuuuauccaaucagcagaucuggguuaaaucuuaaauccugcccagggucuggggacugugucccugcuaggagacaggggccuucuucccuugaggcccccacugccacucuggagcagggagucugggacuccagcagacacgcuguggcccggccugcaggguggcugguggaggaugcuucuucucaggcacugcuuggagaccuuggcuccguaaggggaggggccuggggaucuguauuccucccccccaugauuucagacccacugcacugugugauugcuaucuaagagugggacgcaaccuggagagaugaauuccagaggcagggaugggaaaagccuucuugcaagagauaagauguaagccgggcuuugaagaauggggaggauuucugggccagugauagcagggcaggaaacagaaagaggaggguggaaucuaaguggugggggcuugcaccuucaccgaugcguagggcagggcugggggcugagggcagaugggguagcugggcagccuuccaccccucagcucuucgugccccccggauucagugcacucuguggacuuagccccccgccccuugccccugcaccggggcugguagccuuggggaggguggacugugcauacaggggagcugggugaaucccagggugcucagcucuaggcagcuaacggcucccucccccggcccccaaccaaaaugguuuucaggcacuggacagcugcccagagguaagagcguagaccugaaaccgcuugagaccugucguaccccugcagguguaucuuucuuaauaaucagagugaccauggcaggugguuaccgagaagugcugccagguguaagagccacgucuggaugagacucgugcuggaaugugugugccugaggcaggccaauuaaccuucucaggucuccccacucgggcuguguaauggaggucacugccugccuugcagggccgggagggcuuccagugacaugcgcugagcagcgcuggcucuuguuaggugcuuggugaauggcacaggugaucuuuaccuccuggcccacggacauccaggucccugauacuuauuggcggauccaggcgcugaacaaggugcccaggcaacauaaugaaggugacaugcaguuccuacgugcuaggagcaacuggccaggauggagaaggaccuuggguuaggcugugugcuguccugcugagcccuagaagaagcaagaaccagaaagaacguguccgggauccauccuccgccagggcuaggccgugugcucagacuuagugagguugugacagucacggguggcgcccgcaccccugagcaccugacguggcccagguugaugcccaggcagugguggugguggucugugcugucauccugcccccuugccuuccaaauuuccuugcugccuugaaguguccccucugucagcaucugcccucugcugucugucccuugccgcccccaccuuuaaaaacaaccaaaaaaagacaaggucuugcucuguggcucaagcuggagugcaguggcacaaucauaccucagccucagacuccugggcccaaaugauccuccugccucagucucgcgaguagcugggaccacaggcuugugccaucacacccagcuaacccuggccucucugaggugcuugcugaaggcuuacuggaauuuucaguuuuguuucuggaaaaccaagugugaaacacagcccaggguuuaguguguuuguugagugaaaaaccgcccacccucugugguucaaggcgucccuuucuuucugguggauccuccuaggacucccgucuccagacaccccucuuaguuccugagcucagggaguagguuuaaggugucucauguucaucugagauggaaagcuuucuuuuuuuuuuccuccuuugaaacagggucucacucugucgcccaggcuagaguguaguggcacaaucucagcucacugcgaccucugccuccugggcucaagggauccuccuaccucacuuucccaaguagaugggacuacaggcacacgccaccaugcagggcuaauuuuuuuuuguuuuuaauagagacaggguuuugccauguuguccaggccggucucgaacuccugaucucaagcaauaugccuaucuuggcccccccaaagugcugggauuacaggcgugagcuaccaugcccuuaggaaagcuuuuaaauuuuaaaucucuuuuguggugcaggucuaauagguuccagggcuuguggagguagggcuagaguuugcaccuaggugucacugaagcagguaccugaggcaggugaggggcugggagccugccuuccgcucuuggaggcacaguuuagcuuggcaggggccucagggugugagcaaacgcgcaccaggcaccagcauccuguugccuuggcacaaagcacaguccgugguaaggagcaccgcgugcagcauccccagggcagguguccugcucugggaggugccuccguaggccuggcccuggcaccuaccuagcuccuuccaggcaaaugggaguggagggugggaaggagguccagggaaagagagcugugcccaggaagggcucgcacuaucugggggcgcggggcuguggguagggcgcugcuuaggaagagagaggaggaggagcaggccuggagggaaauggagggaggccagccuuagccccagugcugggaaauuaggagucaagcgacaaaccucguuagcgaggagcgcgccggcugcaggagagcaauucccacccuuaaacucggaggccgugcuccggauuacuaauuuccgggggccgggcgcacugacagugagugucauccaucucccccuugccagcccgccugguggccgccagcguuucccggccaggacucacagagcggcucgcugcugccccccggcgguugccgggguguccggcagcgccucgcuccccuaggccuacuggguugggaaggggagugacuuccaggugugagcaguuuggggcgcagcuugcaugucaccugugugcacaugaucuugagcaacucagggccucaacuuccucaucugugaaacgggaccagaccacccaucucgcaauccaggggagcuagauguauacgccggagggauuggccggcucuaaaaagccgagugaugcaccucccaguggccacuccacacguuuuugugguuggccgucgugguccugcucaaacagguggagaaaccuaaccccaccuucaccccuggcccaagggccucuccaaggaagaagggaguaggugguggcaccguguccgggugagagaccuggagguggggccuaggugucuacccggccaggugcgagagguucauuugcaugcuguuccccuccccccgcagcuuguaauccaggugggaaagggguugggccagucccggaggugaauuuuguuuuuaaggcucggggccagucgucguccauuccuuccuaacaccucccuauccuccccuccccccgcccgugacucccaguggggguggaggcgccccucccccucccccucccccucccagcccuggccgccuggggccgggugaauccgccggccagugcggguauaaauuacccgggcccgcgcggccgagccaccguguggugcguaaauuauagcguccggccaaggccgcaaggggggcgccgccggugagcuggcgggucgugcggggaagcagcacccccgcgccgugccagggccggccagcguccgcagguaggagccaguaacggcccgacccggccucgccgguccguuucccuuuucguuuguggucugcccggagccuugugcaaggcggggggccggcccgcgugcgcccccaccuccgggccccggcgcgcgcucggucggaggucgagcggggagcguggggccugagggagcccgccagacccugccccccggagggcacacaggcugguucugcuccccgcuggcgcgggccccgaacgcucuaggcccgccagcgucaucgggaacagauggaugggggguggcaggcgcccagcgcucgcucccgucgcaauccgggcuggcgcggggagggggagggaggaaggcgggggaggcgggcucgcggggacggcagcgugcgcgccugccaagccuggcgcgggcaugucccggggcagguuuggggcuggcacgagggggcugaaagucgaaacccgcaccgcagcgcagcgcuggggcggccgcccagggggugcugguuugccccagggcucagaaguagggacgcgcuagaucagagggguguuggaagaggaugaggagggagcgaccccggggccucagagccgcccggggggguuacagcccagggcgccagaaggcggcaggggaggcucgccgaccccugcccccgaggcccgccccuuuaaccccgagcuuccuggggacgcgcccgccgcgauggggugggggcggggcggggcggggcggggugggcggagccggggggugggaaggcuggggccuucagucccucuccgcgccgccugugggugcccaggaauuucaggacgcucccugagucauuccagucaagugccugggugagguaggguggggggugccaggaauggggaggcgcugcgcuggggccagaagcgcaaugggucgugccaguuucuggaggcgggcgaccucgccucugaccgcaaccccagcuacuuaaugaucccccuggcgaagcggcgccuccguggguucuccagccccugggccgcggguucuuuaaagaacaccccccgcagcggcccgcaauuguggccuucccaaaaguuacuuaaaacugggggguggggugccuuauggaauuuugaggccaaguucuuaguauucagccuuuucuaguugggguaauaaggucaggcaugggggggguggggcuuggguacacagucuguuuugugucgccuccccccaccccacgcgccaccagcgcccagaaaguuguucuccaaaaggccuccaggacacggaguuacccguccgcccauuauugggccugcucugugucaggcacuguucuagguucccgggacgcagcugcgagacagggcuccgcucacguggcgagggugcugcacuacuuuaagaguuaaguggccggucuuagccaccaagguccccgggacccccgagcaguccagccaggggcucccgagaguguggggguggcaccuccgcggccccgcugguguccccggcucaccuggccggccgggccggggaggggcgugugccugggcggguggauccgggcgcccgucggugcgcgcgcgcgcgccuguguguuugcggcugaaacccgacaccucccgcuggcugaggucagggagccgggagcgagccaguggcccgggagugggcggcguugcguuuggguguguccucggcggcgacagcagcagguguuucuuggccggggccccggaagcuccaccuccccagcgggcccgagcugccgccgccgagcagccccgggugagauaagcaguuuagacaaacacugggcgacgguggcuccagcauguaucagccgagguggagcugcggggcccuggcaugaaaggugagcgcgccgcacccggccggggacgggguccuccccccuccccccaccgcacuguccuccugcaaguucgcggguuucgcgggggcggccgccaacggcucccgggcaacuuccccggaguguuagcggcgauaagagccgggagggcgggcaggcgaccaaaggccacccccuuccuccgcccgcgggucgcagccugggaggccuggcugcgggcggggacucgggggcuccgggcucaggagugcgcucagcgggggauggggggggugcguuuaagugcgugcgggcuagagggcagguaaaguggggggauggggguggcggggggagucuccgagagcugcgggcgcuggagagcuggaaugaaaacuuugcggcgacgcgggagggagcgaauggggguggcugugcgcccccgcggcaggugcuggcgacggccgaggaagcggggguguggggggggggggugcucgcuacuggggccgcgccgguuaggguucuugucuugcuccccucccccuccccgaccccuugucucgggggaguuggucgggagggcgggaccgcagccugccggguuugugacccccacgcccugcuucccgaggaagggcgcgccccgggcucggccgcuucucuccucucucuccccccacccccggcggagcggcucccugccccuccccucccccccgcagaagauggcugccccagccucggaggugggagagggauugcacauccgccgccccccacccgcacuggccuuuuucccuccccggcccuuccugcuccgccuggaugcgccuccccgcccccagcccucccgggcccugcggccgcgcugaugggcggcgaguggcccgaccgaguggagccgauucaauuauauugcagcaccagagacaccuccucggccgcccgcccgccucucuagcaggcuaauuaaauucccuucauggaggcggagcgggaguggagcucacccucccugcgcccgcccacccccagcuuuccgccuccccuccccagcgccgggugggggaccaggggggcacuuagaaaugugcgguggagacucgaggcgcaggccauagggaggggguucccagauggggggaagggacaccgcgacacccucauuagaugggggaguggaggcugcgcccuuuccacguggugggccgggggccuggccgcagugcccgucugaguuccgagggcagcgugcuggcggugggggagcaccugccggguucccagcugggcgguggaugccagccggaguugagucgguuuggcucuuacaaacuagccuuuguacaaagugcguuuaaaacacacuaaacccuugcuccccgcugcggugccuuaucuggggccugagggguagcggccacacagguugggguuuggaaacaaaaagcggggccaccaaauggaaagagggcuccuuuuguaaaaggcgccugaacaaaaggcccagccgcacuccggguggaagcgaacccgccuaagccgauuuccaggcggcgggggacaaaggggcagagagaaggucuuggugggggcguugugaaaugugcccccuggucggccgucucguccucuccucugggauuccgugcucccgccucccggcagggguggaagggggaacccaggugagcagccuucccuggccucccucgguguugcuuaagcuuggggcacuucaguguugcucacccuguguuuacggccgccuccaccagcagggacggcagaaccugaggcacaggcugugccugacucagccgccacgccacaggugaggggcccagggcgcaggcuccgacggcgaagugugucaucccggccgccggcugugcagggagucgccccgcccagguagauucaggagcgcuggaagaggcccuggccugcgagagcagcgaccucggugcuuccuaagagacuuuccgagacagccagccccgugucggcagcguuccugaucuccugcgggccgggugcgaggauggcuuuugucacucuggcagcagacaccaaagucaggaggggaagcuggggaagcuggagccaaccacgguuuugacgcuuggaguuuucuuuccuggagccuugggggcggugccgggccagagcuggugagagcccgccaggagccuccggugaccuagggucagcccugccuugggaagggaggucgggaaguccuaguucuaggcacagugaggcugagcucaaaacaaggaaggcaacaagguguccacuguggcgcaggcucugagcuguuugggacaguuuuuaggaucuuggagugucagaguucaaaggggcuuguacaucuccaaacucgguguuuuaaaacugcugcuggccaggccuuuccaagcccaguuaagccacagccucuggguuccugacccgggucuggggguugucagagcuccccagcugauccuaacguacacacuggggguaggaacaaggggcaaacugaggcuuggggccaggcguggggcggacaccgcgcucacagcaggaagccuccuccgauggccccgaugagcccuccccuccagcagucacuucccugucucugggggaaguucaggggcugcagaucugagugccuugugguuucagagcagaagccaagccugccugugggcucagcaucgccggccccaggaagagccaagucugcacagcgccacucuguggcagaccgggguccugcaccucugagcuagagauuccccccuuccaaccccuggagucccaaauuccccuugagccccuggagcagguacugucuguccuccccugcucugaaggaggcggacuggggggccuuugggcucggagccccgagcugaggggcaggagcuggugccucccacuuuucuggaagagugcggauaagcuagagggcuggcugcuaccuuuucccugccuccaggagcucgcaggggcuuguggagucggcuagcagggccgguuuuuccuggccccauuugaagccuuggaauucccagccuggguuacucgaaguccaaggaucaaacccugggaucgggccaggguuggauggggacccucucuggguagccugugaauugucucuguuguggcaacagcaggguccucugaaaccacagggcuuccccucccuuuccuggugugccgggagagcuguuuuuuuaaccugcagagauccauguugcaggugacauuucagcuugguggcugugccgaagccuggccgccuggcuuuaauuccucccccaguggagucucagaucucgguggccucaccgagugcggugugggacgccgugcugcuggcuucacuuccgcaugcuggccuuucucccccggcugaggccacagccugggaggugacguuucggagugucgcugucaaugagaauuuauugagcuccuccucugaauccagccgugugcuugcugcugggagguguacagacagauaaaacaggagcguggccaaaagcagcccuuugcaugccugccaaacgcacacucgggggccuuuuaaucuugcuucugcagcucugauuccccaccagccucuucucucacgcccucagcuccagccagacgaaaccacacgccauucucgccacuccugcguuuggccacgucccuguccuagcaugggccaucccgucugccugggauucucccgucugcuccaaagcccaccugucacugaggccaguccaccugccccuccuaaccugaugccucccucgcauccauacucccaugcccaccccgugucuggaaucagaaguucagaggggaagugagagcugcccccgggaggcuggggcggaguccaggccuggaggaaggagcuguagaugagggcagggcuggugcuggagagggccucugguuuaccuucaccugcaccuaccagucaucuguggaaagaagggguugggcugcacuugaggcuuuuguggguccuugugacuuggggguuucuagggaggcagguggaggaaguggggagccuccagcucgggggucucuccuggcugcacuuuugaaucaccuggggagcuuuaaaagcucccaguguccaggcuguacugccaggcaguucaggccaaaucucggagggaugcagccugggcauccgugugucaacccucccccccccccccccguuaacugccacgugcagcccaagcugagacccuggcucugcuuucuuccagagcagcuuccuagucaccuaggggccagggugggagcuuuucaaugcuuggccccccuaauccagaagggccuucugcuggggggagcaauguggguaggaauuccuucuccugggaagaugggcugaugcuguuucaggagaccuggggucucucuucccaccugggaagccagagaccgccuugcuugccccggaauuggauggagaacccuggugacucagaaauggacgucuccccucuacgccaccucccccgcaggacggcguggcaccugucaccuggcugcucucuggaugucugugggccuuguguuaaccccaggcagaauccugaaggucauucuugccuggcccaggugugcuuugagcucuucuaaaggggcuuacaaaugcagagucccacuggcauggguggauucguguucaccugcaucucuagccaggccuuccaauucuggaaccgguuccuccagcuggaggacuugacgugucugaggagguguguguaauaguggcuuugggaucacuggacugagguggcgugaggggggugcgugcuaauggugacauagauccuuccacuuuaaucaucacguccucacccccacccccauguucucaucuguaagacgaggaugcagaggcccucuggcaguugagggugaggaugagaugcuguaaugcccgccacaugccccugacggguaaaugacagaugcgggugaggguugagaaggccuggagcguggggugagccccugaugagugucagcuguuacugugucgaucagugcaucugacuguucguaucugccucuugcuuagccugugugaccucaggcacuuguguucugggccucagucuucuaaucuguggaauaggaaugacaaugucaccuguauccugaggcuguugaggguuaaagccuuuauuaccaagugcccaguacagcaccugacacaggcucugcaaagccuugcggcuacuccuguugcuguuguuuuaauuagagacagggucuugcucugcugccuaggcuggggcgcaguggugcgaucacagcucaccacagccucaaacuccugcgcucaagugauccugcugccgcagccuccugagaaguuggaaccacugaugcgugccgcgacaccuggcuaauuuuaaagaaauuuuuuuguggagacagggucucucacuguguugcccaggguggucucaaacuccugaucuugggugauccuuccgucucagccucccaaagcacuggaguuacaggcaugagccacuguguccagcuuggcuuuaauuuauaaaguuccaaggcucuguuccccuacgcucaacugacucccuugcgguguuggggguggccccuuuucccaaaaagacuggaguugcuuuuucugcccuaaggcucaagucaccacagcagacccugccggccccucugcugggcuuuaacaaccggagguucuuuuuaggagccucaacguccccucgggcucacaugcacaccacugcccccuuggugauuggcacucugggcccagguggcgggagaugcuuuaacaaacugucccucccccagcccugcccuuccugcgcucggauggugggucuguggccacaggcagcaaugaaggguaucgaccgcccagcuuuugguugagcaguauugauguuggacagguuaagccgucccgaaggaaaaucuauaugucaagcugagcacaagacagcuugcgaguggaggcgggagggggguggggcgcagccuuaagggccacuucuaggcuaacccugagucuuaucuucuggguuggggggcaaagcccgggggugccaagcgaugccccacagccccagacgggccuggagggacggcaggcgcucuuacguggugugaucugugggcagauggugugccggccaggucuugaucccacuuaaggaguugucucugggauuuaguaaccagaugggaaagacuguauuucuguauccagaggugcuguggcugccccagccuaugagggucacgccgugggcugugcgucaggcgugguggggggacguuuucaccccaacgugcuccuccuccccagggagggacugacuugcuaggcagggauuauccccauuuagccaugcaccagggaagaaaggggccccggggauccauauccucccuguagucacacagcugguaauuaauugguagaggagcagaaacccacaccaugauuuucccacuccagccuccucacccaacucccacccgcucucccuuagagccuggagagaggucaccggcugcuucggaaggcccuguuuaaccugggcugcuuauggggugcgguggcucaagccuguaaucccagcacuccaggaggccgaggcagguggauugcuugagcucugcaguuuaagaccuccucucuacaaaaaauaaaaauaaaaauaaaaagaacuggccaggcuuggugggaugcgccugugguuccagcuacucaggaggcugggcagggaggaucacuugagccccggagcucgaggcugccugcaaugagcugugaucgcaccacugcaccccagccugggugauagagcgggacucuugucucagcaaaaaaacaaaauuaaacugagcugcuucacccagucucgggaugugaguggauucuuccaacugaauucccaguguacauuuaucuuugaguguauuuuuguaauguuuuugcauuugacaugugguauuuuuuccauucacuuaaauauacgaggauccacuagacagccgaugcuauacuggguguugaagacacaaaguggaaugcgguucaagcaaaaauucucagccagaugggagcauuggagagacuuccgccucccagaggcugccgauccacgcggucgucucugccgcccgucgggagggugcgguuagucaccccguaacagauaagaaaacaggguuucggaaucagcccuuguggaaugccugggcuggcgccccacucagcccugcaucucugagcuguuggggaacccguuuagauggucucagccuugggucucugcacuguucucagcccugggucucugcucuguugaggaacccguuuagagggucucagcccugggucucugcuguguuggggaagccguguagauggucuuggccaugggugucugcuguguuggggaacccguuuagagggucucggcccugggucucugcucuguuggggaagccguguagauggucucggccaugggugucugcuguguuggggaacccguguagauggucucggcccggggucucugcuguguuggggaauccguuuagauggucucagcccugggucucugcugugugggggaacccauuuagaugguuucagcccuggaucucugcacuguuggggaacccguguagauggucuuggcccugggucucugcccuguuggggaacccguuuagauggucucggcccuggaucucugcacuguuggggaacccguguagauggucuuggcccugggucucugcuguguuggggaacccguuuagaugguuucggcccugggucugugcucuguuggggaacccguuuagauggucuuggccuugggucucugcgguguugggggaacccgcuuagaucgucucuugaaaaagguuuguguccaccgccccccgugcuggggugugcagggaguggagugugcgcugagaucguaucuauuuuaaaucaagccgauguccuggcguccuuuuuugaauacagucuuaucguuuuacaacguguuguuuccaccuaaauguacaucuuauaagacuuuauaggacuaaggaaguuaauccauccuuagcagggaugccagaccccuggagccugucaccugggcacagggaggacauuuuaacuaagcagcugguuuccagguugagacugguugggauccugcggagugacucugaauccacuaacagcaggacugugucugcuuggaugcuggagcugggguuucuccagccacggcuggcagaguggacccugggguuuugugucauccgugucucuuauccacuggagagacuguuguguuccuucugccagauuacccuugaagaagcaggggaggggagggcgcuccggcccaccucugcuuaccugcccaccucgggcucauucuucccaccccauacuccccaugcagccuucaggacaggagacauagccuggacuacuucucauggcgcaacaagaacuuuguuaccagucuugguggcagagacugccagcucccaacagccaggucugcaccugacugggaaauuuacuaguuccucacugggauucuggaggggcgugugugugugcauguugagaauuacagaaucauuuagacuuaagcagucagccauucagcaguugacaggaugauuguggccggaaaaggugaccaguuuguccuguuugguggcuggguuggaugagggaguccaggacuccuggcgcaugacuguuaugggagcuuuuccuggacagcuccauuccaaaguccaucuuggcugagggugcuuguugguuuuuuccagugaggcauuuagugaugucugggcacagcacuuggggcuuugaagaugggagacgagucuggacgaggaaacgccauuagaacguggaugguucugggcccuuucuuuuuccacccuguauuuccucuguccaggcaggucauauuggggaggguguucauacucguggguugccacuuagggaacucugugcuguaggaguuuguagccuggguucauggaugcuacacaucuucaaacacacgcucccacaggguuuacagauaggcucuucgaacuugguaaaacuguauguaacaugcaguagguguauuuuccuggggagagggucugguccgccacuuugaaccaucuugagaguggaccuuuuugcaaaggcggauguaacuguuuuaugacuugaggggcaaguccugacuuggugagcuugcuuugauucaggggagaccuaccuugggguugacacacgccagaauuguggccuucauaggcguccccugaagcugagccugggaagggguugaccucuuucuguuacacccucauggaguuaccgugucgaugacaucugaguggagugucugugcugaggguugcagcugcagcugccgcagggcuguuaguugcucagaccugcauguacuuggagaauugggaagaccugguguugaggaagcuggcuggccugagaccauagggaggggaggggugcagacucuggcaaccuggagaguuagggacaaacuaagggagaagugccacucauggggcugugguuuuuauggcuuagacuuuucgggagaaacugggcaccuucucguugacuugaagccuccuauuuuaagacauugcccauugauucucguuuaaacaacacagcgugauuucaggucaaauaaaaacagguugaaggguaaaaggcuggccccuuguccacuccuuuuuuuuuuuuuuuuugagacagggucucgcucugucaccuacauugcagugcagucgcgcaaucacaacucaaggcagccucaaccuccugggcucaagcgaucccccaccucggccucccaaagcgcugggauuauaggcgugagccacuguucacugacccucuuguccaaucauuugcacccucucuccaugguacugacagggaaacugaggcucaggccaugcggugcccuggaaguccgcacugagcuguugggcaugagucagccugggcccacccccguuccccuugguuuuccagcucaggaccaagcccuuuuugcucugcccccauaguguguucccucgaggccccacagcucucagccuucaguggaaguucaggcuggcugagugggaugugaggaccccggugccugcaggcaggcacacugcgccuucugacuuaaaggcgcccauuucugcuggugugggcguccgcccuguuggagggaagggacguuuuccagucaucaccaucuccccgccucugaagcuggagacccuggaccccucuucgaaggccagguggcccuuucugcccccgcgccaccuccccugcugcccaggccacuccuggccccuguaugauugcuucuuugagcaccuguugguguccagcuccuguacggccuggucccuguucuuggcuguagacuaagggcccuguagauagguacuggcacucacucgguacagaagggacaggcauucauaggagacguccuuggauccucucucccucccacuuaccugagggagcuuguuaaacacucagccuccuccacacuggggagaggagaggggccugcauuucguggguccuugugagcaagcgucucagccuccucuuccugcuggcccaugccccccggccgccacccgccgucccacggaaacuuggagaccucagugcccgcccuggggugggggagccagguuggauuucccuccugggcaccucucaccugccuggacaccuuggaccucauccguuccucugcccagggccucuggagggaggaagggcucccacaggagcaggugcaauggaaggcagccuggucagcucuggugccaugggcuacacagggcacccgggggcgguuccggccucuagcacaggugcccucuggcugagagcugugggaaaguggggcugggggaggccucgaguccagagccuuccuauucccagccguguaggucccguccguaaaacggguauagcacuagggugggcacccaaacagccgccacagggugagagcugccacagggaggggaccccaagugacgccagccauuuccaaucucuucgcacauuaaagggaagcagccggcaccauggccaggacagcuggguuuccuuccggcuccugagccucuacaugugacccggguugagggcgugaaucuccagccuccguucagccucuguaggcugggagugagcaucccacuguguggaauaaacagguggagagaggcgccugggcaccgccaggaccacugccuccgggaagcagcccauggggagaaugugacaagggaccccagguaccgccaagggcacaggguggcggaggggcugggaaucggccggcaugggugagcccccggcucugucucagcugagcuguguggccccagcggccugugucacuuugcuguucgcagcuuugcuuucuggggucugcuuacguaaagggaaguaaggguacagguagccggcgcccuguaaaaguugcccccugguaccuugaucgcuguuggugcugggcaccaucucccagagucacagcucuggacaccgaccccagccuugacucagggccccgcccucucccuuggucugucgugccccuuuaggaggccgccucccugccgaggccaggcugccgcccgcaucugccagucccgcccuucccgccgcccuccucuccagcccuucaucugcccggccugcuucuccgcacacacagcagccgcuuaggauaaucgcgucaaauguugcugccaucuguugccugacuucccgucccucgccuccauccgggaaccuccgggaccaguccguggccgugaaccucagucgcaggaccgucggcuccuaggaggcugcuguccgcggguccccagaaugcaaccucagcauccagcgccuucugugcagagccccccugcuguccucaaaacuguaguguggcguccaaccugggaagccccuccaggugaccuggccccccaggugacaccccugggauugaccugcucccuugcacuguccaaugcuguuguguggacgucucccgagagcucugcaccccguguucuucugcagaacacggccuccuuuguguucccagcauggcagugagcaagagaaggcuggggagaaaccgggguggccagcccccuccccgucacccccauucacagcaggacugcagcuucaagggugucguggggcucgggcagaauaugggguucaggguggcugcugggggcccuaggcauugcuugggagauggcucauugcggguggcucuacgugguugaccggggcccuggagggcagcgucugggggcuccugccguggcucagugagcguggcagaggacaggucuacacgggccaggcgcuguguugcucuuuccuccugggguagggacuccuguggcugcacagguugcccccgcccaccugcuuguguuuucucagcccuucuuguuccaggucaggauccuggccaccugcaagggcuguccuuugccuuagccaugagugauggcccuggccgguuucuggggcauagaccuugggaagcaaguccaguauggggacccagggcagccuggggggguguuuuuauuuggaaaaaaaaaauuaaggcacaagcaggcugcccccaugugucuggagcaagaagaccucuccccagggucuccccgcccccucccuugccuccacccccaagaaaaauugcuuugugccacugagcuuggagcacguggagggcagauaugauaaugaauuuaucaugaagccgcccaggcuccugcgaucacguggugcccgugcagccucagccgccagggucuguagcagggugacccgaccucguuagggccacggaagcuucgccccuuugggggaguggggaucgcgggggcgggcaccaguccccgagcugggggacgcccuuuauuuguucacaaacauuucuuucugcgguaaugaaaaauuaccaagaggggugauuagagaauccagguccagauugugugugcggggccugaaagugaaggccugcugggcccagccucacgggguguaauuaccccacggggggcugucagggggaaggggcggauuggugcuugaaccgggacccagcagaaaauucaccucagcuauuagcuuguaauuacagagcacagagggagcaggccugaggucuggugccggggaagagccgggaugaaaggaagcaguaauuacgggauccgcgggaggccgggagggcggcuggcacgcugauuaauaagccccuccagccucguggggagggggagcgaggaaugggacaccauauuuaauggaguagagaggccuccccccucguuuaaauccugcuguuggagcguuuggacagcaggcagaccgguuuggggucuguucugaagaacuaagaacgagauggguuccggaaaauagcagcucgcugggccagccagccuugucccucuccacugggacuuugcuuccuuuucuucuugccuuuuuuuuuuuuuuuuuuuuuuuuuuuuuuuuaaagcauugugcugcuucugacccuauuagaaaccuagccagagaauaggagaaaguauugauucaagaagcggugcuuuguuacggggggcggggggugggggccucacccgggggcgguggucuuugcuuccccagaccuuuccugucugugaaauggugggaccugaggguuuugcggugcugugggcugcugcuucauucuccguuuccugcccucuggcuucuggcagaagccucuagguucucagcucugccaggcagacugucuagaccagguggguucuuucugaaaggguccagggagcagacaguugaggcucacaugaagaagggguauguccccuggccccucaguuugagggugcccagggccgaggggccuuuaggugucuggcuguggcagcuuuuuuuuuccugggggugggggucaagguggcagcugacaguggcaggaaggguuguccagagcagcacgugauguaaauaagagggugggggccucgcagaccugguccaccuagaccccuggcucguuuucgccugcugagcugcacaugucaagagagcuuguacagugcggagacagcccccggccccccggccccccggcccucauccgucacaggccuucacacgguggagcguauucccagcuguuaggauaaugaauuuacaugagcugauaauguagacaagaauucagucaauguccaggagcgcagaaguuaauaaauaccucucuaaugagggcagcaggggggugugcucucccagggccucccucuccccgccaucccugugucccccacggacaccuuggcaccugcacugaccucagccagagaacaccugcacgggaggaggcccgcaucggucucccuggggagggcugggggcuucgugccgaggccucgggggcagcagccuugaagugauccccaccaggccuggaggggcaggaggcacgugggcccuggaggcuguguccauucacagcaggcccagggggaccccuccaaggaucucgggguuccccggcucuuggccuccuguccuggccucaagggagcugcgcccggcugcugcggcccccgccccgccugcccagugcacacauacugaggagcagcgcuaauuuuagauucccccuaaugaagccgcucauuuggaauucuauuuuaagugaccugacaucagcagagccgcuucccaggcucacagcuccucaggagccugcagcugacaccggggcagggaugcugcccgcaggggacccccagggacccagggagacuguaccuggggcuggagggggcccauggggcccggggagcagauauugggcuuugucagaggccgggguagggagguugcugucaggaugccagugggcuggugauagugacacugagguagccucagacccaggcauuggagggagcaggcagagggccucccuggucaccagggaagggcuggggagcugugggugagggcucagguucagacuccugcagggacaccccaguucccuccaccucugcccuguggcuggacagccccacgcuuuuguuggcggugcugacuucgugccgucgagccgccaucccuuugaauguccgccuuuuaaaagccugguucacugcagaaaaauuagaacauacagagagagaaaaaggaugaaagugaaagacauagcucuucucguugccaucugaagacacugccaguagccucaaggugugugcgccaucuggggucuggucugggacucgcgccauggccucuguguaccacugauaggguuuggauguguguccccuccgaaucucauguggaaauguguccuccaguuuuggagguggggcccaguggcagugauuggaucauggggguggaucucucaugaagggguuaucaccgucaccuuaguggugagcacgcucucgcaagaucuggguguuuaaaagccugggaccuccccacucuugcucccucucucaccacuggaugugcuggcuucccucgccuuccgccaugauuagaagccuccugaggccuccccagaagcagaugccagcaccacgcuuccuguacaccccacagagucaggagccaaaauaagccucuuuucuuuaugaauuacacagccucggguauuucuuuauagcaacacagacagccuaguucagccacccagcccgugccuguggcugguggucauagcacaucugcccggguggccagccagccucaugaaggccacaggagagagaauuggcaucugcucccagaccuucagggcgggucaccuggaggugaaaugaccauacggugccccacguuccccuuuugcgguagcauguggugugguuugcagggcauagucagccacccagccugcaccggagaucggccccuccugcggcccuggagcaggucgagcugggcccuggcuggcuugucacaugggcacugugcugaggucaucucagcccugcucugcacuggaccugggcuccaagccugccuucgccuaucugggaaauaggcccagucccagcuuucucauagggcggccaagauguagaguggcuggcucucugaggaaugugggaaagggggaugggggaugcugauggucucuggcaucgaagggacauguuuuggagacucugggugaagaugcagagucucugugugcagauaguuucacuucuuggcuuucugauggauugagggggcggccuggauuaauagaggguguggugaugcugaccguaucaguuaucuagcguugugugaccaacuguccgcagcucaguggcuuaaacacaaaaccuuuguuaucucaguuucugugggccagggauuggaggauggcuuagcugggugguucuggcucagggucugugaugagccuacuugagauguuggcuggggcugcggucucaucagaaggccagccuggggcuggaggauucauugccaagguggcuucucacauggcuguuggcuggaggccuugguucuuugaaauguggguuucuccaugaccugcuugagcauccucaugauacggcagcugaccccccuccacuggagugacccaagagggccaggaaggaggugaucuuaccuuggcagcugcagacugcugcuuccauuauacucuguucaucagaagugaguugcucagucuggcccacgcuuggggaagggaauuggucucuaccucuugaaaggaugacugaugaagacuuuauagacauucuuuuuauuuuuugagagacaggguucuguuacccaggcuagaguauagcggugugaucauagcucacuguagcuccaacuccugggcucaaauaauccucccaaacagcggagauuacagguacgcaugugucguuucaggguaauuuacagagacagcgucuaugcugcccaggcugguuuugaacuccuggccucacgcaguccucccaccucacccuccuacuuaccugggauuacaggugugcccaccaugcccaggaugaauguuuuuaaccauuacaguucaacguaucuuagcuguguguggugcgcgcacaugugaccauucacgccuucugaucgggugccaugguugggccguguacugggcaggugcugguaaugagcagugggggcccaggaagccggguucaaguccuggacaugcugcucaacugacugaccuuggaccaagcuuaggucaucuccuggucucgguuuccccaucuguacgcuaggccucuugggcuugggcgauggcugugaggggugggacacaggcuggguggugggugacaguucagcugcuguggccucuccugggcucauugugaggcugucuugagaggugcccgacuggucugugugacuucugagagcugcugcaguauccccuggggggguggucuuugcguuccccggggcccugcuccugucuuccaggcagcucuccuagcgucacccuccugagugccucguugggaccacgaggaccugguucauugauguccgugugggucccugugaggguggggcucuguccugugccacuucgucuuucuagacauucccuccuaaaaacccgcagccuacucgguguggugcugaaggugcuucggugacagauaggacccggagguccucuggacugcccauggcagccccuauguuggccauguccuccaguguccccugcaggcaccaggacaagagcucuggucucccccauccuccaguguccugugggucaccuuuucccggccaccggccuuuuggggucacgggguggcccucugccgaaggugugugggcucgugggcccagggcacggggcuugugggcagggugccugccagcuugacaccaugugcccuccccauuguggcuccaguggggugagcaucgcagacucagagcaugggucccauuugcugagacaccugcguggccuuggcuggacccccugccugcugggacuggcaucugccugcugggacuggcaucuguccucgcuggcuggcaugcugucucguaauggcccuggggugccccacaggcucugaagccccucaugucaguuaccccauuaugcucaggggagugaccucaugaggucagcuuugcugugcuguuaccccguuugguagaugaagaaacggaggcccugacaggcaaaguaacuugccccaaaagguuguucagccagaagcauccagaagcugggucugagccacaggcgcguuuucaucgccuccaauggacccgcugcgccucugugcacagggagaggcacugauggcagcccggugcgggggacacgcagaggccaggcccgccuugggggcagcguggcuggcggugcggagcagagagcagcuggcaggguucaggcuggccgaggacgggcccucauuggcagcccgcauuuucuggaagugaggcugccaggcagagcccccgcccucccgcuuguuuggaugucugugccggguugaagcggccuuggaaaggcaggaugggggugcaggucccccuccaccccuggccccuccagaaagagccaagggaagacaggcuagguggggcccgcugcugcagggcacggccacggcgccaccuggcuguugccugccaugggcauggggcucucagggguccuuuguucccaaggugugagcucucacuggggagaacaaacgaugccccccgaacucguucccgccucucuguucucucauuugcagcccccucucucaggcagugcccccagcccuucccucagugcccccaaagaauuauuuucucccuacguccccucuaucaggagagggaggacuuggcucccugaauacauggccaggacucacggccuuugguggcaaguucuggggauagcagguggacaaaggaggucuugaggggguccucuccacgcugccuccgagccugcugucccauggggacagguuccaauuagacuugucaaugucacuuagaaucuggcagagguggagugggcucuggaggccagggcagccucuuccggggaggaaccugggggcccccuugcccuuaccccauaggaagugcacaguccgccccucuuguguguugccccccggaucucugugacaccagccccaccauguguggccccagcgcccccccgccccaagaugcauccacagggaggaagccgggacccugucugugggugauguaggggugggggcgucucugcgggggagggauguugguggaaacauuuugaccagguugggcuuuuauugauuggacacacggggugggcggacugagggcuuguuuggagguggccauguccuuuccccagugguucugaugucaccagguggcugccccugggcucagaccucuggugccgccgccgccgccgcugucaccacuggccgggagggccaggucagccguugcugcgccaggucggccugaacuuggcccugggaggaaagaggguuccaagcugcaccgcgguuuggauuugcgguuuucuguuuuuagcaucuccgggcagacucugugcccaguaaggggccacaguggggucugcagugcggccguguucuuccccaccgcucccugucagccugccuguguggccccaucucugggaccccucucagacagagacgcacagggucccugaguggcggggaggccgggggucugcccugagugcccgcguggacugggccgaguuggggccuuaguuuccuuuucuguaacguggggcagaacucccgccagucuucugagggcauugccaugcgugccuggcaucgugugcuugucgcgucaguggccacagcaguugucuugguucccgucgucccugggccucuccaccagcguguuucuauccugaggaugcgggccgcacgccuccuccgccugggccucagucuccuuccccacgccauuugauggucaggggccuguugggugaugcgugggauccuccacgaccugcccagccuggacugcccuggagagguagagggacagugcuggcccaagccguucagcaucugggguccugggggccucuugggucugugccggguuccagcuggacucuggggacggggucuguucucucugcagcgcuggcucuguccuguucuugcuuguccugcuggagcccccggggcugccccugcucccugccugcugcugcugacaccggcccugccgacccugcucuggugcugggcgcuccugcucucugggugaccucugguucuucuuuuccuguuucaggcaugagccaugagcccaaguccccuucgcuagggaugcuuuccaccgcgaccaggaccaccgccaccgucaacccccucacccccucgccgcucaauggcgcccuggugcccagcggcagccccgccaccagcagcgcgcugucggcccaggccgcgccauccuccagcuuugccgccgcgcugcgcaagcucgccaaacaggcggaggagcccagagguaagggggcccgccaggcugcgcguggggggagcggcggcucccgaggccgggacucagccucccgccugcggcgugcacgcucacagcaggucucgucuuucccacgccgugugcucugcauggagcaggcagugcuggcugagcuacagacccugggccaguccgccugccccagcaccuccgcuuugccucugugcuucugucucuccugccucuguccuuccucggcccccggagccacugcagggguguccggauguagcgaggugcuccuaccagcucugugacuugauugggaggagggugggugcccuggaccaggggagccccaagaggcugcagagggagagcugggccccagugcuccccaaguggcuccuugcccagguuuugacacucccuccagaaguggcagagaacauggugucccuggaaacacaguggucuggagcgggggucucuggcacagcugaacccaccacugcucaacucccugaggcagagacuguggggagcauagacaagcggcccccggggucuggagccuuggcuucugguaucaccugggcaggaccugcugugugaaccugggcacguugcugauccucugagccucauuuuuccugucugugcagugaggcucuaaagacgcccccuuuggcucuggcucugggguacuuuuuggcgccugcgaugaccauuggcaggggcugcugcuggcacaaauggggaggggcagugggcggcuggagcugcugggggccuuggccauguggauucuggccucggacacccuuuggacucgcugcugacaggcgggggggcugaggaaaccgggaccccaguggcauccgcuucauucaccuccaaggcccacggguuaagauccgggugccagggcccuccgggguggccacagcaacacaugcaggagccauguccgucuuuacauuacccggguuccagcuuggcagaggggacaccugcccugaccagggcgggcuggggggacuucucauuucugaaugucuccuuccuggauccuuucugcugcugcucguuggagaauggggggagugugagaggacacaccugacauugauggaugggggguauuggcccaggagggaggcccguuggggucugguuuccguaccaccagggggcagccccucgccuccuggcucuuccuggcaaaccaggcacaggcaggaccgccagaaaacccuccacgcccuuggcaggggacucccuggccacaccugagcgggccagguugcaugggccccaccugugucaagaggccggacagcugcaggcaagauggcucagggggaagcagacugccugccugguggaggcauccuggacucucuggggcggugaacaaggcagcuggggacagacccugggaggaagcugagcuuggagucgagacucgggcucuccugagagggguggagagaagcgaggucagagcuggcccagcuccugcugcugcaguugucuuuuuuucucagcguuugggggcaggagaaccagggcuggugagggauuuccgaggccacgggcggcacgugacuggcgcuggugcuaccugggcuggguuauccuugcauccugcuuucauccagcagcugugucugcuuuggggccucugggcuccaccccuggguaacgcugcagaggacguggucaggaaagggcagguuucccuccucgccaaggaaggugguagagagguguucagacucgccuucccucccugggcccagcagcggccgugggcgucacagcaggagccugcucacagggccgucgcuuccucuccgcugccccaugcugcuggccccagcacuugguuugguggcucggccagcggguggccugagugccagaggccgcugguccccacuggccaggaacaaagugccgcugggcgccccuggcgggaggccagacaccauggccucguggcccugcucccucccagcugcaaccugggcacugggaagggucccccaugguggaugccccccaggaaagaugcccccgggguggaugccugggaacugaauggcagagggucgggagagcgggcgagcagugccacugccugagccaugugcccaucgguucacucacccaccucacccccuauugagcugggaaugccaagguuuguggggcucggagucugcggauguggagcaguguuuggguccuggaacgcccucagccaggccugggcccucgucgcccccacccguuuugaugaaucuccagcuggucaccccugucaggccuuggucuggauggggagggacugggugacucguuccucgugaccucagccacucagugcaccugguccccauucucauggagucacccggacccugaccucacguuuccccguccauggaacuggccggcagcccucccgggacccucgggcagcugagaaggccaaaguucagagaggacaagucgcaagacggcagccacagcggguggggucguguccgugucccacugcugcugggccuucccgggggggggcugggagagccgccguuaggacaguucugagcugguggucccggcggucccugcuggaaaggaagccccccucaccccuagcaccacugccaguggagcagggagcuggcguugggcgcacaaaagggucuaugccuggcugucagcacgcugacccugccucccuguggguuguggaguccuggaugacaguggggacauguggaccccccagcuccccugugcuacccccccagcucccuggugcuaccuccccaucugcgccagagggcagcagggggaaccuuuggcggacuuggcagugggagggguuugcauuucuuauuuaaaauuuuuuuaguuacaauucacaugccauaaaauucacccuguagaagcgcaugauuuggugauuuuccuacacaguugugugaccaucuaauucuagaacauuugggucaccccuaagagaaccucgguugcauuugccgucagcucccacgcccucccccagcccccggcggccgcugucugcuuucugccucuguagauguaccugugggcauuuuguacacaugggcuggcgcggugcgugucuggacccugagcgugacaucuccugguccuugugggccaucugcggcgugacagcccuuccugcuucucguggcuggacgacccgggucgggggagcuggguggggccacgaacccgcagcugccuuucugcuccguccuggaguuggaccagugagggccuccccaccuucaucauggcaguggcugugcccccuugauugcagcaguggcuauguaucgaguccccccuugaucgcggcaguggcuauguauugaguccccccuugaucgcggcaguggcuguguaucgagcgccugcugugccccuggcgggcucgcugugcuucucacacacccuucgccucugguggaugagaacugagccuccggcuugcccgggucccacguuguaaguggcauggggaauuccaauccccagcuugugccugagacuccauagaccccugccccgcagguguagccuccucccugcagaaagggagaccgggccucugugaaagccacaccugccggggaguggggucccucuggugccugccaggugcccaagagagcaccaagccccagcgggcuagcggcugagcuggccagcucagcggcccgcagccagggcugccuccuggcgacggcacguccugggcagagggggcagggauggaagcagggcagcucccagagcugcagggggagguggcaggagagguggcagagcuggcgcacccagggaacagcagaggcugugcugccccacgcggccccuccucugggugcccugggccccagccgccugcggcaagccuucucacucacccugacccuccucuccagugcacgccugacgacuucuggaagugccucucgguuuucgccaucugacugcgauugccuccgcgucucuccucucauugugucucaaggguguaguuuaaaaauucaauucagacgaagcuguggcaugcgcugcccugggagaaaggcugggaaggagaggaagaggaggcccucgcugggauuuauuuuucuggaggcgcugagacgucuucucuucuucaaagcucagucacccgcccaccagcgcgggccagacacccuuccccagggccagccugacccuuuaaccuacucaccuacucacugccgaggcuggggcgcuuugggcaagggcagacgcuugcgaaucgccgaugcaugccccagcacuuuccuuccuugcugugugauccgggcaggccgcuuugccucucugagcuuccacuuuuucuugggugaggagcaggucucuaccucaugaaucguggggacugggugggaaugugccacagccgggaaugguggcaugagugucaaugcagcaggccuccacccuggcucccacccccgccuccccuucccugccccccacccuaaugcugccuccuuucaccuuccccauucuugccacccccaccuccuacgugccuccccuaccccuccacccacugccaccccuuccccugacuccccguccuaccccugugacccccaucaucugcccugggagggcgugugcuuccccggugggguuggaagguguggguccgccauggcuuccccccgucaauggcucugggccgggagccugcgguggcuuccucugucccaguggugcagggugcaggcagggccaaguggcugccuguuggucuugacuuucugggagaaauggggcuuggagugcccgggccccacgcagaacauucuagaaggaggcugcagguuugggcgugauccugaguugauccuggguugcacccccagccccuucccagcgaccggccugggcugcagucugagccgaggcgucccugacccuguucugcccugguggcuauuggucucuuuguuccucccacauugucccagccaccaaagggacguccccggggccgcccagcccucccuucgacgcagcugggccagcucccgcuguagcccagacuccucggguggcaccggguccuuggguacaagcagggaccuguccccuccucggaauggcggccuggccaccgccucccucccugccucuccuaccaggaccucuucugcacagacacccaaccacccccauaggcaucugaaaccucagccuaggagucccaagacuggggggaugggucccagcccugugucccacccccugcgcuggacagauucugacuccccucuaagccuccugggcgccaggccuagccugccuugcgggugugucgggauccccccaucaucccuuguccuuggaggugcuuguugacugacugaauaagagguguuugccccgagggugccccgggaacgccugugcguggagccaggcccugugcuuccagcuccccagcuccacacccugaaggcagcccugagccaggcuggggugugacagcugucgggccugcccagugucucugcagagggcaggccguggagccuccaccgccgcccccacugcugugugacgaagccagggcugcugccaggcacccucgcaagcuguguggcaucugcuugccgugugcagcaggcggcagccucccgcagggacgcagcgcccgucugccaaggcggccgggggcggagguacggggagccuugcguguccucagcugcuccaggaggcacaggcagcaccugggaccaggcacccccucccugggaaacaguugggggcgaucgugcugcgggccuuugcucugggaggccggcgcuuugggaacaggguggcuccagagccuucccaggugggcuggagagccgccgucuggaggacaguucugagcaggugcuccuggcuggcgaggaagccccaccucaccccagcaccacccauggugcagggagcugggguugggcgcacaagagucugagcccguucccaccccgccuccuugucaccagcccgguggccgggacucauggcuucccugcccacacuucgcucccuuaacaccggccgggggcucaugguaccugcccuggaagcugccagaggccucuccaagcagguguuggccgcuguguuaccugcggcagggguggcccagccacccauagcccggcuugggccacagggacggggccgacaggugguggcaguggggcuggaacugcucucuugucaucgaggcccgcggggcccugugccgccuuccccugguggugucugcuggcugccugccucgucuugucacuggcuuugcaggcaagaggggaggcagauccgguuacuguccugucccuggugccaccugaaaccgagaucccagcugagugaguggggacuacgugugcggggaccacggagcagggaccacagacccauccucaugagcugccgugggaaugcuuccaccguggagccggccugggcgggggagaggcucccccuuucugccgcugccucggaaaucugccucucaaagaaaacagcaaaacaaacacggaggaaggaucccgccuggcaggcgcgccucgcgugggugucagucugcggcggcggcggcucugcaggcgucuggagcccgucugucucccgcgcaggugugagcgccgcgggcguccucauggugccucuccguucuccuggcccgggggccagagggcugguggucaggggaagccagagccaaaggggagcaaggcccacggagaggaccccaccaccuaucccgaccccuucuccgcauagcacaguggggagcccugggcaggguggaggagcccaguacuuggcgugucagccuuugggggccuguccugggauaauggaggcaaggccuccccuagccacguggacauaagggugauuuuuuuccgguuuucccugaugcacccugugccucccugcagccccugugcccguuucuucuuccucguccuaacgucccaccucccucaggguaccugucucagcuccuuuggucccacgcggacucucccggcuccauccggcucccaggguccagcaucuaagcucacgcuguucagcacauaauccgcccccggcaaaacgcaucuccagcuagaaacccgcaccucccgcugucaguuuggguuugaugacuguggcacgugauggcagggugggcaugggagcccgccacuggcugacgcccccccccgcccuuuugcagcugugagguggagccucguugguggacgcaggccgcgggucgggagagcccugcccugggagccuuguagggcggcugcugcuacuuggucuccugcuucucccuggaacgcagggggucgcggcgugacuucagccuugcgcuguggugugccugcugucccguguaccagggcugcggugacuccagaagguuucccagccuguucuugucacuugugcgauggggacuucaccuuccagacccgcaccauucccaguggguggggggcugauuggcucuuuccucuggggucugcuauucccguuccacugggcagauuucaaggaaaguggcuggggugacucagcuccugucccacuucccuacucacuggcuggcggcuuccuguggcucccgugggccuccuaggccaaggggcuggaccuccucuggccgggcuccuuuccacauccaugucgccacaaguccgcccagggcuggguucccagguuuuggguggaaacaggucgguaggcgaaaguagaaaguggaggagcagcccuggcagacacaggcucuguggaccugccccgcccucccuccagcuguuccagccuacaccggcugagggcccagcuggcaucgccguuggugggucugcuccagagucauggcacguggcacacugagucuccugcugaguggacucugcccagagcuuuucaagguugagcugggagcugagcaugaugcugcaugccuauagucccagcugcucggaggcugaggugggaggaucacuugagcccuggagguugaggcugcagugaggcaugaucacacugcugcacuccagccugggugacagagagagacccugucucuaaaaauauuuuguaauuaaaaagaaaauuuuaaacacuaacuuggggacagaacugaugacaggaagagcccccagguuagcagacacacaggguccccuggguucccacccuggccggcaccugccccugcaugguugaaagcagggggcaaagugcaccuggggacccuccuuccaaggggcugagacaggggucugucgcucacccaucuguucaagcugccccucaccugugucuccaucggcagcaugggcuaggcaugggcuguggacaccggagccguccccuagggcucuggcccugcuaagcucugggcagcccccggccauggcaucucacaaagacguuccagggacccucuuuagggaagcacguccgguaguuaccguucuguucucuccaccguuccccugagcaguugcagcggggccgggcccuggggugggucggggccgugcagaacagcggcugggggaaugccugagccgagcucggcuggggagucuuuaccucuccgggugcccugcccuccccuuuccuuccaugcucgcugcuggccuggucagggccuguggcuuuggggccugaccacggugaggccacgcccgccucggucuacagugcgcuggagagugguccuguggcguggcccccaagcgccucuuaaagaccgaugacucuucagggggugccggugguuuuugccuggcggggugggccugagccuggguggcugacaggugcugcuguggcgcugcgguccuguuuuugcccucaauacacucccucgcugacuuuggggugucagcuguuaauuacaucugcccgugggccucagcgcuaaucuucgaggucagacagcagaggugacgcggacacgggcugccucuugucaucuccaauccagauccguuucauugacuuaacuccuggcugaauaccgccaguuaauuacagcaaucacagaccuuccugcuccagccacgcggugagaaugaggguucgagggccaggugccagccucgcuaaugggccuggcguugugggggcaucgaucgaggcugagcuggcuggucugaugaguagcacccgccagcggggauuaggccgcugagugucaauggccugcccugccccagagaagcuccccacccuucacccaccccucuuacuuccucacccgcgccucuuucuuccucacccacuggugcuuagaaacgaggcucauucagagacucuggaguggcagcugccuuggucauggcaaggggucucucugggaggugggguucagagggauggggcagcauggggucuggagccaggcagcuccaggucucugugcauccccuuauggcaugggcuauaagguucuccccauuuguagaguugggguacagagaagucucugagguuccuggggcuuggcacgugguggggcucggaagcuccugcucccagcuccccacuguccgguccccagggaggacccacagcccaccuggccauuggccccaacuuuuccccugggcagcaggagcccggaucaugagcucuuggcagccucugccugggugggguggcggcucucgguguguugguuuuauuuccuuuuucggcuccacagcacaaauguccacauuuccccuacucacagcuacuggaaucuagaugggaacacccuggguuugggccgggugcacaggagggcuuuccaugaaguagggugguggggcaggcaccguuacucaugccuguaaucccagcacugugggcaacugaggcgggaggaucgcuugagcccaggaguuugagaccauccugggcaccacagcgagacccugucucuaccaaaaacaaacaaacaaacaaaaaacuagccgggccugguggcacgugccuuuagucccggcuccucaggaggcugaggugggaggaucacuugaacccaggagguugaggcugcagugagcugugauugcaccacugcacuccagcccagccugggcagcagagugagauccugucucaaaaaaaaaaaaaaaaagaguguugggcacaguacuguugacagcggccacaaggugggcccagccuguaugccaccagcugagggacggaccaguaaggaguggguggacagaggcacacaguggacugucacuuagccgcgggaaggagagauucucuuaggugcugcaauguggaugaaccgugaagacacggcucccagugagaggagccaggcgagaagggccacgcggugggauucccuugaugugaagucuccggaacaggcccuucuuuagagacggagagccaaugcgugcggggccuggggagacgggagugguugcucauggguaggggguuccuuuuggggugacggaaaugcucugaaauggauuguggugauggucgcacaacucuggacgugcuagaaccguggggccgcgcgcugggugggugaauuacgcgggauggaaucauagcucggugaagcuauaacaacugaaacccaagagccauggagguuccauggaauuuuuuuuuuuaaacaacgauccuuucccuaguuuuuauuuuuuuuccccaaaaacuuaaagugaacuuuuucucaaaaucuaaauacauacagaaaagcgccuagacugccaguguccagaacgaacccacagaucaggagggcugaggccuguucuccuguccccacccucugccccugaggugaggggcguggugccccgcccugcagccagcguuuccccuccucagguggaucuaguagcccgccggcacagugcccagucccagguguuggcccggucgacuuggggugguggaguucucagggugugggcagugguuggcuaguccaucugggggucugggguugggucacgccucaggggcagcagcccucagccucauuccccaccugggccagauccuggugggugggagcgugaugaggugggggccuugccuugggcaguucggggguugcuggggagaaugugaacgugccucugggccgcucuggggcguggccgaucuggcuagacggagugucuguuguggagcugcccuauccaguugugcagguugcacacaagcccaggaaaccacauuaaagaggcccagauaccguucugcaggaagcaacggacuugcccucgggacagggcagcugccccaccccaagggagcaccuuugggagagcaaaguucuguuuccacaucgggaugccuguggggccucugccuccuggucacgccacuaaggccacuuuggcugccugaggccucugggcacccccugugagcagcaguuuucuuuggugaaugugcgcgugcccacuccggacacagugaaggggagaugaggcugcuucugcccccggaaccaaggccaggucugaacagaagucgggcaggaugccgggagcugaugggcugggguccuccuucuggaaagggcaucuaccugcuucuaccacgcauucuaccugcuucuaccacgcuuccuaugcaugcauucuaccugcuucuaccaugcuuccuaugcaugcauucuaccaugcuucuaccaugcuuucuaugcaugcauucugccugcuucuaccacgcauucuaccugcuucuaccacgcauucuaccugcuucuaccacgcuuccuaugcaugcauucuaccugcuucucccacgcuuucuaugcaugcauucuaccugcuucuaccacgcuuccuaugcaugcauucuaccugcuucuaccacgcuuccuaugcaugcauucuaccugcuucuaccacgcuuccuaugcaugcauucuaccugcuucuaccacgcuuccuaugcaugcauucuaccugcuucuaccacgcuuccuaugcaugcauucuaccugcuucuaccacgcauucuaccugcuucuaccacgcauucuacuugcuucuaccaugccccgggcuguaggugccucccaaguggggcuuuugcaaacagaaggugcccaauuguaccacaccuccucagauggcagcaucuguccccgugggcccaagugcaagcuugcacagcugcugugacacggggucugggugccugaacgcacggugcugcugguggguggacaugugccugcuccugcuggaaccugcccccaguggacacugcugugauaucauagaauccagggccaccucugcggccugccuuguuggggaccuuggccugugcuggacaccaguugggugcugugugugccucuugggggcggagaucugcccugggccugugucagggaagggggcuuggggagggugagccggacacugagcuguguacaaguccacaaccgugugagcggcacgaggucuccccgcugcaggcugcaggccagccggagucgggggugugagugugcagccgugcacccccugggcuucgucaggcugggcagggcucuugacccccaggcagcagagcuucuggaaccccaggcccaggccucacuggcagccccagccucuggggagcugcucuggucucggucacgggggcuugauccccacaacaagggggggggugggggcuccggaagcgaggcuggugccugguuggggacaggaggacucuugcagcaggugccuuuggacacccccuaccccugccaccacacacacuugguccccuucugaccugggcgggagggagacaacagaggggagcccuggucugagaaggcaguuuugcuccaugaaggaggaagccccuucccuuagggccugggaacacuccuccccguccuccccgguccaaaccccugccgcaccugcagaugggccggggcggcccugcccguccaugcccccuguccuugggguauccucuuggcuguagccaccagucacccaggcccaaagcccuccugccugcccugcacccucccccugcuacccgcggggcugcagccacccauucucccaucccugcugcguuuugggggcugagggguucuuucugaggcgacgggcgaguuccgggguaggucgugguggugguuguaaacagcgaaccuaggcaaaccuccugauguguacccuuaaagauggugaauuauaucucauuuucugaaauuuaaaaauaaauggaucuuuuaaagaaacucccccagggucaccgugggucacccugaauggcugccauuugggcuuccucagccaccaccgcacugcaucccugcuuggcugggccccguagaggggugcugaccacuucuuuuuuuguuuugagacgaagucucgcucugucgccaggcuggagugcggcagcacgaucucugcucaccagaaccuccgccucccggguucaagcgauucuccugccuccgccucccgaguagcugggacuacaggcgcgcgccaucacgcccggcuaauauuuguauuuuuaguagagacaggguuucaccauguuggccaggauggucucgaacuccugaccucgugaucugucugccucggccucccaaagugcugggauuacaggcgggagccaccgcgcccggccagugcugaccgcuucuuguguuuguucccugcugcacugcagccccaugucugcccugcuugaugggagcccccggagggggcgccuuuuccugugaccccccaagcacaugggggcuccccgggaagacucagaggcuuggggucucugcugcuuacacguggagcugccucucgguggggcaggguguguggcccagcuggccuguguguccugggauguccacaggcccuugguucaugacaccuccuagaaacacguguguucucuaacucuggggcuccaugucugucccggaaggugcuaccuucgucucucacucagggacgucaggcacugguccugcccgcccugcccaggcuccuccugucugguggcggugggcggcccugggcaccagagcaucugugcuuugugccacgugagcagggcccguggggcaaagggauagggagugcccgggguagacugagcugcugacccgaucgggccucaggagaggugucuccugccugccugucuugggugggggcccaugaggcugguagaccuggaggucuggggccucacuuggagcaggggggcagcuggagcccagguccccagcuggcacugcacguggcugucacugcggcucccacucaggccaccgucuucuccuccacaggguccucacugagcagcgagucgucccccguguccucuccggccaccaaccacagcucccccgccagcacacccaagcgcgugcccaugggcccuaucaucguccccccugggggccacagcgugcccagcaccccccccguggugaccaucgcuccaaccaaaaccgugaauggugucuggaggagugagagccggcaggugaguggggcggggcagggagccuagcguccucuaaguggggaggcuggauucaggcauccauugggggcucuggagcuuucgagguugaguuuacauuccagacacccccucccccacccugaguuuccgucuccuucucugcaacgugagggugacagcggcacccuccuggaggcccugugcgggugaguacaucggcccacgcaucagucugucagaagaaaccacccgcugggggugucccguuauuuucuccuguucuggaggccacaaguucacaauccgggggccggcagggcugguuuccccagaggccucuccuggguugccgguggcugccuucucccugggucgucuguggugucuccaugucuggguccugaucuccucuucucauaaggacaccagucagcugguuuagcgcccacccuaauguccuuauucucauucggucaccucuuuaaagaccgugucuccaaaugcaguuccguucugaggcccugggcaucagggcucuaacacggauuugggcggggguggcaguccaguucaagcugugaaagugguguuugcacgcugagcacccggcacacuagcugugacugucauagucugugaacugaacaaagaauugagguaggaaagaucccagcccagacgcuaucagaacaagacaucugguggguuuuguguuucugucuuacuuuuggggcucccagcggaggccccuccccaaguuuucggggcuccuuaugucugugggccccucgcucugcacugacuggggccugccuguguggaaggagcuggcacugggagcugcucuucugccgcugccuggggccugugcgcccucagguggguaccugcagcucucccggccccccaccccuggcgcgcagccuggagugggcccuuccuaauuaagagcgauucucaggggcugcugucaccuggacuuuucugcugaguucccagagggacagccccacuuggaaauacuaauuaaaccacaaagaagguggggaggaggggagagucacucuugccugaagcucccucucccccaggggaggacauggguauuggagccaccugcucaucaucagggccugucugcccucuauccccagaggugugggaagggagccagccucaguccacaggugacagcccccgggcaggcccugauccagggucccagugggaaucccugggagcuccggacugggacccccggggccugacguugccucugcuuccuuucacgccuucccuggcugaggggacaaaccugcccaggguccucaccuugcuggaccuccucugccccugaagccucucguaguuugacuaauccucaugugaggucuggagaccgaggggcagggcguggccuggaggguggacccuggccacaggggccuccacaccccacagggcuuggagcagcccaaggcggcccucguccugguuugagggaggcugagggaguuguuaccagcuccgcugccuccagaggccgccccccagggccagccuugaccccaugggcccugaaucacccgacucaaacagcugaggcuccuugcgccccacugguggggccuggcugcuggugccagcgcccgcagcucaugggaggccacuucccugccccagccuggaccaggagcuucuaccagccaggacccugcacccagccacugccuugaccccgaccagagcuccuggccuagacccaggacgccucgaggggauuccagcgccuuuuccggcgacuccuccgcucugagcuggucccuccucggaggguccuuaccgccucgggaacauugagcuaccccagagcagagcaggggcgcgacaggcccgccccagcaguguaccaccgcggcgcuuaauggaacacggugccgccagggaaggcgcggggccggcagcuggauuagcaggugauguacggcuccucgcucgggcacagaggcucagcggggcauuuaauccucucggaguggggaggcagagagaggauuccccucccacccggcccaaagcuguggccaugagucuccgaggcugcggacguggguggcaguugccgggccggaggcuucucggccccuucucggggucaccccucucucccagguguagugggagcugcgagaggagaaaugagaugaaaaagccuguuuuaaagcuaacagggcaugucccgccugucugacuauggaacccuugcucuaaucaccggagaaugacggauuugcuccucccccucccccuccgccccuccucccccucccccuccgccccuccucccccucccccuccgccuucuuucuuucaucguugcagcugcggcugcagccgcugcucagaaaugaaaagcugcccacagaugcgcccugaugcgucugucuguggagacggcagugagaccccggcugccgcuaucggggugccuuugggguagcugccgagccugccgggccuugccuggauggggggcagcccugugccucacuccaggccccgcugaccuaguucccaggugucugugccaggguuggccgggcgccagccagacggaagccacagacaugugggucuggcucgccgggccccugccccgccugcuggcugccccccagccccccggacucccuguuuguccucagccaggccaggaaggugccaucuggccugcgagcagggcuuuguccucggcugaggggagaagggguucaagggccgugucugggcuggggacaggccccuccuuguggcggggcggcuggggcccugugcuuugccguuugacccggcccacggcgcgggcagcaugcggaggagggcggcaggccugggcuguugguaguuugacccugggugcuguccucaggucgaggucuguccuccagcccucuucugacucuggccacccaaggcugggugaugauugaagccccuggcugucgucucccuccugcccuggaggccuccccaccagccugggagggggaguccagguaccccgggugccugagcaggcgaggccccuguucugggcauccagagacccacuagcuuuaggccugguguucauuggggugcuacuuggaugcuggggggccaggggccacuccgucuuguuaaguccaucccagacccuaggaacaggguguguccuuccucgugcuccguuccucagauguuuggcccuaugccaggcaggguaggggcgugaggcaggaucuagaagcccagccuggaaauagccucacggggcugggguaggcaggccagccuggcaacacaccugccauguccgggcccccacccugcuggugcgucccccacaugcccgugcacagcugugccaucaacucugcugcccugugagucccccgcaugcccguucauagccgugccaucaacucugcuguccucugagcaggugccgugacgggcacaugccauugaugugugcacgaggcacgacaggauggccaggucucccaaggucagguuggccccucggccacucccccacuaccccgguugcugacaccggcuggagaccccaaggccaggcgcuggcuccucaauaggaaguucccggccccacgcagggcgucagugcccauguguaccucccacccucgagaccagcacccuggagaggcaggucagaagucgugaacccaggaggacccuacagagaaggggggccggggcucagcccgcgggaagggagcagaugcugccucucauugaagauuccaggcggcggcggcggcggcggcuccuccaguuaauccucgcugacugucuccuggaggguggagagaggggaggcgccggcccgggcugccugcacugccucugcgcgggugccaugugcugcugccgggucaccgucugccgcuaugaagauggaugggcccaggaagaggggcuggcgggucagggacacaggcacggccccugggagacagaugcuucuccacgguggggcaggucucagagccccugggccaucauuccugcugaucuuguggggagacggccauggccuccuuguuuuuuggguguuuggcauuucguggcucagggaggcagagcggggcuggugcucuucaggagcacugcccgcugaucagcagucguuaccugacauggccagauggaacgugaggaagggccggguucccguggcucugcaucccugggaagcucagaggggccagcguggccauggcucucagacacccccaggucaggguaggccugggcagugcuguccccacauggggaagaugcuggggcugagaacggcugccccagugacagagugacgccuggguuggcagccauccagaguccagagcacagcccccaucugggccgcccugaggcucccuccgccccccuccuccccccuccuccccccucccccuccuccuccuccuccccccuccuccuccuccuccuccuacccccuccuccuccuccuccuccuccuacccccuccuccuccuccuacccccuccuccuccuccucccacuuagucacacgaauaacaggaacaagcaaggccuuuucaugcucugguuucuccgggcuggacccugcgugugugcggggcagccucugcguggcuagggguggcacggccuauccuugaacuuggcagggaccucagcccggaaggugggcuuugggccacugccuccuccugcuuugugccuggagaagaccccucaucugaguccucuggaccaccuucccagcuacacccagguccacuguguccaggagccugggacaggcgagcuguugccuucccugccccaccgugugugugaaggccgguaccccagcuggccagucagggcccagcugcugccuguucuggugggcuccagggccagggccaccccaggaggugguugggggcagaccagcaccuucggcccaggggcagugccagcuuccuuugccccugcccuccacgugggcaccagggccaggacaucugcggccaggugggcagcugucggcgcaguugacgucuuggcuacaucguggcacucgcuucacggcgugcugggugccaacggugucugcuuccccgggugugugucuggugugaccuucggauguccacaccaggagggguggaggcaggagccccugccacccugcauccuucaccugcacacauuguguuucugggggguucuaguucuuuugcuggacugaggaggcccagggagggagacggaucccgagacgcacuucaccccagaccugucgcagccacauccccuuucuuacgguucugcuucccacaccacaugcaccauguuuugcguagaaagccuuagggaaaggauguuucuagaacaugaacuaaaucuagcgccuucccgugagucaggagaccuggcuguguccuguggucaguggccuauaccaggcuccugcccugacuggacgcucuccucccgcaggaugccggcuccaggagcagcaguggaggucgggaacgccucauuguggagcccccgcucccucaggagaaggcagggggaccagccauccccucgcaccugcucagcacccccuaccccuucggccucucccccagcucaguugugcaggauucccgcuucccgccacucaaguaaguuggucggcggggacuucggugagguggccagguggggacacagugcucagggucuggguccccaggcagccugcggucugcacagaugaggcugugccugcuagaugguugucggccgcugagcccuggggauugcagcccugucugugccccuucacacugagguggcaguggcagcucgcuccccccgcugcuuaagccccguccucguucggggugccaggagucugggugccgacugagcgccaggggugaugcagggaguuuagccguccccccaugcaggagcaggugugcacucaccuguccccaccuugcccacuauccccgccugcagccuccagcggcccgugcaccacguggugccccccaguaccgugaccgaggacuaccugagaagcuuccggcccuaccacaccaccgacgaccuccgcauguccucacugccuccccucggccuggacccggccacugcugcagccuacuaccaccccagcuaccuggccccacaccccuucccccacccggccuucaggugaggcaucccccacgcgcccucucgucuaggugcuggccuguuccuggcaagauggaaccuggcggggaagguguuucuuaugaccugagagccaggcuccuaggggagggucuagaguagccccugaaaucguccccagcuuugagccuaaauucagcccugauggcccauuagggguccccuccugguagacagucccccuuggugacuguacugucauccuuggcuccuccccuucucaccgggggguccauugacagcaagucacuguuaagagagcagggcuuugcccgugggagaggcgaugcuuugcuguguagcaggagaccucgguggcacuguggucuggccuggguccguggagaagcucugcccauccuugucagaggucagaggggccuguagucaugucauggaccaccccacgucagggcagcccagccugcucgccagccuuggaagggccugggcgcuugaccacucugugcuggucuggcugagccgagggagguggcaggcggcgcccuggaaccccaagcugucggcaccuagcagccuccggcaucaaggggcuuuggggcuagcagcaggcauggucuucauccccagccauuuugucacguuccccacgcucaggcagguguguguaccuggcugagacacaccugucgacagggcugggucuuccccuugguucauuugcugcucacagccccgucuucucugcacaggauggacgacuccuacugccugucugcccugagguccccguucuaccccauccccacccccggcucccugcccccacugcacccaucagcgaugcaccugcaccucucugggguccgcuacccucccgagcucucccacucaucccuggcagcgcugcacucggagcgcaugucuggccucagcgcggagagguaagugcgucucgagccgaggagccccucugcccucccugucccuugauggcagcugggcagaaagccugggcuggaaccugacuggacuccuuggccaugccuguccucacaguuuguccaccugccaaaugggacaaugaucguucaggcucugcucugaaauagcgccugucucgguagccguggucuccugcaguaaaccugcaggccgaggagcucucgggcgugcuugggcauuuuguaagccgcuuugauuguauggaccuuaaguucuuccugcaccagugaaacccggcucaccucccgucacuguucagauuagcgcccuggcucguuccugguuaugcuuuuuaagggccugccccagguccgucucuuguuccuggugcagcagagcccccaacucuuuccaugugcugcaggcugcagauggacgaggagcuaaggcgggagagggagcgcgagcgcgagcgcgagcgugagcgugaggcugaccgcgagcgggagaaggaacgugagcgcgaacgcgagaaggagcgcgagcaagagaaggagcgugagcgugagaaggagcgcgagcgcgagcuggagcgccagcgggagcagcgggcccgggagaaggagcugcuggccgccaaggcccuggagcccagcuuccugcccguggccgagcugcaugggcugcguggccaugccacugaggagcggggcaagcccucggagcagcugaccccaacccgagcagguaccugggcgugggugggcugugcugggcaaggucucagccacccgcggggaggagcccugaaucgcagcaccugccgguugccgugguguaaauguuccccagcugaguucgcccuaaaagcgugguguggcugaacauggaguagggagcagaggcacguuggcacacgauguagacacaguggauauagcugaccccaggaggacaguugugaaauguagccggggcauuaggaagggauguuuugagugcuucguugauuuuauuucucuguaaguuuacgaaacaauuguccaguaauaacaaccagcuuuugcauguuucccggaaauuuaauagucugcucuuugagccagcaugagcuggcucuggcaccgcacuggcugggcaagaguuuugccagccagccacggagcguuuccuuccagggacaagacaugcuucuugaaagcucccguagggccccuucugaauaucuugguucuggcugcgggaagaacccuuuggaagggcucugguuucucugggcaguugggugagagaggacggggagggagcaugcuggcccacguggcugagauccugcuugaccguguuuccccccacagagaagcugaaggaugccggccugcaggcgcccaagcccguccaacaccccuugcauccggugcccaccccacaccacacggugcccagccucaucuccaaccauggcaucuucucucugccuagcagcagugcugccacagcccugcugauccagcgcaccaaugaggaggagaaguggcuggcgcggcagcggcggcugcggcaggagaaggaggaccggcagucucagguguccgaguuccggcagcaggugcuggagcagcaccuggauaugggccggcccccggugccggcggaggcagagcacaggccggagagcaccaccaggugagugagccccaggaaggaaggagggaugagccuucacguuccgauuuguucagcguguauugagcaccuccuguuugcccaacauccugccccagcguuucugccugccucuuucauuucuguucuuucaucuucacguuauaaugccugucuugccuauggggaagcugagacugaggaagaaaauggauugcucaaagguauccccaccaguaaguaaagagaccaaucaaguccauguugagagccagggcacugcacacgcagccugaccuaguucccaggaggccauucacagcagaugaagagugcaagguagaagcuuuaauuacuaauaauaccuguucucuccaucuuccucugcuuuugagccuggacuucuuuuuuuaacaagaaggggacagcuuuugauuuuaaggaaaaaaaugaguuuuauugcuuuuguauuaauaguaaaaacacaugcccguuuucuagcccuuuaugaaagcauuucccaggaaacugugugguggucccuuggaccccggcugcagacacaggucuuaugagcugggccccagugcccccaguccucccugccccugccugcccugggauuccugccuuggggcugugcuggucccaggcccccacgucauauacccccagggcucacucugaagggcugagcuaagauccucagccagaguuggugggaaugaccugccagccuuccauagcucugcuccaggcccagcucagggaccuagggacacugauucuguucccugagccucacuuuccucaacuguccacaaaggaggguggguaggaugauuucugagcaucuuuccagcucucaaggcugugaugcuguccugggauaagaaacccuugggcucugggacggaagcguguuggugguuuaaaaucuguccucccuucugccugccuccguuauccaguagggcagcgagggaaugcgcccccgcugaucagggaugacugggagugacugucaccaggccacagcuaagucucccuguggcucacacugcccggcacggccgaagugagaucccuucugccucucccagcccccgucccugaggccucucaggcucagccuugccuacuacccagaggacugagggcagccagcuccuaccuggcauggccugauaacaucagggugcccugacuccuguaggcaucuucuuccucagggcuccccagggccccagcacagguguugugacuuugcccacccauggacugcuuccagccaguguagcugccccauccggaccuggggcaugaugggaagcagggccuggccuccccuggcugcggugguuccccuguggccggcugcacacguggccuuacagcauugugaacuugggggccugacagggcccucaugcuccaagcuagaaaacuguucagugcuugguguggcgcaugaaauauuuauucuccugcagguuucauucccuugcuguuuacuuaaggacacagcuucuuccugugguucccuguuguauucugcuaagagggacagcagcgucggauuugucccuuggccuggagucuggaauaacuagggagagccuugguggcuguguuuaaacagggcucccggggcaggcuagagaucccugagcccggccgugugccugcuguggccucugccucuuucuuccccucaagcuuugcccagggucucugcacaguauugguccagacauccugugaguauaucucccuuuaaaaaaaagaaagauagccaggcacagugacacaugccuguaggcccaacuacucuggaggcugagaugggaugaucgcuugagcccgggaguucucggcuguaguguacuauacccacuaggugucccagcuaaguccagcacaaauauggugaccuccugggagcgggggaccaccagguugccuaaggaggggugaaccagggcaggucggaaauggagcaugucaaaacucccgcgcugaucaguagugggauugcuccuguaaauagccacugcacuccagccuggguaacacagcgagacccaucucuuaaaaauaagcuggaaaaacaauacuaaaaauagcccugugaguagauuaaaucuuguuuuaauugcacugaggaaacaagccauuuaguguaacuaaggggcagcuucuuguuuaauggaaggguucugauguuagaaaucccuucuuucccucccugccucagcaggccuuagccuggguccuugaagacacuuugaggccucugccacaggccacuugggcaguggggucgcugcaguugugacaggggccacuggggggcagucucggcacaggccccauccugacugggaggaucuucauuucacaguggguuuggcucuggcugggcagacacuggaagguugucuuguggcugccugcggggacaguggggagggaggaguacugcccugugaagguggccagccugcccugugucaugugucccuacaaggcacagcaggaggagagggugcugguggcagggccacagcccaguauauagaguggguuuccccauggaaagugcggaugagcgcuugcccuuaggggaauucacgcaagcaggugggaaaaucgaccgaaacuggaucugucccaggccugagagggucucugccuucccuagcagcuuaggcugggagccucccuauccucuuggagcagccugcacacaccugccgcagguguuggagggccgggcacaguggcucacuccuguaaucccagcacuucgggaggccaaggcagguggaucacuugaggucaggaauucgagagcagucuggccaacuuggugaaacccuaucucuacuaaauaggaaaaauuaguagcugggcaugguggcacacgccuguaaucccagcuacucgggaggcugaagcuggagaagcgcuugaaccugguaggcggagguugcagugagcugagcuugccccacugcacuccugccugggugacagagugagucuuuuuuuuuguuuuuuuugagacggagucuugcucugucgccuaggcuggagugcaauggcacggucucagcucacugcaacgucugccuccuggguucaagcaguucuccugccucagccucuggaguagcugggauuacaggcacccgccaccaugccuggcuaauuuuuguauuuuuuaguagagaugggguuucaccauguuggccaggcuggucucaaacugcugaccuugugauccacccuccucggccucccaaagugcugggauuacagggaugagccacugcgcccggccgagucuuuaaagaaaagaaaggaaaagagaaaaugaaagacagaaacaaugauccuugggguggaguguguguccccucccugcagcccuguuggcacuggcucucuaaggggcugcgccaucugugucaucuuaggagcggcaggcagccagggaagccuguggaugacugaagggucuuuucucccugacugaaggguugguuucacucccuaggccaggaccaaaccgucacgagccagguggccgugacccuccgcagcacuuuggggggccaccaccucugauuucgcccaagccccagcuccaugcugcacccacggcccucuggaaccccgugucccugauggacaacaccuuggagacgcggcgggccgaaagccacucucugcacagccacccggcugcauuugagcccagccgccaggcagccgugccgcuggugaagguggagcgggucuucugcccggagaaagcagaggaggggccacggaagcgugagccugccccucuggacaaguaccagccaccuccgccgccaccacgagagggagggagccuggagcaccagcccuuccugcccgggcccgggcccuuccuggcugagcucgagaaguccacccagaccauccugggccagcagcgggccucccucccacaggcggccaccuucggggagcucagcggaccccugaagccuggcucgcccuaccggcccccagugccacgggcccccgacccugccuacaucuaugaugaguuccugcagcagcgccggaggcuggucagcaagcuggaccuggaggagcgcaggcggcgggaggcccaggagaaaggucugccuccccgcgggccccgagcugcucagggagagccgcacaguggggauggggagccugcaugccagccaccugccccucuccguccacuccugcuuuuugccugggguagucccaggccccagguggcaagugcacuggcuucuuuguagcagcaugacacccucguaggggaggcagacccuaguccccgugccuguccugccucgaugcaaauugucccaaaaagccaaaucaaagcccgccugugaagauaguuccgcagacaagcaugaugaauaagugaugagcggaggcuaauaagauaguuuuaaauauuaauagugcagcauaacaggagagccggccugggcucagcgggggcuccacauacagggccgcugccacgagcugcagcaggugggucagggguugaggacgcggcggcuggcacugccccgggucaggguaggaggucaggcacuucauucuuauuucugcuuggggguggggcguccucagccagcggcucccugaguucuccagagagccaggaagagcaaccgagcaggcgagagugugcagaggggagcaggggcuccagcccaguuuucuuccugaugcugaacacucagguccuguccagugcugagcucagccuccucuucaauagaagcuggggcacaggcggucuuccugguuguuggucuaggcuggauggagggcccagccaaauuucucuccccuacucacuuuguaaaggaggagggagauaccccagcgccccugggcaggggcucugcuauuguucucugugucuuagagagcucaggccugugugugccugucuccucccaggagauggacucagauggccacagcaugggggagugcaugugcacaagcagcccuguguugccguggacacagccccaggccugugugaugaaugguucccugccagggggaggagggaggucuugucagcccaggggaccacccagcuacugggagccauggaucccagggaagccuggugucugcgguccugcaaagccccaggacuggguuaauguugguuuccaccucgguugaaaggaacuggccuucaggguguucaggugccagcaggccuggccugauaggugcucugcacacaugaggcccugcgggcauguccacuggacagaugaaggcucuuugucuggcugaauacaaccauuucuccaucaggguacuacuacgaccucgaugacucuuacgacgagagcgaugaggaggaggucagggcccaccuccguugcguggccgagcagccgccccucaaacuggacacguccucugagguacugggcucuccuccccacggacaugcucugggcugggcucucguuccuagcguccacacccugcaguccaccccacuguugcuagguuccuccgaaguccuggcggguucgccccaugaagcucuucucccaccaggcgcagccagcuacggcccacacuucgaggaccccaggaggggaccccgggacagugcaagcauaccacugccaguggcuucaaacucauuuguuuucuuucccaaucuagaagcuagaguuuuugcaacuuuuuggcuugaccacccaacagcagaaggaggaauugguggcccagaagcggaggaagcggcggaggaugcugcgagagagaagcccgucgcccccaacaauucagagcaagcggcagacgccuucaccgagacuggcgcugucuacccgcuacagcccugaugagaugaacaacagucccaacuucgaagaaaagaagaaguuccugaccaucuucaaccugacccacaucagcgcugagaagaggaaagguagggccucgccuggguaggaaggugggggcucacugggguggaaguggguuucugaagcagcagguggggccgguggacuccaggcaggaucugcgaucacugagccugaggcugccccuuuacuccucccggcucccgggaacagccucucuguucuuacaagcccuccauagcagccuuaccugacaggcuuugcucugagagccccaccaucuugaccugaggacuacccaugucacucauccaucucccagcgcccgagaaggcgcucuuugagccgagugcuccagugaccaccaggcgugaggggaggugccagguguuccagguuugucugcugcaggcuuuuccucuugcuggaccgcuuagguggucugcuggguguuguguccugguggccggaggccuggggaagggcugccaagcagggcagcacacacugagcagauggcuugccuugaaagaugcuuccaguucagucuggccacacagggccacauugggacagacccucugggcucgaauccauauagcagaagaaacaaugcagccacaacaccugcucaggguuuuggcuuccuuggccugcagcgcaggcuggcuuggugcccagauguugacguuccuggcccugccccuuacgcacgcuuucaaguccucgugggccccuggccuccucucugggagaaagucgaaggaaagcagaguuacuucuuggaccuugagcagcuucaagguguugaucaggguguagccguuuacuuucuccuuuuaaccagucaguaguuuucccuuucucuuagcgggcuagugacguguugauugccagcccaguucccuagauacaaagcaucuuuuucccugaauuuuuggaggaaaaaaaauuaagggcgaugcagcccuugaguuucacagucaagaagggccgggugacaucagggaucugcugcguggaacaucguggggucaucuuuccccuucaggaaguggcaguaaugguaggagugggggagaaggcacccugccucagaggccaggccugggucuuugggguguuucuuuguguuggggccaccuugucugacuugaaauaagaauacauccucgcacgucaccaccgagguccgugggcacagugauucacagaggcgucgucaccgcacggacagcugucuuuggagcacgucuaggacauuguguaguggaugccgagagcaaucugggcucgcuuugagaugguugcuuccuuucaacugggccugccccaucacaccugcuuuugguuuuucgggcuuuagugcuuugccugccccucaaggcucggcuagaaucccgcuguccuucucuccaaaaaaugaugcaacuggcucguuaaucucaggcugcuuuucucauagacaaagagagacuuguugaaaugcuccgugccaugaagcagaaggcacugucagcagcaguggccgacuccuugacaaacucuccgagggacaguccugccgucucccugagugguaagggaaggauagccccaccugccaccacccaggaccaucccaugggcugcccaggcucagaggcgaccacucgaggucuucaucauugugaauguggccuccugcaggcugucuucuuccauucuuguaccagcguacgauucuugcacaguugugacagucauugggacggaacgucaguuugaaggcgggcucagaguugaggggagggucuggcuucuguggagcucuacgugcuggucacuauggucguaguaaccguuguccuucaguuacggcacagaggcucacauggaggccaauccaaugguaccaucccaggagggagggcgugcuccagccuuagugcccgcagccugguccugccacuagccuagccgcccuggcucucuuccugcucuuugucuuccucacucugcccucugggcccugccggcaccugccgccacaccuuuccuccucuuacaguucuggcuggccucugcccugucagaugucagagggaaucuuuacagugcgucccaguccucggccccucacacacucucuuguccgguuggacugaauaccuccaugcugccuccguggcugggggacuuccuucuuccuguggaucugcuucuuccuucuugggacaucuuucaaggauggacuugccacuaaacaccccacugucuucagagaauagccaugugcgcggcgguuacuuaaauguuccccgggucuugguucuuugcgcuaggucuuuguuaaguguaagcucuagagaccaggaucugcgugcuggacacucagccuguuaacuugcauuucuuaauauuuuccuucacuuugucucuaaaagaaccagccacgcagcaagccucucuggauguggagaagccgguugguguugcugcuuccuugucugacaucccaaaggccgcggagccugggaagcuggaacagguccggccccaggagcugucgagaguccaggagcuagcuccugccagcggggagaaggccaggcugagcgaggccccuggaggcaaaaagagucugagcaugcuucacuauauccggggcgcugcacccaaggacauuccugugccgcugucccacagcaccaaugggaagagcaagccgugggagcccuuuguggcagaagaguuugcacaucaguuccacgagucagugcugcaguccacccagaaggcccugcagaagcauaaagguaaugaggcugccagucccugcucagcucucggcugugguugaggcugaccaaaguugcugagcgccacagcugcucagccguucagccgugggcacaaguuuuuauaaacuccaaucaccagaagaaaauaauuucguuauuaugccaaaaccauguuuguuuguuuaucuccaagcucuaaaaccugaacucguaggugagaaacguuuguaggcaccagcgcugacgcugugcugugagcagggacgcaucgaucgguaagagguaaaggagugaacgccgacaggcauugguuuuugcagagauuaaaagauuccccaaaggcaggaagagcacuugaguggauuuuuacccgcauucauuugaaagaaucauguuuuucaagacagagaugcagauggccgccaguccucaggguagagcuucccuuccuucauggugguaucuaaagaugucaccaccagcccucuggauccguggguuccgcgucuuuggauucaaccagcuucagauuagaaauauuugugggugggguggaauuccaccaaguuccaaaaacaaaacuugaauuugccaagcaccagguacuacauugaauccaugcaaaucaagucaaguguaggcauuguguuagguauuacaaguacucuagaggugugcauaggugauacgcagauacuaugccacuuuauaucagggacuugaacaucccuggcuuuugguauucacaggagguucuggagccaguucuccaugacagauaccaagggagacuauacagugcuacugagaugccuuucgaaacuucagaauacccucccucccugcccuuuggcagugcaccuuguagaggcuuuucuguggcccuaggacacuuucugccuuauucugaccuuguccuggccuuacacuaaacuguuuccucuagauuuuagucacucugccauaccaguuugagccaagucacuccauugacugggcuggucucaggccccaccaggggcugccauccccacgggaggccaggugugcuccugaggaugucacccaccaggccacgccaugagacagggcaugcccucuugaaacggggcacaaugaggcugauuccugggggagggcagagccccauuaugccuagggaucaaaacagccacgccuugugagaggaugggcuggugucugcugagggcugacuauagaccaagcucaaagagauggaggcagccgggcgcaguggcucacgcuuguaauuccagcacuuuaggaggccaaggcgggcagaucaccugagguccggaguuugaaaccagccugggccaacauggcgaaacccuguuucuacuaaaaaugcaaaaauuagcugggcaugguggcacaugcguguaauuccagccacuccggaggcugaggcaggagaauugcuugaaccugggaggggaaguugcagugagccgagaucacgccauuucucuccagccugcuacccagaggacugagggcagccaaaacaaaaaauggagucucagagaugaauuccaacaaaaaugguccacguaccagaaucaacuagcacucagggcugcguugucuccuggcugucucggacuuucucaaguggcccagaggccuugggcuaggucccuccucucuacgcgaugucaucuugguccccggagcccugcagucauguugacucugcaccaagggcagagcagagcucccuucugagacagcacccugugucccuucccccaacacacugaugcaagcccuguccccuccacagggagcguggcugugcugucugcagagcagaaccacaagguugacacguccguccacuacaacauuccugagcugcaguccuccagccgcgccccuccaccccagcacaaugggcagcaggagccccccacugcaaggaagggccccccaacccaggaguuggaccgggacucggaggaggaggaagaggaggaugaugaagauggagaagaugaggaggaaguccccaagcgcaaguggcaagggaucgaggccguuuuugaagcuuaccaggaacacauagaagguaagggggugcuggggaagaggggggagggggucaggaaaguaccuuuggaaaggaagcugagugaugaguucaugcagaccucugccagccuggggacuguuucuccguccuggggcacaguagauaugaauacuggaaguuucuuccggcuucugguagcggugaugucccaugcuggaaccugaggccagucuugcuagggcauccaaguaccaugaugccagcucugguggcaccugucauucuuuaugugggcccugcucugugggcugcaucagugcugaugucggccucagcuucguguaaggguccugggagacaaccuaguugguugauuugcugagcccuggcagcuaggccuggucacugcuccagcaugccucuugccuagugacagacuccccacacugcaaggauugcucuguggccggugggugccagucauguuuucagcugccuuuacuuuagccaagcacuuugccuaaaaagacaggcuccugguaaaggcuuagucgaaggcuugccgccucucagaauacccaggauguuuugaucccaccugggaaugcacacaccaacccuccugggaagccacagcaccaggcggacucaggccacaucuccccugccagggaguggggccacgaaguugggcguugcagcauuugaugcuccuguauacugcacaccaccuucugccucugugccucaguuucccuaggauauugcacaggccccuuuggggaacagcagagguacccagccuucauuuugcacucaccauccuuacugcgugggcacugcuggguaugcgcuuugacaaaagcugggcugggccacagccaccuguaauugauuuaacauguccuagaggacucuuuaucaucacauaugacaguguuguaaauaucaucaaacacaaagacuugauuaugaaugucagccacuucaaauacuuagaaaaguaguuuuuuucuuuuuucuccugguagaacucagucaggaaaaguauucuccaaacuaaaaacaaacgcccauguagccacaaccaggacaucaaaucccguauuuuguuuccuuuccuccucccguggaaucuuugaguuuauugcgcaccacccccuacauguugccauucuuuuagugcacucguauauauccagaagcaauacacagugauuuuuaacucuccuagaugaaauauuuccaucuuugcugguuuuguagguuuuuuggugugguguugggaauuauuuccauaccccauggcugucaggcuauucuucuguauuuucuucugugaguuuggcuuuuuccuguucugcguaggauucauguguguguacagaguaaggcagaaaucuuaacuguaccuuucccacccaaccaguuguccuggcaauguguggggugcccucuucccugccucacucccacaccugcugggccuggcuucgccccugucaggcaugaccugcgcugacccccucuucucucagcuaccgcucagcuguuuuuagcccauggcuuucccccaaggacuuuuccccuaaggauuuuaggaucgccuuauauucaccccaaagaguccuguuagauuuucaguugcauugaauuuacaggcgugguuggcauccuuuuccaugaauaugguacaaaacuauuacaucauuuuuggacgugaaguuuugacuagauuuaguuucagguaucacauagauuuugggggucuuuggauuuuuguguugccugugauuauuccuuagaucagaggaaucacagaugaucaaaccugcaaauacaagguuugguucuuuccuuuugaauuugucugauugucuugucacuccagugcugccaaagagaggcacugguggggcccuugucugugaaacuuuaaagcaucccauuaaagagugaagguucccauuuccggaguuuuucauccuuugauuuuuuuuuucuugauguugcuccauccuuguugaauuuguuaguacuuuuaggauuuuuaauguauguucguuaguauuagacucuaguuuuauuguacuuugguauccagauugugagcacuuucccuguuuuucauuugcugaaacacuguguauaagguagggauuuguccugaaagaugugaagucacucuccuguugaaacuaggccugguaucuuuugguagagcagaggcuuuauuuuauuaauuaaaucugugcuuuagguguacucuggccuuuuuccagcagccuaaacugaaagccuauuuuuuuuuuuuugaaagcugcauuuuaaggccaucaaauuucuuccuaaucuguaucaaauugccuuuagguccuggauccuuugucuuuauuccuguguauugggcuuaauuuagugacguuuauguauuuaucgguacaauucaaagggcugggagcauugugguccacaggagaggccuucgcuggcugcacuggagagagguuuugggcucugcugggcagggugugaagaggagagcacaaagcgggccuucgggcuccugcauacggaaaauacaucaccaucuccugucuuuucagagcaaaaucuggagcggcagguguuacagacacaauguagacgacuggaggcccggcacuacagccucagccugacggcagagcagcucucccacagcguggcggugaguugggaagggauggaaaccuucaaacacgcaaccuuuugaguuuggguucagaaacacccaugcagauaaguuucagagaggaaaugugcucuuaagagaucaaaauuuggcggaucacgaggucaggagaucgagaccaucccggcuaaaacggugaaacccugucucuacuaaaaauacaaaaaauuagccgggcguaguggcgggcgccuguagucccagcuacuugggaggcugaggcaggagaauggcgugaacccgggaggcggagcuugcagugagccgagauugcgccacugcacuccagccugggcgacagagcgagacuccgucucaaaaaaaaaaaaaaaaaagaucaaaauuuggacugcaugcaauggcuuacaccuguaaucccagcacuuugggaggcugaggcaggaucacaugagcccaggaguucaaggcugcagugagcucugaccacaccagugcacuccagccugguugacagagcaagaccacugucuccugaagggguaaauucagacaccaguugauuaucuaggauuuacuuauagaauaucgauccuggaaggguagggaugcuguuuguagaaugaauuauugccuguaucagucuccucuaccgugauuugcugaggagagcagcaggguuuuauuagagaagggaagcugaagcaacugaaaccaucucacguggcucacagccacacuagcaggauugguucagcagauguccuuggggggcagggaugggaagcaggucucagaucacucccaaaguuuuuacaucuggggguuccaagaacuccgaguuugagccaagacagcagcagaugccgauucuuaagacucuggaagagccagggacagaacacaggcugagaaguggacuuuguuucucuuuuugaggcgaagucucacucugucacccaagcuggaaugcaguggcgcagucucggcucacugcaaccuccgccuccuggguucaagcgauucuccugccucagccucccgaguagcuaggauuacagguauacgacaccaugccuggcuaauuuuuuuguuuaguagaugggguuuccccauguuggccaggcuggucucgaacuccugacgacaggugaucugcccgccucgaccuccaaaagugcugggauuacaggcgugagccaccacgcccggccgggacauuuucaaauguagguuuacccuuccauccagcauguuuguacucuacaugcuuguccuuacagaggaaacggguugguuuugacacaaauuucccucucuccaggaguugaggagccagaaacagaagauggucucagaaagggagcggcuccaggcagaacuggaccacuuacgaaagugccuugccuugccugcaaugcacuggccuaggggcuaccugaagggauaucccaggugacgguuucccuugcacuaggccgaaccuauaguauagaaauauuaucuauuuuauuaccuugaauauuuaauauuuuucacugggagguuugaagcuuacaaaaugagaaugugccaugcaugaagcaaaggauuccaggcuccagaaaaaaugaaugaacucaccuugacgucaaugcaauugaaucaccguugucauucagcgagcaaccaauguaggauugcccacaguuuuucuuuuuaaaggugguuuucgcccuuccucucccacauuauuucuuaaucugaacaugaaggcuccauuagcaacacuaaaacuugaucauuaacagcccccugugcauaugaguggaucaaaccgguucuguucuuucuuguguugccauguuacuaugccucaagcccaguuugcuuuugccgcagcgauggggccagucucauuccuccccaggagugaaacuugcuucagcugaaaagguugggugcauugucaguaaaaagggcuuauuuguuucauuuuacuuuccugcaaaauuuucuucaaagcaacaaguccuaggagcacacaaagcaacccaaaggcuuuucccuggaaaagcucuuucuuaccuaaagauaaaaccaauucacaaacugaagguagcuuuuuauuacuccguggggagcauguacagagcucuguguauacacagcuucacacccaccagauuguuacuacaguggguuggguuuucauacagacguaaauuuugagagaaaagucaaaggugcuucagccuuguacuguguauauauauuaaaaaaaaaacaaaguuuuguauguuuuuauuacuuuaacuauuguuauaaaaagccugccauuuuuaauaugugguuugggggauuuuuguuuguuuuuccuguuuggggguuuuguuuguuguuuugguuuuuuuugggcaaaaaaaaaaaaaaaaccuugcuuuuaguguuuguacugcugcuggucaggacauuaaaauauugaaguguuuuuaaaaauuaaagaagaagaaaaguaaaagagcuuaccacuggcgccuaugcgaucacuucauuuuuaguuugaguugcaccagaagcugccguagaaagccaugcgcuacugcuuaccuccuccacucccccugccugcccccagcaucuggacaagcuaauagcaaauauuacccauugcuaucaagggaggaggggguagucuguagaacccaugugugacagucaugugcacacaugggcgggggcuuuuaaaaaccuuucaggaagucaaugauuucugugauugauauaauucuaaggugucugagagcagguacagaauaggaacuucagaggcuuuguuuaaacgcaaagcuuuguaaaagccacaaggucugagcugaaccccuccuuuuugaacuuacugugacaagcacaggaacggucagaaacugggcucaucacaccaaggcaaagcaacgggcgagucuuccuccuuguccuaguuacugccuauggaggcaguguuuagaucaagaaggccucucuugcucccaagggcccucaccagaggccagggcugccagucacuggucugggggguggaggccugagcugagggcagggugccugaccugugugccggcugcucacugcugugaccagcagccgagcccuuggcccuagcccuugcugcgcagaacagcuugcuggcagcuggcaucgugucgcuuuaucugcccccgcacaguuugcuuuguacgucugccaagaaucuuccaguuauuagcaaacucagacgaauguaccgccaguauuaucagcagucaacaagcaccuuccucuccacagaagcagcuggaagagaacucgaggggcugugcugcaggccuccccucgaaagacacugggaggucagcauguuccacagguguucagagggagucugcuacaaacuaucagggcaaaaucucacuggauuucuccacugaaaaccuacuugagguuucuggucugaaggcuuaagagucacaucuuagcacuuccgcucucaggccuccuccuccaucacagaugucuggaugcuuuuggaaauggccuuggcuaaaguaaaagggaaaaguagauccgauaacuuaaaaacguagcucaucccuuaccauccaaggggcacucccuugguuggauuuucuaugacagcacaggggacagguggcacaccaugagaggucugcccagggugggagcagugucacugugcuagcaauaguuggcuucuccccugucaguggaaaccccacuucugcccggcccuugagcuucuugcccacugucuccccauccuuccaccuacuuguggcgaucugaguacucuacucuugcucaagaaguaauacgacaaucagaauacaaaccaguaaggcaacacgaauaaacuaagaaaaagguaagaacugucucaaaaacgaaagcacaccacccaagacacaguacccagucaugguuuccccauccaacuauuaguuucauacuuugaaaacuuacuuucagauuauucucaaagaacacaguagcaccuaaaucuguuuucaauugggcuuaaaaauugacaugcaaucucuuaaguuuuuuguucagcuacuucacacugaguaccucaaaucugcucuggagucgauuaugccaccugugugucaggaugcaccugaaagcccucggcucgguccuuagaccaucuuccuacauuaccuggaagggagcugccaucugucccucugcagagggauaccuuccaauaguaaauuaucugguuccucacugaaacaaguuauuuuugcuucauauagucagagucagacugacaugauaaaauaucauguuccuaaucuguugucucagauaagugaccaagacgggacuuuccacauuuuagucuacauucuaaucuuaaaggaauaaagcacugaauugggacuaacauucugauagguugcacccuuaagaguauucagagagcaucaaaaggagcccacaccuucagcagugaaggauucuaacacagggaaucugcaguuuguagcagaaugguauuuuccucaaguagcucauaauacugccaaaucucaaaaguuaagcugaauuucacaccagauccuaccccuuucccugagccacauguuucacacaaguguagaaaaugccagggauccaccacaagauggagauggucagcacaaaccgauucuguuccucuuuaaaguguauauuagccacuuagcaaucucuauauucuuucaaguaaccaagcuguugacuuucuuacuacuugcaguagccuguccccaacuuuuccauccagugcuuaaccuaaaaaacuccuuaacucugccuugaccugaggaagaccaugcuaacugguguuauuuuguauguacccugugcuuaauucuauaacaguaaaccccauacgcaggugggagggaggaacaccggugccucggucacucugggggcaguuuagaugcugugaaauuaaaccuguucuaaguguacuuguuugaauuaauuguauuguaauauuauuuguugaauguaguaauuagguauuuaugaauauauugcuguaauuucugacaacauccaaaaaauaaaaucuuccuaaauuauguuaagaggaaaaucuuuuuuaugauauaaaacaaagccaaacaaagaaaagcucaauaacuauacaucuccgcagacggagcugccuccacuggcucaggcucuaagaggagggcauuaggaccccuugcccuccacaauaacaagugguuucauucuaaaagauccccagaugaaagcaggaggauuccaaggaaggcugagaugaaagaacaaguccuaugagcugaaccaagucugaacagcaccuuaaauuauggagaccucaucuuuuggucccagucuuccaggucugacccuucaguguccaaauaaccaccaaaaccugccuggcggggacacgugggcagcaacauggagugauagugugcagcaugcuagacacuggagggcagaugcugggugauaagucuuuaggcucagccugucacacaugcgcauucucagagcuccccagacagcaccccacugcuuuuggcccacugguguccagccaaaaauaggcuggccaggcauggcggcucaugcuugcaaucccagugcuuugggaggcuguggugggagaacugugugaacccaggaguucgaggcugcagugagcuauaaucacgccacucuacugcagccuggaugacagaacgagacccugucuaaaaaaaaaguuaaaauuuuuuuuguuugagacagagucuugcucucguugcccaggcaggaguacaguggugcaaucuuggcucacuacaaccuccgccucucggguucaagcgauucuccugccucagccucccgaguagcugcgacuauaggcgugugccaccacaccuggcaaauuuuuuuuuuuuuguauuuuuaauagagacgggguuucaccauguuagccaggauagucucaaucuccuggccuugugauccaccugccuuggccucccaaagugcugggauuacaugcaugagccaagccaaugugcccggccaaaaauuaaaguuuuuuuuaaagcugauuacagaaccuucuauccauugcaugaugcuggacgaucauuucaccucucaagguaauguaauuucuguaaagguccuaacauuuccaaaaugcuacgaauaaaguaauuuucucuuaggaaaaaaauaauuuccccugagcccacuguuaccuacaacaaagaauccuuccccaaauccaucaagagcagcacugaaagugacuuuucuucuagcauugucacucaugcucaauacauugucacucaugcucaauacauuggauucguuuuuuuccugacucuccucuugauaagcaacccauuaaaccugagcuagaaguagccaagagaaggagacaccccagguguuggucugcaguuuccacuuaacugccgugugccucaguuucguugacugagucaucucagccacaggcucaguccuuuuacuugguaguuacgcagcacaaaaaccuagagagucagagcugaguuggguccauuuuuauuguggaucagggcuuagaggauaagcaccggucagcauuguuggcugcaccaucugccauccuucucugugagccaccucugugagagagucuaaauucagcccaagaaaucaggaucaagaagggguaaaaagccguggaccacauggccacuccugcuguaucuacaccuaccagucacugaacaccugcccaagugugauggcuuccaugcaggagacccaaguggcucugcuagggagaaugacuuauuuaccuaaggcuuuuuuauuucucaaaaguggggggaaaaagggcugguuucuagaaacagauguggaauugaagaaugucccagggagcuaaguuuuaaggacuaaucacaaacuuguuucuccaacaacauccugaauccauuccuugcaccaucacacauuuuucaugcaucagaaguguuucuagagcuccagaaccacgaguaccucaucacguccugagcgcucacaucccccagcaagccgccugcaccaggccuuucucuagaaguccugagacugaguacucuccagaggcuggagguucgugcggaguuuguacaugugguugagcgcuugugugaggaaagucccgcugguguugaucuccaucaaggu

SEQ ID NO: 15842 - RNA, 122316 nt, Homo sapiens
accuugauggagaucaacaccagcgggacuuuccucacacaagcgcucaaccacauguacaaacuccgcacgaaccuccagccucuggagaguacucagucucaggacuucuagagaaaggccuggugcaggcggcuugcugggggaugugagcgcucaggacgugaugagguacucgugguucuggagcucuagaaacacuucugaugcaugaaaaaugugugauggugcaaggaauggauucaggauguuguuggagaaacaaguuugugauuaguccuuaaaacuuagcucccugggacauucuucaauuccacaucuguuucuagaaaccagcccuuuuuccccccacuuuugagaaauaaaaaagccuuagguaaauaagucauucucccuagcagagccacuugggucuccugcauggaagccaucacacuugggcagguguucagugacugguagguguagauacagcaggaguggccaugugguccacggcuuuuuaccccuucuugauccugauuucuugggcugaauuuagacucucucacagagguggcucacagagaaggauggcagauggugcagccaacaaugcugaccggugcuuauccucuaagcccugauccacaauaaaaauggacccaacucagcucugacucucuagguuuuugugcugcguaacuaccaaguaaaaggacugagccuguggcugagaugacucagucaacgaaacugaggcacacggcaguuaaguggaaacugcagaccaacaccuggggugucuccuucucuuggcuacuucuagcucagguuuaauggguugcuuaucaagaggagagucaggaaaaaaacgaauccaauguauugagcaugagugacaauguauugagcaugagugacaaugcuagaagaaaagucacuuucagugcugcucuugauggauuuggggaaggauucuuuguuguagguaacagugggcucaggggaaauuauuuuuuuccuaagagaaaauuacuuuauucguagcauuuuggaaauguuaggaccuuuacagaaauuacauuaccuugagaggugaaaugaucguccagcaucaugcaauggauagaagguucuguaaucagcuuuaaaaaaaacuuuaauuuuuggccgggcacauuggcuuggcucaugcauguaaucccagcacuuugggaggccaaggcagguggaucacaaggccaggagauugagacuauccuggcuaacauggugaaaccccgucucuauuaaaaauacaaaaaaaaaaaaauuugccaggugugguggcacacgccuauagucgcagcuacucgggaggcugaggcaggagaaucgcuugaacccgagaggcggagguuguagugagccaagauugcaccacuguacuccugccugggcaacgagagcaagacucugucucaaacaaaaaaaauuuuaacuuuuuuuuuagacagggucucguucugucauccaggcugcaguagaguggcgugauuauagcucacugcagccucgaacuccuggguucacacaguucucccaccacagccucccaaagcacugggauugcaagcaugagccgccaugccuggccagccuauuuuuggcuggacaccagugggccaaaagcaguggggugcugucuggggagcucugagaaugcgcaugugugacaggcugagccuaaagacuuaucacccagcaucugcccuccagugucuagcaugcugcacacuaucacuccauguugcugcccacguguccccgccaggcagguuuuggugguuauuuggacacugaagggucagaccuggaagacugggaccaaaagaugaggucuccauaauuuaaggugcuguucagacuugguucagcucauaggacuuguucuuucaucucagccuuccuuggaauccuccugcuuucaucuggggaucuuuuagaaugaaaccacuuguuauuguggagggcaagggguccuaaugcccuccucuuagagccugagccaguggaggcagcuccgucugcggagauguauaguuauugagcuuuucuuuguuuggcuuuguuuuauaucauaaaaaagauuuuccucuuaacauaauuuaggaagauuuuauuuuuuggauguugucagaaauuacagcaauauauucauaaauaccuaauuacuacauucaacaaauaauauuacaauacaauuaauucaaacaaguacacuuagaacagguuuaauuucacagcaucuaaacugcccccagagugaccgaggcaccgguguuccucccucccaccugcguaugggguuuacuguuauagaauuaagcacaggguacauacaaaauaacaccaguuagcauggucuuccucaggucaaggcagaguuaaggaguuuuuuagguuaagcacuggauggaaaaguuggggacaggcuacugcaaguaguaagaaagucaacagcuugguuacuugaaagaauauagagauugcuaaguggcuaauauacacuuuaaagaggaacagaaucgguuugugcugaccaucuccaucuugugguggaucccuggcauuuucuacacuugugugaaacauguggcucagggaaagggguaggaucuggugugaaauucagcuuaacuuuugagauuuggcaguauuaugagcuacuugaggaaaauaccauucugcuacaaacugcagauucccuguguuagaauccuucacugcugaaggugugggcuccuuuugaugcucucugaauacucuuaagggugcaaccuaucagaauguuagucccaauucagugcuuuauuccuuuaagauuagaauguagacuaaaauguggaaagucccgucuuggucacuuaucugagacaacagauuaggaacaugauauuuuaucaugucagucugacucugacuauaugaagcaaaaauaacuuguuucagugaggaaccagauaauuuacuauuggaagguaucccucugcagagggacagauggcagcucccuuccagguaauguaggaagauggucuaaggaccgagccgagggcuuucaggugcauccugacacacagguggcauaaucgacuccagagcagauuugagguacucagugugaaguagcugaacaaaaaacuuaagagauugcaugucaauuuuuaagcccaauugaaaacagauuuaggugcuacuguguucuuugagaauaaucugaaaguaaguuuucaaaguaugaaacuaauaguuggauggggaaaccaugacuggguacugugucuuggguggugugcuuucguuuuugagacaguucuuaccuuuuucuuaguuuauucguguugccuuacugguuuguauucugauugucguauuacuucuugagcaagaguagaguacucagaucgccacaaguagguggaaggauggggagacagugggcaagaagcucaagggccgggcagaagugggguuuccacugacaggggagaagccaacuauugcuagcacagugacacugcucccacccugggcagaccucucauggugugccaccuguccccugugcugucauagaaaauccaaccaagggagugccccuuggaugguaagggaugagcuacguuuuuaaguuaucggaucuacuuuucccuuuuacuuuagccaaggccauuuccaaaagcauccagacaucugugauggaggaggaggccugagagcggaagugcuaagaugugacucuuaagccuucagaccagaaaccucaaguagguuuucaguggagaaauccagugagauuuugcccugauaguuuguagcagacucccucugaacaccuguggaacaugcugaccucccagugucuuucgaggggaggccugcagcacagccccucgaguucucuuccagcugcuucuguggagaggaaggugcuuguugacugcugauaauacuggcgguacauucgucugaguuugcuaauaacuggaagauucuuggcagacguacaaagcaaacugugcgggggcagauaaagcgacacgaugccagcugccagcaagcuguucugcgcagcaagggcuagggccaagggcucggcugcuggucacagcagugagcagccggcacacaggucaggcacccugcccucagcucaggccuccaccccccagaccagugacuggcagcccuggccucuggugagggcccuugggagcaagagaggccuucuugaucuaaacacugccuccauaggcaguaacuaggacaaggaggaagacucgcccguugcuuugccuuggugugaugagcccaguuucugaccguuccugugcuugucacaguaaguucaaaaaggagggguucagcucagaccuuguggcuuuuacaaagcuuugcguuuaaacaaagccucugaaguuccuauucuguaccugcucucagacaccuuagaauuauaucaaucacagaaaucauugacuuccugaaagguuuuuaaaagcccccgcccaugugugcacaugacugucacacauggguucuacagacuacccccuccucccuugauagcaauggguaauauuugcuauuagcuuguccagaugcugggggcaggcagggggaguggaggagguaagcaguagcgcauggcuuucuacggcagcuucuggugcaacucaaacuaaaaaugaagugaucgcauaggcgccagugguaagcucuuuuacuuuucuucuucuuuaauuuuuaaaaacacuucaauauuuuaauguccugaccagcagcaguacaaacacuaaaagcaagguuuuuuuuuuuuuuuugcccaaaaaaaaccaaaacaacaaacaaaacccccaaacaggaaaaacaaacaaaaaucccccaaaccacauauuaaaaauggcaggcuuuuuauaacaauaguuaaaguaauaaaaacauacaaaacuuuguuuuuuuuuuaauauauauacacaguacaaggcugaagcaccuuugacuuuucucucaaaauuuacgucuguaugaaaacccaacccacuguaguaacaaucuggugggugugaagcuguguauacacagagcucuguacaugcuccccacggaguaauaaaaagcuaccuucaguuugugaauugguuuuaucuuuagguaagaaagagcuuuuccagggaaaagccuuuggguugcuuugugugcuccuaggacuuguugcuuugaagaaaauuuugcaggaaaguaaaaugaaacaaauaagcccuuuuuacugacaaugcacccaaccuuuucagcugaagcaaguuucacuccuggggaggaaugagacuggccccaucgcugcggcaaaagcaaacugggcuugaggcauaguaacauggcaacacaagaaagaacagaaccgguuugauccacucauaugcacagggggcuguuaaugaucaaguuuuaguguugcuaauggagccuucauguucagauuaagaaauaaugugggagaggaagggcgaaaaccaccuuuaaaaagaaaaacugugggcaauccuacauugguugcucgcugaaugacaacggugauucaauugcauugacgucaaggugaguucauucauuuuuucuggagccuggaauccuuugcuucaugcauggcacauucucauuuuguaagcuucaaaccucccagugaaaaauauuaaauauucaagguaauaaaauagauaauauuucuauacuauagguucggccuagugcaagggaaaccgucaccugggauaucccuucagguagccccuaggccagugcauugcaggcaaggcaaggcacuuucguaagugguccaguucugccuggagccgcucccuuucugagaccaucuucuguuucuggcuccucaacuccuggagagagggaaauuugugucaaaaccaacccguuuccucuguaaggacaagcauguagaguacaaacaugcuggauggaaggguaaaccuacauuugaaaaugucccggccgggcgugguggcucacgccuguaaucccagcacuuuuggaggucgaggcgggcagaucaccugucgucaggaguucgagaccagccuggccaacauggggaaaccccaucuacuaaacaaaaaaauuagccaggcauggugucguauaccuguaauccuagcuacucgggaggcugaggcaggagaaucgcuugaacccaggaggcggagguugcagugagccgagacugcgccacugcauuccagcuugggugacagagugagacuucgccucaaaaagagaaacaaaguccacuucucagccuguguucugucccuggcucuuccagagucuuaagaaucggcaucugcugcugucuuggcucaaacucggaguucuuggaacccccagauguaaaaacuuugggagugaucugagaccugcuucccaucccugccccccaaggacaucugcugaaccaauccugcuaguguggcugugagccacgugagaugguuucaguugcuucagcuucccuucucuaauaaaacccugcugcucuccucagcaaaucacgguagaggagacugauacaggcaauaauucauucuacaaacagcaucccuacccuuccaggaucgauauucuauaaguaaauccuagauaaucaacuggugucugaauuuaccccuucaggagacaguggucuugcucugucaaccaggcuggagugcacugguguggucagagcucacugcagccuugaacuccugggcucaugugauccugccucagccucccaaagugcugggauuacagguguaagccauugcaugcaguccaaauuuugaucuuuuuuuuuuuuuuuuuugagacggagucucgcucugucgcccaggcuggagugcaguggcgcaaucucggcucacugcaagcuccgccucccggguucacgccauucuccugccucagccucccaaguagcugggacuacaggcgcccgccacuacgcccggcuaauuuuuuguauuuuuaguagagacaggguuucaccguuuuagccgggauggucucgaucuccugaccucgugauccgccaaauuuugaucucuuaagagcacauuuccucucugaaacuuaucugcauggguguuucugaacccaaacucaaaagguugcguguuugaagguuuccaucccuucccaacucaccgccacgcugugggagagcugcucugccgucaggcugaggcuguagugccgggccuccagucgucuacauugugucuguaacaccugccgcuccagauuuugcucugaaaagacaggagauggugauguauuuuccguaugcaggagcccgaaggcccgcuuugugcucuccucuucacacccugcccagcagagcccaaaaccucucuccagugcagccagcgaaggccucuccuguggaccacaaugcucccagcccuuugaauuguaccgauaaauacauaaacgucacuaaauuaagcccaauacacaggaauaaagacaaaggauccaggaccuaaaggcaauuugauacagauuaggaagaaauuugauggccuuaaaaugcagcuuucaaaaaaaaaaaaauaggcuuucaguuuaggcugcuggaaaaaggccagaguacaccuaaagcacagauuuaauuaauaaaauaaagccucugcucuaccaaaagauaccaggccuaguuucaacaggagagugacuucacaucuuucaggacaaaucccuaccuuauacacaguguuucagcaaaugaaaaacagggaaagugcucacaaucuggauaccaaaguacaauaaaacuagagucuaauacuaacgaacauacauuaaaaauccuaaaaguacuaacaaauucaacaaggauggagcaacaucaagaaaaaaaaaaucaaaggaugaaaaacuccggaaaugggaaccuucacucuuuaaugggaugcuuuaaaguuucacagacaagggccccaccagugccucucuuuggcagcacuggagugacaagacaaucagacaaauucaaaaggaaagaaccaaaccuuguauuugcagguuugaucaucugugauuccucugaucuaaggaauaaucacaggcaacacaaaaauccaaagacccccaaaaucuaugugauaccugaaacuaaaucuagucaaaacuucacguccaaaaaugauguaauaguuuuguaccauauucauggaaaaggaugccaaccacgccuguaaauucaaugcaacugaaaaucuaacaggacucuuuggggugaauauaaggcgauccuaaaauccuuaggggaaaaguccuugggggaaagccaugggcuaaaaacagcugagcgguagcugagagaagagggggucagcgcaggucaugccugacaggggcgaagccaggcccagcaggugugggagugaggcagggaagagggcaccccacacauugccaggacaacugguugggugggaaagguacaguuaagauuucugccuuacucuguacacacacaugaauccuacgcagaacaggaaaaagccaaacucacagaagaaaauacagaagaauagccugacagccaugggguauggaaauaauucccaacaccacaccaaaaaaccuacaaaaccagcaaagauggaaauauuucaucuaggagaguuaaaaaucacuguguauugcuucuggauauauacgagugcacuaaaagaauggcaacauguaggggguggugcgcaauaaacucaaagauuccacgggaggaggaaaggaaacaaaauacgggauuugauguccugguuguggcuacaugggcguuuguuuuuaguuuggagaauacuuuuccugacugaguucuaccaggagaaaaaagaaaaaaacuacuuuucuaaguauuugaaguggcugacauucauaaucaagucuuuguguuugaugauauuuacaacacugucauaugugaugauaaagaguccucuaggacauguuaaaucaauuacagguggcuguggcccagcccagcuuuugucaaagcgcauacccagcagugcccacgcaguaaggauggugagugcaaaaugaaggcuggguaccucugcuguuccccaaaggggccugugcaauauccuagggaaacugaggcacagaggcagaagguggugugcaguauacaggagcaucaaaugcugcaacgcccaacuucguggccccacucccuggcaggggagauguggccugaguccgccuggugcuguggcuucccaggaggguuggugugugcauucccaggugggaucaaaacauccuggguauucugagaggcggcaagccuucgacuaagccuuuaccaggagccugucuuuuuaggcaaagugcuuggcuaaaguaaaggcagcugaaaacaugacuggcacccaccggccacagagcaauccuugcaguguggggagucugucacuaggcaagaggcaugcuggagcagugaccaggccuagcugccagggcucagcaaaucaaccaacuagguugucucccaggacccuuacacgaagcugaggccgacaucagcacugaugcagcccacagagcagggcccacauaaagaaugacaggugccaccagagcuggcaucaugguacuuggaugcccuagcaagacuggccucagguuccagcaugggacaucaccgcuaccagaagccggaagaaacuuccaguauucauaucuacugugccccaggacggagaaacaguccccaggcuggcagaggucugcaugaacucaucacucagcuuccuuuccaaagguacuuuccugacccccuccccccucuuccccagcacccccuuaccuucuauguguuccugguaagcuucaaaaacggccucgaucccuugccacuugcgcuuggggacuuccuccucaucuucuccaucuucaucauccuccucuuccuccuccuccgagucccgguccaacuccuggguuggggggcccuuccuugcaguggggggcuccugcugcccauugugcugggguggaggggcgcggcuggaggacugcagcucaggaauguuguaguggacggacgugucaaccuugugguucugcucugcagacagcacagccacgcucccuguggaggggacagggcuugcaucaguguguugggggaagggacacagggugcugucucagaagggagcucugcucugcccuuggugcagagucaacaugacugcagggcuccggggaccaagaugacaucgcguagagaggagggaccuagcccaaggccucugggccacuugagaaaguccgagacagccaggagacaacgcagcccugagugcuaguugauucugguacguggaccauuuuuguuggaauucaucucugagacuccauuuuuuguuuuggcugcccucaguccucuggguagcaggcuggagagaaauggcgugaucucggcucacugcaacuuccccucccagguucaagcaauucuccugccucagccuccggaguggcuggaauuacacgcaugugccaccaugcccagcuaauuuuugcauuuuuaguagaaacaggguuucgccauguuggcccaggcugguuucaaacuccggaccucaggugaucugcccgccuuggccuccuaaagugcuggaauuacaagcgugagccacugcgcccggcugccuccaucucuuugagcuuggucuauagucagcccucagcagacaccagcccauccucucacaaggcguggcuguuuugaucccuaggcauaauggggcucugcccucccccaggaaucagccucauugugccccguuucaagagggcaugcccugucucauggcguggccuggugggugacauccucaggagcacaccuggccucccguggggauggcagccccugguggggccugagaccagcccagucaauggagugacuuggcucaaacugguauggcagagugacuaaaaucuagaggaaacaguuuaguguaaggccaggacaaggucagaauaaggcagaaaguguccuagggccacagaaaagccucuacaaggugcacugccaaagggcagggagggaggguauucugaaguuucgaaaggcaucucaguagcacuguauagucucccuugguaucugucauggagaacuggcuccagaaccuccugugaauaccaaaagccagggauguucaagucccugauauaaaguggcauaguaucugcguaucaccuaugcacaccucuagaguacuuguaauaccuaacacaaugccuacacuugacuugauuugcauggauucaauguaguaccuggugcuuggcaaauucaaguuuuguuuuuggaacuugguggaauuccaccccacccacaaauauuucuaaucugaagcugguugaauccaaagacgcggaacccacggauccagagggcugguggugacaucuuuagauaccaccaugaaggaagggaagcucuacccugaggacuggcggccaucugcaucucugucuugaaaaacaugauucuuucaaaugaaugcggguaaaaauccacucaagugcucuuccugccuuuggggaaucuuuuaaucucugcaaaaaccaaugccugucggcguucacuccuuuaccucuuaccgaucgaugcgucccugcucacagcacagcgucagcgcuggugccuacaaacguuucucaccuacgaguucagguuuuagagcuuggagauaaacaaacaaacaugguuuuggcauaauaacgaaauuauuuucuucuggugauuggaguuuauaaaaacuugugcccacggcugaacggcugagcagcuguggcgcucagcaacuuuggucagccucaaccacagccgagagcugagcagggacuggcagccucauuaccuuuaugcuucugcagggccuucuggguggacugcagcacugacucguggaacugaugugcaaacucuucugccacaaagggcucccacggcuugcucuucccauuggugcugugggacagcggcacaggaauguccuugggugcagcgccccggauauagugaagcaugcucagacucuuuuugccuccaggggccucgcucagccuggccuucuccccgcuggcaggagcuagcuccuggacucucgacagcuccuggggccggaccuguuccagcuucccaggcuccgcggccuuugggaugucagacaaggaagcagcaacaccaaccggcuucuccacauccagagaggcuugcugcguggcugguucuuuuagagacaaagugaaggaaaauauuaagaaaugcaaguuaacaggcugaguguccagcacgcagauccuggucucuagagcuuacacuuaacaaagaccuagcgcaaagaaccaagacccggggaacauuuaaguaaccgccgcgcacauggcuauucucugaagacagugggguguuuaguggcaaguccauccuugaaagaugucccaagaaggaagaagcagauccacaggaagaaggaagucccccagccacggaggcagcauggagguauucaguccaaccggacaagagagugugugaggggccgaggacugggacgcacuguaaagauucccucugacaucugacagggcagaggccagccagaacuguaagaggaggaaagguguggcggcaggugccggcagggcccagagggcagagugaggaagacaaagagcaggaagagagccagggcggcuaggcuaguggcaggaccaggcugcgggcacuaaggcuggagcacgcccucccuccugggaugguaccauuggauuggccuccaugugagccucugugccguaacugaaggacaacgguuacuacgaccauagugaccagcacguagagcuccacagaagccagacccuccccucaacucugagcccgccuucaaacugacguuccgucccaaugacugucacaacugugcaagaaucguacgcugguacaagaauggaagaagacagccugcaggaggccacauucacaaugaugaagaccucgaguggucgccucugagccugggcagcccaugggaugguccugggugguggcagguggggcuauccuucccuuaccacucagggagacggcaggacugucccucggagaguuugucaaggagucggccacugcugcugacagugccuucugcuucauggcacggagcauuucaacaagucucucuuugucuaugagaaaagcagccugagauuaacgagccaguugcaucauuuuuuggagagaaggacagcgggauucuagccgagccuugaggggcaggcaaagcacuaaagcccgaaaaaccaaaagcaggugugauggggcaggcccaguugaaaggaagcaaccaucucaaagcgagcccagauugcucucggcauccacuacacaauguccuagacgugcuccaaagacagcuguccgugcggugacgacgccucugugaaucacugugcccacggaccucgguggugacgugcgaggauguauucuuauuucaagucagacaagguggccccaacacaaagaaacaccccaaagacccaggccuggccucugaggcagggugccuucucccccacuccuaccauuacugccacuuccugaaggggaaagaugaccccacgauguuccacgcagcagaucccugaugucacccggcccuucuugacugugaaacucaagggcugcaucgcccuuaauuuuuuuuccuccaaaaauucagggaaaaagaugcuuuguaucuagggaacugggcuggcaaucaacacgucacuagcccgcuaagagaaagggaaaacuacugacugguuaaaaggagaaaguaaacggcuacacccugaucaacaccuugaagcugcucaagguccaagaaguaacucugcuuuccuucgacuuucucccagagaggaggccaggggcccacgaggacuugaaagcgugcguaaggggcagggccaggaacgucaacaucugggcaccaagccagccugcgcugcaggccaaggaagccaaaacccugagcagguguuguggcugcauuguuucuucugcuauauggauucgagcccagagggucugucccaauguggcccuguguggccagacugaacuggaagcaucuuucaaggcaagccaucugcucagugugugcugcccugcuuggcagcccuuccccaggccuccggccaccaggacacaacacccagcagaccaccuaagcgguccagcaagaggaaaagccugcagcagacaaaccuggaacaccuggcaccuccccucacgccugguggucacuggagcacucggcucaaagagcgccuucucgggcgcugggagauggaugagugacauggguaguccucaggucaagaugguggggcucucagagcaaagccugucagguaaggcugcuauggagggcuuguaagaacagagaggcuguucccgggagccgggaggaguaaaggggcagccucaggcucagugaucgcagauccugccuggaguccaccggccccaccugcugcuucagaaacccacuuccaccccagugagcccccaccuuccuacccaggcgaggcccuaccuuuccucuucucagcgcugaugugggucagguugaagauggucaggaacuucuucuuuucuucgaaguugggacuguuguucaucucaucagggcuguagcggguagacagcgccagucucggugaaggcgucugccgcuugcucugaauuguugggggcgacgggcuucucucucgcagcauccuccgccgcuuccuccgcuucugggccaccaauuccuccuucugcuguuggguggucaagccaaaaaguugcaaaaacucuagcuucuagauugggaaagaaaacaaaugaguuugaagccacuggcagugguaugcuugcacugucccgggguccccuccugggguccucgaagugugggccguagcuggcugcgccuggugggagaagagcuucauggggcgaacccgccaggacuucggaggaaccuagcaacagugggguggacugcaggguguggacgcuaggaacgagagcccagcccagagcauguccguggggaggagagcccaguaccucagaggacguguccaguuugaggggcggcugcucggccacgcaacggaggugggcccugaccuccuccucaucgcucucgucguaagagucaucgaggucguaguaguacccugauggagaaaugguuguauucagccagacaaagagccuucaucuguccaguggacaugcccgcagggccucaugugugcagagcaccuaucaggccaggccugcuggcaccugaacacccugaaggccaguuccuuucaaccgagguggaaaccaacauuaacccaguccuggggcuuugcaggaccgcagacaccaggcuucccugggauccauggcucccaguagcugggugguccccugggcugacaagaccucccuccucccccuggcagggaaccauucaucacacaggccuggggcuguguccacggcaacacagggcugcuugugcacaugcacucccccaugcuguggccaucugaguccaucuccugggaggagacaggcacacacaggccugagcucucuaagacacagagaacaauagcagagccccugcccaggggcgcugggguaucucccuccuccuuuacaaagugaguaggggagagaaauuuggcugggcccuccauccagccuagaccaacaaccaggaagaccgccugugccccagcuucuauugaagaggaggcugagcucagcacuggacaggaccugaguguucagcaucaggaagaaaacugggcuggagccccugcuccccucugcacacucucgccugcucgguugcucuuccuggcucucuggagaacucagggagccgcuggcugaggacgccccacccccaagcagaaauaagaaugaagugccugaccuccuacccugacccggggcagugccagccgccgcguccucaaccccugacccaccugcugcagcucguggcagcggcccuguauguggagcccccgcugagcccaggccggcucuccuguuaugcugcacuauuaauauuuaaaacuaucuuauuagccuccgcucaucacuuauucaucaugcuugucugcggaacuaucuucacaggcgggcuuugauuuggcuuuuugggacaauuugcaucgaggcaggacaggcacggggacuagggucugccuccccuacgagggugucaugcugcuacaaagaagccagugcacuugccaccuggggccugggacuaccccaggcaaaaagcaggaguggacggagaggggcagguggcuggcaugcaggcuccccauccccacugugcggcucucccugagcagcucggggcccgcggggaggcagaccuuucuccugggccucccgccgccugcgcuccuccagguccagcuugcugaccagccuccggcgcugcugcaggaacucaucauagauguaggcagggucgggggcccguggcacugggggccgguagggcgagccaggcuucagggguccgcugagcuccccgaagguggccgccugugggagggaggcccgcugcuggcccaggauggucuggguggacuucucgagcucagccaggaagggcccgggcccgggcaggaagggcuggugcuccaggcucccucccucucgugguggcggcggagguggcugguacuuguccagaggggcaggcucacgcuuccguggccccuccucugcuuucuccgggcagaagacccgcuccaccuucaccagcggcacggcugccuggcggcugggcucaaaugcagccggguggcugugcagagaguggcuuucggcccgccgcgucuccaagguguuguccaucagggacacgggguuccagagggccgugggugcagcauggagcuggggcuugggcgaaaucagaggugguggccccccaaagugcugcggagggucacggccaccuggcucgugacgguuugguccuggccuagggagugaaaccaacccuucagucagggagaaaagacccuucagucauccacaggcuucccuggcugccugccgcuccuaagaugacacagauggcgcagccccuuagagagccagugccaacagggcugcagggaggggacacacacuccaccccaaggaucauuguuucugucuuucauuuucucuuuuccuuucuuuucuuuaaagacucggccgggcgcaguggcucaucccuguaaucccagcacuuugggaggccgaggaggguggaucacaaggucagcaguuugagaccagccuggccaacauggugaaaccccaucucuacuaaaaaauacaaaaauuagccaggcaugguggcgggugccuguaaucccagcuacuccagaggcugaggcaggagaacugcuugaacccaggaggcagacguugcagugagcugagaccgugccauugcacuccagccuaggcgacagagcaagacuccgucucaaaaaaaacaaaaaaaaagacucacucugucacccaggcaggagugcaguggggcaagcucagcucacugcaaccuccgccuaccagguucaagcgcuucuccagcuucagccucccgaguagcugggauuacaggcgugugccaccaugcccagcuacuaauuuuuccuauuuaguagagauaggguuucaccaaguuggccagacugcucucgaauuccugaccucaagugauccaccugccuuggccucccgaagugcugggauuacaggagugagccacugugcccggcccuccaacaccugcggcaggugugugcaggcugcuccaagaggauagggaggcucccagccuaagcugcuagggaaggcagagacccucucaggccugggacagauccaguuucggucgauuuucccaccugcuugcgugaauuccccuaagggcaagcgcucauccgcacuuuccauggggaaacccacucuauauacugggcuguggcccugccaccagcacccucuccuccugcugugccuuguagggacacaugacacagggcaggcuggccaccuucacagggcaguacuccucccuccccacuguccccgcaggcagccacaagacaaccuuccagugucugcccagccagagccaaacccacugugaaaugaagauccucccagucaggauggggccugugccgagacugccccccaguggccccugucacaacugcagcgaccccacugcccaaguggccuguggcagaggccucaaagugucuucaaggacccaggcuaaggccugcugaggcagggagggaaagaagggauuucuaacaucagaacccuuccauuaaacaagaagcugccccuuaguuacacuaaauggcuuguuuccucagugcaauuaaaacaagauuuaaucuacucacagggcuauuuuuaguauuguuuuuccagcuuauuuuuaagagaugggucucgcuguguuacccaggcuggagugcaguggcuauuuacaggagcaaucccacuacugaucagcgcgggaguuuugacaugcuccauuuccgaccugcccugguucaccccuccuuaggcaaccugguggucccccgcucccaggaggucaccauauuugugcuggacuuagcugggacaccuaguggguauaguacacuacagccgagaacucccgggcucaagcgaucaucccaucucagccuccagaguaguugggccuacaggcaugugucacugugccuggcuaucuuucuuuuuuuuaaagggagauauacucacaggaugucuggaccaauacugugcagagacccugggcaaagcuugaggggaagaaagaggcagaggccacagcaggcacacggccgggcucagggaucucuagccugccccgggagcccuguuuaaacacagccaccaaggcucucccuaguuauuccagacuccaggccaagggacaaauccgacgcugcugucccucuuagcagaauacaacagggaaccacaggaagaagcuguguccuuaaguaaacagcaagggaaugaaaccugcaggagaauaaauauuucaugcgccacaccaagcacugaacaguuuucuagcuuggagcaugagggcccugucaggcccccaaguucacaaugcuguaaggccacgugugcagccggccacaggggaaccaccgcagccaggggaggccaggcccugcuucccaucaugccccagguccggauggggcagcuacacuggcuggaagcaguccaugggugggcaaagucacaacaccugugcuggggcccuggggagcccugaggaagaagaugccuacaggagucagggcacccugauguuaucaggccaugccagguaggagcuggcugcccucaguccucuggguaguaggcaaggcugagccugagaggccucagggacgggggcugggagaggcagaagggaucucacuucggccgugccgggcagugugagccacagggagacuuagcuguggccuggugacagucacucccagucaucccugaucagcgggggcgcauucccucgcugcccuacuggauaacggaggcaggcagaagggaggacagauuuuaaaccaccaacacgcuuccgucccagagcccaaggguuucuuaucccaggacagcaucacagccuugagagcuggaaagaugcucagaaaucauccuacccacccuccuuuguggacaguugaggaaagugaggcucagggaacagaaucagugucccuaggucccugagcugggccuggagcagagcuauggaaggcuggcaggucauucccaccaacucuggcugaggaucuuagcucagcccuucagagugagcccuggggguauaugacgugggggccugggaccagcacagccccaaggcaggaaucccagggcaggcaggggcagggaggacugggggcacuggggcccagcucauaagaccugugucugcagccgggguccaagggaccaccacacaguuuccugggaaaugcuuucauaaagggcuagaaaacgggcauguguuuuuacuauuaauacaaaagcaauaaaacucauuuuuuuccuuaaaaucaaaagcuguccccuucuuguuaaaaaaagaaguccaggcucaaaagcagaggaagauggagagaacagguauuauuaguaauuaaagcuucuaccuugcacucuucaucugcugugaauggccuccugggaacuaggucaggcugcgugugcagugcccuggcucucaacauggacuugauuggucucuuuacuuacugguggggauaccuuugagcaauccauuuucuuccucagucucagcuuccccauaggcaagacaggcauuauaacgugaagaugaaagaacagaaaugaaagaggcaggcagaaacgcuggggcaggauguugggcaaacaggaggugcucaauacacgcugaacaaaucggaacgugaaggcucaucccuccuuccuuccuggggcucacucaccugguggugcucuccggccugugcucugccuccgccggcaccgggggccggcccauauccaggugcugcuccagcaccugcugccggaacucggacaccugagacugccgguccuccuucuccugccgcagccgccgcugccgcgccagccacuucuccuccucauuggugcgcuggaucagcagggcuguggcagcacugcugcuaggcagagagaagaugccaugguuggagaugaggcugggcaccgugugguguggggugggcaccggaugcaagggguguuggacgggcuugggcgccugcaggccggcauccuucagcuucucuguggggggaaacacggucaagcaggaucucagccacgugggccagcaugcucccuccccguccucucucacccaacugcccagagaaaccagagcccuuccaaaggguucuucccgcagccagaaccaagauauucagaaggggcccuacgggagcuuucaagaagcaugucuugucccuggaaggaaacgcuccguggcuggcuggcaaaacucuugcccagccagugcggugccagagccagcucaugcuggcucaaagagcagacuauuaaauuuccgggaaacaugcaaaagcugguuguuauuacuggacaauuguuucguaaacuuacagagaaauaaaaucaacgaagcacucaaaacaucccuuccuaaugccccggcuacauuucacaacuguccuccuggggucagcuauauccacugugucuacaucgugugccaacgugccucugcucccuacuccauguucagccacaccacgcuuuuagggcgaacucagcuggggaacauuuacaccacggcaaccggcaggugcugcgauucagggcuccuccccgcggguggcugagaccuugcccagcacagcccacccacgcccagguaccugcucggguuggggucagcugcuccgagggcuugccccgcuccucaguggcauggccacgcagcccaugcagcucggccacgggcaggaagcugggcuccagggccuuggcggccagcagcuccuucucccgggcccgcugcucccgcuggcgcuccagcucgcgcucgcgcuccuucucacgcucacgcuccuucucuugcucgcgcuccuucucgcguucgcgcucacguuccuucucccgcucgcggucagccucacgcucacgcucgcgcucgcgcucgcgcucccucucccgccuuagcuccucguccaucugcagccugcagcacauggaaagaguugggggcucugcugcaccaggaacaagagacggaccuggggcaggcccuuaaaaagcauaaccaggaacgagccagggcgcuaaucugaacagugacgggaggugagccggguuucacuggugcaggaagaacuuaagguccauacaaucaaagcggcuuacaaaaugcccaagcacgcccgagagcuccucggccugcagguuuacugcaggagaccacggcuaccgagacaggcgcuauuucagagcagagccugaacgaucauugucccauuuggcagguggacaaacugugaggacaggcauggccaaggaguccagucagguuccagcccaggcuuucugcccagcugccaucaagggacagggagggcagaggggcuccucggcucgagacgcacuuaccucuccgcgcugaggccagacaugcgcuccgagugcagcgcugccagggaugagugggagagcucgggaggguagcggaccccagagaggugcaggugcaucgcugaugggugcagugggggcagggagccggggguggggaugggguagaacggggaccucagggcagacaggcaguaggagucguccauccugugcagagaagacggggcugugagcagcaaaugaaccaaggggaagacccagcccugucgacaggugugucucagccagguacacacaccugccugagcguggggaacgugacaaaauggcuggggaugaagaccaugccugcugcuagccccaaagccccuugaugccggaggcugcuaggugccgacagcuugggguuccagggcgccgccugccaccucccucggcucagccagaccagcacagaguggucaagcgcccaggcccuuccaaggcuggcgagcaggcugggcugcccugacguggggugguccaugacaugacuacaggccccucugaccucugacaaggaugggcagagcuucuccacggacccaggccagaccacagugccaccgaggucuccugcuacacagcaaagcaucgccucucccacgggcaaagcccugcucucuuaacagugacuugcugucaauggaccccccggugagaaggggaggagccaaggaugacaguacagucaccaagggggacugucuaccaggaggggaccccuaaugggccaucagggcugaauuuaggcucaaagcuggggacgauuucaggggcuacucuagacccuccccuaggagccuggcucucaggucauaagaaacaccuuccccgccagguuccaucuugccaggaacaggccagcaccuagacgagagggcgcgugggggaugccucaccugaaggccgggugggggaagggguguggggccagguagcuggggugguaguaggcugcagcaguggccggguccaggccgaggggaggcagugaggacaugcggaggucgucgguggugugguagggccggaagcuucucagguaguccucggucacgguacuggggggcaccacguggugcacgggccgcuggaggcugcaggcggggauagugggcaagguggggacaggugagugcacaccugcuccugcauggggggacggcuaaacucccugcaucaccccuggcgcucagucggcacccagacuccuggcaccccgaacgaggacggggcuuaagcagcggggggagcgagcugccacugccaccucagugugaaggggcacagacagggcugcaauccccagggcucagcggccgacaaccaucuagcaggcacagccucaucugugcagaccgcaggcugccuggggacccagacccugagcacuguguccccaccuggccaccucaccgaaguccccgccgaccaacuuacuugaguggcgggaagcgggaauccugcacaacugagcugggggagaggccgaagggguagggggugcugagcaggugcgaggggauggcuggucccccugccuucuccugagggagcgggggcuccacaaugaggcguucccgaccuccacugcugcuccuggagccggcauccugcgggaggagagcguccagucagggcaggagccugguauaggccacugaccacaggacacagccaggucuccugacucacgggaaggcgcuagauuuaguucauguucuagaaacauccuuucccuaaggcuuucuacgcaaaacauggugcauguggugugggaagcagaaccguaagaaaggggauguggcugcgacaggucuggggugaagugcgucucgggauccgucucccucccugggccuccucaguccagcaaaagaacuagaaccccccagaaacacaaugugugcaggugaaggaugcaggguggcaggggcuccugccuccaccccuccugguguggacauccgaaggucacaccagacacacacccggggaagcagacaccguuggcacccagcacgccgugaagcgagugccacgauguagccaagacgucaacugcgccgacagcugcccaccuggccgcagauguccuggcccuggugcccacguggagggcaggggcaaaggaagcuggcacugccccugggccgaaggugcuggucugcccccaaccaccuccugggguggcccuggcccuggagcccaccagaacaggcagcagcugggcccugacuggccagcugggguaccggccuucacacacacgguggggcagggaaggcaacagcucgccugucccaggcuccuggacacaguggaccuggguguagcugggaaggugguccagaggacucagaugaggggucuucuccaggcacaaagcaggaggaggcaguggcccaaagcccaccuuccgggcugaggucccugccaaguucaaggauaggccgugccaccccuagccacgcagaggcugccccgcacacacgcaggguccagcccggagaaaccagagcaugaaaaggccuugcuuguuccuguuauucgugugacuaagugggaggaggaggaggaggggguaggaggaggaggaggggguaggaggaggaggaggaggaggaggggguaggaggaggaggaggaggaggggggaggaggaggaggagggggaggggggaggaggggggaggaggggggcggagggagccucagggcggcccagaugggggcugugcucuggacucuggauggcugccaacccaggcgucacucugucacuggggcagccguucucagccccagcaucuuccccauguggggacagcacugcccaggccuacccugaccugggggugucugagagccauggccacgcuggccccucugagcuucccagggaugcagagccacgggaacccggcccuuccucacguuccaucuggccaugucagguaacgacugcugaucagcgggcagugcuccugaagagcaccagccccgcucugccucccugagccacgaaaugccaaacacccaaaaaacaaggaggccauggccgucuccccacaagaucagcaggaaugauggcccaggggcucugagaccugccccaccguggagaagcaucugucucccaggggccgugccugugucccugacccgccagccccucuuccugggcccauccaucuucauagcggcagacggugacccggcagcagcacauggcacccgcgcagaggcagugcaggcagcccgggccggcgccuccccucucuccacccuccaggagacagucagcgaggauuaacuggaggagccgccgccgccgccgccgccuggaaucuucaaugagaggcagcaucugcucccuucccgcgggcugagccccggccccccuucucuguaggguccuccuggguucacgacuucugaccugccucuccagggugcuggucucgagggugggagguacacaugggcacugacgcccugcguggggccgggaacuuccuauugaggagccagcgccuggccuuggggucuccagccggugucagcaaccgggguagugggggaguggccgaggggccaaccugaccuugggagaccuggccauccugucgugccucgugcacacaucaauggcaugugcccgucacggcaccugcucagaggacagcagaguugauggcacggcuaugaacgggcaugcgggggacucacagggcagcagaguugauggcacagcugugcacgggcaugugggggacgcaccagcagggugggggcccggacauggcagguguguugccaggcuggccugccuaccccagccccgugaggcuauuuccaggcugggcuucuagauccugccucacgccccuacccugccuggcauagggccaaacaucugaggaacggagcacgaggaaggacacacccuguuccuagggucugggauggacuuaacaagacggaguggccccuggccccccagcauccaaguagcaccccaaugaacaccaggccuaaagcuagugggucucuggaugcccagaacaggggccucgccugcucaggcacccgggguaccuggacucccccucccaggcugguggggaggccuccagggcaggagggagacgacagccaggggcuucaaucaucacccagccuuggguggccagagucagaagagggcuggaggacagaccucgaccugaggacagcacccagggucaaacuaccaacagcccaggccugccgcccuccuccgcaugcugcccgcgccgugggccgggucaaacggcaaagcacagggccccagccgccccgccacaaggaggggccuguccccagcccagacacggcccuugaaccccuucuccccucagccgaggacaaagcccugcucgcaggccagauggcaccuuccuggccuggcugaggacaaacagggaguccggggggcuggggggcagccagcaggcggggcaggggcccggcgagccagacccacaugucuguggcuuccgucuggcuggcgcccggccaacccuggcacagacaccugggaacuaggucagcggggccuggagugaggcacagggcugccccccauccaggcaaggcccggcaggcucggcagcuaccccaaaggcaccccgauagcggcagccggggucucacugccgucuccacagacagacgcaucagggcgcaucugugggcagcuuuucauuucugagcagcggcugcagccgcagcugcaacgaugaaagaaagaaggcggagggggagggggaggaggggcggagggggagggggaggaggggcggagggggagggggaggagcaaauccgucauucuccggugauuagagcaaggguuccauagucagacaggcgggacaugcccuguuagcuuuaaaacaggcuuuuucaucucauuucuccucucgcagcucccacuacaccugggagagaggggugaccccgagaaggggccgagaagccuccggcccggcaacugccacccacguccgcagccucggagacucauggccacagcuuugggccgggugggaggggaauccucucucugccuccccacuccgagaggauuaaaugccccgcugagccucugugcccgagcgaggagccguacaucaccugcuaauccagcugccggccccgcgccuucccuggcggcaccguguuccauuaagcgccgcggugguacacugcuggggcgggccugucgcgccccugcucugcucugggguagcucaauguucccgaggcgguaaggacccuccgaggagggaccagcucagagcggaggagucgccggaaaaggcgcuggaauccccucgaggcguccugggucuaggccaggagcucuggucggggucaaggcaguggcugggugcaggguccuggcugguagaagcuccugguccaggcuggggcagggaaguggccucccaugagcugcgggcgcuggcaccagcagccaggccccaccaguggggcgcaaggagccucagcuguuugagucgggugauucagggcccauggggucaaggcuggcccuggggggcggccucuggaggcagcggagcugguaacaacucccucagccucccucaaaccaggacgagggccgccuugggcugcuccaagcccugugggguguggaggccccuguggccaggguccacccuccaggccacgcccugccccucggucuccagaccucacaugaggauuagucaaacuacgagaggcuucaggggcagaggagguccagcaaggugaggacccugggcagguuuguccccucagccagggaaggcgugaaaggaagcagaggcaacgucaggccccgggggucccaguccggagcucccagggauucccacugggacccuggaucagggccugcccgggggcugucaccuguggacugaggcuggcucccuucccacaccucuggggauagagggcagacaggcccugaugaugagcagguggcuccaauacccauguccuccccugggggagagggagcuucaggcaagagugacucuccccuccuccccaccuucuuugugguuuaauuaguauuuccaaguggggcugucccucugggaacucagcagaaaaguccaggugacagcagccccugagaaucgcucuuaauuaggaagggcccacuccaggcugcgcgccagggguggggggccgggagagcugcagguacccaccugagggcgcacaggccccaggcagcggcagaagagcagcucccagugccagcuccuuccacacaggcaggccccagucagugcagagcgaggggcccacagacauaaggagccccgaaaacuuggggaggggccuccgcugggagccccaaaaguaagacagaaacacaaaacccaccagaugucuuguucugauagcgucugggcugggaucuuuccuaccucaauucuuuguucaguucacagacuaugacagucacagcuagugugccgggugcucagcgugcaaacaccacuuucacagcuugaacuggacugccacccccgcccaaauccguguuagagcccugaugcccagggccucagaacggaacugcauuuggagacacggucuuuaaagaggugaccgaaugagaauaaggacauuagggugggcgcuaaaccagcugacugguguccuuaugagaagaggagaucaggacccagacauggagacaccacagacgacccagggagaaggcagccaccggcaacccaggagaggccucuggggaaaccagcccugccggcccccggauugugaacuuguggccuccagaacaggagaaaauaacgggacacccccagcgggugguuucuucugacagacugaugcgugggccgauguacucacccgcacagggccuccaggagggugccgcugucacccucacguugcagagaaggagacggaaacucagggugggggagggggugucuggaauguaaacucaaccucgaaagcuccagagcccccaauggaugccugaauccagccuccccacuuagaggacgcuaggcucccugccccgccccacucaccugccggcucucacuccuccagacaccauucacgguuuugguuggagcgauggucaccacggggggggugcugggcacgcuguggcccccaggggggacgaugauagggcccaugggcacgcgcuugggugugcuggcgggggagcugugguugguggccggagaggacacgggggacgacucgcugcucagugaggacccuguggaggagaagacgguggccugagugggagccgcagugacagccacgugcagugccagcuggggaccugggcuccagcugccccccugcuccaagugaggccccagaccuccaggucuaccagccucaugggcccccacccaagacaggcaggcaggagacaccucuccugaggcccgaucgggucagcagcucagucuaccccgggcacucccuaucccuuugccccacgggcccugcucacguggcacaaagcacagaugcucuggugcccagggccgcccaccgccaccagacaggaggagccugggcagggcgggcaggaccagugccugacgucccugagugagagacgaagguagcaccuuccgggacagacauggagccccagaguuagagaacacacguguuucuaggaggugucaugaaccaagggccuguggacaucccaggacacacaggccagcugggccacacacccugccccaccgagaggcagcuccacguguaagcagcagagaccccaagccucugagucuucccggggagcccccaugugcuuggggggucacaggaaaaggcgcccccuccgggggcucccaucaagcagggcagacauggggcugcagugcagcagggaacaaacacaagaagcggucagcacuggccgggcgcgguggcucccgccuguaaucccagcacuuugggaggccgaggcagacagaucacgaggucaggaguucgagaccauccuggccaacauggugaaacccugucucuacuaaaaauacaaauauuagccgggcgugauggcgcgcgccuguagucccagcuacucgggaggcggaggcaggagaaucgcuugaacccgggaggcggagguucuggugagcagagaucgugcugccgcacuccagccuggcgacagagcgagacuucgucucaaaacaaaaaaagaaguggucagcaccccucuacggggcccagccaagcagggaugcagugcggugguggcugaggaagcccaaauggcagccauucagggugacccacggugacccugggggaguuucuuuaaaagauccauuuauuuuuaaauuucagaaaaugagauauaauucaccaucuuuaaggguacacaucaggagguuugccuagguucgcuguuuacaaccaccaccacgaccuaccccggaacucgcccgucgccucagaaagaaccccucagcccccaaaacgcagcagggaugggagaauggguggcugcagccccgcggguagcagggggagggugcagggcaggcaggagggcuuugggccugggugacugguggcuacagccaagaggauaccccaaggacagggggcauggacgggcagggccgccccggcccaucugcaggugcggcagggguuuggaccggggaggacggggaggaguguucccaggcccuaagggaaggggcuuccuccuucauggagcaaaacugccuucucagaccagggcuccccucuguugucucccucccgcccaggucagaaggggaccaagugugugugguggcagggguaggggguguccaaaggcaccugcugcaagaguccuccuguccccaaccaggcaccagccucgcuuccggagcccccacccccccccuuguuguggggaucaagcccccgugaccgagaccagagcagcuccccagaggcuggggcugccagugaggccugggccugggguuccagaagcucugcugccugggggucaagagcccugcccagccugacgaagcccagggggugcacggcugcacacucacacccccgacuccggcuggccugcagccugcagcggggagaccucgugccgcucacacgguuguggacuuguacacagcucaguguccggcucacccuccccaagcccccuucccugacacaggcccagggcagaucuccgcccccaagaggcacacacagcacccaacugguguccagcacaggccaagguccccaacaaggcaggccgcagagguggcccuggauucuaugauaucacagcaguguccacugggggcagguuccagcaggagcaggcacauguccacccaccagcagcaccgugcguucaggcacccagaccccgugucacagcagcugugcaagcuugcacuugggcccacggggacagaugcugccaucugaggaggugugguacaauugggcaccuucuguuugcaaaagccccacuugggaggcaccuacagcccggggcaugguagaagcaaguagaaugcgugguagaagcagguagaaugcgugguagaagcagguagaaugcaugcauaggaagcgugguagaagcagguagaaugcaugcauaggaagcgugguagaagcagguagaaugcaugcauaggaagcgugguagaagcagguagaaugcaugcauaggaagcgugguagaagcagguagaaugcaugcauaggaagcgugguagaagcagguagaaugcaugcauagaaagcgugggagaagcagguagaaugcaugcauaggaagcgugguagaagcagguagaaugcgugguagaagcagguagaaugcgugguagaagcaggcagaaugcaugcauagaaagcaugguagaagcaugguagaaugcaugcauaggaagcaugguagaagcagguagaaugcaugcauaggaagcgugguagaagcagguagaaugcgugguagaagcagguagaugcccuuuccagaaggaggaccccagcccaucagcucccggcauccugcccgacuucuguucagaccuggccuugguuccgggggcagaagcagccucaucuccccuucacuguguccggagugggcacgcgcacauucaccaaagaaaacugcugcucacagggggugcccagaggccucaggcagccaaaguggccuuaguggcgugaccaggaggcagaggccccacaggcaucccgauguggaaacagaacuuugcucucccaaaggugcucccuugggguggggcagcugcccugucccgagggcaaguccguugcuuccugcagaacgguaucugggccucuuuaaugugguuuccugggcuugugugcaaccugcacaacuggauagggcagcuccacaacagacacuccgucuagccagaucggccacgccccagagcggcccagaggcacguucacauucuccccagcaacccccgaacugcccaaggcaaggcccccaccucaucacgcucccacccaccaggaucuggcccagguggggaaugaggcugagggcugcugccccugaggcgugacccaaccccagacccccagauggacuagccaaccacugcccacacccugagaacuccaccaccccaagucgaccgggccaacaccugggacugggcacugugccggcgggcuacuagauccaccugaggaggggaaacgcuggcugcagggcggggcaccacgccccucaccucaggggcagaggguggggacaggagaacaggccucagcccuccugaucuguggguucguucuggacacuggcagucuaggcgcuuuucuguauguauuuagauuuugagaaaaaguucacuuuaaguuuuuggggaaaaaaaauaaaaacuagggaaaggaucguuguuuaaaaaaaaaaauuccauggaaccuccauggcucuuggguuucaguuguuauagcuucaccgagcuaugauuccaucccgcguaauucacccacccagcgcgcggccccacgguucuagcacguccagaguugugcgaccaucaccacaauccauuucagagcauuuccgucaccccaaaaggaacccccuacccaugagcaaccacucccgucuccccaggccccgcacgcauuggcucuccgucucuaaagaagggccuguuccggagacuucacaucaagggaaucccaccgcguggcccuucucgccuggcuccucucacugggagccgugucuucacgguucauccacauugcagcaccuaagagaaucucuccuucccgcggcuaagugacaguccacugugugccucuguccacccacuccuuacugguccgucccucagcugguggcauacaggcugggcccaccuuguggccgcugucaacaguacugugcccaacacucuuuuuuuuuuuuuuuuugagacaggaucucacucugcugcccaggcugggcuggagugcaguggugcaaucacagcucacugcagccucaaccuccuggguucaagugauccucccaccucagccuccugaggagccgggacuaaaggcacgugccaccaggcccggcuaguuuuuuguuuguuuguuuguuuuugguagagacagggucucgcuguggugcccaggauggucucaaacuccugggcucaagcgauccucccgccucaguugcccacagugcugggauuacaggcaugaguaacggugccugccccaccacccuacuucauggaaagcccuccugugcacccggcccaaacccaggguguucccaucuagauuccaguagcugugaguaggggaaauguggacauuugugcuguggagccgaaaaaggaaauaaaaccaacacaccgagagccgccaccccacccaggcagaggcugccaagagcucaugauccgggcuccugcugcccaggggaaaaguuggggccaauggccaggugggcuguggguccucccuggggaccggacaguggggagcugggagcaggagcuuccgagccccaccacgugccaagccccaggaaccucagagacuucucuguaccccaacucuacaaauggggagaaccuuauagcccaugccauaaggggaugcacagagaccuggagcugccuggcuccagaccccaugcugccccaucccucugaaccccaccucccagagagaccccuugccaugaccaaggcagcugccacuccagagucucugaaugagccucguuucuaagcaccagugggugaggaagaaagaggcgcgggugaggaaguaagaggggugggugaaggguggggagcuucucuggggcagggcaggccauugacacucagcggccuaauccccgcuggcgggugcuacucaucagaccagccagcucagccucgaucgaugcccccacaacgccaggcccauuagcgaggcuggcaccuggcccucgaacccucauucucaccgcguggcuggagcaggaaggucugugauugcuguaauuaacuggcgguauucagccaggaguuaagucaaugaaacggaucuggauuggagaugacaagaggcagcccguguccgcgucaccucugcugucugaccucgaagauuagcgcugaggcccacgggcagauguaauuaacagcugacaccccaaagucagcgagggaguguauugagggcaaaaacaggaccgcagcgccacagcagcaccugucagccacccaggcucaggcccaccccgccaggcaaaaaccaccggcacccccugaagagucaucggucuuuaagaggcgcuugggggccacgccacaggaccacucuccagcgcacuguagaccgaggcgggcguggccucaccguggucaggccccaaagccacaggcccugaccaggccagcagcgagcauggaaggaaaggggagggcagggcacccggagagguaaagacuccccagccgagcucggcucaggcauucccccagccgcuguucugcacggccccgacccaccccagggcccggccccgcugcaacugcucaggggaacgguggagagaacagaacgguaacuaccggacgugcuucccuaaagagggucccuggaacgucuuugugagaugccauggccgggggcugcccagagcuuagcagggccagagcccuaggggacggcuccgguguccacagcccaugccuagcccaugcugccgauggagacacaggugaggggcagcuugaacagaugggugagcgacagaccccugucucagccccuuggaaggaggguccccaggugcacuuugcccccugcuuucaaccaugcaggggcaggugccggccagggugggaacccaggggacccugugugucugcuaaccugggggcucuuccugucaucaguucuguccccaaguuaguguuuaaaauuuucuuuuuaauuacaaaauauuuuuagagacagggucucucucugucacccaggcuggagugcagcagugugaucaugccucacugcagccucaaccuccagggcucaagugauccucccaccucagccuccgagcagcugggacuauaggcaugcagcaucaugcucagcucccagcucaaccuugaaaagcucugggcagaguccacucagcaggagacucagugugccacgugccaugacucuggagcagacccaccaacggcgaugccagcugggcccucagccgguguaggcuggaacagcuggagggagggcggggcagguccacagagccugugucugccagggcugcuccuccacuuucuacuuucgccuaccgaccuguuuccacccaaaaccugggaacccagcccugggcggacuuguggcgacauggauguggaaaggagcccggccagaggagguccagccccuuggccuaggaggcccacgggagccacaggaagccgccagccagugaguagggaagugggacaggagcugagucaccccagccacuuuccuugaaaucugcccaguggaacgggaauagcagaccccagaggaaagagccaaucagccccccacccacugggaauggugcgggucuggaaggugaaguccccaucgcacaagugacaagaacaggcugggaaaccuucuggagucaccgcagcccugguacacgggacagcaggcacaccacagcgcaaggcugaagucacgccgcgacccccugcguuccagggagaagcaggagaccaaguagcagcagccgcccuacaaggcucccagggcagggcucucccgacccgcggccugcguccaccaacgaggcuccaccucacagcugcaaaagggcgggggggggcgucagccaguggcgggcucccaugcccacccugccaucacgugccacagucaucaaacccaaacugacagcgggaggugcggguuucuagcuggagaugcguuuugccgggggcggauuaugugcugaacagcgugagcuuagaugcuggacccugggagccggauggagccgggagaguccgcgugggaccaaaggagcugagacagguacccugagggaggugggacguuaggacgaggaagaagaaacgggcacaggggcugcagggaggcacagggugcaucagggaaaaccggaaaaaaaucacccuuauguccacguggcuaggggaggccuugccuccauuaucccaggacaggcccccaaaggcugacacgccaaguacugggcuccuccacccugcccagggcuccccacugugcuaugcggagaaggggucgggauagguggugggguccucuccgugggccuugcuccccuuuggcucuggcuuccccugaccaccagcccucuggcccccgggccaggagaacggagaggcaccaugaggacgcccgcggcgcucacaccugcgcgggagacagacgggcuccagacgccugcagagccgccgccgccgcagacugacacccacgcgaggcgcgccugccaggcgggauccuuccuccguguuuguuuugcuguuuucuuugagaggcagauuuccgaggcagcggcagaaagggggagccucucccccgcccaggccggcuccacgguggaagcauucccacggcagcucaugaggaugggucuguggucccugcuccgugguccccgcacacguaguccccacucacucagcugggaucucgguuucagguggcaccagggacaggacaguaaccggaucugccuccccucuugccugcaaagccagugacaagacgaggcaggcagccagcagacaccaccaggggaaggcggcacagggccccgcgggccucgaugacaagagagcaguuccagccccacugccaccaccugucggccccgucccuguggcccaagccgggcuauggguggcugggccaccccugccgcagguaacacagcggccaacaccugcuuggagaggccucuggcagcuuccagggcagguaccaugagcccccggccgguguuaagggagcgaagugugggcagggaagccaugagucccggccaccgggcuggugacaaggaggcggggugggaacgggcucagacucuugugcgcccaaccccagcucccugcaccauggguggugcuggggugagguggggcuuccucgccagccaggagcaccugcucagaacuguccuccagacggcggcucuccagcccaccugggaaggcucuggagccacccuguucccaaagcgccggccucccagagcaaaggcccgcagcacgaucgcccccaacuguuucccagggagggggugccuggucccaggugcugccugugccuccuggagcagcugaggacacgcaaggcuccccguaccuccgcccccggccgccuuggcagacgggcgcugcgucccugcgggaggcugccgccugcugcacacggcaagcagaugccacacagcuugcgagggugccuggcagcagcccuggcuucgucacacagcagugggggcggcgguggaggcuccacggccugcccucugcagagacacugggcaggcccgacagcugucacaccccagccuggcucagggcugccuucaggguguggagcuggggagcuggaagcacagggccuggcuccacgcacaggcguucccggggcacccucggggcaaacaccucuuauucagucagucaacaagcaccuccaaggacaagggaugauggggggaucccgacacacccgcaaggcaggcuaggccuggcgcccaggaggcuuagaggggagucagaaucuguccagcgcagggggugggacacagggcugggacccauccccccagucuugggacuccuaggcugagguuucagaugccuaugggggugguugggugucugugcagaagagguccugguaggagaggcagggagggaggcgguggccaggccgccauuccgaggaggggacaggucccugcuuguacccaaggacccggugccacccgaggagucugggcuacagcgggagcuggcccagcugcgucgaagggagggcugggcggccccggggacgucccuuugguggcugggacaaugugggaggaacaaagagaccaauagccaccagggcagaacagggucagggacgccucggcucagacugcagcccaggccggucgcugggaaggggcugggggugcaacccaggaucaacucaggaucacgcccaaaccugcagccuccuucuagaauguucugcguggggcccgggcacuccaagccccauuucucccagaaagucaagaccaacaggcagccacuuggcccugccugcacccugcaccacugggacagaggaagccaccgcaggcucccggcccagagccauugacggggggaagccauggcggacccacaccuuccaaccccaccggggaagcacacgcccucccagggcagaugaugggggucacagggguaggacggggagucaggggaagggguggcaguggguggagggguaggggaggcacguaggagguggggguggcaagaauggggaaggugaaaggaggcagcauuaggguggggggcagggaaggggaggcgggggugggagccaggguggaggccugcugcauugacacucaugccaccauucccggcuguggcacauucccacccaguccccacgauucaugagguagagaccugcuccucacccaagaaaaaguggaagcucagagaggcaaagcggccugcccggaucacacagcaaggaaggaaagugcuggggcaugcaucggcgauucgcaagcgucugcccuugcccaaagcgccccagccucggcagugaguaggugaguagguuaaagggucaggcuggcccuggggaagggugucuggcccgcgcuggugggcgggugacugagcuuugaagaagagaagacgucucagcgccuccagaaaaauaaaucccagcgagggccuccucuuccucuccuucccagccuuucucccagggcagcgcaugccacagcuucgucugaauugaauuuuuaaacuacacccuugagacacaaugagaggagagacgcggaggcaaucgcagucagauggcgaaaaccgagaggcacuuccagaagucgucaggcgugcacuggagaggagggucagggugagugagaaggcuugccgcaggcggcuggggcccagggcacccagaggaggggccgcguggggcagcacagccucugcuguucccugggugcgccagcucugccaccucuccugccaccucccccugcagcucugggagcugcccugcuuccaucccugcccccucugcccaggacgugccgucgccaggaggcagcccuggcugcgggccgcugagcuggccagcucagccgcuagcccgcuggggcuuggugcucucuugggcaccuggcaggcaccagagggaccccacuccccggcagguguggcuuucacagaggcccggucucccuuucugcagggaggaggcuacaccugcggggcaggggucuauggagucucaggcacaagcuggggauuggaauuccccaugccacuuacaacgugggacccgggcaagccggaggcucaguucucauccaccagaggcgaagggugugugagaagcacagcgagcccgccaggggcacagcaggcgcucgauacacagccacugccgcgaucaaggggggacucaauacauagccacugccgcgaucaaggggggacucgauacauagccacugcugcaaucaagggggcacagccacugccaugaugaagguggggaggcccucacugguccaacuccaggacggagcagaaaggcagcugcggguucguggccccacccagcucccccgacccgggucguccagccacgagaagcaggaagggcugucacgccgcagauggcccacaaggaccaggagaugucacgcucaggguccagacacgcaccgcgccagcccauguguacaaaaugcccacagguacaucuacagaggcagaaagcagacagcggccgccgggggcugggggagggcgugggagcugacggcaaaugcaaccgagguucucuuaggggugacccaaauguucuagaauuagauggucacacaacuguguaggaaaaucaccaaaucaugcgcuucuacagggugaauuuuauggcaugugaauuguaacuaaaaaaauuuuaaauaagaaaugcaaaccccucccacugccaaguccgccaaagguucccccugcugcccucuggcgcagauggggagguagcaccagggagcuggggggguagcacaggggagcugggggguccacauguccccacugucauccaggacuccacaacccacagggaggcagggucagcgugcugacagccaggcauagacccuuuugugcgcccaacgccagcucccugcuccacuggcaguggugcuaggggugaggggggcuuccuuuccagcagggaccgccgggaccaccagcucagaacuguccuaacggcggcucucccagcccccccccgggaaggcccagcagcagugggacacggacacgaccccacccgcuguggcugccgucuugcgacuuguccucucugaacuuuggccuucucagcugcccgagggucccgggagggcugccggccaguuccauggacggggaaacgugaggucaggguccgggugacuccaugagaauggggaccaggugcacugaguggcugaggucacgaggaacgagucacccagucccuccccauccagaccaaggccugacaggggugaccagcuggagauucaucaaaacgggugggggcgacgagggcccaggccuggcugagggcguuccaggacccaaacacugcuccacauccgcagacuccgagccccacaaaccuuggcauucccagcucaauagggggugaggugggugagugaaccgaugggcacauggcucaggcaguggcacugcucgcccgcucucccgacccucugccauucaguucccaggcauccaccccgggggcaucuuuccuggggggcauccaccaugggggacccuucccagugcccagguugcagcugggagggagcagggccacgaggccauggugucuggccucccgccaggggcgcccagcggcacuuuguuccuggccaguggggaccagcggccucuggcacucaggccacccgcuggccgagccaccaaaccaagugcuggggccagcagcauggggcagcggagaggaagcgacggcccugugagcaggcuccugcugugacgcccacggccgcugcugggcccagggagggaaggcgagucugaacaccucucuaccaccuuccuuggcgaggagggaaaccugcccuuuccugaccacguccucugcagcguuacccagggguggagcccagaggccccaaagcagacacagcugcuggaugaaagcaggaugcaaggauaacccagcccagguagcaccagcgccagucacgugccgcccguggccucggaaaucccucaccagcccugguucuccugcccccaaacgcugagaaaaaaagacaacugcagcagcaggagcugggccagcucugaccucgcuucucuccaccccucucaggagagcccgagucucgacuccaagcucagcuuccucccagggucuguccccagcugccuuguucaccgccccagagaguccaggaugccuccaccaggcaggcagucugcuucccccugagccaucuugccugcagcuguccggccucuugacacagguggggcccaugcaaccuggcccgcucagguguggccagggaguccccugccaagggcguggaggguuuucuggcgguccugccugugccugguuugccaggaagagccaggaggcgaggggcugcccccuggugguacggaaaccagaccccaacgggccucccuccugggccaauaccccccauccaucaaugucagguguguccucucacacuccccccauucuccaacgagcagcagcagaaaggauccaggaaggagacauucagaaaugagaaguccccccagcccgcccuggucagggcagguguccccucugccaagcuggaacccggguaauguaaagacggacauggcuccugcauguguugcuguggccaccccggagggcccuggcacccggaucuuaacccgugggccuuggaggugaaugaagcggaugccacuggggucccgguuuccucagcccccccgccugucagcagcgaguccaaaggguguccgaggccagaauccacauggccaaggcccccagcagcuccagccgcccacugccccuccccauuugugccagcagcagccccugccaauggucaucgcaggcgccaaaaaguaccccagagccagagccaaagggggcgucuuuagagccucacugcacagacaggaaaaaugaggcucagaggaucagcaacgugcccagguucacacagcagguccugcccaggugauaccagaagccaaggcuccagaccccgggggccgcuugucuaugcuccccacagucucugccucagggaguugagcagugguggguucagcugugccagagacccccgcuccagaccacuguguuuccagggacaccauguucucugccacuucuggagggagugucaaaaccugggcaaggagccacuuggggagcacuggggcccagcucucccucugcagccucuuggggcuccccugguccagggcacccacccuccucccaaucaagucacagagcugguaggagcaccucgcuacauccggacaccccugcaguggcuccgggggccgaggaaggacagaggcaggagagacagaagcacagaggcaaagcggaggugcuggggcaggcggacuggcccagggucuguagcucagccagcacugccugcuccaugcagagcacacggcgugggaaagacgagaccugcugugagcgugcacgccgcaggcgggaggcugagucccggccucgggagccgccgcuccccccacgcgcagccuggcgggcccccuuaccucugggcuccuccgccuguuuggcgagcuugcgcagcgcggcggcaaagcuggaggauggcgcggccugggccgacagcgcgcugcugguggcggggcugccgcugggcaccagggcgccauugagcggcgagggggugaggggguugacgguggcggugguccuggucgcgguggaaagcaucccuagcgaaggggacuugggcucauggcucaugccugaaacaggaaaagaagaaccagaggucacccagagagcaggagcgcccagcaccagagcagggucggcagggccggugucagcagcagcaggcagggagcaggggcagccccgggggcuccagcaggacaagcaagaacaggacagagccagcgcugcagagagaacagaccccguccccagaguccagcuggaacccggcacagacccaagaggcccccaggaccccagaugcugaacggcuugggccagcacugucccucuaccucuccagggcaguccaggcugggcaggucguggaggaucccacgcaucacccaacaggccccugaccaucaaauggcguggggaaggagacugaggcccaggcggaggaggcgugcggcccgcauccucaggauagaaacacgcugguggagaggcccagggacgacgggaaccaagacaacugcuguggccacugacgcgacaagcacacgaugccaggcacgcauggcaaugcccucagaagacuggcgggaguucugccccacguuacagaaaaggaaacuaaggccccaacucggcccaguccacgcgggcacucagggcagacccccggccuccccgccacucagggacccugugcgucucugucugagaggggucccagagauggggccacacaggcaggcugacagggagcgguggggaagaacacggccgcacugcagaccccacuguggccccuuacugggcacagagucugcccggagaugcuaaaaacagaaaaccgcaaauccaaaccgcggugcagcuuggaacccucuuuccucccagggccaaguucaggccgaccuggcgcagcaacggcugaccuggcccucccggccaguggugacagcggcggcggcggcggcaccagaggucugagcccaggggcagccaccuggugacaucagaaccacuggggaaaggacauggccaccuccaaacaagcccucaguccgcccaccccguguguccaaucaauaaaagcccaaccuggucaaaauguuuccaccaacaucccucccccgcagagacgcccccaccccuacaucacccacagacagggucccggcuuccucccuguggaugcaucuuggggcgggggggcgcuggggccacacaugguggggcuggugucacagagauccggggggcaacacacaagaggggcggacugugcacuuccuaugggguaagggcaagggggcccccagguuccuccccggaagaggcugcccuggccuccagagcccacuccaccucugccagauucuaagugacauugacaagucuaauuggaaccuguccccaugggacagcaggcucggaggcagcguggagaggacccccucaagaccuccuuuguccaccugcuauccccagaacuugccaccaaaggccgugaguccuggccauguauucagggagccaaguccucccucuccugauagaggggacguagggagaaaauaauucuuugggggcacugagggaagggcugggggcacugccugagagagggggcugcaaaugagagaacagagaggcgggaacgaguucggggggcaucguuuguucuccccagugagagcucacaccuugggaacaaaggaccccugagagccccaugcccauggcaggcaacagccagguggcgccguggccgugcccugcagcagcgggccccaccuagccugucuucccuuggcucuuucuggaggggccagggguggagggggaccugcacccccauccugccuuuccaaggccgcuucaacccggcacagacauccaaacaagcgggagggcgggggcucugccuggcagccucacuuccagaaaaugcgggcugccaaugagggcccguccucggccagccugaacccugccagcugcucucugcuccgcaccgccagccacgcugcccccaaggcgggccuggccucugcgugucccccgcaccgggcugccaucagugccucucccugugcacagaggcgcagcggguccauuggaggcgaugaaaacgcgccuguggcucagacccagcuucuggaugcuucuggcugaacaaccuuuuggggcaaguuacuuugccugucagggccuccguuucuucaucuaccaaacgggguaacagcacagcaaagcugaccucaugaggucacuccccugagcauaaugggguaacugacaugaggggcuucagagccuguggggcaccccagggccauuacgagacagcaugccagccagcgaggacagaugccagucccagcaggcagaugccagucccagcaggcaggggguccagccaaggccacgcaggugucucagcaaaugggacccaugcucugagucugcgaugcucaccccacuggagccacaauggggagggcacauggugucaagcuggcaggcacccugcccacaagccccgugcccugggcccacgagcccacacaccuucggcagagggccaccccgugaccccaaaaggccgguggccgggaaaaggugacccacaggacacuggaggaugggggagaccagagcucuuguccuggugccugcaggggacacuggaggacauggccaacauaggggcugccaugggcaguccagaggaccuccggguccuaucugucaccgaagcaccuucagcaccacaccgaguaggcugcggguuuuuaggagggaaugucuagaaagacgaaguggcacaggacagagccccacccucacagggacccacacggacaucaaugaaccagguccucguggucccaacgaggcacucaggagggugacgcuaggagagcugccuggaagacaggagcagggccccggggaacgcaaagaccacccccccaggggauacugcagcagcucucagaagucacacagaccagucgggcaccucucaagacagccucacaaugagcccaggagaggccacagcagcugaacugucacccaccacccagccugugucccaccccucacagccaucgcccaagcccaagaggccuagcguacagauggggaaaccgagaccaggagaugaccuaagcuugguccaaggucagucaguugagcagcauguccaggacuugaacccggcuuccugggcccccacugcucauuaccagcaccugcccaguacacggcccaaccauggcacccgaucagaaggcgugaauggucacaugugcgcgcaccacacacagcuaagauacguugaacuguaaugguuaaaaacauucauccugggcauggugggcacaccuguaaucccagguaaguaggagggugaggugggaggacugcgugaggccaggaguucaaaaccagccugggcagcauagacgcugucucuguaaauuacccugaaacgacacaugcguaccuguaaucuccgcuguuugggaggauuauuugagcccaggaguuggagcuacagugagcuaugaucacaccgcuauacucuagccuggguaacagaacccugucucucaaaaaauaaaaagaaugucuauaaagucuucaucagucauccuuucaagagguagagaccaauucccuuccccaagcgugggccagacugagcaacucacuucugaugaacagaguauaauggaagcagcagucugcagcugccaagguaagaucaccuccuuccuggcccucuugggucacuccaguggaggggggucagcugccguaucaugaggaugcucaagcaggucauggagaaacccacauuucaaagaaccaaggccuccagccaacagccaugugagaagccaccuuggcaaugaauccuccagccccaggcuggccuucugaugagaccgcagccccagccaacaucucaaguaggcucaucacagacccugagccagaaccacccagcuaagccauccuccaaucccuggcccacagaaacugagauaacaaagguuuuguguuuaagccacugagcugcggacaguuggucacacaacgcuagauaacugauacggucagcaucaccacacccucuauuaauccaggccgcccccucaauccaucagaaagccaagaagugaaacuaucugcacacagagacucugcaucuucacccagagucuccaaaacaugucccuucgaugccagagaccaucagcaucccccaucccccuuucccacauuccucagagagccagccacucuacaucuuggccgcccuaugagaaagcugggacugggccuauuucccagauaggcgaaggcaggcuuggagcccagguccagugcagagcagggcugagaugaccucagcacagugcccaugugacaagccagccagggcccagcucgaccugcuccagggccgcaggaggggccgaucuccggugcaggcuggguggcugacuaugcccugcaaaccacaccacaugcuaccgcaaaaggggaacguggggcaccguauggucauuucaccuccaggugacccgcccugaaggucugggagcagaugccaauucucucuccuguggccuucaugaggcuggcuggccacccgggcagaugugcuaugaccaccagccacaggcacgggcuggguggcugaacuaggcugucuguguugcuauaaagaaauacccgaggcuguguaauucauaaagaaaagaggcuuauuuuggcuccugacucugugggguguacaggaagcguggugcuggcaucugcuucuggggaggccucaggaggcuucuaaucauggcggaaggcgagggaagccagcacauccaguggugagagagggagcaagaguggggaggucccaggcuuuuaaacacccagaucuugcgagagcgugcucaccacuaaggugacggugauaaccccuucaugagagauccacccccaugauccaaucacugccacugggccccaccuccaaaacuggaggacacauuuccacaugagauucggaggggacacacauccaaacccuaucagugguacacagaggccauggcgcgagucccagaccagaccccagauggcgcacacaccuugaggcuacuggcagugucuucagauggcaacgagaagagcuaugucuuucacuuucauccuuuuucucucucuguauguucuaauuuuucugcagugaaccaggcuuuuaaaaggcggacauucaaagggauggcggcucgacggcacgaagucagcaccgccaacaaaagcguggggcuguccagccacagggcagagguggagggaacuggggugucccugcaggagucugaaccugagcccucacccacagcuccccagcccuucccuggugaccagggaggcccucugccugcucccuccaaugccugggucugaggcuaccucagugucacuaucaccagcccacuggcauccugacagcaaccucccuaccccggccucugacaaagcccaauaucugcuccccgggccccaugggcccccuccagccccagguacagucucccugggucccuggggguccccugcgggcagcaucccugccccggugucagcugcaggcuccugaggagcugugagccugggaagcggcucugcugaugucaggucacuuaaaauagaauuccaaaugagcggcuucauuagggggaaucuaaaauuagcgcugcuccucaguaugugugcacugggcaggcggggcgggggccgcagcagccgggcgcagcucccuugaggccaggacaggaggccaagagccggggaaccccgagauccuuggaggggucccccugggccugcugugaauggacacagccuccagggcccacgugccuccugccccuccaggccugguggggaucacuucaaggcugcugcccccgaggccucggcacgaagcccccagcccuccccagggagaccgaugcgggccuccucccgugcagguguucucuggcugaggucagugcaggugccaagguguccgugggggacacagggauggcggggagagggaggcccugggagagcacaccccccugcugcccucauuagagagguauuuauuaacuucugcgcuccuggacauugacugaauucuugucuacauuaucagcucauguaaauucauuauccuaacagcugggaauacgcuccaccgugugaaggccugugacggaugagggccggggggccggggggccgggggcugucuccgcacuguacaagcucucuugacaugugcagcucagcaggcgaaaacgagccaggggucuagguggaccaggucugcgaggcccccacccucuuauuuacaucacgugcugcucuggacaacccuuccugccacugucagcugccaccuugacccccacccccaggaaaaaaaaagcugccacagccagacaccuaaaggccccucggcccugggcacccucaaacugaggggccaggggacauaccccuucuucaugugagccucaacugucugcucccuggacccuuucagaaagaacccaccuggucuagacagucugccuggcagagcugagaaccuagaggcuucugccagaagccagagggcaggaaacggagaaugaagcagcagcccacagcaccgcaaaacccucaggucccaccauuucacagacaggaaaggucuggggaagcaaagaccaccgcccccgggugaggcccccaccccccgccccccguaacaaagcaccgcuucuugaaucaauacuuucuccuauucucuggcuagguuucuaauagggucagaagcagcacaaugcuuuaaaaaaaaaaaaaaaaaaaaaaaaaaaaaaaaggcaagaagaaaaggaagcaaagucccaguggagagggacaaggcuggcuggcccagcgagcugcuauuuuccggaacccaucucguucuuaguucuucagaacagaccccaaaccggucugccugcuguccaaacgcuccaacagcaggauuuaaacgaggggggaggccucucuacuccauuaaauauggugucccauuccucgcucccccuccccacgaggcuggaggggcuuauuaaucagcgugccagccgcccucccggccucccgcggaucccguaauuacugcuuccuuucaucccggcucuuccccggcaccagaccucaggccugcucccucugugcucuguaauuacaagcuaauagcugaggugaauuuucugcugggucccgguucaagcaccaauccgccccuucccccugacagccccccgugggguaauuacaccccgugaggcugggcccagcaggccuucacuuucaggccccgcacacacaaucuggaccuggauucucuaaucaccccucuugguaauuuuucauuaccgcagaaagaaauguuugugaacaaauaaagggcgucccccagcucggggacuggugcccgcccccgcgauccccacucccccaaaggggcgaagcuuccguggcccuaacgaggucgggucacccugcuacagacccuggcggcugaggcugcacgggcaccacgugaucgcaggagccugggcggcuucaugauaaauucauuaucauaucugcccuccacgugcuccaagcucaguggcacaaagcaauuuuucuuggggguggaggcaagggagggggcggggagacccuggggagaggucuucuugcuccagacacaugggggcagccugcuugugccuuaauuuuuuuuuuccaaauaaaaacacccccccaggcugcccuggguccccauacuggacuugcuucccaaggucuaugccccagaaaccggccagggccaucacucauggcuaaggcaaaggacagcccuugcagguggccaggauccugaccuggaacaagaagggcugagaaaacacaagcaggugggcgggggcaaccugugcagccacaggagucccuaccccaggaggaaagagcaacacagcgccuggcccguguagaccuguccucugccacgcucacugagccacggcaggagcccccagacgcugcccuccagggccccggucaaccacguagagccacccgcaaugagccaucucccaagcaaugccuagggcccccagcagccacccugaaccccauauucugcccgagccccacgacacccuugaagcugcaguccugcugugaaugggggugacggggagggggcuggccaccccgguuucuccccagccuucucuugcucacugccaugcugggaacacaaaggaggccguguucugcagaagaacacggggugcagagcucucgggagacguccacacaacagcauuggacagugcaagggagcaggucaaucccaggggugucaccuggggggccaggucaccuggaggggcuucccagguuggacgccacacuacaguuuugaggacagcaggggggcucugcacagaaggcgcuggaugcugagguugcauucuggggacccgcggacagcagccuccuaggagccgacgguccugcgacugagguucacggccacggacuggucccggagguucccggauggaggcgagggacgggaagucaggcaacagauggcagcaacauuugacgcgauuauccuaagcggcugcugugugugcggagaagcaggccgggcagaugaagggcuggagaggagggcggcgggaagggcgggacuggcagaugcgggcggcagccuggccucggcagggaggcggccuccuaaaggggcacgacagaccaagggagagggcggggcccugagucaaggcuggggucgguguccagagcugugacucugggagauggugcccagcaccaacagcgaucaagguaccagggggcaacuuuuacagggcgccggcuaccuguacccuuacuucccuuuacguaagcagaccccagaaagcaaagcugcgaacagcaaagugacacaggccgcuggggccacacagcucagcugagacagagccgggggcucacccaugccggccgauucccagccccuccgccacccugugcccuuggcgguaccuggggucccuugucacauucuccccaugggcugcuucccggaggcagugguccuggcggugcccaggcgccucucuccaccuguuuauuccacacagugggaugcucacucccagccuacagaggcugaacggaggcuggagauucacgcccucaacccgggucacauguagaggcucaggagccggaaggaaacccagcuguccuggccauggugccggcugcuucccuuuaaugugcgaagagauuggaaauggcuggcgucacuugggguccccucccuguggcagcucucacccuguggcggcuguuugggugcccacccuagugcuauacccguuuuacggacgggaccuacacggcugggaauaggaaggcucuggacucgaggccucccccagccccacuuucccacagcucucagccagagggcaccugugcuagaggccggaaccgcccccgggugcccuguguagcccauggcaccagagcugaccaggcugccuuccauugcaccugcuccugugggagcccuuccucccuccagaggcccugggcagaggaacggaugagguccaagguguccaggcaggugagaggugcccaggagggaaauccaaccuggcucccccaccccagggcgggcacugaggucuccaaguuuccgugggacggcggguggcggccggggggcaugggccagcaggaagaggaggcugagacgcuugcucacaaggacccacgaaaugcaggccccucuccucuccccaguguggaggaggcugaguguuuaacaagcucccucagguaagugggagggagagaggauccaaggacgucuccuaugaaugccugucccuucuguaccgagugagugccaguaccuaucuacagggcccuuagucuacagccaagaacagggaccaggccguacaggagcuggacaccaacaggugcucaaagaagcaaucauacaggggccaggaguggccugggcagcaggggagguggcgcgggggcagaaagggccaccuggccuucgaagagggguccagggucuccagcuucagaggcggggagauggugaugacuggaaaacgucccuucccuccaacagggcggacgcccacaccagcagaaaugggcgccuuuaagucagaaggcgcagugugccugccugcaggcaccgggguccucacaucccacucagccagccugaacuuccacugaaggcugagagcuguggggccucgagggaacacacuaugggggcagagcaaaaagggcuugguccugagcuggaaaaccaaggggaacgggggugggcccaggcugacucaugcccaacagcucagugcggacuuccagggcaccgcauggccugagccucaguuucccugucaguaccauggagagagggugcaaaugauuggacaagagggucagugaacaguggcucacgccuauaaucccagcgcuuugggaggccgaggugggggaucgcuugagcccaggagguugaggcugccuugaguugugauugcgcgacugcacugcaauguaggugacagagcgagacccugucucaaaaaaaaaaaaaaaaaggaguggacaaggggccagccuuuuacccuucaaccuguuuuuauuugaccugaaaucacgcuguguuguuuaaacgagaaucaaugggcaaugucuuaaaauaggaggcuucaagucaacgagaaggugcccaguuucucccgaaaagucuaagccauaaaaaccacagccccaugaguggcacuucucccuuaguuugucccuaacucuccagguugccagagucugcaccccuccccucccuauggucucaggccagccagcuuccucaacaccaggucuucccaauucuccaaguacaugcaggucugagcaacuaacagcccugcggcagcugcagcugcaacccucagcacagacacuccacucagaugucaucgacacgguaacuccaugaggguguaacagaaagaggucaaccccuucccaggcucagcuucaggggacgccuaugaaggccacaauucuggcgugugucaaccccaagguaggucuccccugaaucaaagcaagcucaccaagucaggacuugccccucaagucauaaaacaguuacauccgccuuugcaaaaagguccacucucaagaugguucaaaguggcggaccagacccucuccccaggaaaauacaccuacugcauguuacauacaguuuuaccaaguucgaagagccuaucuguaaacccugugggagcguguguuugaagauguguagcauccaugaacccaggcuacaaacuccuacagcacagaguucccuaaguggcaacccacgaguaugaacacccuccccaauaugaccugccuggacagaggaaauacaggguggaaaaagaaagggcccagaaccauccacguucuaauggcguuuccucguccagacucgucucccaucuucaaagccccaagugcugugcccagacaucacuaaaugccucacuggaaaaaaccaacaagcacccucagccaagauggacuuuggaauggagcuguccaggaaaagcucccauaacagucaugcgccaggaguccuggacucccucauccaacccagccaccaaacaggacaaacuggucaccuuuuccggccacaaucauccugucaacugcugaauggcugacugcuuaagucuaaaugauucuguaauucucaacaugcacacacacacgccccuccagaaucccagugaggaacuaguaaauuucccagucaggugcagaccuggcuguugggagcuggcagucucugccaccaagacugguaacaaaguucuuguugcgccaugagaaguaguccaggcuaugucuccuguccugaaggcugcauggggaguauggggugggaagaaugagcccgaggugggcagguaagcagaggugggccggagcgcccuccccuccccugcuucuucaaggguaaucuggcagaaggaacacaacagucucuccaguggauaagagacacggaugacacaaaaccccaggguccacucugccagccguggcuggagaaaccccagcuccagcauccaagcagacacaguccugcuguuaguggauucagagucacuccgcaggaucccaaccagucucaaccuggaaaccagcugcuuaguuaaaauguccucccugugcccaggugacaggcuccaggggucuggcaucccugcuaaggauggauuaacuuccuuaguccuauaaagucuuauaagauguacauuuagguggaaacaacacguuguaaaacgauaagacuguauucaaaaaaggacgccaggacaucggcuugauuuaaaauagauacgaucucagcgcacacuccacucccugcacaccccagcacggggggcgguggacacaaaccuuuuucaagagacgaucuaagcggguucccccaacaccgcagagacccaaggccaagaccaucuaaacggguuccccaacagagcacagacccagggccgaaaccaucuaaacggguuccccaacacagcagagacccagggccaagaccaucuacacggguuccccaacagugcagagauccagggccgagaccaucuaaacggguuccccaacagggcagagacccagggccaagaccaucuacacggguuccccaacagugcagagauccagggcugaaaccaucuaaauggguucccccacacagcagagacccagggcugagaccaucuaaacggauuccccaacacagcagagaccccgggccgagaccaucuacacggguuccccaacacagcagacacccauggccgagaccaucuacacggcuuccccaacagagcagagacccagggccgagacccucuaaacggguuccccaacacagcagacacccauggccaagaccaucuacacggcuuccccaacacagcagagacccagggcugagacccucuaaacggguuccucaacagagcagagacccagggcugagaacagugcagagacccaaggcugagaccaucuaaacggguuccccaacagcucagagaugcagggcugaguggggcgccagcccaggcauuccacaagggcugauuccgaaacccuguuuucuuaucuguuacggggugacuaaccgcacccucccgacgggcggcagagacgaccgcguggaucggcagccucugggaggcggaagucucuccaaugcucccaucuggcugagaauuuuugcuugaaccgcauuccacuuugugucuucaacacccaguauagcaucggcugucuaguggauccucguauauuuaagugaauggaaaaaauaccacaugucaaaugcaaaaacauuacaaaaauacacucaaagauaaauguacacugggaauucaguuggaagaauccacucacaucccgagacugggugaagcagcucaguuuaauuuuguuuuuuugcugagacaagagucccgcucuaucacccaggcuggggugcaguggugcgaucacagcucauugcaggcagccucgagcuccggggcucaagugauccucccugcccagccuccugaguagcuggaaccacaggcgcaucccaccaagccuggccaguucuuuuuauuuuuauuuuuauuuuuuguagagaggaggucuuaaacugcagagcucaagcaauccaccugccucggccuccuggagugcugggauuacaggcuugagccaccgcaccccauaagcagcccagguuaaacagggccuuccgaagcagccggugaccucucuccaggcucuaagggagagcgggugggaguugggugaggaggcuggagugggaaaaucaugguguggguuucugcuccucuaccaauuaauuaccagcugugugacuacagggaggauauggauccccggggccccuuucuucccuggugcauggcuaaauggggauaaucccugccuagcaagucagucccucccuggggaggaggagcacguuggggugaaaacguccccccaccacgccugacgcacagcccacggcgugacccucauaggcuggggcagccacagcaccucuggauacagaaauacagucuuucccaucugguuacuaaaucccagagacaacuccuuaagugggaucaagaccuggccggcacaccaucugcccacagaucacaccacguaagagcgccugccgucccuccaggcccgucuggggcuguggggcaucgcuuggcacccccgggcuuugccccccaacccagaagauaagacucaggguuagccuagaaguggcccuuaaggcugcgccccaccccccucccgccuccacucgcaagcugucuugugcucagcuugacauauagauuuuccuucgggacggcuuaaccuguccaacaucaauacugcucaaccaaaagcugggcggucgauacccuucauugcugccuguggccacagacccaccauccgagcgcaggaagggcagggcugggggagggacaguuuguuaaagcaucucccgccaccugggcccagagugccaaucaccaagggggcaguggugugcaugugagcccgaggggacguugaggcuccuaaaaagaaccuccgguuguuaaagcccagcagaggggccggcagggucugcuguggugacuugagccuuagggcagaaaaagcaacuccagucuuuuugggaaaaggggccacccccaacaccgcaagggagucaguugagcguaggggaacagagccuuggaacuuuauaaauuaaagccaagcuggacacaguggcucaugccuguaacuccagugcuuugggaggcugagacggaaggaucacccaagaucaggaguuugagaccacccugggcaacacagugagagacccugucuccacaaaaaaauuucuuuaaaauuagccaggugucgcggcacgcaucagugguuccaacuucucaggaggcugcggcagcaggaucacuugagcgcaggaguuugaggcuguggugagcugugaucgcaccacugcgccccagccuaggcagcagagcaagacccugucucuaauuaaaacaacagcaacaggaguagccgcaaggcuuugcagagccugugucaggugcuguacugggcacuugguaauaaaggcuuuaacccucaacagccucaggauacaggugacauugucauuccuauuccacagauuagaagacugaggcccagaacacaagugccugaggucacacaggcuaagcaagaggcagauacgaacagucagaugcacugaucgacacaguaacagcugacacucaucaggggcucaccccacgcuccaggccuucucaacccucacccgcaucugucauuuacccgucaggggcauguggcgggcauuacagcaucucauccucacccucaacugccagagggccucugcauccucgucuuacagaugagaacaugggggugggggugaggacgugaugauuaaaguggaaggaucuaugucaccauuagcacgcaccccccucacgccaccucaguccagugaucccaaagccacuauuacacacaccuccucagacacgucaaguccuccagcuggaggaaccgguuccagaauuggaaggccuggcuagagaugcaggugaacacgaauccacccaugccagugggacucugcauuuguaagccccuuuagaagagcucaaagcacaccugggccaggcaagaaugaccuucaggauucugccugggguuaacacaaggcccacagacauccagagagcagccaggugacaggugccacgccguccugcgggggagguggcguagaggggagacguccauuucugagucaccaggguucuccauccaauuccggggcaagcaaggcggucucuggcuucccaggugggaagagagaccccaggucuccugaaacagcaucagcccaucuucccaggagaaggaauuccuacccacauugcuccccccagcagaaggcccuucuggauuaggggggccaagcauugaaaagcucccacccuggccccuaggugacuaggaagcugcucuggaagaaagcagagccagggucucagcuugggcugcacguggcaguuaacgggggggggggggggaggguugacacacggaugcccaggcugcaucccuccgagauuuggccugaacugccuggcaguacagccuggacacugggagcuuuuaaagcuccccaggugauucaaaagugcagccaggagagacccccgagcuggaggcuccccacuuccuccaccugccucccuagaaacccccaagucacaaggacccacaaaagccucaagugcagcccaaccccuucuuuccacagaugacugguaggugcaggugaagguaaaccagaggcccucuccagcaccagcccugcccucaucuacagcuccuuccuccaggccuggacuccgccccagccucccgggggcagcucucacuuccccucugaacuucugauuccagacacggggugggcaugggaguauggaugcgagggaggcaucagguuaggaggggcagguggacuggccucagugacaggugggcuuuggagcagacgggagaaucccaggcagacgggauggcccaugcuaggacagggacguggccaaacgcaggaguggcgagaauggcgugugguuucgucuggcuggagcugagggcgugagagaagaggcugguggggaaucagagcugcagaagcaagauuaaaaggcccccgagugugcguuuggcaggcaugcaaagggcugcuuuuggccacgcuccuguuuuaucugucuguacaccucccagcagcaagcacacggcuggauucagaggaggagcucaauaaauucucauugacagcgacacuccgaaacgucaccucccaggcuguggccucagccgggggagaaaggccagcaugcggaagugaagccagcagcacggcgucccacaccgcacucggugaggccaccgagaucugagacuccacugggggaggaauuaaagccaggcggccaggcuucggcacagccaccaagcugaaaugucaccugcaacauggaucucugcagguuaaaaaaacagcucucccggcacaccaggaaagggaggggaagcccugugguuucagaggacccugcuguugccacaacagagacaauucacaggcuacccagagaggguccccauccaacccuggcccgaucccaggguuugauccuuggacuucgaguaacccaggcugggaauuccaaggcuucaaauggggccaggaaaaaccggcccugcuagccgacuccacaagccccugcgagcuccuggaggcagggaaaagguagcagccagcccucuagcuuauccgcacucuuccagaaaagugggaggcaccagcuccugccccucagcucggggcuccgagcccaaaggccccccaguccgccuccuucagagcaggggaggacagacaguaccugcuccaggggcucaaggggaauuugggacuccagggguuggaaggggggaaucucuagcucagaggugcaggaccccggucugccacagaguggcgcugugcagacuuggcucuuccuggggccggcgaugcugagcccacaggcaggcuuggcuucugcucugaaaccacaaggcacucagaucugcagccccugaacuucccccagagacagggaagugacugcuggaggggagggcucaucggggccaucggaggaggcuuccugcugugagcgcgguguccgccccacgccuggccccaagccucaguuugccccuuguuccuacccccaguguguacguuaggaucagcuggggagcucugacaacccccagacccgggucaggaacccagaggcuguggcuuaacugggcuuggaaaggccuggccagcagcaguuuuaaaacaccgaguuuggagauguacaagccccuuugaacucugacacuccaagauccuaaaaacugucccaaacagcucagagccugcgccacaguggacaccuuguugccuuccuuguuuugagcucagccucacugugccuagaacuaggacuucccgaccucccuucccaaggcagggcugacccuaggucaccggaggcuccuggcgggcucucaccagcucuggcccggcaccgcccccaaggcuccaggaaagaaaacuccaagcgucaaaaccgugguuggcuccagcuuccccagcuuccccuccugacuuuggugucugcugccagagugacaaaagccauccucgcacccggcccgcaggagaucaggaacgcugccgacacggggcuggcugucucggaaagucucuuaggaagcaccgaggucgcugcucucgcaggccagggccucuuccagcgcuccugaaucuaccugggcggggcgacucccugcacagccggcggccgggaugacacacuucgccgucggagccugcgcccugggccccucaccuguggcguggcggcugagucaggcacagccugugccucagguucugccgucccugcugguggaggcggccguaaacacagggugagcaacacugaagugccccaagcuuaagcaacaccgagggaggccagggaaggcugcucaccuggguucccccuuccaccccugccgggaggcgggagcacggaaucccagaggagaggacgagacggccgaccagggggcacauuucacaacgcccccaccaagaccuucucucugccccuuugucccccgccgccuggaaaucggcuuaggcggguucgcuuccacccggagugcggcugggccuuuuguucaggcgccuuuuacaaaaggagcccucuuuccauuugguggccccgcuuuuuguuuccaaaccccaaccuguguggccgcuaccccucaggccccagauaaggcaccgcagcggggagcaaggguuuaguguguuuuaaacgcacuuuguacaaaggcuaguuuguaagagccaaaccgacucaacuccggcuggcauccaccgcccagcugggaacccggcaggugcucccccaccgccagcacgcugcccucggaacucagacgggcacugcggccaggcccccggcccaccacguggaaagggcgcagccuccacucccccaucuaaugagggugucgcggugucccuuccccccaucugggaacccccucccuauggccugcgccucgagucuccaccgcacauuucuaagugccccccuggucccccacccggcgcuggggaggggaggcggaaagcugggggugggcgggcgcagggagggugagcuccacucccgcuccgccuccaugaagggaauuuaauuagccugcuagagaggcgggcgggcggccgaggaggugucucuggugcugcaauauaauugaaucggcuccacucggucgggccacucgccgcccaucagcgcggccgcagggcccgggagggcugggggcggggaggcgcauccaggcggagcaggaagggccggggagggaaaaaggccagugcggguggggggcggcggaugugcaaucccucucccaccuccgaggcuggggcagccaucuucugcgggggggaggggaggggcagggagccgcuccgccggggguggggggagagagaggagagaagcggccgagcccggggcgcgcccuuccucgggaagcagggcgugggggucacaaacccggcaggcugcggucccgcccucccgaccaacucccccgagacaaggggucggggagggggaggggagcaagacaagaacccuaaccggcgcggccccaguagcgagcaccccccccccccacacccccgcuuccucggccgucgccagcaccugccgcgggggcgcacagccacccccauucgcucccucccgcgucgccgcaaaguuuucauuccagcucuccagcgcccgcagcucucggagacuccccccgccacccccauccccccacuuuaccugcccucuagcccgcacgcacuuaaacgcaccccccccaucccccgcugagcgcacuccugagcccggagcccccgaguccccgcccgcagccaggccucccaggcugcgacccgcgggcggaggaaggggguggccuuuggucgccugcccgcccucccggcucuuaucgccgcuaacacuccggggaaguugcccgggagccguuggcggccgcccccgcgaaacccgcgaacuugcaggaggacagugcgguggggggaggggggaggaccccguccccggccgggugcggcgcgcucaccuuucaugccagggccccgcagcuccaccucggcugauacaugcuggagccaccgucgcccaguguuugucuaaacugcuuaucucacccggggcugcucggcggcggcagcucgggcccgcuggggagguggagcuuccggggccccggccaagaaacaccugcugcugucgccgccgaggacacacccaaacgcaacgccgcccacucccgggccacuggcucgcucccggcucccugaccucagccagcgggaggugucggguuucagccgcaaacacacaggcgcgcgcgcgcgcaccgacgggcgcccggauccacccgcccaggcacacgccccuccccggcccggccggccaggugagccggggacaccagcggggccgcggaggugccacccccacacucucgggagccccuggcuggacugcucgggggucccggggaccuugguggcuaagaccggccacuuaacucuuaaaguagugcagcacccucgccacgugagcggagcccugucucgcagcugcgucccgggaaccuagaacagugccugacacagagcaggcccaauaaugggcggacggguaacuccguguccuggaggccuuuuggagaacaacuuucugggcgcugguggcgcgugggguggggggaggcgacacaaaacagacuguguacccaagccccaccccccccaugccugaccuuauuaccccaacuagaaaaggcugaauacuaagaacuuggccucaaaauuccauaaggcaccccaccccccaguuuuaaguaacuuuugggaaggccacaauugcgggccgcugcgggggguguucuuuaaagaacccgcggcccaggggcuggagaacccacggaggcgccgcuucgccagggggaucauuaaguagcugggguugcggucagaggcgaggucgcccgccuccagaaacuggcacgacccauugcgcuucuggccccagcgcagcgccuccccauuccuggcaccccccacccuaccucacccaggcacuugacuggaaugacucagggagcguccugaaauuccugggcacccacaggcggcgcggagagggacugaaggccccagccuucccaccccccggcuccgcccaccccgccccgccccgccccgcccccaccccaucgcggcgggcgcguccccaggaagcucgggguuaaaggggcgggccucgggggcaggggucggcgagccuccccugccgccuucuggcgcccugggcuguaacccccccgggcggcucugaggccccggggucgcucccuccucauccucuuccaacaccccucugaucuagcgcgucccuacuucugagcccuggggcaaaccagcacccccugggcggccgccccagcgcugcgcugcggugcggguuucgacuuucagcccccucgugccagccccaaaccugccccgggacaugcccgcgccaggcuuggcaggcgcgcacgcugccguccccgcgagcccgccucccccgccuuccucccucccccuccccgcgccagcccggauugcgacgggagcgagcgcugggcgccugccaccccccauccaucuguucccgaugacgcuggcgggccuagagcguucggggcccgcgccagcggggagcagaaccagccugugugcccuccggggggcagggucuggcgggcucccucaggccccacgcuccccgcucgaccuccgaccgagcgcgcgccggggcccggaggugggggcgcacgcgggccggccccccgccuugcacaaggcuccgggcagaccacaaacgaaaagggaaacggaccggcgaggccgggucgggccguuacuggcuccuaccugcggacgcuggccggcccuggcacggcgcgggggugcugcuuccccgcacgacccgccagcucaccggcggcgccccccuugcggccuuggccggacgcuauaauuuacgcaccacacgguggcucggccgcgcgggcccggguaauuuauacccgcacuggccggcggauucacccggccccaggcggccagggcugggagggggagggggagggggaggggcgccuccacccccacugggagucacgggcggggggaggggaggauagggagguguuaggaaggaauggacgacgacuggccccgagccuuaaaaacaaaauucaccuccgggacuggcccaaccccuuucccaccuggauuacaagcugcggggggaggggaacagcaugcaaaugaaccucucgcaccuggccggguagacaccuaggccccaccuccaggucucucacccggacacggugccaccaccuacucccuucuuccuuggagaggcccuugggccaggggugaaggugggguuagguuucuccaccuguuugagcaggaccacgacggccaaccacaaaaacguguggaguggccacugggaggugcaucacucggcuuuuuagagccggccaaucccuccggcguauacaucuagcuccccuggauugcgagauggguggucuggucccguuucacagaugaggaaguugaggcccugaguugcucaagaucaugugcacacaggugacaugcaagcugcgccccaaacugcucacaccuggaagucacuccccuucccaacccaguaggccuaggggagcgaggcgcugccggacaccccggcaaccgccggggggcagcagcgagccgcucugugaguccuggccgggaaacgcuggcggccaccaggcgggcuggcaagggggagauggaugacacucacugucagugcgcccggcccccggaaauuaguaauccggagcacggccuccgaguuuaagggugggaauugcucuccugcagccggcgcgcuccucgcuaacgagguuugucgcuugacuccuaauuucccagcacuggggcuaaggcuggccucccuccauuucccuccaggccugcuccuccuccucucucuuccuaagcagcgcccuacccacagccccgcgcccccagauagugcgagcccuuccugggcacagcucucuuucccuggaccuccuucccacccuccacucccauuugccuggaaggagcuagguaggugccagggccaggccuacggaggcaccucccagagcaggacaccugcccuggggaugcugcacgcggugcuccuuaccacggacugugcuuugugccaaggcaacaggaugcuggugccuggugcgcguuugcucacacccugaggccccugccaagcuaaacugugccuccaagagcggaaggcaggcucccagccccucaccugccucagguaccugcuucagugacaccuaggugcaaacucuagcccuaccuccacaagcccuggaaccuauuagaccugcaccacaaaagagauuuaaaauuuaaaagcuuuccuaagggcaugguagcucacgccuguaaucccagcacuuugggggggccaagauaggcauauugcuugagaucaggaguucgagaccggccuggacaacauggcaaaacccugucucuauuaaaaacaaaaaaaaauuagcccugcaugguggcgugugccuguagucccaucuacuugggaaagugagguaggaggaucccuugagcccaggaggcagaggucgcagugagcugagauugugccacuacacucuagccugggcgacagagugagacccuguuucaaaggaggaaaaaaaaaagaaagcuuuccaucucagaugaacaugagacaccuuaaaccuacucccugagcucaggaacuaagaggggugucuggagacgggaguccuaggaggauccaccagaaagaaagggacgccuugaaccacagagggugggcgguuuuucacucaacaaacacacuaaacccugggcuguguuucacacuugguuuuccagaaacaaaacugaaaauuccaguaagccuucagcaagcaccucagagaggccaggguuagcugggugugauggcacaagccuguggucccagcuacucgcgagacugaggcaggaggaucauuugggcccaggagucugaggcugagguaugauugugccacugcacuccagcuugagccacagagcaagaccuugucuuuuuuugguuguuuuuaaaggugggggcggcaagggacagacagcagagggcagaugcugacagaggggacacuucaaggcagcaaggaaauuuggaaggcaagggggcaggaugacagcacagaccaccaccaccacugccugggcaucaaccugggccacgucaggugcucaggggugcgggcgccacccgugacugucacaaccucacuaagucugagcacacggccuagcccuggcggaggauggaucccggacacguucuuucugguucuugcuucuucuagggcucagcaggacagcacacagccuaacccaagguccuucuccauccuggccaguugcuccuagcacguaggaacugcaugucaccuucauuauguugccugggcaccuuguucagcgccuggauccgccaauaaguaucagggaccuggauguccgugggccaggagguaaagaucaccugugccauucaccaagcaccuaacaagagccagcgcugcucagcgcaugucacuggaagcccucccggcccugcaaggcaggcagugaccuccauuacacagcccgaguggggagaccugagaagguuaauuggccugccucaggcacacacauuccagcacgagucucauccagacguggcucuuacaccuggcagcacuucucgguaaccaccugccauggucacucugauuauuaagaaagauacaccugcagggguacgacaggucucaagcgguuucaggucuacgcucuuaccucugggcagcuguccagugccugaaaaccauuuugguugggggccgggggagggagccguuagcugccuagagcugagcacccugggauucacccagcuccccuguaugcacaguccacccuccccaaggcuaccagccccggugcaggggcaaggggcggggggcuaaguccacagagugcacugaauccggggggcacgaagagcugagggguggaaggcugcccagcuaccccaucugcccucagcccccagcccugcccuacgcaucggugaaggugcaagcccccaccacuuagauuccacccuccucuuucuguuuccugcccugcuaucacuggcccagaaauccuccccauucuucaaagcccggcuuacaucuuaucucuugcaagaaggcuuuucccaucccugccucuggaauucaucucuccagguugcgucccacucuuagauagcaaucacacagugcagugggucugaaaucaugggggggaggaauacagauccccaggccccuccccuuacggagccaaggucuccaagcagugccugagaagaagcauccuccaccagccacccugcaggccgggccacagcgugucugcuggagucccagacucccugcuccagaguggcagugggggccucaagggaagaaggccccugucuccuagcagggacacaguccccagacccugggcaggauuuaagauuuaacccagaucugcugauuggauaaaggcuggagggagagaggggaaagcagcgcccgccucucccugccugcccccucuuggggaggaaccagauucgccagggaugcugggggagccccaccccagcagcucagguggcccucaguagcccaggucaccucuaggggaacaggaaaggguuaaggcccggcuaacucccuuugaggaguuuuccucuuaaccccgggcugccccacacuuccugcccucucagcgccugguuccaauccgcaccccgcacacagcugcacuccuuuacaaucaguuaacagcuguuuugcauagauuuucaauucuaauugccucgcuuugugagcgccgccgagcccuggugaauggggacgccgccaccgcggcuggaaagcgggcgggagagggaguaaaaggaagccgugugcgucggggcugcuggcuuuuauuuuucuaaaucagaaaagaauaccccugcuaccaaccgccccccagcuccugccucuccuacuggagcggggaaaccugaaacgggugacccccaccucuggagaggcacccacucuaugaccugggcucccugaccccaacccagauacaggucccagagggcagcuuccagcuccagagcuggcccaggagccauggcucuccucccuccugcagcuccccucccccuccucccucccgccccccccaccccaggcucuccaguauccagauaugggaagcuaauuggacaguaaaguugaacagcaaggaaacgcacucucuggagacagcuggcaucuauaaaagaaauauuugcauuuaaaaccuuuaaacuuuauauggcggggccaggccgaggcaggggaagggggcugggggagcagcgcucggacccuugauggggggcagagaauccugggaguuuuggacgcuucugccaccagugagcaccccccacacauaccccuugcccuguuacugucugggagacaaguuggccccugcuagccagacggcccuggccaagucuaagugucccaggugucugaaauccugggaagagcuugcguccacuugggcugccacaggcaagccacagggaucccagggcauccaggcuggguccugcacccugguggugggccuggcucaacugcuguccacaaccugucccucucccgggucacccagaagcuccaggacccagugacgggcagacucaguggcaaaguggccccuuccuggcaaggagacguucugccaggagccgccucugguggccugaagcccuccguuccauccccugcacauccagacagugcagcugugugagggcaccugaccagguccgcguucagggcccugcaggcuggcaucacuacacugcacggaugagguuguggagcucggagaaguccgcccugccuucccagcgcuccugcugucugggguggggaugccagguuuucauuuccucacaugccuaguucccauuuuucauauuugagagaaaccuggccaaauuuuccuacugucaacaugggugauguaaagccgggagagcauguguuccggaguggucugauuuuagcaggcuuuuauaaaaucccagggcgcugagaaccccgucuaccuggcaggccugcuggagugggcugugccacggcagacuucaagggcaggagccgaaacuucugugguggaggugagaaggagggcaggggcuggcggccaagcccgaugggcacauggguagcuuucaaugaugucaacucaacagaaaccacggcagaaacagguccaguucacuggcagcaaucagaggggagcagggucuccuccuugcaacuuuucuucccaucaggaaacuaucuccaguccaagcaaggcagucucagcuccugggccgcccaugagcccagccugcuguuugaggcuucugaucaccuacaaugcggucuucaguuuauccggcucgcuacgggcagcacccucucuaccacuuaccucuaaaaacacccuggggccagacguguuaaccccauucaaugaccacccagacagcaaacguuaaaauguggcuuuggagagcacagccgguggcccccccgggggugcagggggaggauggacauggcagucaagcugccggacugggcaaaucuccacccacugcacacccguuuccuuagcugcugcccugcaaggaacgugucccccugcccccacuuuggugaggaccagacaagacaauagagagagccaugcccagugccugggacgaagcuggagcucagaagcauucccuuacauuugcugugcggaggaaguggaaagguggcagcacagacaaauaaaguuuuacgaggaagcacuucucggcgccagaccagaugggcagggaggucggucacuuagaccacuucugcccugggacauugggccuagagugagagcagcggaacucuuuucuccuccgacauuaggagaggccuuggaaugucacacacacuccaagaaucacaccagcaacuugcgugagcccagccccugccggccccuggcuggucacuaggcaaggggagcaggacagcggguggggcccagccggccacccaagucccuggcuucuguaagugugaagauacugauagcagaccaggcgcaguggcucacaucuguaaucccaacacuuugggaggccgaggcggacggaucacaaggucaggagaucgagaccauccuggcuaacacggugaaaccccaucucuacuaaaaauacaaaaaacuagccgggcgugguggagggcgccuguagucccagcuacucgggaggcugaggcaggagaauggcgugaacccgggaggcggagcuugcagugagccgagaucccgccacugcacuccagccugggcgacagagcgagacuccaucucaaaaaaaaaaaaaaaaaaaaaaaaaaaaaauauauauauauauauauauauauauauauauuuuuuuuuuuuuuuuuuuuuuuuuuuuuuuuugacagaaucucacucuguugcccaggcuggagcgcgguagugcgaucauagcucacugcagucucgaccuccuggucucaaggauccucccgccucagaaggugcaucuuuaaaaauuaucaaaucagcccaugugaccaucaacggggggaagagauaaacaaaauguggucucuguguacaauggaauauuauucagccacagaaaggaauggggccugauacacagugaggcaugaaacauaccuucgcguccacgcaaaaccuuguacggauguuccuaucagcauggcucaucauagccaaaaagugaaaaccuacauguccaucagaugauggauagaugaagaaaacaugguuuauccauacagugaguggacuauuacucagccauaaaaaggacugaggugcuaauccacgcuacaacacagaugaaccuugaagacacgaugcuggauggaagaagccagacaaacaagggggauuccauuuguaugaaaugcccggaacaggcaaauccagagacaaaaagcagaggaguaguugcuuagggcuaggggaggggagaggggaguggcugcuaauggaucugaguuuccuuuuggggugguccuuuuggucccucugucuugccccugccuuugccacgugauaugcuggcucccucuuugccuucccucaugauuguaaauuuccuggggccucccccgaagcugagcagaugugagcaccaugcuuccugcagggccugcagaaccaugaaccaauuauaccgcuuuucuuuauaauuaaaaagaaaaaaagaaaaugauuuggaccaggacagagacgagggcugcauauuaggaauguacuaaaugccgcugaacuguacccuuuaaaacggcuaauuguauguuacaugaauuucaccucaauuaaaaacaauccaaucugggcugggcccaguggcucacaccuguaaucucagcauuuugggaggccaaggagggaggaucgcuugagcccuggaguuggagaccagcucaggcaauauagugaaacuccaucucuacaaaaaauaauaauaaaaaaauaaccaggcuuggggguacaugucuguggucccaguuacucaggaggcugaggugggaggacuggcuugagccugagagguugaggcugcagugagccaugaccgcaccacugcaccacagccugggcgacacagugagacccugucucaaaacaaaacaaaaaaauccaaucugaaggccucugccugucccugggagaggccagaugcagggcagggccuguaguuuccagagaagccucaagaagagaagcauccccuggaaacucccuuucgggcugugcggaugacccucgggcacugggggcugagcagagucacgagcgaagccagucaugacccagcacauuuuccucccagggaacuuuccccacucggcgucucucccccuuccacggacacggugcccucucuguggacccaagcucugagauggagggguucacaauguccccucccccagcugagcucccucaaagcugcagaccuauuuuuguccucacugacaauucucccaugcaggggaaaggcgggucuugcugccucgugagcucugagcagcuggaggucgugacacugaaaugaacacaccugucuccaagcagggcugcaaggcagcuccugccaccuggccacucggcuggaaagcggccagcugugacccuggcaggccuggaggggaugggauggcagcccaggcaggggcacagggaagcaaggccugcagaggucaccagcugcccacggagcgccccgcuccggucccagaccccugaccugagaccagugugugggccccugcgggggagggcaagggcagccccuguaaccggguacaucgcuggcagcagugaguacacuuccaccugcugagccuggacaccaguggaccggaaauuugggugauucacucaaaagcccgggaggaacugucuuccuucauaaagaucaaccggcuguccucaggcugggugaggggcuuuccucuggcuucgugguccauccacuggcucagaggacaccuacaccucaggcccccaccaaggccaccacccagagauaggcuacaugcccagagagcacccaggaggccggguucuggagcagcgggucacccuaggcccaggacagaugugggucgggcagggauccggcaaggucaggggagcucgcucacaccggcagaccaggagcgguucuagaaccccagggcggccagggcccaagggucuccauuagcccccaagaagccucccagggauccuuagaaacuuuuauuucugggucccuguucccugauuuucuaccacauguuaaaagccuucgaaguucuuuuccguaucaaguagcacuggcuggggacacgcaggccugugaaucaguccacacgcugcucccgccccgccuccucccugccuggcccccgccucggccuccaggcaacccccugggcgcugugugcugcuaacccggcccuggcagcaguccuggcugcucagaaucagcauucguuaagugccuacugugcccggccuucugccuucauccuugcugcaaaccuaggagaggccaacuucccuggacgguggggcugggaucugaaccacggaggagcuucuucuagaacugcacucucucuuccuccaggcccgucuucucccucucccuccccgccgccucccagugcuccugacaaaugucuugauuaauaaccuacugccggucauuaagaucacaacugucacucggacaaucaagucccaguugccuuuaucacucgcgggcucgacaagcgaugcacgcagacagaggagacccugguguccagggcagcucugcccucacccaccacaggauaggcgggcccuggggacgcggggucaagaccugggccucagcucccuagcucacgucggcugcaaggaacccucugcugcggcucuuguuguguuuauguccuuaaaauuuggucucacaaaaauuaaaauaaucaaaaaggaaagguuagauggacaaaguuguuuucaucgcucgaaguuccugguguggagauuuuuagucagccgccuguggcccuucugggugucugccggccccgcgcugaaggugagcguggaggcaguggguccccaggucacccccccaccuugauuucuaccugauugccucagcucugccucuugccagagagccucuucccgccuggccuuccucuggccugucuuugagcucccauucugaaaggccuccuccccaccagccuggccccugcaaucccucccagugccaguaaaguugcucccacguucccugacugccgugggccuggcagacacccauggcugccccaccccugcugccuccucuccuggggcugcuccccucccaccccucacacggcaccucucccucagccugccucuggggucuauuuccccucugagacucccuccuggcccucacgacugcacuaggggcgucuggaagcgucucacagucucucuagacucgcccagccccaccacccuucccugggccugcuguauccucccccagcagagccccaucuccuuuauucaaacccugaccucuuccuucaagcccuggcuuaaaauucugccuccuccagggaguccuccuggauggcagcucuaacccccccacugguggaagccgaccuucccuccucccaccgagggguugcuuuggcauucucacuuucuuccaggcgcucacugagcugagccguuggagaggagacugagcuaaaugaaaucaagaagccccuaggaggacacaaacccucaucagcgccaaacagcccuccuguccccaaaauaaacccagccaaaaaaggaugcgggaaccuccugcaggauccgcaccaugccgucuuguccuggauugcugagugccuuuccccaguugacaaggauggguuuauuucaucagccuucagagucccuacaucugcgaugcuacgccagccccuccccucuucauagcuggaguguuuugcaaagagccaccaggaaaacaaaugcuggguuuuugggguguguguguguguguguguguguuugggguguguguguguguguguguuuuuuaacaaggcucccaaaugaucuuaagacacacacaccacagccuucuuagccacagccagccacugccucucaacacuagccucucacccggaguucagacacucuccucucccacgaaagacagugguccucgagagagcccucagccuggccuuccccaucaggccugggugacaucuucccagccccuccccuuggcccacauggaagcaucgaggaggcccagcccccuccugccuggccauuugggcacagggugaucacagcccggcucaggaguucuauuccuggcucagccagcaaacugcuuugugaccuugggaaaguccccacaccgcucagaccccaccugugaguguucccgugaauaacccaagguggcaccuuaaaagcaggcucagcucaaagaagccacguggauggagcgggccuggaagaggaaggaccccgugucucucuggcugcaaugcauagagaauacccgcagccgcccucggaggccacagagacccagagggguagccaggcacggcuucaaggggcucacacaggagggaccuugccagguccccgucacagggaggacagcugccgcccucccauuuuagagaggaaaagucucagagccuugcccaugacuggggugacagccucaucugucuuccagguggcaagucucuguugcccaggcuggcagugguacgaucauagcucacugcagccucuaacuccugggcucaaguaauccuccugccucagcuucucaaguagcuggggcgacacgcacaccaccguguccagccagguucagggaucuuaagagggagagaaggagaaagagaaaggaagagaggguagggccugugauaaaugucucuuccaucuccuccaacugccucagcccauuucuggcaauucuucagguccagagaaggccacagaggugagaugcaagaggcuugugaucacagguggccagggaagcacgcggccaggaagccagaucccaagaugcaccccacugccacuuccguugacucacgauccccaaacuucacucugcacaagaaccagcuggucccgugucaccacccccaccucccucacccacauuccagauugggggcagguccagggcggagcccaggaaucaguauuguccacagguagccccugucccagcucuaagggggugucugccgcucagcccuggggaaccaccccaugacaccagcucaccucgucaucugaccuguggcgugaucgucuuuuaaaaauuaauuguaauuuauuucuucucccccgccucucucuccaaaagaaccugaagcagcaucaccaaccucugauaucgagauguguuuauuauuuuuaugguuucuccaggaagcgccggguaacucaaagggggaauuuuauucagagagaauuggguccccaguguaagucaacauuauucauuuaacaacuucuaucggcgcacgaagaugugagugggccuuacccgaagacgucuccugcgguuacuggaagauuuaauucacaacauccaagaaaaauaauugagggggaguaggagagaggaggguauggagcagggccuguggcuuggcaguuucuugugccaaccacugccccgaugcuccaaucaccgccugugggcuuugucauugaucacagaccacaggucccugcuccagcaaacaaggggccauguccucauccagaggcugcagaacggacgagggggccgcaccacaaagcccaucuggacagaacuuuuggaagaggugacagccaagauccgagcagccaagccagcccucccagcacucaaugguugcgggaugcaaacccuugccccaugccuacuugggaggcccacguggccuggagccccucuuggccugccugcccagaaggcgucuucccuugccuuugcugcaaugcuccuugguggcugagggagcccgggguccgggcacuacggauuagaaguuccugcucagcuauuuggagugcuggugcuuucuuaagcacauucguuuuaaaguacacuggcaaucucugaaagaucaaaguugguuucuaauaugcaucguuuggaggcaggauaccaagcauggagggccagacacgcggcucugggauggggcugggcauucuccugaaagcugaugcccacagacagggugcaccaaggcacagggaccggcucucgugggcagcccacccgaacugcccugcgcagcugggugcuggcaaacccaggcacagcacauggggucccagagagcaggagccagcugcaaagaaccuucugggcccucuuguccagcccuacucugcugagagaugagaaagugaaaaaaaaaaaaaaaaaaaaaaaacaaccaaaccucaggccugggagagaaagagagagagaaaaacgccgaugccugcacacugauuuuugcagaugggauacaccucccugaaacaguccagggucagguuccgaggaaucgcuucuucagugcaccagucauuuugguauuuuauguuccauuuuccacucuccucucuaccauuccacaagaagcaggacacccuucugaauacccugagggccgaucucuacccguaagaaagguuaagcaccugaacccaagucacacagcagcagagaagaucaaaguucaaaucagauucccagcucauucuccuacagagcgaaugcaaaaagaucuaaccugagaccaguaauggcugaggcuggcccaucuuuuaguuauugaagaauccagccaggcgcaguggaucaugccuguaaucccagcacuuugggaggccaaggcaggcagaacacuugagcccaagaguuugagaccagucuaggcaacauggcgaaaccccaucucuacaaaaaaauacaaaaaucugccagguguggcggugcauaccuguaguccuagcuacuggggaggcugaggugggaggauugcuugaggccaggagguugaggcugcagugaacuaugaucucacuacugcacuccagccuggggaacagaaugagauccugucucucaaaacaaauuaauuaaauuuaauuuaaaaagagaaucugugugaguaaacuuguagaauacugcucucugacagaacuuucuucuucuuuuuuuuuuuuuuuuuuuuuuuuugagacagagucucacucuguugcccaggcuggagugcagugggacgaucucagcucacugcaaccucugucuccuggguucaaagcaauucuccuggcugggcacgguggcucacgccauuaaucccagcacuuugggaggccaaggcaggcagaucaccugaggucaggaguucgagaccagccuggccaacauggcgaaaccccuucucuacugcaaaugcaaaaauuagccgggcaugguggcgggcgccuggaaucccagcuacuugggaggcugaggcagggaggauugcuugaacccaggagguggagauugcagugagccaaggucaugccacuguacuccagccugggugacagagggagaguucaucucaaaaacaaacaaacaaacaaacaaacaaaaaaacaacuacaaagccauucuucugccucagccucccaaguagcugggauuacaggugugugccaccacgcccagauaauuuuuguauuuuuaguagagacaggguuuugccacauuggccaggcugaucucgaaguccuggcuucaagcgaucugcccgccuuggccucccaaagugcugggauuacagcugugcgcuaccgugccuggcugaacuuuccaugaugaagagaacguuguccaucugaacuguccaguacuggcacacauggccucuaagcacuugaauuguggccagugugacaaaggaacugaauucuagauuuuauuucauuaauuuaaaauuuuaaaauuaagcauaaauagauaguggcuacuguauugggcagcauaauguuagaauacagaaacaacuuaaauuuucugagccaacguuuaugauauuuggucugugagguguaugugggcuuauggagaaaacaaggugggccaccugaaggcggaaucuuccugggaggauuccagaacacacgagcacacacaugaugaacacagugagccaggugcccggcugcugucaugggagucucucugaaagcuugagucuagaagcgucacagaagucugagaacacugcuccuccccggggaacuaucuugaggcuucauuucccaagucagugaugcguucugcagcuaaggugggccaggcccccuccccucacguuaggcggaccaucaugcugaugugagaagagcagaugcauccguccuucgagcugcgaugcagcggugggggaggcagccacgucucugccagagaaaagauccuaccuuuagaccaaauguagggaccacggauagacaguggaugagugcauggguugagggacagauggguucagggguggacggaggaauggguggauggguagauggaugggugggcagaugggagaaugggugggcggauggaggaaugaguggguggauagaggaaugggugggagggcggaggaauggguggguggguggaucggugggcagauggaagaauggguggguggauggaggaaugggugggugggcagauagaaaaguggguggguggauggauguguggguagauggaagagugggugggugggugggugggugggugggggaauggauggauagagggauggauggauagaugguuggguggaugagugaauggcuggguguggggauagagagaggaauaggugcaugaaugaaugggugggugaguggaugggaggaaggaagggagggagggagagaaauagaugaaagguagauggguagaugauggauggaggaauguuaaaacacagaaaagaucuggcauuacaaagucccaaccacauggaacguguccuagaggcuccucaacaggcaucagaggguuuucaggaaggaacauaccaguguuuccugaucaacaagaccaugaggacucugagccagcuaucugcccugagggguucucagccaggaggcacaacccucuccaccagccuaagucucuaagucuccgcagaggggccuugggcauucaggcugugucugucaaacugaaaaggagaagcugggcccccaaagagaaaggaugcagagaaaggaugcuuccugaguuucuccagaggaaaaugcuagaagaccccagguaauaaagacccuuggggcagcgugugaggccugggcagggcuuccagaacgcagucuggaggggaugcaggggccagagagcaggaccaugugcuggucuguacucgagagagacaggaaugucccagccugugcgggccccagagaaccugccggucuguacucaacagagacaggaacguccuggccugugugggcuccagagaaccugccaguccgaacucaacagagacaggaacguccuggccugugcaggccccagagaaccugcccuuccuuaccgccccucugccuguuccccuggcccccugguuucuuuccaaggcuccucauuccugggcccuucccauggcacugguaccucuuccuucagcauguucagcacagccucgugggccuccaaugaugcccaaggugagcggcgcuggcgcccuccccgggagcgggcaugaccagcagucacgcacucaccagccacagacacugggccuguguuucgugcaggugucacucgacagacuuuauccacauucuguccuuugauccuccuaauaggcccagaaggcagggacaauaaugacuccuguguuacagaggaagaaaccugcucugagaggcugagaaacuugcucacaucccacagcggccaucugacccacggagaccaaguucgaaccugcacucugauguaggaagaggcuccacgggcguuugcugaaugaaugaaugugugcguguaugcgugagggagcgagugaaggaaggacaauuugaaaccguuccugaagucuaggagcuaagagcuugcuggaaggacagcaugaaaggcaggccagcagccccaaggaaggcccuggccaggcgaccguccagccagggagccacaauuccccuggagacucagggcucacagauggggccuggggcauggaaaauaaaggaggcuucgguggagagcagauggagaagcugaccgcgguggggcagggaggucuggcgguuccaaccccugcccgccuguccccuccgccccccccccccaaccccccagggaucgggcccaggcccuccacagcaggccuccugcccuggcccaucggggccaccgacaaccggcaggcaggccaggccuugggcagcccuggcuggucccccuccuccuccaggccccuuuccucccucccuuuucugcaaagaagucaaauuugccacucugaugcauuaaccaagccggguaaugaauggcgaguguguggugugcccgcuuggagagaaagaagcgcaggccaggcgcggaccccagcaaccgggcaauuuuccaggcacugcuuccgagccccuccauucagcccccuccggcccccccagaagagagaagcagcaugcucugucaucagaaccgcauuguucuggccagaagaaaaaacggguccagcagauggcagguguaacaaaagcagcuugcuguggccaaaccaauuauuuaucuaauuaugauuuaccacuuaaccacaugaucuuucugcagaguugugggcaauuaaaaccagggugacuguguggauuaugcaaaugggcuggagcccagcgaauaaaauuggagauuagacauucacacaggcaggcgcuagcacagggcagcccugguagggggggagugaggggccgggagggaggggaggcuaaggggccgggcuggggagggccagggggucaggacguggaagcaggaaggagaaggagaagcaagggaaggggaggggaggacgggagaaggcagugggaacugcauccucccucaaguccccaggcugccccugaaugaugacaucaggccccugggagagggaaaucaaggcagcugaccugaccagcccugcagagagccagccuugccaggcccuggaggggaggcacuccuguggccuccagagcuugugcugggccccauggagccagggcacucucugcuguggaggggaggggcgggguggggcaagcuggccccgucccuccagcuggcugccccacagugagagcuggcccgugggaccagguuugguuagguaggcggcagccaccacaaugacccacucgauagaccaggaugcccacgguugcccccagcucugugacugacccagcagcugugugaccccagccaguuugcuuguggucucugggcucaguuuccaaacaaaaggacuagagaggaugauuccuucacuucccugcagcuuuaaaagauggggugacacucuccaauagccaaaugcaauccaagucucccagagcuggcugaacagagguggcggggccuggagagagaggcagccaugagggaguccaggcacccucgccuagagcuggucuccuccacccagagcgcccccacccacacugcuccgaaugcuuagggugacucauccaguuaagccuuccaaaaggucugcaaggggugccgucaucaucccuauugacugaggcacagagagguucaguaacuugcccaaggucacacagcuuguaaagggcagagcaggaacugucacgcauuugugccuucaacucaggcuccccugaaacgccaagcucuggguggaaguuaaacauaaaaaccgauguaaccaaggcccccauccuugaggggcugcauucugcuggagagaaauuucuggaucugccguguguuuaagcagaagaaggggccacggguagaaaugcuccucccaccccaccccugcaagugcccgggcaaaacccucccagacacgugugaaggccucugugacuuggaaacagcgucagugaagaaaauaugcacaggccgggcagaguggcucacgccuguaaucccagcaguuugggaggccaagguggguggaucacuugaggucaggaguuugagaccaacuugggcaacauggagaaacccugucucuacaaaaaauacaaaaauuagcugggcaugguggucccagcuacuugggaggcugagacaggaggaucacuugaacccaggaagcggaaguugcggugagccaagaucaugccacggcacuccagccugggcaacagagagagacuccgucucaaaaaaaaaacaaaaacaaacaaacaaaaaaacccgaagaaaaaaagaaaaagaaaaaaucugcacagaaaagcuccuccucacacggagcucuucccacuagcucuguacugacgggagcggggggcggggggugccccuggccgcaggugcuacuuagccuuaaacugacgugaauuaaaauuaaauacaacgagugcauccgauccucauugcuccagccacauucugagcacucuauagccacauguggcuggaggcuuccgauuugggcaucgcggaucuagaacauuccaucaguguagaauguuccagcagacagcgcugcuccggaaagucagcuccaggaacacgggauuuuugucuuuuguuggugaugaauuccuagcacccagaaccgucccuggcuguccauuuauggaaugaaugaagaaaugaaacgccucuucuacaaagaacaacaguugauuuugaaaaggagccgacggagucccggugagguccggacccugaguggcuggucugccugcagccaggagcccccagcacccccagcccaugcccaucucagggucagaggggaggcuggucuugccacggggggcacugccgacagccaggugacugccuccaggaccccuccccagcaccgcugagcccgcaaggcugugaggagcaaaagguuggcuguuugcaaagaaccaguucccaccaaggcuccauccgcaucugggagucgggagaaaaguuagagccacugggcucccaaaucucccuucucuuggcccaaacuaaccagccucaucuccccacuuucugaguuggggcccucaguucuaauucaggcugggggugacaggguagcaacuggaggggaaacuagaguuaaacaauuaaacuccuggguaccuccaggggcccuggaaauaaaccaggagggcccgacagaggccccuacaccucaaccccagggucaggcgcuguucucuggauccgaugaaagccguggaccuucugcuaggacuacagggaaggaccccaauuuugccaccaaugucagggggucuguaagucccgauggccucugcccuagcaucucuucccacacgaacaagaguaaggaggaaagggcaggguggcccucgggacacaggcaccucaaaugcccugugcccugcuccccaggagggcacacagcugugggcugucccugguccagcuccgagagcacgucuggucccccccaccgcaugucagcaccgagugcggcccaagcuucaucccagggauucucggcuagcccuggggaaaacgggguucccauuuuacaggacggaaaagaggggucccaagaggcagagugagcugcggagggucacagagccaaaugguggugcagcguggccgggcgggagcccaacacccacuucucccacaaagggcccgccacacaugcuccacacacacuccaucccucccacacgcacacgcugucucaaacacauucacauaucacacaugcucaaucacacacgcucacacacaggcccacgcauucacacaugcacacaaugucacacaugcucaaucacacauguucauacucauucacacgcgggcccagucacacacgcaaugucacacaugcucacacaaucacacacacacucauucacacacaggcccaugcguucacacaugcacaagaugucacacacgcucacacaaucacacaugcucacacucauucacacgcgggcccacauguucacacacacaaugucacacauguucacacaaucucacacacucacacucauucacaagcaggcccacgcguuaaucacacacacucacauucacacaugggcccaugcguucacacacacagucacacauguucacacaaguucacacucauucacacgcgggcccacacguucacacacgcacacaaggucacacauguucacacaaucacacacauucauucagugacauacacaaugucacacacauucacucacacgcucacaaucacagggucaugaucacacacguucaauugcacaaauguucaaucacacgccucacacacaccuucacaaucagauacauucauaaacacacaguucacacauucacacucacgucucauguucauucacacaggucacacagucucacauucacacaugcauucacacaccacacgaucacucucacauucccacaaugucacacacguucacauucaugcucaaucacucagguucacaucacacacauuccuucacacacaaugucucugucacauguucacaauaucucacacauguucacacacauucacacauauucacacucacauucacacacgucucacacauauucacacauacauucacaaugucacacaaguucacacauguucagucauccacauucacacagucacauucacacguucacacacacacaauaucucacguucacauuccauacaccgccauacauuugcacacgucacacauacacauucacugacauucacacauaugcgcauacacacacacacugggucacacaugcucaggcacgaugcuucagaaauguuauucacuuggagagcugguaaacaaauaccagggaccccccgccccaccuuccagagaugccagggaaacucaacccaccagguucccgccauggcuccucuggaguucuuccaaaagugcccaggcuccacccgcgccgugucaaagcucccacccagcccaggcccugcccacccagcauccaggcucugcccagcguccagggcucucagguccacagcccucucccucuccaccugugugcacagcugagaaacagggcccugcccgaccuagaagccacccacaaacccuccccaccccagcaggugcucagguggcauccugggucucccaugccccaggcaggaggucuggggugcagaguggucaccaacguuccuuucagcuccugcuaggaagccgguggggguggggccugaaaaguccccagcugggcagagaggagggagggaggggagaggcggguacacggggaucccgggaaggggaggauuugggggccuggaagucagcacagcccauggcccuccuggcaugcaggaguguaccccacccgcagaugugugaguauaugugugaacauguguuagugugaacgugugugugaauaugugugagugugaacaugugaaagucccuggggggacucucauuuccccagagcugugcgcacagcugccccccagggcaguagguacagaggccgagggccguuuugggaggcagcaggccucgggugcuuaucugggcuguccucagcccuccagcguccccgggcccccugacaaaggccccccucccuccaggaaagugcuccuuguuaauaacggccacggcagauuucgccgccugcccaaguugauaggagauuuaugcagcccgccaagucgggaaauacagaaauauuccugauaauacuucuugucccagcaaaggucacagacagggccuaucaaucccgagaaauaaagaagcccccgguuuugcuuguucucuggcgaggcaggagaagagcccuuucuuuaaucgccucauuuggagcacuggccgggguuguaugucauccgaauuacagauucagcauuaauugaccagauguggggggcucuuucagggcccuugaggaucauaaagccguucccacacugguaauuagcagccuagcaggcccaggcugggacacgggccccccaaggcccgcagcggggaagggggggccagucagccagugagcaugugcugccucucucaaggcccagggacccccucaagagcggccaggcugguggccgaugccauguagggaaugcagcguucugggaagcugguggcagccagcagugggugcauucuuuggcugacccugcccuccugguggggaaucgagcgagaugcaagaggccagcuggggagaggggcucaccccagugaagugaagcuggcaaggacagcgucgcccaccaccaaaggggugggugcagcagugaauccccuggccucuggaaagaggaggacgaagagacacugccuccccuguagagaggcgggggacggugacagccaggugaccaauuacgaugaccgagggcauccacaggggugacguuacauuuaacaaccagcccggcaaggcaggggcugaagcaagguggugccugccuguccugcaaaaccuuaacucuuucaccguccagacacgggaagggcugggggagggggcccaaggguccgggaaggcuuggggguagggcgaggaacagccucuuugccaaccggcaggaaaguccuguaacauuuuauccgccaacccagacuaaguaucccagcccucuagcacuggcucccugaggaacagcuggggcaggagaggguucucgguggcagaaccuuccuggggauccuugcaacccauacuccagccucugcucagugauggggcaaaaccaacagggggccugggcugagcugagaagcccccaccucgcccaggaucguaccuggauguaccuaggccgaaggugugaagcccccgcuguguccccaggagcccagcaggugcacggugucccucccccucccccucugaagccugaccacccacagccucacaugcacacugccgugaucaguucugcugugauguguuuuaugaacaugcagaugguacggccagggccgggggaagguuuuuaccuugggauaagaaauuaacacuggcuaauagcaaauuuacugcauguauuuucauuuuccuaauaccagcgccaucugcuagcaauuggggcuccacaucgccguuucccccuuuauuucucccguccgcucuuuccuguuuucaucuuccacggccgggcccuccagaccauggggucuggucuggggggggggggguuucguccucagaccagagcgcccacacugggaccagcacccuguacccucccgccagaggccgaggcccauccuacuauugucuccuccaggcuacaagagauggaggugcccccaccacacacacaauucugcaucuuagaggggugaugcgagccuagcaaggaacagccuguaaccaacccucacucucaaccaugguagugcaaucaaaacagcuccauccagcccccuggcagcugcgggcacuuacuccucucgcgcugcaugcuggaauuauuuaaaauaagaaaguuagcuacugugccuucugcacugagcucgccugagcugggggaguagggaggggcugccagggggccugggggcacggaggagagcccaccggcuccgggguuuccugcagcccaggagaaagaggcccuccaugccggggcuguggacgggggucucacacggcugcucucagaggugggaggggugauacuuuccacaugggaagccauggagcacggcagucgggggggcgcgggggccggcgucgggcccgugagcacguuguaggagcagcugcgacucuuggccaugcggccuggcagugggacagcugguguggcccggcucccgggagggacuggauccauccugggagccccuggaagaacaaacauaccagggccgaccgaugaugacgcucaugaaacagccuucgggcugagcccaugggaaggcgagaucagagagauggggcuggaggagaggggcugucccucccggcacucggcacucgggaaccucacggacaaaggcauccaggccagggcuccgccguccgaggcaacaccuaugucaugggcuaaacugugucccccaaauucuuacgcugaaguccuaacccccagugccacaaaaugugcccucaucuggaaauugcagauguaauuaauuaguucagaugaggucacacugggguagggugggccugaacccacugacuggaguccuucuaacaaggggaaaucuggacacagagacagaugcagacagcagaaugaugaugcgaagagacacagggaacggacggccaaguaggggagagaggccugccuggacagacccuucccucccagcccucaaagggagccagccuuggggugaaccugcaccucccaccaagaugcaggcucuucuauuacccccauuuacaagugagggaacugaggcacagagagguugaguaacuugcccaaggucacacagcuaacaauugucagaggcaggaagugacccuaggcaggcuggcuccaaguccacacuccucacacaggucccaagucgcacccugcagccaaaggaaauguauguggaucagacacuuaagacacuggcugggaagcucucagagugggaugaugcucgugucaucgccgucagcucuauaaacaaggaaagugaggcccagagaagggacggcacuugcccauggccaugcaggaagaguuccagaaccaggaugggccccuugggcccugcagcagacugcaaugaugggaggggucuagacuggggcugggacagggcaggaaagucucccucccuccuccccacauggagacccagcugggcagaaagacaccccaaaggcaaccacgugccaaagcgaguguuuggagaaacguaggcgacacagaggagaguccugcuguccugggcguacuccauggggucucacggcacgggccuccaagcucaggggucaugccugggcacccugaaaaugcccucucggcugccauacagaagaaccgccaaaaagggaagagagaaggaaagccccagggcagggcuuggagccauccuggaugggccucugguuccuggagcccuuggggaccaauggguagaagccucuggaccccaggacgccggugacacacagcagggcaggcagggcugcagcagggguuccugcaggccagcacguuuuuauugucccauccucuguggccucgccagagacaacagcagguggaaagcggcaaacggcucagcagcugaucacgccuuuuuuuuucaccuuuuagaaaauguccucgcaacuuuucuuucccgucagugaaagcuccugccccauacgcuggauuuggccuuggaagacgaggucuucggacuucccuggccaucucuggcgcaucccauuaccgugacaacccgggccacguggccccacgguuugccuccuuggagguuguggauggggcuggaggggugggggaaggagugcagggggcgagggucuuggcagccuccaccuuggcacgcguuuccauccugcagagccacccccacacccugcucagccgugcugcucccaccaacuuuuccggccagagggaagccaaugcacgagauuagaggauaaaauuugauuugaaagaauuuuaucguucagcccaaugaugguuuuaaauauuaaaaaggcauaaaacggagggggaacggaaaagcaguaccaaguaccagccucagauggcuuucgccaaauaacgcugccaucugagaaagaacgcgugcggggagagggaggggugggggaaacugcuccaccuccccgauccuacugcuucgcaggcguucucaaagcagcauccuggaucucccaaaccucacggagacagguaauacauucacuauugauggaucaguacccggagaguguaaauuacugaaacaaacacggcauaauuagggcauuagaggcagcguggagggaaggcggggugugcuccgcuuggcuguggcuuucaucuuugcagguguucaucuuggugguagccagcaucccagccugccuaccauaugcacaucccagcuagccaguucucagcugggaggcccacugggaacucccuccugcccaaaaagaggggagccaggggccccgaaccagccuggcaucuuggggaacacgcagagggggaggaaggucuccaaacagacaggggcccacgcaccggcacgcacgcacacaaagacccaaggccagucugcgggcugugcagcuggcgagccuguguccccguccccaugcgugcccucaggauuucaugacaagaaugaaacugaucaggcagccuccagcuccauaauuagggccaauugaaggagacaaagaaaucuauggagaucacagugggaagugguagugaugaacgcuggcuuugaaacagcguuuuguacucacuggaccaucacugucuuuacauaaaagcugccugccuccuuucccucacuccccucccugggagcagaggccgccggggaggcaggcuccagacagccccuccagcaauugccuuuucugggucaggccucauuucucguggcacgacaggaggaggacggggggcgggugaggccuccucuuuuguuuuuuuguguuuuggcaguggguaaagacaaaaggcaggcaugaaaagcccccacucucacaugcaucugaauaugggggugcugcaggaaggugacucacucacuggcaugcugggagagcacagggcccgugugugaguuugcgugcgaaugugugagcaugugugaguuccugcgugugugacuucaggcguguguguguguguguuuguguguguguuggaauggggguggggggcgguccuggaaaggccgagagccuuggaaucugaggagucugcagcccauucuugauacugcuuuacuuuccaaaaaguuaugacaacaaaaccacccuggggcccagaccuggaagccgucagcuauggaggacccuggaagcaggcagagaaaggugaguuugagggaacaggaccaggggcugcuggcagagcugcagggcacagggcacacauggccaggucugccugggcagacagcucacucccuggggauccuagaaggaacccccaacugagaaucgcuguauguccugccuauuacccuuguaaucgggggaacaggguuggaaucaaagacugggccagcguuuccuaccgucccccagaauuccagcgggagacccccaggacaccacccucgcaggaggguguccucuggagagcuggggguguacccugcggggaggaaugaguggcuccaggaagccacccuggcuggcauccccgagacugugccagccugcucaagcacgcauguguggcuucccuccccgugcccacaguaauccuccgacuuuacagcaaauuauuaaaacucacuuauauuuaaucugccuucuggaauuaauugaauuuuuacgcucagcaaaugccacaguuugugcugccucccgaucacuggcucggaacagcuaaaugacaaggcggccgaccaaccgcaggcugugcagacaggcucucaggggugaaaaggcauuaagaggcgaggggggguugugcaggauggccccguccccaccccgacgcccugaaccguggagaagagaagcucaauuuaucaacacggggaggacugagcuccaggcaccccaggcggcugcguaagggggaacugggugucagcucuggggaugccaccagugcugacugaggaccaccagagggaggagccacccaggaagcaagccaggcagggcuccuccccucgccaaggaggguccucccaggggaugucggguccaaggaagcuucacccuuucccaagugaccgggcucuggccaguccccaaaaaggccccaagaacaccauuuccucuccugcacuuagcauucccaggaacccagcacgugggggcuuccccaucccccaugaaccgcagccagcuucugcaguggaguuccacccgaaggcgaagggauggaggauccaaggucacacugaauacuggcacgcucccuucucgccgagacacauuaauccagggggugccgacaccucgggggaggaggggcaauguuugcagagccccguucgggugcuaagugaauccucuuacauuugccagguuuggaguuuucagugcgaugacaccagcgugccugcggaaguggcugugucuccucuugccuccuuccccacccaauuccgccccaggagcccagggauggaggcccaggagacggaucccacaagagccagcacccacuccaccccagguagcuggcaguaucugucucuucaaucugacugaucacccaacuugggguggggagcuuugaaaaauguagacucccaggccccaccccagauccucuggcugggauuugcugggugguagaaacccaaggaaguuuguguuuucuagaaccccauaagauucggaugcagccagugggggacaggaacuucagcaggggaagccgcagcccuggguguagaccccauccacucgugccugaugcagcccuccucucaaggaagggcgagcucacugaaggggacaggucacaggucagcccaauucacccugagcacagaaaugcacacugcauuuaggacggccggauugcuggaccaaaccugucucucuguccccugcacacauaugcacaugcgcaugcacagagacgcaugcugaacuucuacggaagaggagagcgguaggaccaggcucuccaggguccugccuuggggucucuccccacaacuguggcauaaaccucucuccagaaacagagggccugauaacccgucagcuccccagaauccgaauccuaaaaggcucuccccaggguucguccggcuucagcagagacccuucccacccaggccggagcccugcauucaguugccagggacaccgugcaguacggcccccagcaaccugaagacaucaaggucccaucccccugcuuccaagcugccaaccuuccucauuuccugggugguggguaaggggcagggggcauggggcagaaagagauccucccccucucuuggggcuuccuccaccagcccccuccccacugaagcucccuucugaaggaggcuggagagcugcugcggagagaggagcccaugugggaugcccucccaacacacacaggcugaucaccucaccaaauccuuauuaaaaccaucccuguucaaaggcaaaaucagccaaccaccagugucccucugaccuaauguccagcagggcaagagcucaaugccuggaugucaccuccagggccucagcaacugugcaucucugcucaggcuaccaaacaaaacaccccagacuucguggcuuaaacacagaaauuuauuuucucauaguucuuaaggcuggaaggccaagaucaaggugcuggcaggguugauuuccguggagggcucccugcuuggauugcagacggcugccuucuggccgagagcucacgugacggagacagcgcacucucuggggucuccuccugugaggacacuaauccuagcagagcaggggcccacccugagaaccucacuuaaccauaacuauuuccuuagaggcuccauuuccaaauacagccacccugagggucggggcuuccacaucugaauuugggggagcacaaacauucagccugugacaaggauaccaacagaugucagccaccacagccaggccuugugacccaacaggaggcugcggugucccugggcaucgcuggggcaugucucaaaugggucuaaacccagucucucuggcugagagcagaggucugagaggcucaauggcaggaaggagcccaguucaguggggaggcagagagcacgcagccucccuccuuggcgggguucggaugcuggccagccuucagggcuggccggcugcugcccaaggccucccgcuucuccaggaagggcccucccuugcucucucccucucugcacucaccccuucucccucucccuacacgcuuuuccacugugagacuggaacaucaucgggacagcccagaauguccucuuccccugcaggagcucagcaaacauccacagagugaacauuccaagcaacauaguccaggagccacguuccagccauggggccucugcacugcuguucucuucacauggccugcccuucccccagaaagagagaagaggcccucucugguugucccaucaaaacuccacccuucucucacccuccucccagcuguaucccuucucugcagcccuaacaugcauuccacuuuauuucccuugucuacugucugccucucuaacuacuaagucaguuccagccgcuccaggauuuuugucuuuucaguuuagcccugguuccucagggccuuagugacuaguguguagugccuagcagccaguagaugcucaauaacugcuugcugauugacuggggugagcuccccauccauggagcuauuucaagccaagccuagacgaucuuucagggcuaguucuaaccuaagacuugguaguuccaugacucucuuccuggcccagaccgaaaaggaacuuucagcaggaacccgggacugggaucugagauggggcuccuuggaggacucugacuaggaagagagacgggaggccgcaccaaaaacacaagcccuucaugggucucccaggcguaggucuggggaaucccccaggccccucaggaucgacccugcuggcccuggaucuccaggacgcgucccucugaccugccugcccggccugugaguccccggcagcaaccgcugcagacacaggcugcccagcgccagggccaggccggauuaucauacauuaagacauaauuacucugcggaaauuuacaauacaaagcgcccuccccaaguuggcuucagaaggauuccaaggauacaaagaccugcugugucugccaccgacccaagcuggccccagccagaauuucaaaagaaguggguggguuaguuuuuggaaaaaccccauucuacccuccaggcagaagccccgccccaaggguagagcccucugauaccccaagccccacccagaggggaggguccccuccaccccgaccagcguugcuccuaaaccacucggguucccccaagcccagaagcuccaagcugacaccaccaaggucaccccacuucucccaaguucucucuuuuuagacuauuuaggccuaagggcagaaagaaccuuaaaucccaagaugcuagcuuuugaccugcagagagguguggcagcccacugacauugauuaagcgccugcugugugccugguacugugccagcaucaggaugccacagagaacaagacaaaccagaucgcugugcuggggggagcuuacaguccaguugaggagacgcaguaagaugcuaaaaaaaaaaaaaaugcacaucaggugugcaggaugggugagugaccggggugcacgguggccagagagccucaaagguggcaucugagcagaggccugaaugagcaagagagacuagccugugcaaaggcccugagguggggccauguguggugagggguaguggaggcagagaaugcuggcuuuuacucucaagaggguuuccagcagggaagcugccugauucgggggacacuuggccugcuguucuguuagauuccugcaucuaccaccuccuggcccugggaugcugggcaagucaguuagcccuuuaagcuuuuguuccucccugcaaaauaaaaacaguaaccacagcuaacacacgcuuguugcacagaacaagacagagaaagucgggaaagggagggccaugcaugugaggggcgggggagaagcucucugagccuuagcugccccacaugugaaaugggaaccagccccugccaacagaaggacuaaaggcccagugacuugugccucugucgucuggggagcccaggcacuuggagccuggcguucgggacaggcugccaccguuauccauggcauucaggugaaaacgcugaugaagggguaauuuaucccuccagccauaaaaccugggggaagccgcacagcaagcagcugucccggugccgcccucccaggugucagcgcacaauaucuggggcggcucaggggguccuggggagaggcccugccaaucuccuccagccugcugggugccagccagaguggagagcugggaggggccggaauucaacggaagaacugcaggccuuucagcagccuccucgcaggagaacaaaggcugcagccucccaacaccagguggcugacagcaaagaaagaggcucagagaggggaagcaacuugccuggagccacacagcgcacagcagcaagccgggcucugcaaaggcacggccaucgggcaucagcaccuguacugcugacuggcuuggaaggcucagcucaacugagaaaugcaaaaugcuggagccccuggaggacuggaguggaaaaggggaaaccuggaacccaagccuuuaucugcccugcuggggugggggacccgggcuucuuccuaaaacuccugggcaaggguagaaagaaacaucaguuccugagucaaggguagagccaggccaccccuuccuaggaugggugaucaggaccugccgggugacccucgaccucugugccacacucacccugggcaggugacugugccucucuggggucagccccuccucugugaaagggggauaaucgcagcgcugccuccugggcuagugcgaaggagaaaugagcccaugcagguacugcauagaguaggcgcucaauaagcuucagcucuggcuagcccaggauggaggacucuuuggauguccuccagcugcugggugggguggugggguccuugucacagcagaccugcccuggcuggcccugaagcacuuccuccaccacccuugcagggacagcagagaaaaacccaagugccccgaaugcacaccccacuucccugagaggaccgcguccucccuccucgaggugaucaccacugggcaggcugggcaccuccacuuucugggaccccaacuucaagggcaucagccaccaccuaccaugaagagaaccgcagaggagaagaccugccucugccccuggccgggugcccagggacggucagcucaccuccaggaccccagcguccugacugugaugccccuggccgggugcccggggaaggucagcucaccuccaggacccaaguccugacugugaugccccuggccgggugcuuggggauggucagcucaccuccaggaccucagcguccugacugugauaaucaagacagggucaccuaaagcccccaugcagggccugcauucagggaagggccugccugcucuuguaaaccaggcaguguugcaaaacuggggugggagaagcugugagagcccagugaugacccaggguccccgugucuaauccacaggcuuugcaguggcaaagcaagacagaagcaccaugauccccaaggacacaccagggcaucaguccccaagcaagccuggaacccagauuugcaaccccaggacacaacugcuuuuagucccuccuggacacuugggaaagaaaagcguuucuaaaacucuacaucaagaauaggugacccuucaaaaaaugccccguaauacccauaacauaccccugcucuuggcagggcuuaguuaggaagaaagggucuggggacagcuucucccgggagagcagacagucaauucgggacuugcuagaggaagacaugcggcccagaugucaggugauccgagcuccagcaucuaccccaggccucuagcagagaccaauaaggacgucuaggcuccaaaaguguggaaggggcagcguuuggcuucccuucgcuuuucaaaagcaagcccaccucuaugcucauuucaaaguccuucguuaagagauaaacuauuuccucguagagucuggaaaacccauuuauuuucaaauuccaguuacaucggagaccaugucccuuuaaaugugccuuucccucuggaauccaagagacuccgaagcauuugguaauauuguguauuaaggacgcaccauaaaaauaaauugcauuguaaaagcuggccucuuaacagacaaccuuagcuccaggguuaaaugucuaauuccauacuauuacccagagagagaucagauaaaucaaagggcaccgguauuccuggccuugcuccugugggccucuggccuggcacagaauguguuaagcagggcccaggauaagaaaccucuuccagguaauacucccccgucacugcucuaacaccaggagcaccuucaaaaccaaaugcucccaaagacagcugucagacacauuaaaaaacaggaaggggaaaaaaaaaaaaaaaacagaaacgaggcagcauaccaaaugccaaaauauaaugaaaauucaacagcuaaaacaaauauaaccauaaaaagacuggaauccuagaaaagcgaucucuacaauuaagcaguuuucugcuauauagugauaaucaccuaauuauacuauuaaugacaguucaaccugcuuugaaauaaaaggacauucuuccauaacaggaugccagcuguuaguuacagaugucaaacaucuuuaaagcauuauuauuaagggggaggaaaaaaacccuauaaaaugaacacauccauaugccccucccgcccgucaugaaaaagaaaucgcaauuagccguguguuuuugcagugcccaagugaaaaaauaaaaauaaaaugugaaagcccaaggaggagaucagaaaagaggggagacgagaggggagacgagagggaagccgguccccacagggcacacagcaccagagcgaagcaaggaggggucuguguguauuuuaacggcauccuuaauuccuuccaaugaaauaaucuccggaaccaggauguuuaugccggauagcagaucuccuagauuccgccagaacuccccggguaaacacaaauccuggagugccucguuugaaagcugcucgccacagccaaagcugggagcaccgcagguugcagagguggcugccaccugccugcccuggcccuguggacauaugcucagccucauucccugccaguauuucuucaaacugugcgugccucugacauucuguagcgccaaggugugauaaauauccaacuuugucuucugacaauaggcagccacauuuaauuaacuggagcguaaaaagccggggggcgggggagagggggagcggggagccgcuccccagcgaggggauuaaccuuugaagcaagccgcuggcagggcaagggggcugcccggccuugucgggagggugcgaagacaagcuggcucaaucuaaagaggggacgcucaggguuaaaucccccgccugccuggagcgcagaucccaauauaaccagggcaggcuccagcagggagcccccaaggguccgugaccgaugccugcugccucccacccuggcuguagcugggugaggaggagacccaggggaccugaagcacaggaggagaccagccaaaucucagcagagccaccagcggacaggacacaguguuuuccgaaggaaaaaaaacaucuggcacauuccacaccagcgccuucuugggcucuuggcaucacagcccagguguccucuggaggccgggcggagaggcccagaaaggaaugaccuaggcccagaaaggaaugaccuggcuuuggguguguucuacgaggucacuuccuguagcuuucugaccccggggccucguccgaggcggaagggacaacuucgcagaguucggcuacugcugacgcgcagggaguaagccucggguuuugaugggauagcagacagguggauugcagagcuccggaaagacccagccgggugucaagaagagcccuccuaguuuggccucuaacuggcugugugaccccaggcaggucacuuguccucucugggaagcagcugaauaaugaacacugggauuuucccaggcuggcuucucacugcagagcagaggaaaagcauucugggggccugcuauggagggucauuuauccaguuuacaacuuccacggccggcccucaauggcuuccuuucucucccacaagagcgcugggccaagccagcucugcaccaguuggacgccuuccaagaaaaacucaggcuccgggggcugcuugucaggaccagacgggaggccuggcgcccccgcccgccauguguggggagcgggccucucccaagccaguccccgcgggggcugagcugaugggauguccugcuucuucucuggccaaagagacggcgccacgucugcccgaguucuccugaaauucccacacaaggaggguggcagcugucaccugcccuucccagcuuuggucucuuuuucuauggaauucagcuuuggaaaacauuuucuugaguucccaggaaguuccccagaaacacagggaggacacucacucacaauaacuccaaucugaggcaacugguggccggaggaggagaaaugcuucccgggcccagacuggcacaaaccagugcgccugccggcucccccuccggacgcgcccacugugauggcuggguguugcuauuaauagcagcaaugaaagacaucauucagcuccuucaaguuuccaaauaaaauacgcuacuugauacagaaaaccagcaggaccccaggacacagcuccacuucacagcugggaaaacugaggcucaggaagagagucuggcaguuccucaaaaaguuaaauagacuuaccagaaggugcagcagucccacuacagauacaugcccaagagaaaugaaaacauacagacacacaaaaacaugcacgccaguguucacaacagcauuauucguaauaaccaaaaaguagaagcaagcugaacgucaucaacagaugcauggagaaacagaacguggucuauccaggccaggacagacgacuuggcuaugaaaaggaaugaaguacuagcccagcacagugcagcgcacccguagucaccgcuacucagaaagugaacauggcuugaguccaggacuucgaggccagccuggacaacauagcaagacuucauccuuuaaaaaaagaaagggaugggccgggcgcaguggcucaagccuguaaucccagcacuuugugaggccgaggcgggcggaucaccugaggucaggaguuuaagaccagccuggcaaauauggcaaaacccuacuaaaaauacaaaaauuagcuaggugugguggcgugcgccucuaaucccagcuacucaggaggcugagacaggagaaucucuugaacccaggaggcggagguugcagcaagcagagacagcgccacugcacuccagucugggcgacagagggcugccggcccucugcaugugugauuccucucuugcaaugcccugacuugaucaucugcagguucuccaaagugggccuuccuuuagguaauagacaaggccccacaccucuuccagaaagcccacaaugaccccuuggcuccccuuucccggaugagguccuggagcagcaggggccccuaggguugggggagcccucggaaaccgagggaggagaacuggguuccggagcagccccugcuggguucuaagcagcccaucccaggcacaucauuuaaccugcucuggaaaagaaggcaaggcacacugugcucacacacagccugguguguguguguaugucguguuguguguugugugcacguguaugugugugcgguguguguguggugugugugguaugugguugugugcauguggugugugugauguguguugugugugugguaugugcuguguguuguaugugcugugugugugugguguguagugugugugguguguuuguguguggggguaugugguguguguggugugugauuguguguuguguguggagggguauguggugugugugguguguugugugguaugugguguguguuguguguggggguaugugguguguuggugugugugugguuguguguggugugguguguuuuguacgugugguauguggugugugcgugcuguguguguuguguguguaguaugugguguguguguaguauucagugugugugugguguguugugugugguauguggugugugugugugcguuguguguggugugugugugguauguggggugugggggggugugguuguguguauggugugugguauguguuguacgugugugugugugcuauguguucuacguaugcaucacuagacacuaguacugauguccuccaggguccaccugguccccacauccaauaccacuugacaauggaaaccacuccuuccuucaugaaacugccacuuggugguuugugcccccacgcccaacucacuuccccauuucauggacagccaccgucucucagauuccaaacaugucccuugcugccagcuccucccugggccuggccaccgacagggacccucugcagccugagcuccgccauggccucugcccccacgccucugccucccuugcuggggccuccugcagucucugaccuguuucucccccucaguccuuccuguguuuaaugucaaaaggucagucagucaggucccugcuccaggucccuguggccccaaacacggcaaagaccuccccacuaggcucucaagagccuccccgagaagacccggugacgcucccaggcccgugccaguaucgcuccgaggauugcaggcccagccuuccagcuucugggcugaggacuggcacgguccgguggaacuuucuggaacaauggaaaugcucucuaucugcacuguccgacugagcagccuccauccgcacguggcuguugggggcucaagauggagcugcugugauuggggcacugaaguuuucauuuucuuuaauuuugaucaguucaguuuucaggucugauagccacggaucuaugcuaguggccaccacauuaggcggugcagguccagugcccuggcuauccaaugugaggccucugggccagcagcacugaugccgcccgggccuuggaagggugcacgugacuccggggcucaagggagggaaguuccccugugccuuguuagaaaggcagagccuagggccccucccagacccgcugaauccgaaccuccccuuuagcaagauccgggucacuggaguacacaguacaguuuguggcaugcugagauaaaaaccacucuccucuucacaccucccccaccuucccuuuucaaaaguaaccaacgcuucagaaucugcuucaagcaccaccuccugcaggaaguccucccagaucacuccagccaaaaggaaacuuuccauccuccaagcgccuggaguuaccuguauccuuccaacccccagaaacuuggagucaguggcuugcggcugagcuccugccuccuccggcguccggcagggucuucgagagaauccugugacagacuuuccacccucccccucagccccuccagggccuggcaccaacaggugcucaggaacugcccuggcaguugcacuugcaagaagccaacgucucuuuccaaaccagggcaaggagaacaaaguugguugcgggcuauuugcguuccuauuccucccacgcggcucaccccaccggucugacccgcuggccaccucucuccgagagcccuagaaccugggaggugacagggcccugagucaaaggcaucaaaaucagaugaaaagccaggcagguggaguuauggguuucaauagccaaauaaaaccgcacaugcuuuucaugacucucucugcaggcugggaucaagugccacgacuuugucacacagcaggugucaguucucgaagugccugccagcaggccacuugcgggaacccccaaagccccagagaaucccuggcagaggcgggucaagggccaggucuuuccucuccccauugcacucccucuccuaagcacagacuugacagccucucacaugcugggaggcucugaggaccuccuccagcaccaagguccuugaagauggacacugaccaagggccaggcccauccagaacuccccccaccuuggaaggggcccucagaaccagccugugugccuaggacucuggcaggcaaccucucauuccaucuggccacucagcuagcccgacggcugcuucuccgaaaagcucacugcaagaaguggccaguucagccugggaacucagggccgcaacuguaucuuggcucuaaucccggaagccaccagaaaccucacuuuucucuguccuccuccgacagaggcggggauugaaacccccaccuccacccccuagggcucaggcaggaaguggccucaucuccacacagaggugggcggucuccagggcuuguauuacaaaugggucuguccaggcggugggcaggugcaaggccccccggagagacuggcaaagcccacacaggccugaugcagugcagaggcuuuccccaacgcacgccacggccacaguguaguaaacucuucgguuccugagaagcagggaaaacacacguaacacgagacggcagucauccgcauauacccgugugugcuggcacugagcuagggagucccaggagguccugcgcuggagcuucucucccagcaggaaauccagugaugaugacgaucacacagacgauaauaccaagagcaaguccgcccuuccugacagccuagacaccacacuaagcucuugaaauguacaaagccuuuuaauucucacagcagccucaggaaaauuauccuccacauuuaccacccaaguaaacugaggcccagagaguuucaguaacuugcccacagucucauacacaaggacucaaggcggagcaagaauucacauccgaccacuuggcccccaggcccaggggcucagcuacuaaauaaagagcuacagugguaggucacgguugcuuacuaucuacccaagagcacagagcagggagcggccacuccuaacaggagugagcacugaccguucccagacaccugggcucagcgcucuaggcagcaggaacagccuggccaaagguguggaggacagguagagaagggcaggcuagaguguuaggcaggguuggcccugucggggagaaaaggaucccagcagaaccaucuuggaaaaaaugcaaacuuacuauuucaagaaggcuugaauuugggaggaggcuccguugcaugccacccagaaagugaccucaaugacacuaaccaugaucauacuccagaaccaaagauuaucuguuaaagggacucauuucuaggggucuccauccuucccaggaggcucuaagaggggaguagaggcagagaagugggagcuuccggcuccuucugcacagacgucacccucauccacagcagcuccaaagugagaacagaccgcugugaacccagggugauccagggggucaagaacccucugauuucugcucccaucuugagcuggccccagcccagcccuggucgagcuucaacuuugcuaaugagcugugaguuaccagccccaccucuggaccaagaaacuaagggagugaauggggaaggguuucccaagagccuccgcccuggguaauaagcccguaucugggucacgaggcuggcugccugcucuagccacugaucaaccaacccuguacugaagucaacgaugaauauucaugagccuauccaguuccacacuuucauuucuggcccaaauuaauaauuuaccauggaguuucauaaaaaucagacauagcucauuaguagcucccuaaaaggcacucccaucuucccacugauccagugaggggcccaucuugccucugugacaagaaacaacacccuuauuuucagagacaacccucacuauuauuuucagagggcuggcgaaccugaaauugggggccgccaugacuguggaggcccaccccggaggccuaccagccuccccaccagggcacaaagaccucugcccucaaagcuccaugucacaggucuucaggaaacuccagaagcagacccuggaagaagauggaaccucuuuccuuccucaaggcaaggcuaccacucucuggaaacacauacuucacagaggauguggguggguggagcauguguagcugaugacauuuuccagagaggaaacaucaauugcaucucccaaaccccaugcccuucuagaaggguaccauucccccauuaagagguggagcccaggccaggcacaguggcucgugucuguaauccuaacaccacugggaggcuggggcaggaggaucacuggagcccaggaaugcgagaucagccugggcaacauaagaagacucugucucuacaaaaaaauuuaaaaauuagccaggugugguggugcauacgugugaucccagcuacuugggaggcugaggcaggaggaucacuugagcccaagagguagaggcugcagugagcugagaucgcaccacuacacuccagcccgagcaacagagcgagacccugucucaaacaaacaaaaagagaugaagccuaacuccccuccaguugaaaaugggcaggcuugucccucacuugcaaccaacagaauguggugugguacagccuucccuccgaggcuaggcccuaaaaggccgugcagcuuuccgcuugugagcugggaccacugccuucggagcucuggggccgccauguuuugaggaagcucaugccacacugaggggccacgaggaggcgucccagcguugagagccccggcugcggucuggcgaacagccagcaccaacugccaggccugagugagaggagccuucagacgacucgggacucugcacagcaaaucaccuugccucccagucuucccagcugaggccccagguguagcugggcagagaccggcuccaccccaccacacccuuucugaauuuccaacgcacagcagcugggagaauaaaacgauguuuuaugaccacacacuugcucaugaagucuuccuccaugccaggagcccugguccccugcagacccacccaccagccgccccauccccucccccgcaacgguuggucugaccugcccaccgacaggccggcacccuguggugagugcugucauaaagacagcacaggcgguugaaauccgccugugagugaaacuuuccaggagagaaauugggcggaggggggugggggugggggugggggugggggugggggcgggaguaacaccuugucccugggcccuuaagaucuaagauaaaggccgugacacuuccgacagugacacagguucuuggagcgggugagaggccuacgugaccgcccccuacugcccaugcaguggccggcccuuccgcugcggccccuccacagcaaguucaauuaagaccccgccauucucuccuccucccuucuuuuauguucccugccggccccccuuucucuugucagauaaucacgggaaaccagcaaacgguugacacaguuaccaagacgacagaaguuaggaccagcgaggaggucugaaagcuaauccuaaaugaauuacaggacaagaaugacaagagguggggaggguuggggccgguucaaaggccccagagucugagacaaggugccaucggccucggggcacuggcugugggccugucacucacuaagggugacacugaagucuucugggguuggggagguggaagaagaaaucuauaacaaagaaauucuccgcugaggccgggcuggccaauagcgcccuccauccagugacuccuggggcccaggguucacccaguucggcuuuccuuacaugggacgcaguggagagagggccaggacgaccucaccaggacgauuccguuucuucuuuacuuauucagaacuugccgccuugugaccacggcgcugugcguggccugggcuggcggacagccauuucaggagucugggcuucucaaagacccucccugcccagcccacugccuccaccaggagugacuuggccaggucucccagguggggucccccucuuccaggucauucucaaauccaagauauggacggcgugcagcugggagcaugacagcugggagcuaucaacccaaaugguaauugcagcucaggguccuacagcgcuuggucccucccuucugccaguuaacucaucgaacacugucagcagccccaggaggcaggcuccgcuacuggccccauuuagcagaugagaaaacagagauccagagaggguaaggaaccugcccagagucacacagccaguaaggagcagaggcaggauggaacccagugcuuaggcagcgcugcagccucagaaaagccugcugcccuggaacccacagggcccaccagaagacuggcaaggacacccggggaacccucgccaucgggacccaacuccuccuggagcauggccgagacccagggucccuccugcuucuucucacaccuucucucaggcuuuggccugguucgagcaccgcucaccccacagccugcucucaaaucuccugcugguguccagggucaggugaaggggucaggccuguucucucacuccagugggcacuggcauccccaggagggcucaugaacaugcagacuccacaggaaacagccuuggcacucgcugcccuggcucucucacccuuccccuucucuccagagcuucccucgagggacccuucgccaugggccccucgccggugugggcacugcacgaggaugcagcucugggggcuucucaggggcaucucccugugccuggccugcgcucccucuacacguguuaaacaagcacaggggguugguuggugguuuuuuuguuuuuuuuuguuuuuuuuuuugagacagagucucacucgcucugucacccaggcuggagugcaguggcaccaucucgucucacugcaaccuccgcucccagguucaagugauucuccugccucagccuccugaguagcugggauuacaggcacgcaccaccaugcccggcuaauuuuuuuguauuuuuaguagagacgggguuucaucauguuggucaggcuggucuugaacucgugaccucgugauccaccugccucggguucccaaagugcugggauaacaggcgugaggcaccgugcccggccaaguuggucgcuuuuaagaacccagguucccacucacugacaacagaaucgaguucaugugucaccggcuugaugacauucaagacccucuuaagacguggcuccgacccacuccccggcuucauucccacacuucaccauccccuggccacacucuccccaccccuaaacucugggcucugcuuccugccagaagcugugaaggggcccguccgccacacucccgcacgccuggcugucugaggacaaggacugggccuaaugcaucuaucucucuggccugcagagccugggaggagcagggaacagauuugacaggcacagcuaccccuuccgcacaggcucccucugccugcacauucucuccuacuguuccuuggcuucuggaaagggcccugcugccggacacccucugguccccauggugccucugaaggacgcacaggcuucagagccccaccccuagagggugcugcugagcaacggggcaggagugguggccuucccugccaaguccccacuggugaggaauguggguuuccccagaguagaaaggagagcucaaaugucaccuccgcucuguggccuucuuggacacagccuucacccccaucucaaaccaaacuguuuuccucugcacgcccagaaaauucuacacacaccucucagcaccaguacuugucacccugauuacucaauccaugccccccacacaccaccaccaacaccacaacgugggcagggauggccccaugcccagcucccggcacaccugacaugaaccuaaugugcugagucuuguaagagcaguuucccuauuucuguuccucccuccucacuguguuagccuccuuccucccagccucacucaccucgaagcuccauacuuccaaagccugcuuuuagugccaccuccuccaggaagccuuccuggauucccucugccaggaugcuucuaagaguuuccagagcaauccaucugugcucagcucucuguuugcucccuaagugacuuacagauaaaacauagaucuccucugcugcuccugcccaguggacugacgcagcgcagugcccggcacccacuggcgcaagcccugcccagcucacagggggccugacgggaggugcuugggaaggggaggcuuggucuguguccucagaggacaggacuaggucacaggcacguguucugugcgaaaagcaacaacauccuagcucgccacaguggcacagcccgguccaacccaggagcaggaccugcacgugcccagccugaggugaccacgagacccccaaauccagagaagggagggacagcccgucugaccucugaggucccucccaaguccaauguuccgugacuuccugaccccacaggccauuaagcaagcagccaaaugcccacugggcggcgguccaggccuggucagagggcgcuuccugucucacugugggagggagcagaggauggagcugcccggauccuucagggccugggcuuccggcagggcugagcuccagaauggggugggaucacccucuggagauaagaccuggaccuggcuuuacccaaaccccaccagugcccuacucccgcaaucccccagccccagcacccacucccagcuuccagcacagcuguaauuggggcugaggguaacgaccagcgccaaccccagcugcggagggccuggcaugugugggaaaaagccggaaaaauacauuuuccccuaaagacuuguaagaaaauucucacugauuuuuuuuccuuuuaccccaagcuuucacagcacuaaauaugccacacuuaguaauuuuacgagcaaaccaaacuauacaucacacgguuuuauguuccuaaauuaacaaaaggacuuuaaaucuauauggcgcucuuaaaagaaaaaaaaaaaaaaaggaagaggaggaggaggaggaggaggauaccauguggauguugauucccucacccccgaacucccucuucccuucgaauacacggugccccuacagcuucaaaauuucugcugauccugcagcuagaccaccaaaaggggacaaucccagacagggacaaggaucuguuuggcugaggagguccccuaagaggggaucccaucauccuuccugaaaggccacguuaagggccacaacagucuaaugauuuucccacaaagaguaugacaggacgcagccugguugauggagaggcugccucuaccacccuagucuccccaaaagucuaaggaagagaauuugaagucaacaggccugcgaggucuccugaccgcugugaucucaucuacacaaugccaggguagaccaggugacuccaucacacuugacauuggugagagggaaccccccugggaccgcuccccccaacacguguccauguccaggaggaagaugggcaagcgacacggagcaccaggcucaaagcaggaggccaaguccagacacguccuccccuucccggcucuguccaggagcuguguggcuugggccaccugccgcucccacccugcacuuuccccugcguagaaggacacgcauucuugccccggaauccagguaacauaaugaccauuugcucccagaguacaaagaaaccucuucugucuccagagucaaggagauaagaagagaguuuccagcgggacuauaucagguucccacccauggcguaacaacaacacauuuaagcaagaaaaaaaccuuaaugagaaccaaauugggcagggggggugggaaccagaccaggccccucggaaaagggcugggcugcagcugggacaaaagggccccuggcuuucccagccgacagauggaaccguggcggccuccccaucucucagggguaucggaagauuaauuagugacugccuggaaagugcuagauggaagccgaaaugccuguccccgcugaguuucugagcuguaaauaagcagcuuucucaaucacaacuaaaauagccauguuuuccuuuuaucugagucagaucccauuaggccuaaccugcgcccagagugggucuuggguggcuccggcgccacagcuaugguuugcuaacgucccaugacaagccugaggcuaugcaagaccuuggucccugcgggugccccguccccgccucggcuccaagcacccugggaguuggguuccagccugaccucaccuccagacaccacccccaacccaggugggccugagccccugccucacaccuugacuuucuggaagcaguuuagaugggugggaaauagaacccagcggcccccacaggccgagcuucacucuggguaccccagcucucagcaggggaagccucagccuccugcaagccccucccaggauggucaagaaaggggccuaggacaggccggaugagauauuuaugacuugcucuggccuccgggggcagcuggggccggggaaauguuccagggggaccccgaguccuagagcaaccaccagcaggcuucauggcuaugggccaagccccagcucucucugggccucaguuuccucccuggagggccgagggcagccuuucuagcaguggacagugauccugagggaaggccagggucacccagaguucaguguggggcugggguggggucagcugauggcugaggagucaguccucccuccagaaacgacaggaaccagauaaggggcucggagggcgccgcugccaacgccagcggccagcucccacucaacacagucaacaaauauuuaugaagcagggacucuggagccagacugcccaggaucggcgcccugcuccaccauuuagcgcacaugugaccucaaucucucuguaccucaguuucccuggcugucaagggggguaagaguagccucaccuccagagcuguucugaggaagcaccgugucuggcguggaaugggaauaguagacgaagcagccacugccucuuccucaugaauaauuuuuuuuuuuuuuugagacaaggucucacugucacccagguugcaguacagucguggaaucacagcucacugcagccucgaccuccugggcccaggugauccucucaccucagccuccugaguagcugggucuacaggcaggcaccaccacgaucgacuaauuguuucugcauuuuuuguagagagggguucuuaccauguugcccaggcuggucucgagcuccugggcucaagugauccacccaccucggccucccaaagugcugggacuacagguguaagauaccucgcccaguccucguuauuauuauuauuuuuuuuaggaucguuauuacuggcccggcacugagucugguaaaaaggagacacccagucugcgccagcauggggcuagcagccugguggaguucaggaaaggggggaucuaggcauacauacauacauacagaggaagguuugagaagggacccccguuugaauuucccagucgccccauuugcaggaagguggaggccacagcuugugcccucccacucaccagccccaucuccuuucacacaugccccugcaccuugcucucccugcagccagcauccccucacggcuaccauuucccccuggccagugaagaagcacuaagaggcagacgcuacaaccauggcggcaagaggccugguccaaagacaagaguucagguccccacuaagaagcucuaugacuuggccaggugcgguggcucacaccuguaaucccagcacuuugggaggccaaggcaggucaagagaucgagaccauccuggcuaacaugguaaaaccccgucucuacuaaaaauacaaaaaauuacuugggcgugguggcgcacucccguagucccagcuacuugggaggcugaggcaggacaaucgcuugaacccgggaggcggagguugcagugagccgaaaucucgccauugcacucgagccuggcaagagagagagacuccgucucacauaaaaaaaaaaaaaaaaaaaaaagaagaagaagaaaaaaaagcucugugacuugcugcaaauaauucuaccucaauaacaauaaugaccgugacaaaauaagaauuauuauuauuacaguuaucacucgacaagcgcuaacuucaucccaggcaccaucuucaguggaccugcucauucuguuucuugcaacagagcgugggcaaacuuucucuguccaggaccagacaauaacuaaagauuuuaggcguggccaguccagauggucucugcucacaacucagcuuggccauuauaaugugaaagcugccagaggaacaggcguggcugugugccaaucaaacuugacuuacaaugggccgggccauggauugcugacccuugccuuacacugauccugagggagauacaauuauggaucccaucuuacaaaugggaaaacagacucaauugagaguaucagucacccgcccaaggacacagcucaggagaggcagagccugacuucaaaccuacugcccagccucaguccucucaccugucaaacaggagcagcgggugccugaugccagccugacugugaacugccccuggggcaauggcuggacaggcggguucugggcccuugcucccugcagugucugggaucuggcaucaggcauagaaaccaaguccaagaggcugcagagcaccauggugucaggccucuguggggcagggucagccucucauccagaaccacaggcccgaagcaagccaugcuggcugcugcaccuggacccccuuauucccaguucaguguggcagacagaagccagcuucaugucccagcuccgccacucccaagcugggcaauugcugagccccugggucucacuuugcucaucugauaaguggguggauggcagcagcuaccucagagagaggaagugagaucuacagagagcccacaaagcauuuguaacagggccugagagcacucaagaggaccaggccagggcugggcacguaaagccuguaaucccagcccaaggugggagcccaaaguggguggaucaccugaggucaggaguucgagaccagccuggccaacauggcgaaaccccaucucuacuaaaaauacacaaauuagccuggcauggucgugggugucuguaauaccagcuacucgggaggcugaggcaggagaaccucuugaaccuggaagguggagguugcagugagccgagaucacaccacugcacuccagccugggcgacacagcaagacuccaucucaaaaaauaaagaggaccaggccacugccguuuccaucacucucaaugcguuaaccccagcccugggaagccacucccugaccauaguucuucccgguaagcccucacccugaauauuacacuaagacaauaaaguguaaaaccccaguggggacuuuaaauacaaccaccaaaaaaacuauaaugcggggaaagccugcauccacaggcugagauuuacuugugccccgaccuccccuccccucacuucugaccucucuuaaucucccugggggucaggacaaaagucaccccuccugccuacccacugggggcuuuacuccagccugggcugaucuuccuuaauggcuuugaauuucccagccugacacuuccuccuccucuuucugagucucccuguguaaacagaaaaucggucaccugaugaauaaauaugcaccagcagccuccaguggcaggugaagagggguguagauuacaaacaccugugcuuugaagacgcccuguacuuaagaagauucauucuuggcacaagcugguccugagcgccuccaaggcaggcauagcugccggggaggcacaagcucucugcuuuccccagccacagacccggggggagacagacgagaaaaacccagauacagcaugaggaucuguuucauuuugggcuaaagggcucugaugaaugucagcgcgacucagacccagcccucauuuaccuggaaucuucccaugggagagauagcucugaguucccaagggcucacuccgcccuccccuuacaaccuuuauuuuacuaaguuggggauucccgguucuaauuuggauuggauccgcuaggggagggagggaaaagcgaagcuugcuguuuguuguugcuuugcauuucaggcagaggaggagaaaaaaaaaagaucaagaauggaauggaaacgcuggaaaauauucaauauucuuccuaucaaaacggcauacacaccaagaaaaaaacauagaccuggucaguuacugggaacuaaaacagacaccacgaaacucaaaaagaguaaaaguacagauuuccuccaggaggagucucuccugccuuuuuuuuuuuuuuaagucaguuggacucuggugacccucugcccugcucuguuaacucagugaaaacguuugcccagguuagggcagcaaaggccagauccaagggagcuggguccuguccaggccccuuccugccccacacgcuccuccuggggacuccagagagguguggaagccucagcaaaagugacaggaucuucugaacagaggaaaaaaaaaaacccgaaaccgaacaccgggccacgugcacccuuccccagcaaaacaauucagaaauaaagcuccagggcagcgucuucugcagaauuuuauaaaagccucaacaugggaaaacuaggaacuuccccucuccucccuacacccccacaucacccuccccacccacacacaccccaccuucauuagguaccgugugucaaagcucaagggagaucaacucggagggagggaggaauaaaaucagcucauuccuagaaccagcagucacacgcagcacagccuuccugaccugcgucacguggccccaccuggggcaggccugugcguuucuccccgaccccagggggcacaggagugggggugacggcgcgcgguggggaagaacccugggguucaccacccagggcucccucgccugaauuccuggaucaccagcuuccauguagccuacacuuaauuuuuuuuaagguuuagaaauccaaauaaggugaauucaggaggggcuccccaaaccuccagcugucaacccccuccccuccccuccccuccaggcugaaagcgcgacuugccccgaaacagaaaguuacagggcaagcggcugucaccgcgcaggaagguuaaggaaacaggaagccacgccaaauacccuccugagcuuccccggcccccuccuccgaccucggcggaacaaaaccuuccagggaaucccaggcaggaaggggggcggcgggggggccggcgagccacgcucgcgccgagaccgcgcaaggggguuggcuggagggagagggaaauaaaccccaggacuggggggggggggggcaugcuacccgaucggggcggccugcaggaaaguaacuucacacucggcgcuuacuucaccuuggaagguuuaagugccucggccgcucgcuccgccgccgcggcggagccggcucccggcagacaaaaggagcgagacgcgcaacccccggcggcggcgcgaugggggcggcgggccaggugggcgcuccccgccgcacguagccgcgcacaccgcgggcuugaccgcagcgggaggauccgaggccgcgcgcgucugcggggggcaccggcggacccaaugccccgacccuggcucgggggucuggcggaggggggucgggugagggagggucccgggcgcgccggcgccgcgcgggacccagggaggcgcacggcucgcuuaccugguaaguaauacagaggcggcuucaauccaaacaugguucaaauuagaauuccauaguggccagagagggaugaagaaggaaaauaauauuaaaacccaggaaugaacaaaaagcaccguucaagccacggcgcucaaaaauguccaaaacaauaaaauaaaggcagaagagcgaucccgagagcgacgaaaaaaaaaaaucagucuuucccccccccgccccgcaagaugaucaaaaggcucucucuccgaccagcgcccaggcaauuucggccaccuuggcccuggcagauccacaaugagguaauugacgaccaaggacgggccggagccuccacggcugcccgggugu

SEQ ID NO: 15843 - RNA, 16735 nt, Homo sapiens
auccgcgggcucuucgcgagcgcggucuccgcccccccgcccgcagacagcgccuauaggcugucuaccgccuuccuauaggcuggcgcaggccgucuuccggccggggcgggcucucgccguggcgggaaaacggcggccgcggcgucuccuccgggacgcugaggggcccgaggagaccgugaggcucuggccugcagcucgcgccgccauggacgcugccgaggucgaauuccucgccgagaaggagcugguuaccauuauccccaacuucagucuggacaagaucuaccucaucggggugaggccugggcccgccguggggaggggaggccgggcugggcgcguccggggcucccgcguggccuucagccccggggucgcgggcucgcccugcucccgcaucugcggaggccaccacucggcgcuugacucgcucaccgccguucccgcuucucggaugaggaaagcgagacugcgcucuuugccagugccccgaacgcccggguuuacaggguuuuuuugaucuguuugggggcuuuuuugguuuguuuuuugguuuuugagguggagugucacucugucgcccaggcuggagugcaguggugccgucucggcucacugcagccuccgccucccggguucaagcgauucuccugccucagccuccugaguagcugcuguuacaggugcccgccaccacgcccggcgcauuuuuguauuuuugguagagaugugguuucaccguguuggccaggcuggucucgaacuccugaccucaugagccacucgccucggccucccaaagugcugggaugacaggcgggagccacugcgcccggcuuauuuauuugguagagaugcggcuggccucgaacuccugggcuccccaggcgauccucccacgucggccucccaaagggcugggauuaugggcaaaagucggcuuugccucuguuuguuuuugucuuuaucuuugagauggaguuucgcucuaucgcccgggcgggaaugcaguggcgcgaucucggcucacugcggccuccgccucccggguucaggugauucuccugccucagccucccgaguagcuggauugugagcccccgcgcccgcccggcuuugcguuuucaguaugagggaggcgccucggcgcugggaguccuggagaaggagggcaggcucuguaccugcccagacccaccuccccgcaccccaggaccccaacauugggugugugaaaccuguuccggaguuggagggugcaggcgggagagggagcgccccccacccacucaggggagacuugcauccuguccgcggaaaggccagaaggacugagccccacgcucgcaggugucucggagccgcucaggaggcgcuuuguucugagucugguaacaguuggguuuuuauuaauugcauuuggacuucagccucugcaaugccuugccucuuauuugauagcaguaacgcacaguaaugcuuuuuuuguucuuuuucaaucuuacggggaauuguuuuacuuuuggcagggggaccuggggccuuuuaacccugguuuacccguggaagugccccuguggcuggcgauuaaccugaaacaaagacagaaaugucgccugcucccuccagaguggauggauguagguaaggaugugguggagacugguugaugcguggguggggcugggcuuggggugacgcccucucccacgggguggaggcauggggccuccuuccugacuagguccgugcucccucuguuccguuaucuacugaucagcugaaaggaauacuuccagauucaccucucagcagagucugcuaaccacuguuaguaaugucauguuagguuuuggugugugugaaaguuguaguuuguuuuuugagacgggucugacuccaucacccaggcuggagagcaguggugcaaucucggcucaaugcagccuucaccuccuggguucaagugauccuccugccucagccucccaaguagcugggaccacuggcgugcgccaccacacccugcaaauuuuugcguuuuuguagagauggggucuugccaugcugcccaggcuggucucaaacuccuggggucaagcgaucuggccaccuuggcagaucugcugggauuauaggcgugagccacugugcccagccuauauuuuaauguaagauauuucaauuugcuuuaaaauaaauauaugaccuuaaauaagcauuuguuuuaaaauuuuaaaaauaaguauagauuagcauguugagaagcaguuauagagaaugcaugaaaauaauauaucacaauaagguugaauauuauucagcuauaaaaaggaauggaauucugauacaugcuacugcguggaugaaccugaaacaucuuaaagaucuugcugaaugaaagaaaccaggcacaaaaggccgcacacuguaucauuccauuucuaucaacugucuagaauaggcaaaucaauagagacaauguagauuaguaguugcuuaaguaugggggucuugcuuugggugauggagggauuguggaguuucuuuuuggcaugaugaaaauugggauugauggagguaaugguugcccaagucugaauauacuaaacaccauugacuuguacacuuuguuuuuaauagcccacaagugcuacuaaaacuuguauacuuuuuuuuuuuuuuugagacagagucucgcucugucgcccaggcuggagugcaguggugcgaucucggcucacugcaagcuccaccuccuggguucacaccauucucccgcgucagccucccaaguagcugggacuacaggcgcccgcuaccacgcucggcuaauuuuguuuuuguauuuuuaguagagacuggguuucaccguguuagccagguuggucucaaucuccugaccucgugauccacccaccucaaaacuuguauacuuuaaauggcugaauuguaugauauauuaauuaugcuucaauaaagcugcuagaaaaaacugaaacaaaucaaagaugcagacaggcuuuauucugagccuuugaaaucuuuuucuucucuuggagauaugaguagcuuauuauagggaaaaaaaaucuuaauuuuuuuguguguguuggugaggagagggguauggucauacauauagaauuugaaaagacccugagugauuuuuuuuuuuucuuuuuauggagauggggucucagccgugagugauuuugacugcccccuccuuacugggacuuauuggggguaccuaccuccuagaagcaagagcucauugagccagccacucugggguccguuuaagacagacugcuuagugucuuccccuugcucccuguccuaaaguggcaagugacucagguaguccugaaacauaaugggaaaccccaguuccucugcuuugagacgguuuuuuuuuuuuuuuuuuuuugagaaagggucuugcucugucacccaggcugggcuauagugaugcaaucauagcucacugcagccuugacuucccagccucaagucauccuccugcuucagcuuccggaguagcugagacuacaggugugcaccaucaugccugacuaauuuuuugauuuuuuuuuuuuaguggagaugggggucuugcuauguugcccaggcuggugucaaacuucugggcuccagugauccucucagagugcugggauuacagaugugagcuguugccccuggccggaaggcuuuuguagaggagaggcucaccaggccuggcuccauuaaugcagcauccucuccaggccccuuguuuaaaaucagugucuggcacuuuugucccaucuagaccccaggugauaacauggcaagggccuguuuuaucgcaggcuagagucagaagguguggagaguuccccuugaacuuuuuaccugggcuggagccauauugugggaacagugaggcaccauuaaccugucuauagacccuacccaacagccugcugccuccugacuucugcaccacagauaaguucugccuguucugggccaggcgcgguggcucaugccuguaaucccagcacuuugggaggccgagauggguggaucaccugaggucaggaguucaagaccagccuggccaacauggugaaacccugucucuacuaaaaaauacaaaaauuagcuggguguuuggugggcgccuguaaucccagcuacuugggaggcugaggcagggagaauugcuugaauccaggagguggaaguugcagugagcugagaucgcgccacuguacuccagccugggagauacagcgagacuccaucucaggaaaacaaauccaguucugccuguucugggacuucauguaaauggaauaaucuaguaugucauuuuuuguuucugauuucucuuauccaacacuguuuuugagauuuaccuguuuacguucucaacaccgggacacagagcucagcucccaaccccuuucuccacuacugaaacucauauucacaccaccuggcuauguucuuucauugcuggguacucuccauacuacauauuuguucaccgauucuucuguugguagauauuugggauuccccuuuuuggcuuuaacaaaaaauuuagagacagggauuucucuguugcccaggcugaauugcagugguuauucaaaggugugaucauagugaauugcagccuccaacuccugggcucgagugauccucccaucucagccucccuaguagcugggacuacaggugugcaucaaugugcccagcucauuuuuggcuuuugagacagucucucgcucugauguccaggcuggagugcaguggcgugaucauggcucacugcaaccuccaccuccugggcucaagcgauccucccacuucugcuucuugaguaacugggaauacagguguauaccaucacauucagcuaauuuuuauagagacaggguuucacuuuguugcucagacugguuuugaacuccggggcuuccaccucggucucccaaagugcugggauuacaagugugagccacugugccuggcucauuuuuggcuauucuuaauaaggcuuuugugaauauucuuguccacgucuuuucauggauauguuucuuuuucccuuggguaaauaaauaccuagaaugauggacuugcuggaucucagggauaaugcuuaacuuuguaagaaacggccaccugguccuucaaagcagcugagccuuuauccuacaagaaauaugaguucccauuguuccauguccuggccaaaaauuuugacuguagcuuuuuuauuugcuagaaaguuggaccagagguguuucauaagcugauucagauguuaaugaaaggaucacucugcuguguagagaagguuggugcaauaggagcagggaaugaauccaggcaagcacugagaguggccucuggcugauggaggugggagaugugguaggugucuagguguguuuugaaggaagcagcagcaggauuggcugaaggacuggccauggggugugagggagaagagugaaagcugacagccaggcucuuggcuggaggcccaggagagggaguugcugucuccugaggugggaggcugcaggagcaggcugugggcugcaguggguaucaggaguuggggguuugaacuguugugcuuucuggauauccaggaggaaguuacagcagcaaugagguuauugaguuaggaguuagagcucaggggcugauggggguauaaauuuggaggucuuucugagcauguggguagcauuuggacgaggugguguggauaugaguuuagguagugaagaaagggguugggagcugagcucuuugucccagugucgagaggucaggaggaauugccaggagacaaaaaggggagccuagugaguucauaagcaagcucagagggguguucacggagggccuucuuuuuaaggcuauaucuauuaguguguuugggaggaucaagcaaggaggggacagugaucauuuaagagcaugagagcugcuggagugccuuacugugcaggugagaggaggguccaggacaccuggaaggcugguccucgaguggguaggagcuacacagggaguuugggggaugggguggugugugggucacacucagcugggugucaggugagaggugggugguggguugaggcggugcuggcggcagugaagagagggugaguagaccaaggaauugggccaggauugcaggacggcaccaagggcccuggggauggguaguuggccguuuacaaugggacccugcagcguagcugugcuccgugcuugucccuuagcuauaguacacagucugcucccaggacagguuucucuguagagggggagggcugagggagcuggagcaugugugagaacagugcugaugcugguggaauuggauacagcuguuugauucuagacgcugggcuuucaccccucuaggaugucaugccuccucccggcugggguggcuuagcccucuaggauauuguaucgugcccaggcugggguggcuuaaccccuaggauauuguaucgcgcccaggccaggguggcuuaaccccccuaggauauuguaucacgcccaggcugggguggcuuagccccuaggauauuguaucacgcccaggcugggguggcuuaaccccccuaggauauuguaucgcgcccaggcugggguggcucuaguuuuguaaguugucuugcucccuucugaacaaggcuuaguauaaauaaauuuaagucacugacuaguuugaucacuuauugcaucaaaggucuaauacugaccaggugacucacuccuauaaucccagcacuucgagaagcugaggcagggcgaucacuugagcacaggaguuugagaccagccugggcaacauagugagaccuugucucuacaaaaaauaaaugguggcaugugccugugaucucagcuacuccuugggaggcugaggcgggaggauugcuugagcccaggagguugaagcugcagugagcugugauggugccacugcacuccagucugggcaugagagagacccucucaaaaaaaaaaaaaaaaaaaaaaaaaaaggcgguaaagguaaaucacuuugcuguuucccuaaaaaagaaaaaaaacaaaagcaaaacacaacaaacaucaaacuuuugacucuaacauuguuuuuaggaauaucuucugcaggcuaaagcagcgacaaaaauuuaccuuucuuuuggagagaaaguuucaaggaggaggccucaaaucaucuagauaaugauacaaaugucaucccaaaauguuuuuucauguauuugcuaguugauaauguauuugccagauaauauaggcacuugguaaauuuggaagguuuaauaaauaucuugguuauaaugaugguaaaauguauuaacuucuaaauuucagaaaaguuggagaagaugagggaucaugaacgaaaggaagaaacuuuuaccccaaugcccagcccuuacuacauggaacuuacgaagcuccuguuaaaucaguaaguagaucucaccucuuagaggccacacccaagacuggacucgccaugcccuuccccuaacccucguccuuccucuccgcuucccugcuuauugccucaguaaguggcaacacuggccgcccuguuucucaggucagugaccaugaggucaucuguguacacacaccugccaggugcacucugucugucucugugugucuuucugucuguucuuugccuuucucugucucucauuuuuccuuuucuccacuucccggugaagcccuuggcucuuuuuguucugccucacaucacucgacauuggaccccagugugagccaccagcaucucacagaaucggcaguagccauucuuugccauguauguguuuuauuuagcacagcuuuacuccuguuucuccuuggaguagguggauuugaguuuuuuugugucuuucgcaggaaaggccagagggcuuacauuugccucuguccuuggguuacaggaaagcccacuuccuggcaaaaucaugcuguaguaacuccguagcuuguuugccuucauccauacuggcuccgcucagcuuuccauucauucuucacaucucagccagaggggccuuugaaaggcagaacugccaugugacucccugcuuaaaauccugucuucccucucgucuaccugagcgugguguucaagcaguguacagccuagugcgugcuccuccucccucuuucacccucucuacagcucuuuucucugcuucuggagggcucaggcucacacuggccccugucacuucuucaagcauucugacuuugcauauacuguucucugcccuguaagucuguccuuucccugccccugcucaccucugcugguuagcauaacaugucucuucuggguucagcacacauguacucuuggcagcucuacacauugcuauggcauuugccaguuguaauuuucuuguuugccuggcugugccaucacauguacccauucuaaaugggcaggggcugggucucguaugcauauguccccagugagaugccugcggcucauguuuguugagugaaagugaaacuagugaagaaggcagacaaggguggauaauuuugcuugggagauacuuagaaugucauuuguacaauuucaagcuucugaagcuccccggguauccuuuaacuggguucaagagcagaacuagaauaaaaaauugugacacuaguacuacugcaugcugcagagcagcaggaagggcugggagcccacugaauggcgcugcugaauuuaaaggaaaaguuggggacacaacaugggcuugugcuuaggcugagaugaggcugcagucagcccaugaauuucauaaaaagcugagaagcagcaaugcaccaagcauuccacucggcaguggcguuugucccauaggccugcuuccugguguggugcgggagagaugugggccugggagccuauagugaaucuucagugugaccaaugcucuugacaguccaucagagcgcaguaaggccagguggugccagagagggcucacagagguuugcugggagugcagacuuguaggagguggacgguaggggagagggcagugaggcaggaacugauaugcucaggcagagugugaaggaccugguguagccgggcaagcagagauauuugaggauguguaguacauucaugggagcagaggaauggaggcauagguucugcugcaguggccagccccugggaggggcauguggccucagagggaccugagagagacuguaguggugguggggaugguagcuggaagggagaggaucuauaaacaggcuagguaagaauuuggcauuagcuaggugagggggccuauccauuuuuuguuuuugaaguucaauauauuauggauguaguuuuuaucaaaaaccuuguuuuauaauucauucgguuaagggacuuaauuuuacguuuguucuauaguucagcugacgaggaguugggguccuuuguccuuuaaccugcuguugagagcacaagaucuaaauguuuggguuuauaaauaaaacucacuacauaaauuuuguaccagugguuugccacuuacucaucaggaauuaauuguagcauauggagagaaugucuagcguaaccuguaaugccuagugacgaacaauauuugcuucugcuuuuaucguguaguuuuucuucaaagguuaguuuaaaauacuucacaacgggagccucgacuuugugaaagccuuccuucaucccuugcuggcuuugagcuucuagccagaauuuugcuauguguaggugugcucacuguauacuaauuugcaguuucuucugugauuuuugaaacuuguuuuugucuucucugaagagcaggagagucccuucccuucagggcuuuugugaggauagaaaugccagguaaagugcugagcccaguaccuggcauggaguuggcguuuuccuucucuaggcugugagcccuggauuccugguggggaauagggagaucugcucaacacucuguaaaugaggagcaauagaacucgaccuuugagccagcccucgaaacugauuccuuguagauggagguuaggcagcacggaaugcuguuauccugagacagaggcuucugacuuagagcugauucucuacuaauuuucuuagguaaacagcaguccuguucagcagccugccaugggauaguuaaugugagcaaaagaaacuccauguggaucacugccgcaccaagcuuaacugcuacaaaucuuuacacccuaaaguugaaaauaaagcaaaacagacuuucugagucuggaauagccacgguauuuugccugaaaagagccacucuauccagcauugccucagguuaucaaguguuccccgacugacuuuagcccuugcuccuuuagugcuucagacaacaucccgaaggcagacgaaauccggacccuggucaaggauaugugggacacucguauagccaaacuccgagugucugcugacagcuuugugagacagcaggaggcacaugccaagguaggugccgccuugccugggugcugguggccuugaugccgcauaauuucacauggcucccgucugcugaggcuauuacaggcaggcauuacuagcugugcuuuucaacaguucauugguuucuuauuuuuauucaguagaguuuaccuuuuucucaaaaucaaaaacuccuuggccaacuuggucuguuuucuugcuuuagcuggauaacuugaccuugauggagaucaacaccagcgggacuuuccucacacaagcgcucaaccacauguacaaacuccgcacgaaccuccagccucuggagaguacucagucucaggacuucuagagaaaggccuggugcaggcggcuugcugggggaugugagcgcucaggacgugaugagguacucgugguucuggagcucuagaaacacuucugaugcaugaaaaaugugugauggugcaaggaauggauucaggauguuguuggagaaacaaguuugugauuaguccuuaaaacuuagcucccugggacauucuucaauuccacaucuguuucuagaaaccagcccuuuuuccccccacuuuugagaaauaaaaaagccuuagguaaauaagucauucucccuagcagagccacuugggucuccugcauggaagccaucacacuugggcagguguucagugacugguagguguagauacagcaggaguggccaugugguccacggcuuuuuaccccuucuugauccugauuucuugggcugaauuuagacucucucacagagguggcucacagagaaggauggcagauggugcagccaacaaugcugaccggugcuuauccucuaagcccugauccacaauaaaaauggacccaacucagcucugacucucuagguuuuugugcugcguaacuaccaaguaaaaggacugagccuguggcugagaugacucagucaacgaaacugaggcacacggcaguuaaguggaaacugcagaccaacaccuggggugucuccuucucuuggcuacuucuagcucagguuuaauggguugcuuaucaagaggagagucaggaaaaaaacgaauccaauguauugagcaugagugacaauguauugagcaugagugacaaugcuagaagaaaagucacuuucagugcugcucuugauggauuuggggaaggauucuuuguuguagguaacagugggcucaggggaaauuauuuuuuuccuaagagaaaauuacuuuauucguagcauuuuggaaauguuaggaccuuuacagaaauuacauuaccuugagaggugaaaugaucguccagcaucaugcaauggauagaagguucuguaaucagcuuuaaaaaaaacuuuaauuuuuggccgggcacauuggcuuggcucaugcauguaaucccagcacuuugggaggccaaggcagguggaucacaaggccaggagauugagacuauccuggcuaacauggugaaaccccgucucuauuaaaaauacaaaaaaaaaaaaauuugccaggugugguggcacacgccuauagucgcagcuacucgggaggcugaggcaggagaaucgcuugaacccgagaggcggagguuguagugagccaagauugcaccacuguacuccugccugggcaacgagagcaagacucugucucaaacaaaaaaaauuuuaacuuuuuuuuuagacagggucucguucugucauccaggcugcaguagaguggcgugauuauagcucacugcagccucgaacuccuggguucacacaguucucccaccacagccucccaaagcacugggauugcaagcaugagccgccaugccuggccagccuauuuuuggcuggacaccagugggccaaaagcaguggggugcugucuggggagcucugagaaugcgcaugugugacaggcugagccuaaagacuuaucacccagcaucugcccuccagugucuagcaugcugcacacuaucacuccauguugcugcccacguguccccgccaggcagguuuuggugguuauuuggacacugaagggucagaccuggaagacugggaccaaaagaugaggucuccauaauuuaaggugcuguucagacuugguucagcucauaggacuuguucuuucaucucagccuuccuuggaauccuccugcuuucaucuggggaucuuuuagaaugaaaccacuuguuauuguggagggcaagggguccuaaugcccuccucuuagagccugagccaguggaggcagcuccgucugcggagauguauaguuauugagcuuuucuuuguuuggcuuuguuuuauaucauaaaaaagauuuuccucuuaacauaauuuaggaagauuuuauuuuuuggauguugucagaaauuacagcaauauauucauaaauaccuaauuacuacauucaacaaauaauauuacaauacaauuaauucaaacaaguacacuuagaacagguuuaauuucacagcaucuaaacugcccccagagugaccgaggcaccgguguuccucccucccaccugcguaugggguuuacuguuauagaauuaagcacaggguacauacaaaauaacaccaguuagcauggucuuccucaggucaaggcagaguuaaggaguuuuuuagguuaagcacuggauggaaaaguuggggacaggcuacugcaaguaguaagaaagucaacagcuugguuacuugaaagaauauagagauugcuaaguggcuaauauacacuuuaaagaggaacagaaucgguuugugcugaccaucuccaucuugugguggaucccuggcauuuucuacacuugugugaaacauguggcucagggaaagggguaggaucuggugugaaauucagcuuaacuuuugagauuuggcaguauuaugagcuacuugaggaaaauaccauucugcuacaaacugcagauucccuguguuagaauccuucacugcugaaggugugggcuccuuuugaugcucucugaauacucuuaagggugcaaccuaucagaauguuagucccaauucagugcuuuauuccuuuaagauuagaauguagacuaaaauguggaaagucccgucuuggucacuuaucugagacaacagauuaggaacaugauauuuuaucaugucagucugacucugacuauaugaagcaaaaauaacuuguuucagugaggaaccagauaauuuacuauuggaagguaucccucugcagagggacagauggcagcucccuuccagguaauguaggaagauggucuaaggaccgagccgagggcuuucaggugcauccugacacacagguggcauaaucgacuccagagcagauuugagguacucagugugaaguagcugaacaaaaaacuuaagagauugcaugucaauuuuuaagcccaauugaaaacagauuuaggugcuacuguguucuuugagaauaaucugaaaguaaguuuucaaaguaugaaacuaauaguuggauggggaaaccaugacuggguacugugucuuggguggugugcuuucguuuuugagacaguucuuaccuuuuucuuaguuuauucguguugccuuacugguuuguauucugauugucguauuacuucuugagcaagaguagaguacucagaucgccacaaguagguggaaggauggggagacagugggcaagaagcucaagggccgggcagaagugggguuuccacugacaggggagaagccaacuauugcuagcacagugacacugcucccacccugggcagaccucucauggugugccaccuguccccugugcugucauagaaaauccaaccaagggagugccccuuggaugguaagggaugagcuacguuuuuaaguuaucggaucuacuuuucccuuuuacuuuagccaaggccauuuccaaaagcauccagacaucugugauggaggaggaggccugagagcggaagugcuaagaugugacucuuaagccuucagaccagaaaccucaaguagguuuucaguggagaaauccagugagauuuugcccugauaguuuguagcagacucccucugaacaccuguggaacaugcugaccucccagugucuuucgaggggaggccugcagcacagccccucgaguucucuuccagcugcuucuguggagaggaaggugcuuguugacugcugauaauacuggcgguacauucgucugaguuugcuaauaacuggaagauucuuggcagacguacaaagcaaacugugcgggggcagauaaagcgacacgaugccagcugccagcaagcuguucugcgcagcaagggcuagggccaagggcucggcugcuggucacagcagugagcagccggcacacaggucaggcacccugcccucagcucaggccuccaccccccagaccagugacuggcagcccuggccucuggugagggcccuugggagcaagagaggccuucuugaucuaaacacugccuccauaggcaguaacuaggacaaggaggaagacucgcccguugcuuugccuuggugugaugagcccaguuucugaccguuccugugcuugucacaguaaguucaaaaaggagggguucagcucagaccuuguggcuuuuacaaagcuuugcguuuaaacaaagccucugaaguuccuauucuguaccugcucucagacaccuuagaauuauaucaaucacagaaaucauugacuuccugaaagguuuuuaaaagcccccgcccaugugugcacaugacugucacacauggguucuacagacuacccccuccucccuugauagcaauggguaauauuugcuauuagcuuguccagaugcugggggcaggcagggggaguggaggagguaagcaguagcgcauggcuuucuacggcagcuucuggugcaacucaaacuaaaaaugaagugaucgcauaggcgccagugguaagcucuuuuacuuuucuucuucuuuaauuuuuaaaaacacuucaauauuuuaauguccugaccagcagcaguacaaacacuaaaagcaagguuuuuuuuuuuuuuuugcccaaaaaaaaccaaaacaacaaacaaaacccccaaacaggaaaaacaaacaaaaaucccccaaaccacauauuaaaaauggcaggcuuuuuauaacaauaguuaaaguaauaaaaacauacaaaacuuuguuuuuuuuuuaauauauauacacaguacaaggcugaagcaccuuugacuuuucucucaaaauuuacgucuguaugaaaacccaacccacuguaguaacaaucuggugggugugaagcuguguauacacagagcucuguacaugcuccccacggaguaauaaaaagcuaccuucaguuugugaauugguuuuaucuuuagguaagaaagagcuuuuccagggaaaagccuuuggguugcuuugugugcuccuaggacuuguugcuuugaagaaaauuuugcaggaaaguaaaaugaaacaaauaagcccuuuuuacugacaaugcacccaaccuuuucagcugaagcaaguuucacuccuggggaggaaugagacuggccccaucgcugcggcaaaagcaaacugggcuugaggcauaguaacauggcaacacaagaaagaacagaaccgguuugauccacucauaugcacagggggcuguuaaugaucaaguuuuaguguugcuaauggagccuucauguucagauuaagaaauaaugugggagaggaagggcgaaaaccaccuuuaaaaagaaaaacugugggcaauccuacauugguugcucgcugaaugacaacggugauucaauugcauugacgucaaggugaguucauucauuuuuucuggagccuggaauccuuugcuucaugcauggcacauucucauuuuguaagcuucaaaccucccagugaaaaauauuaaauauucaagguaauaaaauagauaauauuucuauacuauagguucggccuagugcaagggaaaccgucaccugggauaucccuucagguagccccuaggccagugcauugcaggcaaggcaaggcacuuucguaagugguccaguucugccuggagccgcucccuuucugagaccaucuucuguuucuggcuccucaacuccuggagagagggaaauuugugucaaaacca

SEQ ID NO: 15844 - RNA, 641 nt, Homo sapiens
ggggagggcgggcgggagcgcgggggcgggcgcgccgcggcucgcucgggagaaguggccgccgaugacggcagaggugcagccagccccgcgcgcgcagcccccuccccuucgcccuccucccccccgucguccucuuccuccuccuccuccuccuccucccggcccguccgcggcgcagagcagcggcggcagcggcggcggcggcagcagccacccgaugucuucggcgcccgagaagcagcagccaccgcacggcggcggcggcggcggcggcgggggaggcggcgcggccauggaccccgcgucguccggcccguccaaggccaagaagaccaacgccggcauccggcgcccggagaagccgcccuauuccuacaucgcgcucaucgucauggccauccagaguucacccaccaagcgccugacgcugagcgagaucuaccaguuccugcagagccgcuuccccuucuuccggggcuccuaccagggcuggaagaacuccgugcgccacaaccucucgcucaacgagugcuucaucaagcuacccaagggccuugggcggcccggcaagggccacuacuggaccaucgacccggccagcgaguucauguucgaggagggcuccuuucggcggcggc

SEQ ID NO: 15845 - RNA, 2164 nt, Homo sapiens
cuuuguuggguuugauuuccuaaaauuuuauuuagaauuguugcuucuuuguucaugaggaauauggcccugugguuuucuugucuuguaauugcuuugucugacuuugguauuaggauaaugcugaccucauuaaaugaaugagaaagugcucuccccuuuuugguuuucuggaaaaguuuauguaaacuuggaaucguuagucuccuuaaagccuggguagaauucaucagugaagccauauggaccuggaguguucuuggugagaagguuucuaacuacaaauauaguuacuuucauagauaggacuguucagguuauccauuuuuucaugaguuaacuuaguaguuugugccuuucaagcaauuuguccacuuuccccaaguugucuguaagaucugcagugaugucaagaaucucgggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcaugaacccgggaggcggagcuugcagugagccgagaucccgccacugcacuccagccugggcgacagagcgagacuccgucucaaaaaaaaaaaaaaaaaaaaaaaaagaaucucaucccuggccaggcuugguggcucaugccuguaaucccagcacuuagggaggccgaggcgggcggaucacaaggucaggagaucgagaccauccuggccaacauggugaaacccugugucuacuaaaaauacaaaaaauuagcugggcaugguggcaugugccuuuagucccagcuacuugggaggcugaggucagagaaucgcuugaaccugggaggcggagguugcagugagucgagaucacgccacugcacuccacccuggcgauggagcgagacuccguuaaaaaaaaaaagaaaagaaaagaaaaaaaaacucuucccuaauaauugguaauuugugccuuuucuccccuuuccugaucaaccugguuagauguuuauccauuguauugaucuucucaaagaagcaacuuuuggguucauuguuuuuuuguuuguuuguuuguuuuuguuuuguuuuuugagagggagucucacucuguugccuaggcuggagugcaauggugcgaccuuagcucacugcaaucucugcuuccccgguucaagcgauucuccuuccccagccucccaaguagcuggaauuacaggugccugccaccacgcccggcuauuuuguuuguuuguuuguuuuuguauuuuuaguagagacaggcuuucaccacguuggccaggcuggucucaaacuccugaccucaagcgauccgccugccucagccucccaaagugcugggauuacaggagugagccacuacaccuggcccauugguuuugucuaguguguucuuggucagaaucucccuggaaacaaaggacacucgcucuuccuccuuuccucuugucuaaggaauucucuaagagaacuagcucacuugaaccuugucgaaggcuaaccuucaaaauaaauccaccuaccaacucuuguuuuucucaaaacucucagccaaguaccacaguuucaugucacaaauaauuuuuucgaaggugcagcauucugaucacauucugcagagaaaacggauguguagcuuuugaaauauucugccccuuacagaaaagcuucagugacagagaugugauaauaugggauguccauuuagugacagggauauucuugagccggcucugguuuuugcuaacaugugaccuggagcaagugacuaacaaucucuaagccucaguuuucuucucuccaaaaugggaauaauaaugggguuguugaaagacccacuuugaugaugaaugcaaaaccucagugcagaaucuggaugugguaagcauuccauuagcaguggcuauuaaaauaugauagcaaggguuauggucugggauuccacucccuuuacuacuggaaaggaaggauuuauggucuuccuuuucuucuguugauguuggagccaacauuuauugguuguaaauguuaaaaauaua

SEQ ID NO: 15846 - RNA, 830 nt, Homo sapiens
guaaaagccugugaccagaguuucacaggagagagagagagagagcacuuguaacagaagcacuaagggcaacaguaccagaaagucauuuaaugacaaagagcauaaagcagacacuccauacauccaguguucuuggugacucuacaguuauaguacagugguggugaugauggugguggugaugauaaugacgaugaugagggugauaaugauaacagugauggugaugaugguggugaugagggugaugaugaugaggauguugauagugaugagggugaugaugguaacagugauggugaugacggugguguugaggaugauggugauggcaaugaugaugaugaugaggguguugaugaugauuagguugaugauggugaugguggugaugaugagggugaugaugaugaugaaggugauaauggcaacagugauggugaugauggugagggugauggugaugaugauggugaugaggaugauggugauggcgaugaugaugaugaggguguugaugaggguguugaugagggugaugauggugaugauggugauggugaugaucaugaugauggugaugaugaugaugauuauuaugacaagggugaugaugauaugaugaugaugauuaaaauaacacaauuacaccgaucugugacugcgaguuauugaguguuuguucucuguuaaguaaguacuaugcugagugcuucaccuaaauuagcucauuuaaucucccaucaccacuccaugagcaaugaguguuauuucacucauuuuacaaaugaagaagcugagagagagagaaaugaagucacuuguga

SEQ ID NO: 15847 - RNA, 81925 nt, Homo sapiens
cagcccgccaggagcgcccucgcaguggccgccugcuccgccgcucgccgcccgcggguuccauugagaaaagccgagcggccgcggcggcggcggcgagugcgcgggagcggaggagccggcacccgcccgucgggcaguccgcgcgcccgcaacgcaggaccguggccucucgggccuccgcggcagcuccagcggcuccggggcugggcgcgcgggcugggggcgcgggccggggcggccgcggagaccgggggccgggggcaugagcggccccgcggccccgccgcgcccccgccgcccgccgccgcccgcccggggcuagaggcggccgccgggagggcgcgcggcgccggagacauguccaggcggaaacagagcaacccccggcagaucaagcgugagucaaacuuugcccgcgguccccuccgcgcgcccgacccccgccggagcccagccgccagcgccgcccccgcccguccccgcucugcccugggcgccggcgaccuucaccccgcgccgcgccccccgcgcugugccaagcgcgccguaaucuaaucuccgccggcggccugggcccccgcgucucggcuugggcaccgggggguucagcccaggagggggccgcccggaggccgggaggaggguguuugggggcgcggcccgggcagcucggccccucgcggccugccccucccccgcaucugcgagauggugcggcgauagggcggccccgaucugggcucagauaaaguuuaaaauauuacauucugcaagucccguccugauaagaucguucugucgggacgggcugaaauugugaucuuaucucgcgcgguugacucucccaggcuuuguaucuagaagcgaagagagagaccugggaggcagaggggacacccggggccgcggagaugccuggccaaguggcaggcaccggcccgcgcccacccccaccggugccgucgcagagccgcaggacaggggaggggguagcgcgcagcugccgcagccuaggcacuuggcuccagccccccagacacccccaccccgugcccuagcgcugaaguccugaacccaggccccgccagccuggugacaccuccuggacccugcaagugucccagccaaggcggcaugggcaacaaauggugcccucggaugcccgcgggcacccccuggcaucccaaugggcugcucugagucagagaagggccucccaggacgcagccccgggccggggucgccccugcacgccacuaaguuucucgcugguccggcucccugcccggucagaggcugcugccccgccgccacauugccagugcccccgcgaugagaacuaagcugucggggccacugucuggccugggccucugggcugugccaggagggagcaagagcacaggaagcuacccuccccacccuaugccaauaauaacuuugcgccucacaguuagggcccagacgcaggucuuccuccccggggcgccuccccggagccugacgggcaggucgucugagcccugccaggaggccacgacggaaacccgcccgcugcccagccguaggcgcccgggcacuaccuccuuuguccacacgaccacugccaccaggaccccuugugcggggccugugggagcuucccuacucaggaggucucccgaggcgggggucacaggcaugaaccgguucccguaacccaacucccucagcgcaaacgggaccuguuuuccgaaagucgccuucuaucgugucaacucaaguauuaaaagccacccacaggucccgauccgcgcuugugcucugguuucuuuuuccuuccuucccugagcgccuauguucgguucuggggugugugugugugugugugugugugugugugugugugugugguguuucacugugaugagaaaugcagauagcucggacagggagaucgcagguuggaaaccgaucuccagcgcugauaaggccgccagcgccagcgagagcccguagcccagcccagcggggcgggcagagcgcgcgcacuuugggaacugggaccgcggcgggugcacggugagccaccgcggcccauccucguugcggcccgggaccggggcagagaaagggcccggacgaggaaggcagggccgcggacccucccugucgcucgcggcccggggcgccuccuccccauggcagaucucagcacguuaagaugcgaaggcugauugucaccaagcggcggcgcccgcccgcccgcccucuugccagcgccugugccugcccgcugcccuggccucaccugcggccgggccgcgagugcagagcggagggggccgagcgcuucgggccgcccaccccccacccgcgcccccaucaaagcccuggcgcagcugcccgcgccucugugcgccuuuuguuccgugcggagauagaugugccgcgcugauaaggcgcgcaaccgaugguggcugagauaggcgcuuccauuuauuaacuucaaacgugggagcgggggcagggcgaggcgggagcgcggccuuggccggccagauggcggaggcgauaggccgggcugccgacggggagcgcggggccggggcagcucgggacccccggcgcccccagcccgcuggguuuuccucccgcccgagucgaugugagcuccgauaagagccuggccggucggcccgauggcgaucgccaagagcgauaagaggccuuaucuuuggccaccaggcccggccggguuggagaacagcgcgggggcgccgcgacuggggcgagugggggcuuggaacggcccggguuggggccggggagccggcgucccugcgcuggucugucugggggaguuuucuccccaaacacacuuaauugccaagaaguugauccuccccuguggccggugguacaguccgucaaaaugaaagaaaacuggcuuugccccggccaggagggggaagggggaggacaccccgccccgaguccucguagauggugcgagaccgcuagagguggguuugucaccuccagagggagagaggguguuuuccccuugaaucaugcugguguugcugguaguuccuagcaagaaccaaguguacacugcuuggaguuuucuugaaaaaaaaaaaaucaaggugguuuccauggcccagacugcuuugggggaggccaguguacccugguguggaggcgcugcagaccugccugggcugagcacuguuugcugagcacuacugcauacaggcccugggucccaguggcaaacgagaggggcagagggggcagccaaggggagcagggggcacgucagguggucagggacacuucuuggaagggggugaccuuuggcacaguagggcuggccucaguuuuccacugcugucgggggagcaagggcugagaggcgccuggggcuggggggccagccugugccagcaggugcgagugaggucgggagugauggaguuggucagguccuuggucucccacucugaaaaauggaaucaggaauagguccccagggcugugggaguccccaggucaggcuggagauauugaggguccaccgaggcacuuugcaguggaagggcccauggaucccacaggccagauagaacccuaggccaucuggguagggccuuccggaaggagccggggagggagggucccugagccccuccuauuccagcccaggcagcugcugcagcucagaacaagguguuuuucacacacucucagaguuugauuaaacaaauuauugguaaccacaggaugacuaauucacuccaagcuucaaagucacccaccugcucuccccagcagcccaacgcccacccguggggcuggcagugccaucuggcaagggccauuuccaguuccagagagggcuggguugggcccagagggagauggggugguuucugugauguguuaugaacaugagugggaugucagcacagagccauccacacuggccuuccaugcgugggaggcacccggguguugaggcugucagaggccaccuuaccaugcucaugacccagagugguggcagagcauccaggaaagaaggggcuuuggcagccuggcugacccuggugcugaaccacaggggacaaguuacugugcuuuccacagcucucaguuucccccuguuggaaacauggauaugauagugucugccauccaggggcugcagguccugcucucagcuuaccugguccuuggcccaguugccucguccccagucaccauccugaggggaacggugccugcagccugcuugaugcuuaggcugcgaagccaucauugucaucucagaguccugaucccagccacguuuuucucucuuucucucucuuuuuuuuuuccuuaguuaaaauuuuuuuacaaaauagacauggagucucacuacguugcccaggcuggucuugaacuccugggcacaagcuauacucccagcucagccucccaaagcacugggguuccagacacgaggcaccgcaccugcccucaagccacauuuagcagagggaauuagagaucgggagguacucucaaggccccccaccccuaaaccuggacuccagcagggucuggcggaccccggaguccacgccgucacccagcucugggccgauugugguuuacccccuuuccugggccuuagggaaggcagacagcucaugaucauuugaugguaagaauaauauucauaacagccaaugcuuaagagcccucucugugccaggcuguguauuaacuuaaagcagguccucuucugaucacuauuuuacaucuggggaaacugaagcacagagaaguuucucgcccaagcaagugauggagcuagaguuggaacccaggcggccgggccugcgcuccuuaaggguguguccgugagcaccgcgcugccuucucuccauccuccggcuucugucugcccugccacccugagccucucucagccucagucuccacaucugugaaaugggccuuugggaccagaggcccucugaggucuuuccccagauggccuccuuccuaagacaugacugcaagggggaggggguccccugggaggcucauccgggccuuccuugggccugggacugccgucagccccgccagccccucccuggaggucaccaggaacccaguguggcauccagcaccacuggggauuuaaaugggucaguuggagaagaaaggaggagggaaugugaugccauuaauugugccccuuaucuccuguuucuaugccaaccagacguuccugggcuugacgggcuugugaauaauacucccgcuggccuaucugccaucgacagccuccuccuggaggcagcuguugccuggccgauugguaucaccaaccccauggacccggcccggccacacucggggcccugguggggcuccugcccaccuggccaccauacccguggguauuccuggaggugcccaguggcuccugaccccauuucacagagggggaaacugaggcuacagccacaggucugcucuccagaccucgucugccacccuacacucaggcaggaguggcccagacugaagggaaggggguuccagaaccugcaaaggggucaucugcgcccugccuggugagucccgccacucuggaugcgcuguccuugcuugugucauuaggaggcagaugaccccaugggugagggaucagccaccugcaagcugcaggcagcgcauguggccuuauggaccaggggagagccggcgcccgucagggcugagccccucguuagggccugugugcaagucgagacuuggguggcuccucuguggcuccuuuuggccccuggaauuugccugugugcaggcggcccccaugcagcuccuucagaggcccuguccacaccugccugauggccuugccagcccauccugucacccacuccccgcucaggcccacaagcucucugagagcaggacugggucagucccguccccacagagugggccucccggaacucugucagauaaaugaccagagggacgcucagcucaaaauagacauggucugcucacaccacagcucugccacuuacuggccguggaacuaugggcaaggccuacccaugugagccuccguuuucccaucugcaaagugagcguaaugauaguaccugcccccugagcacuguuguaagaauggaaggaaaauaccuguuauccgagacagcugcuacuaacccucucccccuccuacccuucuccuuccuccccuuccuccuccuucucuucauuccccccuccucuucuuccuccucccccuccuccucuuucuccucccccuccucucccuccuccccagcagccuaacgcccacccauggggcuggcagugcccucuggcaagggccuuccuccucccccuccuccccuucccccuuccccucuuccccuuccuccucccccucuuccuccuccuccccuuccuccucccucucccccucccccuuccccuccuccucccccucuuccucccccucuuccccuucauggucaaucacuugggugagaucugugguuuccagcuuaucugagauggagcaaucccucuucccaagcugucucccaggacagcccagcaugugaaacacacaggggcccugccuuggaagggccccucaacccugcugcucacauagcucacugcgcuggccccagguuccaggucagggcagccccugacacccacccucuagcuggcuggcccuucccuccagcgcaucccgacuccccaggcuguguggccuuggcauacucuugcccucuugggcuggggcuucccuuuggcgaaggcagcgaggaggggcugagaugaugcuccugccugugccuguccaccuccccacccggcucugggagggucuggaccaagccaagccagagggguuuuggguccaggcagccaagcgagaggcccaggguuuaucgaggguccccagccuacuguuggcagggcccggagagcagugggcugcucucagccugggaaggugggucaggaggagugggguucuucacaggaaggcacacuggcaguuccuggggagcugccugccaucuuucugggcccaggcagugucaugguggcggcccucccugccucgguugguucaaugggcauacccauuuuucagaugaggaugaaaagguccuaaggggccaggacucaaguccugcccuggugcgaggaagaaacaggggagauggucugguccugcccucugcccaacaccagccuucauguuuagcacguggcacugacuuaaggaccccagagugaggauggaggguguggcucucagccagguggccucagccaaugcccaccuuagagacuccgcuuuagagugggaauaacagggucccuccuauccgagcuguguuggguagucuaacagggcugguauacaguaggugcuuaaauagcagcuguuuggagcagaccccuggucccgcgucaggaagaggaccugacuuauucaugccgggugacauggugcuccuacucccgugggccucggccucccagcuguucauggggccacugggcaggcuaaggacugagggaugggaggccuggugaggaccgaggggcggggcgggaggccuggugaugaccgaggggcggggcgggaggccuggugaggaccgaggggaggggcgggaggccuggugaggaccgagggguggggcgggaggccuggugaggaccgaggggcgggaggcccuggugaggacccaggggcagaaggucuggugaggaccaaggggcaggaggcccuggugaggacccagggauggggcgggagaccuggugaggaccgaggggcgggagaccuggugaggaccgaggggcggggcgggaggccuggugaggacccaggggcgggaggccuggugaggacccagggguggggcgggaggcccuggugaggaccgacgggugcgaggccuggugaggaccaggaugcuugcuggggaguccccagguucccaccccauccccaccgcaggggcuuugccccgccaccugggcugcacccucagggcuccgggugguugccggccuucagcucuggagagggaggugaccagucuggggaccgcuucggacaacagcgcaaccucacguccuggccuggccuugcugugacccuuuggccaguggcuguaucuggggccucuguuucucucuugaaggaggagcuugaugagaacaccuccuucccggcuguuguguggggugcaggcugggaagggcuguccuagggacacgucugugagggacuuugcugccucuggagcugccgguugcauuauugauauuuugccaaaagcccugaggguuggacguuaagcagagucccgcuggcccuccccuccuucaggcguuagguuuugaagggaggagggacucugccugagugugccacgcccuggacugggcuggccucacaccccagccccggcuguccucuucuugcccggagaucugacccacugcuaagaucaucguuggcacuggccaacccauuuuacaggagagaaacggaggcccuggaggcgugacaugugugagguuaugugacgugggagcuggggccguggacccugggggugggcccagguuucucugggcacugcccacucagcacccccaggccaccagcccuacugcaucggccggcggccuccccaucuccuccucccuccccagcugccuuguguuuugggggaaggcagugguccugcugaggcaggaaugugguggcugaucuugggcagagccgcgugagcagauaagcaggccccuccccucagccuccugugccuccgucugcuuccccagcuuccccugggcugcuggcuguggucuugggagccucagcuuccccggcugugaaauggguguugggggcuggugggcagcuuccgagagcucaggcccugacuccccugguucccucaguuccccaccuggagcugaagugagcccggcgugcugagggcuccugucugcuaagugccuuacgggcauccccguucugcccuucuccagacaccacuuagcuuuggguucuccacccauuucgcacgugagaaaaucgggggucagagaggguggguggcugcgcuagagucucacagcacacaguggugcucuggcuguggaggcagcggcagggcagggugacccugcugugccuaggaccugcauggcugccugugccuaggaccuccuggacugucagggguguggcuuccugagaaggagagggcagccaccgcgggcuuccggguuguuccgggagcuucccugugggccgccaugguuggaauccuggaguggagaauccuagacccucugucauuauagggagguuaccuugcuucuccaagccucagucuccaucucugcaaaguggggguaucguaaggcaccaggcugggcuccaggguugcccggucuucgugcaagucacucagccacccugagccucaguuuccccacuauaaaauggagcagugaugcucaccucacggggcugugaggagcgaugccacccaacacgggaggugcagcccgggccagggcccccuguggucuguaacaaaauccacacaaacagggcaggggccccccuccccuccccagguugcugacgucccucaggugucucugucacggcuggccuugcgugggcccacuccuucccacuuccuucugggcaccugcacccaucaccgccuccugccccaacuucccuuuuuuccaucaagcucccacuucccaagucagacccagggagcaggagcggaggaggccccagggccagguggucguggcuccuucccgaagugaugcaugaggaaagaccugcuggguaguccuccggggacaggggacagggccucacgguugauggcgcaucuauccuggacauccucagcccccagugagggaccaggugccugcagcugcccccucagccucucuugggguuccucuggcagcaggcgcccagacccucgugaugggaggggaagccaagacucagagccaucaguggccacagggcccucccccggaugugaccccaggaccuaagccgcucuccacacucagcccccagguucaccggugucacagcaccuacugggcauuuacuaggccccugccucgcacuaggccaccgugcccaggauuugauagacguggccucacguccuucucccggcagccuuugaaggaggcccagugugcagauggggaaacugacgcuuagagaguuucaaggucagccccagccccggagcuugagcuccuagaucugggcggggaaaccacccggcaaauauuuugaggagggaacgagaggagggcagcaguggugguuuucauaggagaccuuucccugcucccgcugggccaggggacgcccgucuucaggcugaggaaacugaggccuuccugugucucuaggcagauccagcucuggccucaaaacuguguccucuggcugugugacccugagcaagucccuucccugcucugggccaagguggccacugcagggccuuagaaauguaggaaagagaucagagccacggcuagaccuggcacacguagggcagggccagcccugggcacuuccaggaagucccagaccaugggauggggcuccagccagccaggagcccuugaucgagguguuuguucuauaccccgugguccaucggucaauccuugggggcuggaaggaauggauuggaggcuccuucuucccaguggacagaggugcucuguuuagggccugggugccgcgucucaaggaagggcccugaggagaggugagcagccccucaaaauuuaagggugcacugagcacaccugggcccgaggggccgaggcaugugagccgugccuaagguugagacccacaggggcagggcccccaggugcccccaggcugccuguuuaugacugauaguucccgacuccaggccugggcccuggauaugcucccagaggggacgggacacccugcaagucccaaggcaggaggacgggguguuugcaccucaguccugcugcuguccccaacaccaccuaccgucuuuccacuucgugggccuggaacagcucaggaaggcuugggacuaccccagccuucuugggaccuugaggcagucagccucaguuucccccauugcucauaggcccacacccagcuccaccaaaaccaaacauuuucccagaaagcagagagacccccuacccccgccauggcaauggucggugggcacccaggcccucuggggcccuggcucaagccgaucauucccauacccuuccagcucuacaggcugcggccugguccgcccugcacugucuccugguccgggccucuggcgggcacagguuucagcuccugcgauaacugggaaaguugaacuggccccauuacugcgccaagauggugagugagauacagccuugauaauggaggagauaccagcuucucgguggccaauagcccagccucuccacccauuaacauuccccaccagcgauccgcugccuaucucguccauuuccacuccucccgaagauaagaauggaaauucugacuucauagcucacugauuaaagugucuggauuucuugauaauacauagauaaauuauguuuuugaaaaagaagguagggaggagggugaggaggaugggggccuggggugggugggagcccuuggccguuucucccagccucuuuuggccccugggccagaccaugaaccacagagcauccggccuacaccgcagcggccucugcacagaccccguguccggaggugcagaguuagcucacagcagggcccgggcuggggagacacaggcagggcgcagcgucugcucagaagacaaacagcagaaacaugucauaaugcuggaaacaggcuggugcugggagcuaguaaccguggcccacaggccugcggggaagcccucugucggggaagugccccucccagcagccugguggugggcaaaggguggaggaaaagccagaagucugggccuggcuggcugcgccugucuugggccaugucucugugccucaguuuccccaccugucaaaugagugggagcacggggcccuccucacagccuugacagcaaugcaaugccccagggugggcauuucgccuguguggaucccuggugucccccuggugccuagaacagugcccgguuauacaguagguacuuaauaaauguggagggcccaggcagagucccauuggccagcuggggagggggaggggcuugccugcauugagaaacccugugugcuccccggcuuggcucccacccuguccccagccaucccuggcccugcugcugcaccugacagcugcgcccagaugggacucaggugccaucgcggcgucugucuggauaaagccgccuccuucagcugauccgagauccggcgcugauggagcgauuagcggcgauuagagcccggcgugcggcuaauccuccugcugagggacaggugaagcagccauagggguggaggagggacaggugaagcagccaugggguggagggugccaaggggcccgccgugcacgggggaaaccaaggccacgcagcuacgaugucuccuugaggcaguggcccggccgcucccucgcuggcagaaaggcuuccuguggagccgccugggcucccagugggugcaggccagcuugccauuucccccuuccuggauuuuauauuuugagugacucuugagaaaugagauccucugggaacccaaaggcaggaucccuggggcgguguggauggugacauuucugggugguucugggacccccaguuguagugauccugauggcggccgugguuagacaacagcuccguuacccagccccggcaguucuggcauggaguacucugcagcccugggaggggcgccuaugaccucauucuccucagagaacugaaggcucagcgagguugaguaacucacccaagaucacacagcaugaagagaacagaagggacccuggcuucuggcuuagagucuagccgaggucagagucuccauccuggcuggagguucugggguguuugcaguggggggcagcccacgagccucccagggggcucacccguaccuuucagggagaaaggccaagcacagaaagggcaggggacggcugagggccgcacagcccauccuggcagugggaggggaugggcggaggcuggccugccucuauucuuguuucuuggguucauuucaucuguccccagaaaauaagcuccuuuggugagaaaguugguuucuuucuaacuuuuggguuugguuuuguuucaauauucuaaaaggaagucagcuauuuccagugcagugggguguguaugugggggagggggguaaaugucagcuccagugaccagcguuuaaauccugcccccuggccggcagccucucaguuuccucacuuguaucaugggcaugaucacaguuccagccuccuuggccuuugaggaauuagggcagaaguggguaaagcaucuggggcccuugugcggcagggcucagugaaccccaaaacggcggugguauuaauggggggacacgagccggggcgagggucccugggguggggccaccucuccaaagcccucucugcccgcagcccacccucccugaauccuacuggcauucuuccugcacgguuuuccgccaacggcuacagugugccgaugaccucagugaugucaccuagggccucgucccaucacacagcggccagaguggcuccagaacauuugucccugugauccaagagucuaccccuugucagucccccauaguugccacagucacccagaccaggagccgcagcaaacaagcaggggguacagcaucuguccccauggcccugguucucacacacaucccagagucucaggucucaguuuccucaucugucaaauagggccgacaccgcuaagccugcccugcaggccauggccaaccccccugaggucuccccaccccucccagcggugcccacccagggcuucucgaggaaggagcucagcacccgccccagugacacuucacuucucugggcuuugcugccuuuuccuauaaaauggggugccagucgcccucucagaguccuuucaaggagcugaugguguagaccgcgagaccugccuugcagggcacaugcgcagcugcuccugucaugcugggaccuccggaccccgggccucgcagcugccuuggauccccucccuccuccagucacgggcucugggcuggcugcugggcguguugggcacagcgggcccuaagcugacccgugcccuuuguggcugggaccugagauggggaggcccccacccccuaguuccauggcuuugggaggugggggugggguguuuucuacucuaccacccuacaacgaaaaagaagaaaagagaacuugauaaaaaagggcgaugcgugcugugcgguggaggaggugcuaucgccguuaucuaucugcuugcucgagcugagcggccccccuuccccuuaucucaccccacccuaaugccaggaacaaaagugagaacacacucucaacccgcacacccgcgagccccccaccgccccucacacacccgcgagcccaccgccccucacgcccccgcgagcccaccgccccgacccacccgcgagcccaccggccgcugacgcaccugcgagcccaccgccccucacgcacccgcgagcccacugccccugacccacccgcgagcccacaggcccugacgcacccgcgagcccaccgccccucaagcacccgcgagcccaccgccccucaagcacccgcgagcccaccgucccgacgcacccgcgagcccacugccugcggcgcacagagccaccagaucuagagggagagcugagcacucggggugcucugaaagucaucaucaucaucauuuugcaaagaaagcccccaaauagcccucccugaaacaaggcagccaaaaauaagaagucgcucucaacaggcccccacaggagaaaagaggccggccuuggagagggguugggacuuggggccaggucccagcugugccggccucuuggcuguacgaccuuggaccaguaucuuucccacucagagucaucccugaauggaugucagggagccuucgaggaaaggggagagccugcacuguaacugaagccccccaccagccccaugcagcuuucugacccuagacuuggggcugggaccagucacccagaaucugauacccccagggccccgccccccagagccccacccccauggccagggcaccacuguccuaaccagccuguuggcagccaauggaaaugggguaugcaaaugagcaggggugaggcccagggauuggcugagcugcugugugggggcagggccuccuccaggggcugcccuugaccugggggaguaguucccauccuggacccugccccaggacgggagaccucugccaccaccaccaccggcucuggaagggcccgccuuuuaggggccucgcugucugggcacaggcggauggacaggcuggccucuggaugaccugccaaccgucagagcccagacccacguggccucaguuggggaccaggacccaggaguucccgagaggagugcagccagcagccacucccagaugggaacagcgaguuucacaacccggcagggacggcccuggggccagccagccucccacccccaugucugggcccacuccagacccuccugcaggcugccccccaccgcuccacccucuccccgcgcugacuuccauccggaaccucauucugccaagcuucugaagugccggccgggccagggacguggcaccaucuuaaugaaugacagucccaaccccuuugcccacccucagccuccccaucuguaaaaccggaaggcggucuaguaggucugccucccaggaugguuucugggcucuucagcaagccccuugccggccugggccucaguuuccccuuccacaccaugaggcugagguggcagguucucuggggguccuccugucuguggcuguggcauagccuggaaaccuggggucuuccagauuucccauugucagaaauucaugugccaggagaccaugucuacagggggcuuaggacaccuuagggggcaugcaccuguguucugcauccacccacacugcacagugggucuugcuggcaagaccaggaugaggcaggcuccgccggccugagaccuggcuggaggcccugucagcucccacggcaccugaaaaucagccacagguguggguguuugucaaaaauguguaaguggaaaauaguggcggggcgaggagagaaagagucugggcugagaucuaaggagaggaaguagggaggggccguccgaccagaaccagacaucaccuuggccagggccccacccccuaacguggggugcagugccucucacguggugagggucagaggugcgugcccagcccagaggaucuccccacgcagcccucccagucugcagaggggucuccacacaugcaggcagcucuguccucucccaggacagcuuggggcauacaguaggugcuccauaaauacuccccagcugauuucuggaucugcucccugugccuggcuguguccccagaggcaaagcaagcagaaggaaaaaggaaacggagaaaaagccagggccuccagagccagcauuguccugggcaaaggccccucccguguaggagcaucgccuguggagagccacgguccuugucccugugcuggggcugugacucacuccugcgggguccuugcugucagggccaccccaccuguccuggggacagggcugcuggacggguuggggcgggcagccucuggaugcccacggguguccccuguacucuccaaaccuguacugagugccugcugugugcugggcaugguccagggaccccaggugaccucauggaaccccagccuaacgagggagagugaacacaggggucugacgugcucuguggcagaaccacuggggaggcuguuguugggggacuggugguguggagggccggguggugacacucagugacaggugaggauguggcacgguguggagggccggguggugacgcugagugacaggugaggauguggcacgguguggagggccggguggugacgcugagugacaggugaggauguggcacgguguggagggccggguggugacgcugagugacaggugaggauguggcacgguguggagggccggguggugacgcugagugacaggugaggauguggcacgguguggagggccggguggugacgcugagugacacgugaggauguggcacgguguggagggccggguggugacgcugagugacaggugaggauguggcacgguguggagggccggguggugacgcugagugacaggugaggauguggcauagggaaacacauccucgccgagcgcacagugggagcuccgagcaggggaugaggucguccaggaaggggcgggagacgcagcgugacgcacugacccagggcccagcucagaugccaguaccucacccggugggguccagccuccgcgacaggcauucccuuccccgugugcccuugccaacuacauacugggcugcccagaggcugccuucugaaggagcgagggggccgggaggaggaaagcccagcuccccugcagccaugauagauagaccagacuuuuccucuccacuuacuccgcccugaccgcgaugggcacugagaauucagacaagagccggacucccugagcucccaaccagcugacccuccagggcugcagccaugugugaccuccacccucgcgaaggccagcggccgcagggucuggcuugggcuauagcaucuaggcucugagaugacuguguccguggcggcucccgcucacaguucaggaccccgagaugaccgugcccacaguggcucccacgcauagugggggggccaagaccccaagaugaccauggcugcgguggcuccugcucacagugggggaugccaggaccccgagacgaccaugcccacaguggcucccacgcauaguggaggggccaagaccccaagaugaccauggcugcgguggcuccugcucacagugggggacgccaggaccccgagaugaucguggcuguagcggcucccacucacagagguggggucagggccccaagaugaccguggccgcgguggcucccacacacaguggaggggucagggcucccggcucuaaagccacauggccugggcaugaauuccugcccaccacuuacucacacugggaucugccacagacaccugagccugugacuaagacuaaggcuguguguccaucucugugaaaucggggcgaggcccccgcgggcugggagggcucugggccuccggcuggcugugcaccauguuccacuggguuauuccugaggggaccugcagguccgcaagagccuugggugggccggggcaggggccguguggucugcagggaguggagccagaagccugggccuccccgguaggagcccggcagggccaaacccugaugggcagcggaagucuguuggggccacucucaggacaggucaccucagcugggcucccaccacccauggccgccgguaaccccaccccaucuguggacccaguucguggagggggcgcagggcugaaccccagcgagccccagccucaguguccacacccacaaguggcuggaggcacgguggugggcagggcaggugcccacaggguggggcacacaggcagggaugugccagcucugcgccucggucccaggagaaagggaagaggcaccagagcgccugcugccaccacagcacagagaggguggcauuuccugcuuuuuuguuugaauuuucuuuuuuuuuuuuuuuuuugagacugagucucgcugugucgccaggcuggaguacaguggugugaucugggcccacugcaacaucugccucccggauucaagauauucuccugccucagccuccugaguagcugggacuauaggcgccugccaccacgcccagcuaauuuuuguauuuuuaguagagacgggguuucacccuguuggccaggauggccuccaucuccugaccucgugaucugcccgccucagccucccaaagugcugggauuacaagcgugagccacugcgcccggccugaauuuucuauuuuuuauugugguaaaguguacaucacauuuaccauauuaacccuuucccguguacagcucaggacacaagugcauucggugcugggaacccagcagcaguggguccccauaacuccacgcccucccggcacaggcucucccugaugguggcucccacccuugccccagccccacuccagcauccuaggcuccgccucuguggguuggaggcugauguguuaacuccugguuucaggcggggcagcaggcccagggcaggccugcaucacagagcucagagcucuagcgccccacaagcuuccaggacgccgcagcccuggaccccaccaggacgaggggccagcugggcaggaggucugggcgcaggcccugcggcgcugccgucccccgugggaccgggcagccuccguuucugcagcugugcggugggagcaguugcuuugcugccugagacccuggaacgaggaaaaggcugaacugagccagagggcgugacuucuuccuuucugaaaggcaucugagggucuggacacuaggguccccaggucuggggugaauccugcuccuggcccccgggaaucuccgggauggcccacuuggaagaggauggcaggaaccacccacccuugggcugugguuggaugcugugaaugaaagccuggagucuccugggcuugugagcucacccaccgacccucaggccucagcccagcuguacagccacugaugaggggccccucucaccauggccuugagggcggggugaggugaacccacaggccuguccucgagggccgcagggcgggaggagggucggcugcuagggagggccaugacggccccgcugccccggggucugggugcugcgccccacuucucccauggccgggcccauccugggggaccccugcucccuuccagggagccagcugccuccacccaucugacgcaggcugcgcggcgauggcuccgugagccgcggcccccgccccaucuaucagcccuuaucacccaucuggggaggggggucgcuccccagcccagauucucggggccgugcugggaccucuccuccucccugggccuccggcgggcuugcagccgcgugcguggccucagccacccugccacacauauggccugaccccauccucaccuucacccugugcggugguccuugcccgccacggccccacgcggccucgccacccccacccacaucccaucccugggcacccccucggcucuuccgcaagggguuuaguaaucgguucuccggagugaagcaaucucauguaaucuaucaguggcuaucaggcccaucggagggccgggaguggccgggcccagagauggcgccaaccuucagcgucgauaaaguuuccgaguucagcggugaugaauguugaguaagcgcaggccgcaccgauaggauguggacuuggcaggcggcggcuccggcugaaaccaaucucuccccuaucagccgggcugggcuuucucaggccccggcucuuucuucccuccuccuccgccucccuuucucucugccuugccccgcccgggccacugccccuggggacacgggugggggaccagcccacuggcccuggcuccagagaaggggcaggcucagggcagggggaggauccaagggagcccgaagagguggccagagcuggggggcugccuggaggugguggcagaugcagcagcugcccggccaggguucccccagcagcccagggacccuaccacagucugacagauuuuggcauucugcucggugucugaugguggcuucucacggugcccagaauaaaaccccagcucccuccaaagccuccagcccccugccuccccgccacccgccuccucccaucccugggccgugcagggcuccgucccacuucggggggcggggggcucugucuucagcgcucucugcccggagcucuucucagucacagguaaagguuagccucugagaagcccuggugaccacccugucugaagccagcccccacgccagcccgcucuucuccauccugaacacuguccgagccuccgcggcauccuccauucccacacauaggauguucauuugcuccgcucuuaacgccccugcugcagaacccccagggcugucgggaacccgcaucuggggccucucugccuccugcagagccucccagccucuguucacagcagcucuucgagacugaugaguccauacucguuggccagauguguaaaccaggaccugggcagccccuaugcccagagccagucgccagcuagauuccacuuggcccugaauggcagcugaccugaggcccgugcugggaccaugcagggacaggucuggcugcucucugccucaguuucccuacaggccugugcuugauccuggcagagcuucauaaacugugaagggcugugcauucguguugauggggaucuggucagagggagccacagcuccgggaggagccaugcccgaugccagcccugcaccagagcaggcgaggcagguggacgcucccguggggugucgagggugcccuggcuucagccaugcagugggcaccuggcagggcccaggcccuggggggccaucagaggggagggugggcacacacagggaccauggugagggcaggagcgcacgcgaugggagggaaggugugggaccgggaagggccucgcugagcugugauccuccuaugacguggagccaggaggagaaacugaggccagcaaggggagagaccagaccucgggccuggaagcugcacagaccugugucccaaucccacccaaguaacccugagcaggggcagggguccgggggggggagcacagccaagaaaaagggaggaggaggaggggagagcgagcugaggccugagaaagcccagguccucucuccugacugugaggaccccaaggacaacgccggguacagggcagggcucgggaaaagggugcaggcaggcugcugggucagcacaccuggaucugugcuaucuguguggccaccccgaggcucgcuggccacugcccacugucugcugccuaccacuguuaguuccucugcuuagggaggggcugggcucagaggagccccagcauugccugcagccgaugcugccugggacgcacgcgugcaggaggaccugggccuacccucggcccccuggacggcugcucagccuggacaccauucggccagaggcugggcguggcugugggcccagggcaguuaagcccaccagguccaccccucgguuacugggucagccacaggaagaagugguggggcugagggggugugggugcagaacccccucccaaugcuggugccccaugacccugagucucaucccucuccucguggugcccccacacccacccaggccucagaccccacaggggcagguagcagggcaccuugccaugggcaccuucggccaaccaggugggacucagccuggcucacccaccccagggugagcaggcugagacccgaaggccccucgcgggaaccaaccaagccuccaucccucugcacagccucccugcugggggagcccaggaugaccuagccacaccccccuccaagccagccacaccccaccagccuguuuccaggcccugacccuucccguguccaucagcauuugcuggguaccuacugugugccgggcaccguuccagaugcugggggugcggccgugagcauacgugaagggagggagagagggccgccaaguggcagggcggccaucgugggaacuggggagggcugagggagggaggggagagggccgagcaggugccugcuggaaguucuggcagagagggcagccagggcagggccauuuucggaaaccaggugggagcuggguagggguuuggcuuuugcuccgagauccccgggggcccaugggaggcauuucagcagaggaggugagggguugggggcugcuuagugaacaugaccacaaggccaaguguggcuggggaggcagggagacaguucuucacacagcaaguguguuguggaauccaggcuguuggcaccgagggagggacucgacuugaacauacauacgaugggggccaaccugagccagggagggcuucccagaggggcagggaaaggcagggaauuugagggcccgagauggucagaagcuaagccgguggccugagggcuucccacuucuggcccgggaccgcuuuuggcugcaagacccuggccccccaagggcagugcuuacgcuagacacacagugugauagcgauggagagaagauuuggacgugcgcacgcccgugcgccgggucccuucuccacaccaucgcagaccggggccacgcagaccuuccccgcagcccugaaagugaguucuggucucugccagcccggcuucccugccuuccaugaggaaauuggaacauggacauagagggaaccacaggagaggagaggagggagagaagcgggcacaguucacaugagugccgggaagggacagcugagcagccacgugggcugggcgugugggcuuuggccugugagggccccgggucagcggagaagggcacggggaagguggcugaugcuagaaagaguaagauuuucagugacuccuuucagacucuugaagagaagcaagcacagauuugggucaccgcgguguguuucuuugccugagacugggccagguggggcccuggauuuuauuugggcugcguguuaccaccauacccauuuccagcaaacuuuccugccuuuaaaagccaaacauggcugggugcaguggcucaugccugcaaucccaacacuuugggaggcugagguagaaggauugcuucaguccagcaugguggcaugaaccuguggucccagcuacucaggaggcuuaggccggaggaucgcuugagucuagggguuugaggauacagugaaccgugauugcacaggcacacuccagccagggcaacaaagcaagaccccgucucaaaaaagaaaagaaaagaaaagcaaaaccaagagaaugcuuauggggaugcaguugguuguaugugaauuccaucucaauugaauauuuauaaggcucucacugggagugagucagggcucagggccccugcacagcagccaccuacuugagccuggggacauucaguucagcagcagcuccccaggcuuggccuggagggcguguugggcucugaggcugcuucagugggcuuggcccuccuggagcccacagccugaggccgaccucggaggggagaacagggagaacagaccugggggugggugggucugggacucagaagaggcacgagcuccccauggcagggugugugggagcucugucugucugccucuugguggagccgcucaaccgccaugucuccccugccccaggcccgcuggcacaguugaggggcaggaccgaugggggagggugucugggcccagaaggcacagcccggguggugggcucaggccacguccccagccugccacgacucucugggacccuggagguucagccacgugcuccugcgcugguuagggcucugcucuaguaagccgcacccucaccggcauccgcuuuugugguugcccuggcugacagcaagugcugaucccgaacugaggagcugcgggugggccagggguggggcugcugcagggcacucuucccgccugggccucucauagcccccgagggccucuucauucuucaucuccaucagcgucugcgucuacacagccguuccuguguucuuucuuuagcaccuggugccggcaucccuguaaggggucgcugucacgguugcccguccugccucccgcagggcucacugagcugcuguugcgggcccacagaggcacacaugcccccucccaguccagccggugaaccagugugaccuacaaauaaacgaggcuccggcagagcuggggugcuggaagggaggccuggaccaugggggacggaccuaggcugggggaaaaagccuccgccagagggaugaggaggccucaacugcacauagaggcgaggguucccguagagggggcagggggugcugaggccccaaggcaagggcggcaggggaaggaguugggggccaaccugaggacccauggguuuaagaagccaggugacaaaugcuacucgagggaaacggggguggagacuuccccgggggccuggaccccacauggcagugguggcuccgggccacaccggggugauggguuggacgugaaggaggcucgaggcuccgagggcgugugccgagccugggcuccccaguggguagguggguaggcacagaaggcgccgucugcuccgggcucucccaggcucugcgcccacucccucagcugcccuagugccuggaagucagucuggcugcuugauggauugcgcgugagguacuggccacuugguccugagggugugggcggugagucccgagucccaaccgcggggccgggcuccccacgcagguggugcugggcuggugucgccagcagaccccacuuugauggcggggcugggcugcugcuaccacugcucucugugcuucgguuucccugcuuggcgagauucacgggaugagagaugcuccuagcugggccaggggguguggacagcaucagccacucaccagggaccugggagggcgccgcuuggcuggaggucaugcuguagacucaacucgggucagccugggggacccaggcccucugcaauggcucaccacggcccccagacccagccugggccccagucaccuugcgcucccauagcguggccucaacagagcgagcggggccguccccgucuccucucuguccccaccguggcccaagcugcccgcugcccagcuggugggaaagucugaaucuguugcuauuuucugucuguuaucagggccuuaucuggccgcugugugccgccagaggccagguucucccuccuggcaaugcugugacccccccccacccaccugcuacccagggccagcaagaccaggaggccagcccugggggucuuucucuucugccuccccagccccaccccucucccaucuccccaucccauccucugccccgaccugugccccucuccgcuccccuccccgucccucccucccccccgcugccacccccgcaguacuuccucccccagcccuggccuucacccacucacaccccccgccgaaggaggaagauggggcacgucccugcagaguagaaacagugacagcagcuguggugacaaccucacaucugcgcccagcgcccacugccaacaccuggcugaguccuaacgccagccuuuggcaagacaguuugauccgcugaaaccaggcucagggagaagccgccugcccugugccagccucagcuccugcuguuccuuucuccuggagcgcuuuucccuggacccggugcuggcagccuccuccucuccccauccagauugccacccacuugcuacuuccuccaggaagccuuccuggauggcaccucugacucuuuccuguggugcucacacuggcaucuuccacuuuuugggggauggggcuggucacugcaggaucucuggcaccucgugaggguggggcacgccaagggcucaggaaggggaaaggagccagcgaaagcgaaggaggaagaagugagugugugaggggacgggugagugagggagcggaugaaagagugaaggaaagagccguggugcuggugggggaggagcggggccguguggcugccaguggucacccgccccaccagcugcucacauggggccugggcaggcaccugcaccuccacuuccuccccucuagaccaagaaugagagaacucccaagagaggccagcauaggcgccuguguccccugcaggcacccacuggggacuuaggcucaucucaaacacugagccggagcagggugcucccugggccagggcccugguuuucagaaggcuugcccaaggucacagagccaggggcaccgcaggggccuccccaggggccucagacuccucauccacagcccccaucugcgccccaccuggcauguccacccuggggcccacagucugggggaugccccccucuccucagcgacuggcuccagcuuuccgcaagacagucguucaaaggagccccccagcgccucgccaucaaagccgggaggggccaccuuaaucgucgguguggggacuuggaagggagcugggaucaucccgcugcacagagccagcuccauaauucaguuuuaaagcaugaaaaaagggaguugaugaaauuccgcuaucagcgccaagccaauaugcaaaauaucucacccccaaucaaauagcuauuauguuuucauuuccauuucggcguccggcuuaaugagcaggagacggaugggcgcacgggugucugcuggcugugauaaccaaggggcuccgggcaccacaggggcugagcccagugcugcccuggccgccaaugaccacagccauagcccguggacaccuccaggcaggugcagccuuggccacugaccucugccaggccaggcaauggggcugacaucacccucacugcagguggucccagggcgagggaggcgugggguccgugucuggcucggggaagggcuacgugcugggugcaggucugaaacccagccccaaguuccugucccaccacccccacccccaccaccgcugccuccucgccgggggccguggacagggcagcucgcaagucggccuugcugggccuugguuuacucaccuguaaagugggaaugaccuggcuucccacuguggguauugggaugugguuggcgagugggauuuccacgauggcugcccccaagguccugcuuacgcuacuccacuccacccugccacagccgucaccgaguccccguacuguccucauacccccuccuccaugcacccugucccccugcacuuuccugaccgccccuaccugcugaggucugugugggcugccacccucuacaccccagguuccccaucugaaaugaaauuggaagaccaucucgcuggacuacgugggugggggcgguuaagggugggcauuuguaaagugcugagcaccgcccguccagucuuaaccauucacacccuugcccauuucucaaaaccugugcuagccacaguucauguucacugagcaccugcccuguguugagcucugaggacgcgggcaggcugcacguuucaucuccugaagugggagcugcuguggcuuccaucuguagaccgggaaacugagcacagagaguggagugacuugcucgaggucacacagcaaggacgcagcagcugucagccugccuggccguggguuggccugcuccagcuguuggcaucacugggcagagagaggguccccagagaggcuagggggguucuuugcuagccccgggcauggggagaaagcagcagagagcagcuguggcucacagaugcccccagccacugggggcccaagugcucugucgcccaccuggagaguccccacggaccccaggugggccacagacgagaccggugcugacuuaggggcucgguggggaccaggcagcugcucucagacaccgaggcaggcccagggcagcauccaccucgacacauccuauuugugggcugacaguugucuccugcauuaucagagccguuuuaauugugcuggaacugaaauuagccuggcagccucuuucuccacgcucaucaccacggcuuuguguggagcaggagccuuuguucuuguguaaauaggagaacccaucaccaucccagcaccucccugggugucugaggcccaccugggugggguauggagagccagcccaccuuccugaggcugcagcagguaugcacagggcugugucuccugugggccccagccccagugcucugguccccgaagucccugaaggcagguggccuccagcccauuugccagagcaggucacugaggcccugaugcccuacagcugcucagcaggaggaagcacagcuccugggcagccccucccagcuccaugccagccacagaaagcccgggccucuagaagggggaggagccgggcugagcugaucguuccgcgugcucccgccaagucggggauggccgagcaccuccugaccuucuggauggcacugccugcucagggccgaccccagagguggggaggggaggccucgguggcugcuuuucugcccuggcgugugcugagggagggcacucggguugggccuccugucccaggggcaggaguugaaccggucagggguggcccagccugcccuggagccugcccgugugggcgcuuuaaugggaggcugugagcccucgccuggggcuggcuccuguguggucugagcccagcccccuccuauaauuacagcucugaggugcucugaggaggccgggacucaugggucccagcuagagccccaaaggcugcagcuaggagaguccagccugccccuccuguccaggaccccccauggcuccccgguggcaccugccccuccuguccaggaccccccauggcuccccgguggccccaggaugaggguccccuccuccccguggccucugaggucagcacggccaggacccugccugcccucagccuugacugccagcacacccuggcccccgaccuccccuuccuccaccaccucuggccccgccccagggccuuugcacauauggcccccucugccagagcugucuucucaggggcuggucucacaacaaccacuguucccuccgagaucuaccggcggcagccccucccauccccguguuuuucugucuuucucucauggccccuucccucacugcacuuccagaacuugccauuguuuucggccggggcccaucuguuguucucugacuguccccacaguggcccggacacccagggcaguguucagcgaucuggugcaccccugcauccuggaacggcaccuggcaccuagcccucgggugucagcagaaggcagaaaaggcaucugccccuccaggagcaguuugguuugacggcaucagccagccacagccugcucaugaucagagagggggcuggaguccaaacgcgcagaaaauccaccuucccgccucccugcugcauggaacggcggggucagccuuggacaucagccugaaacucagucacagcauuucuccuucucucgcaucuucgggggucucugacaugagccucugaaccuggcguuggacgcuggcggguggcacguuucuuacuggcugggcagguguuucgggcguuagcaggcuccaccuccgaccagcccaucucccucccaucuucugccuuucccuggagaaacaaagcaaagcagggaucaugaggggcugugaaggaggacaguggggauucggagagaagcucuugaagcugggcacaugugggcgcuucgguguguuuuucuggggaggaggcaccagguuucaucagauucccagaggggccaugaggcaagacaagccaggaaccaccuagccagaggcgcaaaccccgaacaguucuccauccgugcggcuugcuugccuccagggauggggcgcucagcccucaggaggugguuguuccagccugcaacgcucaggccuucccucuggugucuucuguucugccccacccccacucugccccaucagcuccccugacacgugaacucagacacgcgguuuccagacuuuucuuauucauuauucugcugugaccauggggcuuggcggccgcaggaccuggggucugggcucaggagggccacggccccucccacuccugagugugucgggaggcucugcccccaucgugcuucacacaggacaguagaaggcugggcgggucaggccuuguggaguaugggugcagagggggcagucgcagcacgcaggcugagucagggccuggggaccuggggagcagucaaacaggauauggaagggcaccucuguccucuguucacacuggacaccaucacccaucaccagccccgccggcggaugucagcacacacaccugcacucagcgccacuccacagccacugugggguccggagcagcugcccccgcacuugggccgcguggccuugucucagucugccuugucaccugucagguggacuccuggaguucccccaccccgaugugugagucucugagggacccaggcccugaggcacuccacccccaggugcugcagacaccugugcccugcuugguuuguucgcucgacaagucugugagcgccuccuuugugcugggugagggugucaccccagggaguucccagaccgagggaaugagugugagggaagugcacggggacugggccccugggcggggcacuggcaggugaugccaggcggaggccguggcgacggcgacccucagggccuggauggacgcugggccuacaguacagggagggcccacucgcagcuccagggcugccagagcaggugggggccuguccccuggugcuggggggagcaggugggaaagagacacgggguccgcggcccuucucuggcaagaguggaauccgugggcgugguggaggccaagggucacggcagguaagggugggcggaggcgacccugcagcuuuggaaauguugcagaggguggggguucgucaagaaucaucaggucuuuuuuuuuuuuuuuugaaacagaggucucacucugucacccaggcuggagugcagcggugcaaucgcggcucacugcagccuccaacucccagucucaagcgauccucccaccucagcccuccuaguagcugggacuacaggugugcgccaccacacccagcuaauuuuuguauuuuuuauagagacagggucuugccauguugcccaggcugcucucaaacuccuggacucaagcaauccucccaccucagccucccaaacugcugggaucacaggugugagccaccaugcccaaaugucaagucuugaggaacccagagggagcccccagcuaacagccaccuguccuuugaccucagggugagggaugacccucacccccacccauugccauuuccgccugggcaccggggcuguaccuaugccaggaggggucaggaggcaggagcuguccccccagagcuccucccgaacccccaucgucuuguguccacagguucccucggagacauggaggccagagaggaggugcaguuggugggugccagccacauggagcaaaaggccacggcaccugaagccccgagcccucccagcgcaggugagucagacugagcccucucaccgcgccuccagccggggccuccauugcuuacccguaccaugcccucagagcucaguggugucugagaggugugggccaacuauaugcaggaguccaggacaggcgucuuccagccagaggccuguugcccggaggcccucgguggggcuggggggucuccaggaaaggggagaugugcacaccugcugcaugugcagccugaaauccagcccucauacaaaugagcagaccaaggcccagauggggcaggucuggcccuggguuggaugggaauccaugccccucccagccucaguagacccucugugaaguggggaccaugaggcccccucccuggggcuuguugagcugugaucccugcuggcaugcugcuugggcugagugcacagugggugcugggugcaagugggugcugggugcacaguggaugaccgcugggugcaagugggugcugggugcacagugggugcuaggugcacaguggaugggugcuggguacacagugggugcuaggugcaccaugggcgcugggugcacagcagaugggugcugggugcacaguggguacuaggugcacaguggaucgguccugggugcacagugggugcuagguacacagugggugcugggugcaaguggguacugggggcacaguggaugcugggugcacagcggaugggugcugggugcacaguggauacugggugcaagugggugcugggugcacaguggaugcugggugcacagcagaugggugcugggugcacaguggaugcugggugcaagugggugcugggugcacaguggugucuccugcuaagacaccacaccccauucacagaccagagaaguuuggugacuugccagggucacucagcucgcaagugcccuagugggggucccacccaggucuggguuuagccugauuuccuccacccucacaggcaccuccacauucccugggcccuccugguggccaauuccauggggcagggcauuucccaagccggaaggagggccugcccucccaggagacaguuaaccugccauaaggaggccugcuggagccagcuguaccccagacacauccagagacccugggagaaggggccucccugggacagaggugccaggagaggucagcaugcucacccccauuuuccaagguccgagagagacagcagcagguuguggggugggcuccacccagcucccccacacuccacuugcagccccaggcaccaaucucauaccuaccccaugccaugaaacccuuugcacacagacugugaauuacccccacuccaacguggaggggauguggccauacccggaccauuugggaggaugcuaggugggugacaugagcugggguggaggagagauggaugcguggggcugccccugacgggcggaagaaugccaggaggcagugacagcagguccaaaggcuccaaggccaacgggggugggggagagguuucagaggggucugcagccgaggggcugggguggagaucccaggcagaccuuggucccuggcuugggagcgggauuucucaguggggacccccaccccagcauuucccagucugagugucaggguccccgcugggugggccgcggccccaagagcccagcaggccucacccccaucugcacaugcccagccugcugcgccugggccccuuuuucuggcaggcagcaggcccuggggucaccagagccagugggacuugaccccagggcuggggccgccaucuccccuagcucacccagggacaucccagccccaggacggccaggccaggugcaggcguccagcccagccucuggugaggccugggacccgcuggcugccacuccucccuguccuugccgccguccccgucggcacacgcugcucgugguacagccagagcucucccuggccagucccggggccgggcucuuaacccucgcggagccuccguuacugcacaugugagcugggugcgagucccuugguggcuggggggagagagcacguguagcacauguggacuccgaggcccuuggcugucaccgccgccagccuuagugccgcacgcaggugccgccggcaagcugcagggcgcccugauggaggggccgcagcaaagggcagguggagguggacuuugacccgggccggcuucccggggagccaggcuccuuaucugaucuaggagccagggccgcaugggggcggggguggggcccgggaaggagcuggaaaaaacagccagggcugcaccuggcaccgcccguagugauagcguggcgaugggcgcgauaacacagcagcgcaggagcugucugccgcuuggcggguccagcgaggcucccucgcgguggcuggagcucagaugccagccacuuugauuuauagccaaaaauaauaggacuuuuauacugugugauugacuuauuugauguuaaucgcagcccuuaucgcggguauuaauaaucuguagacacgugacgucauggggugggggggcuuuaugggaucgcaucgaucggggccgaggugguuaucaggccagcugggaaggcaaacaugcccuuugggcuggaaucggugcagggccugguggaggggcccccagcugccagcagaggggaccagggagcuggcgacggcgcaugugccugcuggccgggacaggccaguuggccauccuguacccugauuaucaacagcagcuggaauaacaauuaucuuugaagcaauuaaugaggggagagggguuuuaaaagagcaagaggaaaacuuggaugucugucccaccccagugagagcgcaccaggagauggggguggcucugggcccgagcuccccaacccggcgcccagcgccucagcauccuucccagcuacagggaggggcagcucagugcccggcacucagcagggaugugacgguguuuuccucucugcagauguuaacucacccccaccgcugccgccccccacauccccaggaggccccaaggagcuggaaggacaggaaccagaacccaggcccacggaggaagagccgggcagucccuggagcgggccagguaaccacgcggguggugggggcagcagcaucgccucccgggcagccuggcccggccccugggagcagggcgacgugggugcuggggcaggugugcagguugcuggagacccaccaggcccaggccugugccuaguccaaagcucagccaacccgugcagcuggugguaucacuggagcuuggcacccucgcgccaaucccgggccucacgugguguacaaggaagcgcugggggguucccuggaucagagccuggucugggccgcggaagaggauccagagugguggcugguaaagaauccucagaggcaggaaaggcagggaggugggaacaggaggcugcgucugagcugcccgggcccguggccuucccagcugggccgggauucagagcugugcugaggugcccaggcaggcggucaggccugaagggcaggagagggccccaccccacuccagagcggcugcagccuauggggacggagucccauccacauaccccgcggggccugggccacaggguguguccuagagggugguuuggugacucugcuccgugauuugcagcuggaguucugaccccagaagucccaugaacguguucucccuguggccccuucggggacugugaauuccauucauuuaugaacgcaggaaauacuggcagucagguuguuucugucguuccuaauaaaucccacagcccaaggaaccgcaguagcgucugggguggaaucccagggcugccuggccaaggccgucaugggagcuggugggugagggagggagggggcccagcagaggcggggugggggucgcaaggucccccguggaggagggacagcguggggaggggcaggugcucgagccagaugcauguacagaugcagcaaguauuuauuauuuuuuuuuuuuuuugagauggagucucacucugucgcccaggcuggagugcaauggcgcgaucucggcucacugcaagcuccgccucccagguucacgccauucuccugccucagccucccgaguagcugggacuacaggugccugccaccaugcccggcuaauuuuucuauuuugaggagagacgggguuucaccguguuagccaggauggucucgaucuccugaccucgugauccgcccgccucggccucccaaagugcugggauuacaggcgugagccaccacgcccggcagcaagcauuuauugagugccugcugugugccaggcauauagccgggagcagauggccgaugcagagcgcgcaagcggccguaaugacaccagcagggccccgucuguggagagaagaugcauggugaggcgcucgccgugcuggggagcgggaaaggcuucgcugaggcagagggaccacauuccuucccaggggccaagauggaaaggggucagcgaggucccagcagcaaggggagagugcacgauggguccaugugcccgccggugcaaguaggcagccgcuuguuuaacgcugccccuucccacaacagggcagccggggccacagagagaggggugggccugggcagccgcagccaggaggaugacccggccccauggggaagcugaguuacaccugcaugggcuguggggcugcccaaggcaaugcuggggccucauggccaccgguccucacgggcucccccugcugucccccaggaagggggaccgggcauccagcacagcagaugaugugacuugcccaccugggacccacagaugguggggguuccaggcgccaugguagaaacuugcuggcugcgucccuucuccucagggacaccagguggggagcaggcccaggacacaccugucgggggucagacaggcgcuggugccuucggggcucucggucaggcgcuggugccuucgggggucucggucaggcgcuggugccuucgcgggucccagucaggcgcuggugccuucgggggucccagucaggugcuggugccucaggccuucgcugcggagucagcaugacagggaggccuuuucacuugcagggcagcacuguggggucgggaggggccgcccugacugccucaguguccccugcuguagaauaggguagcggguagcagggagggcgcccacaggccccccucgggcccgcagagcucccacacucuaucaguggagaccacccacgcaguggcagggaccauuguguaccugugggacccaguuggccacugggcaaacagggugcugggcaguccucacaccagccccaagaggggccgagauggugacccaagucucuggaggaggagacccagcccggggaugcaggacgcauccaccgucaugcggcugggaggugguggagcuggguuuaggccuggaguucauagacacugguuugaucgccaccccaagggucccuguccaucccugcgguguugagagggguuagaucauccuccuguucuccagacggagaaggcccugggggauggagccuggcgccgggaagggccgggccccugaggccggccgugguuuggggcuggggcacacccccgagcuuccugugcugugugcauccucaggaccaggcggugcccuaucggcucccgcagauaugaauuucugugcagugggcggugaugggcugauacgcggccgcuggccaaccgcugcaguggcuacggccuaucagacccacacaggcugagcuaucacccgcggggaagccaaggaggcucugugggcuguuaucucucggggcggcccgugcgucgauggccagcagggucaguggccccaagggcagugcccagccaggugaccgguccaguggccagggcacaauaggggaucagccacauuugcccugcuccuccugagcaucucugccuucugucuccagacccucucucugaugcuccaucuugugugagccccucucucucuccccaucccuccucgccuucucccucucucccuuccucucucccucucucuuugccguucuccuucucucuuccucccucccugccucucuuucucucucucucucucugucucucuccaugccucucucccucacccgucucugccccuuucucucccaauuucuguuuuauggucucuggcccacagcugcuccccaccccacccaaucccaagggugggaaacagugcaggccccagcccuucugaaccugccccagccccucugaaccuggccuggggcccuguucuugaggcggccugggaggugccguccuccuuuccuaucugggguggagggagcaccagcucggaccaaggggcacucugcaccuuguggcuuuggggaggugacugggcccugagucuguuucccaucuguccugcauguggaugggacccggucacgcugcagagcccagagcccagggcccucaucugcuggcuggacccggacucacagguauccugggaaaccccccaaccccgaccccgguuagacccauuucccagggaaagcgacugggacuuguggacauccagaagguggacgguguuagcccggcggagaggcccggccuuggugccucucccaacagcuccaccauggguccagccaggcugcccugucccugguggucccagacucccuggaggcacucauguaacaucaggcagagaggaggccucccagccccucuccuucucccaagggacacccaagaggcccccaacacccgcugcacacauaagugaguuccugggcacacaaggacuuuguaagcaccggagagcugucccggggagcagagaccugucccaggguguggggagcugucccagggagcagagagcugucccaggguguggggagcugucccgggguauggagagcugucccgggguauggagagcuaucccggggugcggagagcugucccggggugcggggagcugucccggggugcggggagcugucccgggguggggggagcugucccgggguggggagagcugucccggggugaggagagcugucccggagugaggagagcugucccagggugcggggagcugucccgggguggggagagcugucccacggugaggagagcuguccuggggugcggggagcugucccggagugaggagagcuguuccgggguggagaaagcuguccuggggugugggaaauugucccgggguggggagaccugucccgggguggggagagcugucccgggguggggagagcugucccagggugcaggaagcugucccggggugcggggagcugucccgggguacggagagcugucccgggcugcggggagcugucccgggguggggagagcugucccgggguggggagagcugucccagggugcggggagcugucccgggguggggagagcugucccgggguggggagagcugucccgggguguggugagcugucccgggguagggagagcugucccgggguacagagagcugucccggggugcggugagcugucccggggugcggggagcugucccggguugcggagagcuguccuggcaugcacauggccauugucuugacuucccaugaucuccuggcccuguuacugcccccaccccagccccuuccuggcccuaccugauaccugguggucccagagcccuaaaaaggaucagggaggcacucagugggugcugguuuuuguuuucaaaaguucugagcucugucugcugcgagcggcuuugcucucgagcgccacggcuucaaaggagggcaccuugagcuguucugagacgggagcacaggcccuauaguccagccucgcugagugacagcaggcaggccgccugaccccuccaggccucaguuuccgcaucuguaaaauggacauaaggaaagccacagccgcaggaagccuccacgaggagggggacugcggaguguguagcgcagaguguggcuggagucacuucccagaccucggcugcaggccuugagcuugucggcugccccggggcggccuggguuaucucggauuggggggugcgggcagguucuacggggagaagccgccaucugcaaccuggaacuccccuuuccgcggccaagaggcggccgagcaggggccgggagcagccaccuugcgcucccccgucgguggcagucaccauggccucauggcaggaggagcucaccccccaaaccccguuacccucucagcaccagggaggcuuccagguggaagccggaagggauccaccagugggguuguugcagugcggccccgcuguccaaagcaggacgcccggccggggugagaggccgcgggcagagccucccgucacagggaccaaucacaacacaccaaaccccgccgucaccacccacagcaaacccaggaagcgagggggaaacagggagggggcugauuccaggaggggguguccgcgggccuccagggugagucggggcccugcaguagggagcagagggugcaguagagggcgcagcccugcacgggcaggaggccgcagggccugaguggggggcgaggcgggcguggacaggcaggagugcggcccggucacugggccuguggccuuggacuccagugaggcagcaggaggagccggcaggaggagagaagggcuggggucugagcgugaucccagaaguggccacagagaagggaccucggguggaggccaccagggccuggacucccuccuccucccuggagccaccagcccggaugcgaagggaaggaugggcggcaggaggcggagagcuccuauuuuaucuuugaaaugaccuuguuugccggaggggcggcugcuuaagauucugcuaugcaaauggcuaagccauaaucuauaaucccugcacgcgcucgggagcagcucggccguggcucauccugcaggcccgucccaucgugggauguggggcugaguccugggcaucccacuccugccucggaaaauggaggcgcucagacgugccagccccacuaggacuuggagggguggagccggggucccauucgacucccugggguccugggcuggcccauuucacgggcccuguguggucgucugcccagagaguaaucguguaggcugggccacaaggaaacaggugcaggaaaaggccgaagagcgugggggcuggacccuggaguguggaauccccuccccuggaacaggccuccgccaccucccucugugaggcugggcagaacugaggggaacugggcucagaggaaagcuucucgcccagggcuaccuggggcaccgaggaggccucacuuguccguccuuccucuggcccccuaccugcccaccugugccagugcagaggaggugccuggucugcugggugggcagagagcgagucucccccagcucugccugugucugucugggaggcagcguggugcaggcaccgagggugggaaggauggccugagaccugacgcuaagggcaggaccgugccaagggugccaugcuaggcggggagugaggaggcggccucagaggcccacaggacuugcccaccacucugugugugugaaguaacaugagggaagccggggcucuauggccccggauggaaggugaguggccaggagcccacuugggggccaggguggugggguucccuucaccaggaggcgucucggggccuagagcuuuuuccugguaaccaaauguaugaaacaaaaugcaacugggccauggggaggggggcaugcuaaggcaagaggagcacagggguccgccugugaggugggagcuggggugguccagggcaaagcguggccgcauugcccacaggcuccggggcaggcucccagcagugacuccugcggcucucaccugagccugggcuccauguggccccacggccauccuugggcagggcaggacacuccaucccagaguccucuggagccgaaggaggaggcuuccagagggcaccuggcaguggcauccacugcccuugggugucagggagaauuuuccuggugggcucagcacacauccccugccuggccuccuggaaggguuuuccaugaggagggaccagccugggcagaggugagaggcccaggaugugacagcggcggggcuggcuuuauccugagagcacagggcuggggguuccaggcuggagccuggccuuggagacaggcuggauaggagagggagggcagaguggggcuggguuggugcuuggggaccugacccaggugcaccacugaggcucagcccuggccugugcaguucccgggcaagcaauccucaugaagcccagaccccgccccacccccacugacuccaggggcaaaguggggccugggaagcugggccuuugguggaggagaggccugggguacccugcggcugagauugaacaggggggcuccccuggacccugaagcccccaccugggggcuucaggcuguggaacaaaaguccccaccugcccuggcccagggugggccacaggggagagaaagcaacagagagggggcuugggguggggacggggacccucacccacacacugcugggcaucagagcacaccagcacuggucauguacacggggcuugaggagaucgccucucacugggcguuuccugugaggggggcucucgacuccugguauacagggucucucacgucuggcagccaguccugcaggggaggucugaguuggaucccacucuacaguuagggaaacgggggcucagcaaggugagguggcuucgccacagcgguccaacccugaguggacauggggcugggacuugggcagcgcugccuguggguggggggcugccaggccugccccugcccaggagccgcacacaccugcuccuggcucgcuccacccguaagugccucaggaccuggagcucucccaggaccacuauggacaaggugaauuccagcugaucacacaagucgugacuuuuccauccccacuccauccugggcucugauggcagagaugggaaggcuggccauguccccagggcacugcuggccaguagaagggaugcccgagugucaggcugggugugagagaugggaggggcggcagguggacggccccagccccagccccagccccagccccauuccaaggugugacagacacaguagaguggggucgggugugcacaaggagcuggcucagggccugaguuucaaguggucagugguggcuggaacaucagggcccgggcggggaugggguucagaggggucaggguggggcucagggccugggcggggaugggguucagaggggucaggguggggcucagggcccgggcggggaugggguucagaggggucaggguggggcucagggcccgggcggggaugggguucagcggggucagggcgggggcucagugccagggacugcaaggagcugccucgguuuucuuggcuguaaaauggguacccugaaggguuuugugggggguguucgugccgugagcgauccgguccagcaucccggcgcugggagccggcagcugcugugaggcgggaggagggcucuguccacuauuuccugccugaggcccacgaagggucccccgccccagggucccgacagggcccgcccgaggcugggaauccucacccgagugugugagggcgucgggcugguuaucugggccgagcuccaucugacuaaucucgccggcggagcgucuacgcaaaccucaaggccugcuaucggguggaggcugaggcgggggcccggccugauggacagcagggagaugggccgauaggcgacuggcucccuccccacccggugugcgugggugggaaaucauuccagcuauucugccuuaucagcggcccugugcugcccccgauagcacuauuagucuuagauuaacggcggaggagggggcccuggcggauggcaggggucagccuggggucagcuccagagaccagacccagugcugggucaggagccaccuccucuggcuguccuggggaacacggacccaccugggggguccccagagggagccucagaccccgccccacuucacagcugggcagagggggcccuggggagcccgagacagaacccgaggaggggcugugugucucgcagccacgccccuuccccggagguuugcugagcacuuuggggccaggcgcauaucaggugcuggauagacagggaugggccugcccuggacguguaugguggagggacacgggcccuggaaccagaaagaacauggguguccugcccgggagcaguuaagagaaggagguggcauguucauucaaccagcguguguaugagggacgugcucaggccagcauagcccaggcccuccgggaucugcuccuuggugagggagacaccccaaaucaugacgagguaggaaccccacauguccgaggggcaggcagagccggccucgcugagccgacguuugaguuccaaaugaacgaggggcgucuggaaacggugucccaggccgagggcgcagucccggagccgggggcaccccucuaaucuggagugaucgcaggggugaggcagcagucagcucagagccugaggccccaucacauugggccugcggcugcagagggugguuaucuuggaaacugaguucagaggucgcaggcucuggcuggccugacccugggucguuggcguggacaccuuggcugccccuggcccugagccuucccaugacacccuucccuccccucucccaagcacuggccccaggccugggugggggcugcacccggguccugccugcaccaccagaccccaggccugccucuccacgcaaggcccugugggcggagccccuggacaggguugagcuuggggccagagccaucugcagcccccgaggccggcuccccuuccuucauccccagcuccccaacggcccccguggcucccccaugaccaggcugccggcacccuggggccuggcugaccucccgcacccaccccagcccuggccauacagaagccgccuccugaaccuggcccugacuucagccuccaccccgggaaagucaccugggccucgaagucccgaaaucgcaggcagagccggcacucacucacucccuuguacuuccauuuauugagcacaagcuaugugccagcccugugauagacagggggaugcagcgugaggaaaacagaccuccuccagagcagccgcggaggagaagagagcagucgugggggccgcgcagcgggugggagacgcaggccagggcagaggaagccggguacagaggccugggguggggccggcccagcugacuuugggagcagcgaaggggccagggggcaggcaggaccgcgcacguggacagggcggagccuggugccuagcaggcuggacacggagcaggucugcgugcagugugggggaccccaccuggguggccccugaaucccgcuggcuggguggaggacggcucaggggcagacagagggagaucugagaaagggcuuggcugaagugggcaguguccccauucacagaugggaaacugaggccaggagaggugagguagccaccccacccccaugcuggggaggggccgagugggcacagagcccacaggccugccucccagggaagggcccaggcccacccauccagccucuccggguccagcccccaagucccgugggcuccccggccccuccucggccccaugccagcagagggugagcggacaguggaugccccaugaggagcgcagccggagcccugggucuccagccauccuggugguuggggggcgggggccgggccuggcugccugccgugcugcccucuggccucaccaccuuccgggagaggcuaucuguggccagggcagccuaucucggccgcaggcgcuaaucaagcuggcuuccuccuccgcccucccacccggcuuccugccccggccaucccccaccaccagcccccacccaggccccgccguugcccuaccggccccucccagacaucucgggggcaggcccaccagagucaccugggcgagccccuggagccccggcuacugcccagaagcuucccuccuugccccuccugggccugccgcauggccggggacacagccagcuccccccaugagcugguggccucgucaggaagacggccacagggcgcucuugggaggacccuugggacagugggcaggcgcugggcaagccacaagcgugucgcuggcagcugcugccccagcugcccuuguucccaccacuacacccgugucaccaccagcgugggcaccgugacugucacuagcacagaaacagcgcuauuagagagugcugcugcuggccuggccgcugucaccuugcuggugcugucgcugucacucugggucauucugucaccuugcuaggacuguugcugccagcagugcuguugccguuacuggcaccaacccucccgcuggcacaacggcagacucagcuuccaggugucaccucucucaccgcagaccuggggccuguugugcccuguucugggcucaggguccucaucugugagacguggacaggacaguucaggcucccuggggcugcuggggcagggcagggcccacaguuucucuuucccagcaagucugcguggucagcucggaucuuggccacccugggcugagccagguccugggcacagugcugggucccuagacggcaccucgguguccucaccugaccgacagguacagcgggcccucccugugggggugcagccuuggcuggggauaugucagggucucuaaggcuggccccuccccacacuggccugacuucuccaccuccuccugcccaggagggaaacugagacaccacugcuggugauggagguagcggucauggaugcgggggcccucccgcaggugcuggugaugauggagauagcagacauggaugcgggggccaucccgcaggugcuggugaugauggagauagcagacaugggugcgggggcccucccgcaggugcuggugaugauggagauagcgggugugggugcaugggcucucccgcagguacuggugaugauggagauagugggccugggugcgggggcccucccgcaggugcuggugaugauggagauagcagacaugggugcggggcccucccgcaggugcuggugaugauggagauagcagacaugggugcggggcccucccgcaggugcuggugaugauggagauagcagacauggaugcgggggccaucccgcaggugcuggugaugauagagauagcagacaugggugcgugggcccucccgcaggugcuggugaugauagagauagcagacaugggugcgugggccaucccgcaggugcuggugaugauggagauagcgggugugggugcaugggcucucccgcagguacuggugaugauggagauagugggccugggugcgugggccaucgcgcaggugcuggugaugauagagauagcgggugugggugcagggccucucccgcaggugcucuugaugauggagguaacgggugugggugccgggcccucccgcuggugcugaugauaauggagauagcgggcaugggugcagggcccugccgcuggugcuggugauggagguagugggcgugggugcagggcccuccugccacugcuguuugccaugggaucaaccccagcccgcgagggggcuccugggccgaugagcaaacugaggcccagugaguucacgugguucauccgagguggagaccaggccggugagcccugaccuccugaccccagcccugcaaacgccccaacccaugguuuaacacuccuaguagcuccuccacccccgacgcggcuccacccgcccccccccauuuauuuauuuauuuauuuauuuauuuauuuauuuauuuauuuaucucuccuccuucucugcguguaacuuuuuauuuccucacugcgcuuuuccauuacagcggccguggacgcagcugauaagaucgguccccggagaugggacaaaggggccgccaucggcucgagggcuggucauauccugcccgaaagggccgagcagggccugagaugcggcaagaugcuaucucggguuuauugcgucucgugagggugccucccaccccggccccccgcccucucccgcccugcccaggggcccgggcgccgggcacucaggacccaccucugccccauaggccugacgccucugugcuugccccuccaugucccccaaccccgucccugugcccugugggccgcccggggccauggacagggucuuuggccccagguucccaucuggauccacccuggagucacuguaggucuugggcuuguccccagccucccagagccccacugucccuucccguccagugcugcuggaggcaguggccuuggugacccccccuagccgaggguccccaccucgcaggucggagccacccgguccgggcugccccagcgccagcagcugcugcuucccuugacucagcaguuggcuccugggaauuuaucccagaaaaaucaucccggcaugggcgggcucaggucagcaugucaaagauggcaagccauuuauuuuuuuaaauuuuugcugucuugccacguuucuuccagagaaggauguucuaagggcagcagaggccacguggaugcccguuugugggucucugcacacacgguggccggacggcagauccggggcugcccucagagcgcucgccacccccacccgccuuuagcugucguuccuccaaccccaccagccaugaaggccccucagggcuggaaggcugugugcggucucuucggcaggugggagguggcaggggcgcugcuccgcggggcaggguggguggaugagcacggcgccccugggacaggaacccccacuguagcacagugcuugauucaggggccaguggggacccccguggguccugagcagcggcacaggggagggagcugugucuggggggccacgguuccugaguggagggaucugugucuggggaggggcccacgguuccugaguggagggaucugugucuggggggcccacgguuccugaguggagggaucugugucuggggaggggcccacgguuccugaguggagggaucugugucuggggggcccacgguuccugaguggagggaucugugucuggggggccacgguuccugagugcagggaucugugucuggggggcccacgguuccggaguggagggaucugugucuggggggcccacgguuccugaguggagggaucugugucuggggaggggccggccuguucugccuccagggcuccuccugcuuccuggucuuucccacccucugccuggccugcaucugacucacagccagcugccucucuguggagccagguccucucugaccucggucuucucaucuguguuggggugaucggugccauggcagcacccucuguggcuucccauaaaaucacacgugacuuuuagaagaggagacacauucacaguucacggaagcaccuucugccuccgggacucacauggggcugggcucaccccggggcacaggcccuguaccccaguuagcgccucgggcugccaggcagaucuugggcucccgaggccucagucucccccugguuagcaccuccucuguggaggugacgagccugaagggucagugagggcucagggcagcagccuuuucuggaagggacuuuuccauucuuggggguagcaguguccugacacucucgguggguaccagcguccucaccagcaccugccuggguguccauggcugcccucagugggggugggugccugccaggcuggguagauggucucgcccagggcugaggcaguacccugggcccucacucacccucucccauuuaugaagcacagacagaguccccagggggcaaaugaacaggcugagcagggaccugguaggaagaaagggcccucagcggcauccagacccuggaaaaacggggcagaggccagggcgcccaggccgauaggacacagauaagguaaagaaaauauguucugugcaaacagcuuaucugacauccuguuuucagccaccaauaggacaaggcaaggcuggggagagccagggacccccaccccaguucucaggccucaggguccccaaagaccagacuacuaggaccuggaggcaaaucagcucccucuccccacuucccaggcgggaagaccaaggcccaggacccaggguguuuagccuuccagaagcccagagaggccgccaaucucccagcuuggaggugacaugaggcuguggcuuucagacuccucagcccuggcgaggugccgcagaguggcagagacaccgcccagggugcauggagaaagagcaccucgcugggccccgugcacagaccccuuaaggguacauggagggacauggccccccuguguaccguggcgcucugccugccaguccagcugccccagacggggccaagguaguggugucugagaccacaguccccagagagcaccauggaagggguucagacaggcaagaccuggcuccgagcuguccucaaggccucugaaagggcaguucugggccugagcacugccccacugccccuguggggccagggccuugcccuuucccuuagagacacccccuccccaggacaggccacugggccugcaggugcgagggcccccaggucccugcaggagagcugggccccacccugcccuccuugcuauucccaggcggucccagcucugccauuagcuggggccaggguucagcccgauaaagaugggcuguuguucugugucaaaaaaucaauaauugcagcgauguuccaggcgauaggaagacaaguucacaggcaccagcuggcgggugggcggggcgaggcugggggcugcagcaccuggggccggcccuuccugccucucccucgcccgguggcugacgcagcugcucuacaguggacgccaggcccaggcuuggccaagccaagccauggccccugagccugcugcuccuuacugcccguuuguggaagggcagcccagagccagcuagggccucggcgaggaggccagucccuccccaggguccucuggcugggucuucucccaggcgguggugcccuccuccuccaaacacaggcacucagguccacggugucccagugccuuggggacacagccguucaacagccggcccugaggggcugacaguccagcaggaagacagaguuaaugaaaucaagaccucugcccccuggugcccucaggagguggugagcacucuggggaccugggaggcagggaggaggugggaggggccggcaucgcccuccgcacgacggcuuccugggguccuggcacggugccaugugggcuggcccugaggcaucaccauaccuggcaucuaccauucccuggagccagcacccccugccgucagcucccgggaacgcagcccaugccgccugucugcugaccccacccaggcccccugcgauguggguccugagcacaucuuggcaaggagaccaccgugcuggugggcgggugcuuggaggaugggcacauagggcacgaggcccaccucuagcagagagagagccucggcaggugcagccgccggcagggcccccccauggggcuuuccaaccacgugcucaccccaaggacaggcaccccccgcacccccagccccccacagccauccacagugagugcagggucugagggucucaggaaggcagguucugugguucgaagcccuuuguuaaccucuggccuggggugagaagaaaacccucauccaggaggccuggggcucuaggccaaccccacccugggcucuccacuggccuccagggugcucugagguuuguggcccagcagaggccaggcaucauggccaggaggccaacaggggccaugccaggcagaaggcagaggagaccagggcaggagguggggagaccaggggcaggggcagggagaccaggguaggguuggggggcaccagggucagggggcagggagaccagggcaggggugggggggcaccagggcagggggaccaggguagaggagcuggaacccucccaggaggugaugggccuggggucuucuagggcagggcgcuggggggccuuaggcaggccccuccuuuguuuccccucagugaaauagacucaggucuugugcuggggcuuaacugcaaugcugggcacacaauaacacagaauaauccagaaaggacugaaugggggcgggcgggcagggcagguugugcacugagugugcguccgcagagugguggccaucacugggugugcacggggcacagcucugaggagcagagccauuuccccaguguggccagagggcccagacguaugugacaucugguuuuucaacagcaaagcugauccauuucucuacccauccugggugugcagcucccaggcuccucugcgccucucccagacccagcccuccugcaaggaccuggacccucugaggggcgcuggggggacccaggaggaggcagggugggagcccucaucaggcccccagaagccaggcuaaucugcagagcccucgaguggcuuugucuccaagcucuggugcauccauggcucccgucacccgcgucucauccgccugcggcuccgucucccuucucgcuagcgcaugucacguuguuccuuccaucucggcugucccgagugccacagccggggccacugcugcgagugagggcuacgguccugcuggccuuuccagguggccuucugccugcuccgcucggcgacuccuaucugugaacggggaaggggcuucacggagggcccacuacccaaggggugggauucacugcaaguggggguauggccugggcugcagacauggguuugcgaucagaggaccugggcucgacucucccaugccacuugcuggcuguguaaccuccgacguggcccccagcuucucaggccuugcuuuucacagacgagagcaggagaaacgguccccaucaucccccgagcucuuggccucacccccucagcaccauguccccgccuccagagcucagagaugggaagcugaggucugcccagaggugccauggccaucagugacccagccagggcuggagucaagccugggucccuuuauguuucuugacuuggcauucagguguggcuugauccagggaacacacugacugacuagugccccauggcucuggucuccugguccuagaccugggcugccugggugugucagccuucuccaugcccuggcagguuggcuggacgggguaugacucagaggacggugcucagccacuguccauagccuggguugggucuuguggauucuacaggccugagaacaccagcccccaugggagaugccauccagcuccggcagaugugggccucggggagaaguggcagcccugaggggcccgcauggcugugggaaaggcccccugcagagagccagcugcccaguguacccugaccucacccaugcacccaggcauucggaugcucacaagggacccuugugaggccccucugcagaugggcccagccccacagcccuccugggaggauacccuuccccaggccauccugggcuccacucgggggccuccagcagccacucccuccucugggccuugguugccccaucuguaaacaggaaccuaaaaaggggaucacaggaaggggcccagugggucgaggaugugugaagaaguugcuggugggccgggcacgguggcucacaccuguaaucccagcacuuggggaggcugaggugggcagaucauuugaggucaggaguucaagacacgccuggccaacauggcgaaaccccuucuuuacuaaaaauacaaaaauuaaccgggugcgguggcgcgcaccuguacucccagcuacucaggaggcugagaugggagaaucgcuugaacccgggaggcggaggcugcagugagccgagauugcaccgcugcacuccaggcugggugacagugcaagauucugucucaaaaaaaaagaaagaaaagaaguuguuggacccccagccucgucccccaugcauuucucaccaggcuuggguuuguucccagccagaucuugggaggaucacaugugaaggaggccaugacauccacacaggaccacccuuucuacugcccaagaggcuuccguggcugcagagcaggccacagaguccaaccacaggccuugggcuccacguggguuccccuggucucuccugggcacaggcccaucccgacgcucacucugaaccucucccagauguggccuucggugccugccgugggcccugguuggugaauccugggaaccagggcucugccucccguagguggcugcagcacacagagccagggccugcuacugaggcugcagaggggacacagaguuugcgcggaggucacggggugggggaggagcuacuuagccuccccccuccccuucugucgccucucucuguccuggggccucagcugccacccagauuacgggcuuuuccccccaggagggucugacuuuggagccggugaccuugggcaggucaccucacccccuguuaaaugggcuccagguccucaggggccccgcgggguuugccugcgugggaaccaagcacaggugaucagcaagcgaauccgcacgcggcgcgucaucguggacagaggggccggcuugccccgccccacgcagcugaccccuggccaccccggucugccucccgugugacccuggggagccgcucgccccucuggccucgguuucugugucuguacaggauguguuggaagcugguguucucggggcccacguggucugugcaccagccucaccgccaguccgcugacccacagaggcuuccagaaccccgucagccugggguuuuuccuucccucccccucacuccuuuuucuuuccuuuuuugugacuuuuaucaaaagcaaacagcaugaucccugagacagggccgcucccaacaaagcuggacccagcuggccuaugggagccacagggcggggccgggcggagcgauggggccgauuagauaagugggugcuggggugaccccacggugggcaccaaccacagagcccaccaucugggguggcuggacuuugcacucccgagacuaccagccauuaggcacacagggaggcuggccccuggaaggcgggaaggccagcugugugcaggaggggccccgguucccggacguccgcagacucacagggugacgccuucaccugccuccucaagucagagcugugagccagccugccagggccagggcucagguggagaaacaggccuggggaggcgggcggcugagcagaguggguucaggagcagguggagaaacaggcccagggaggcgggcgacugagcagaguggguucaggaggcagaagacccuggguguagccuuggauccucugucagagagcagcuucagggucuggucucgggagcaacugcccucccugcuaugugacccccagcugcuugcuggagucucugggccugugggaugggagcagacgcuccucuaccggcuugcugccacacgcgcgucacggagggggccacgguuccugcgcugggcacuguuggccacguuguugagggaggcgacaggggccucuggggccucgggggcagagccagagcccaggggugaaggccaagucccagggggcagcccugggcugggccccaggccuuaggaugcccaccuggugcagcuucucagcccaucugggcagcuaggagagagagaauagugcuggcugcaccggcagacacacccccuaaccucacggcacgagcccgagggaacgucaugcuggcacccccuucuccauauggguaaacugaggcucagagcacacacaaccgcuggcaagcugggcagaggcaggacuuggccccaggccuguggauuccaaaccccagcucucccuccccaggcacccccaaaaggcccuggacccuggccagacccaccgggcuccccucagccagguuccccacucugugggguuggcucagccagcagcgccaagcucugccugguccucggucccccacugcuuccauccccaugggguguaaucggagggcuuuaagacccauguggaccuuucaaucauauaaauaugcaauggcuggaacuucucauuugguuccucgcagaugccugggggugaaauugaaucccagcacagcguguuuguucuggaaauggcgugugcagucuuguuugccugaauaaauuaguccuugucccagugcugugccuguaguggcggccccauuccccuggcugggcucacccaugcggccuaggucccgcccccuccucaggagacccgucuagagauggggaaacugaggucagagcaggaagagucagccacggggccaccagccgcugccucccaccucagcucagaagagcccuggggcucugguucaaacccacccacccacugccuacccuugggccaguugcuuaaccucucggaucugucucccccauguacguugggaggaguaacuugagcacagcuggaaagaauccucacaaguccugcugggccuggcugaggcucgguccguggggcagguacucaguuggguccguggggcgggcacucauguuggguucguggguuuuugggagccacagcuagcguccccauucuucagcugcagagacaaccuggccggagcuggcaucucugcugggcucacccaguuguucuggagcuggggaagaggaggcagaaagaccagucacaggaggcuggcagggaaggacaccacccccuggaagcccacccugacaggcccgcccucagagcugucggugccggugggggugucuggccacugccuguguuuucugggagccccaaggccaaggcuguggcaugccuguugcugccccaggugccccacaggguuuuguggcgggacaagcacugagcucacgguggguucuggucccaccuccagccacagcucccaguguggcuugggcacuccucagccucgccgggccccaggcuuccugguggugggguugggugcugaccaucuccaugggugccacugucuggaucccccagccauuucagaggccauuuaaaaaaacaacugccugugucuuccugcccauucccacccagcucagcaucccccggcccuaggcuccaggccccucacccucacucacggacacuuccauccauucucagccuugagccaaguccucaggaggcaccccaucugccaggaguaggaggccucacccacccccacuuuccaaugcgauuuuacuuccgguugggagagggucucugcaggaacagggcuggaaauagguuaugugagcagaagagcguugagaaccaccacggccucuauguucaguugcacaggucgaaugcugcacaagggcaccuggggugagcuggggcuaagaucagccaugcuccccuuaccaauccaggcaccugcauccacccccaagaggcaccuuucccgugcacagccccuuggagacgcauccugaacccugguccagggagauggguugucauggugaccauugcccugguccccagccccacaccccuccgaucccuggacuccuuggaggccccucgcccagcccccggccaucccugagugguggguucugccccugggcgaguggaacggccaccuuuaucagagccagcccucucuggcagugugugauacccauacccagaaggggcggccgccacgggaaaugccagccacgcucuuaucugggaggcuuggccggcuggcccuggagcuccgauuagggagcaggaccguuugccugugggugccucgugggccggguagggugggcaccaguucugcccucccacuuccccaugagggcaggggacaagugagagcccagggcugccaggacagggaccucagcacccuugaggugugauacgcggcagguguggacgcugcaggcccaagcuccuccuaccccuggaaaggugggcaccagccccaggugcacagcagugucucaggaacagcagggacucuggucaggaauguucuggaacccgaggggaaggcaugccaccccuucccucucugaaaggaagucgcagccacuccuggguccagacgugcccucaggggcuucucggacaagggguccucuuggccccccaccccgcccugccccccaggccccagcaggagagcagaggccugcaugcagggcccaccccacgaagcuccaagcguuucugacaguccggaugggauuccacaugcuucccuguggccccagcccugacucgggggugacacacaggcucacuugaugguggcacugaggacccgccggaggccagacagagggacagaugagcacacaccaggagcucccaucgggggagucucuucucucccgugcccacccccgaggccuggccaggugggccagagucgcagguacagccaggacaugaggggccgggccccccaccacugucacacgcaggggugccccuggagccaggccucuggguuuggaccccggugccccacugcuagccugcuagccgcagagccuccaggggccucgauguccuugucugugcagggggaugaccgucacaggaauggguguucccggucccccauagggccgcggggugcuagcuggcccgugugacugugaugcugggaccccgcucacacuggucacccucuuggugccaagcccugcaggggcaggggagggggcggccuaguggucagagcccugggcugggacccaggcauucugggugggcuggcagcccugaagcugagacggcagaaccgcuccugcugcccccaguccgcucuucccuuccugggggcugauaaaggggcgcgggccuccucggccucucgguccugguucgcugccaucuuaucugcccuggggaagacaaagacccaguuaaaacguuuuagcagggccucccggcguauuuacauguuaucucugccauuaggcaagcagcuaucugaucaucaggcccauuaagaccacagccugcccaaucggggcuccaggaaguggggccgccacagcacugcggccaggggaccaggccaggccacgugaggccucugugggcccaggcagcccuggccacaggagagguagagguggcccggccuuccugggcagaggguguguggccugggaggagccacgucccuguuguccaccaaggaggcugaggcuccaggaggcaggugagggccagguguggccagguguguguguguccucggcugggugcuaaguuagcgugaccuggggcuucaggcagcagaguguguccuugcacagcccggaggcuccaagucccaaguccaagugucggcagcaccaggcuccuuccagaggcucccuccugccacucucagcuucugggggcuucaggcgacccucauggcugccucccaucuccaccuccaucuucccauggucuuuucugucuccuuuucugugucucuuagaaagauacuugucauugguuuuagggcccaccugauaaucccauugaucucaagagccuuaaucuaauugcauuugcaaagacccuuuuuccaaauaucagcacguucauagacugcaggcugauguaucuuuugggggcccccagucagccaugacauaaacucaggccagcguugcacugugcggccgggcucugugggccugucccacccgcagcccuugcucuggagaacgaccaucgcagggcucacagcucgcucaaacccagccacaggcauccuccuggcugcgucccuacaccccacagugcccuagagaucuugcugcagggcugcccaggccccugggacccagcaccugcccggccccugccauucaccccaggcccccaggacugccacccuccacugccccuugggccaacccuagcgggaggugggcuggacaggccccagaccgggcacgccucaugccugcgaugucucucugcagacgagcuggagccgguggugcaggaugggcagaggcgcauacgggcccgacucagccucgccacgggccuguccuggggcccguuccaugggaguguccagaccagagccucaucccccaggcaggcggagccgguaagaagcccccauccccgccccugcccgcccaccccaaugcagggcaacauggacccaggggacaggcccagcuuagaugccagcuccggggcucuggccacuugaagaugugggccugagauauugggaccuggaggauagggagggauucgcugccuuggggcccagggagggcuuccuguaggaggugauauggggccuuuggugccccagggaggacuuccuggaggagggguucuuuaagcaggaccuugacagaugacugggcauugaagcagaggagaagagcauucaaggggagggaggaacaaaccaauggcccaggccuugggguacugggacgguggggaugcuacagcagagagcgagaggguaguucugugucuguccccgcggacucuucugacgacaggcacggccgucaggcccauggucuccauggccucggcacgugugcucaucuccuuggugacagccccugccuggcagagccuuccaaggcagccccuugcugcuagacacaaaggccugugucguuugucuuggauguacuucuggggcuaccuccaacuuaugacaagucaguucgguuuccuccgaagaggguauaaugguuucuuuuaaaccacgucucagcuaagaaagggcacugguauauagaaaccuguaaguacguguggggcugcaucaugggcggcauagggucuggggccuccugggccauucacacagccuuuugcagcugagcgggcagacgcaugucccaggccgcucagggagucacugggaagcuggcccaggacagagggcgucccccuuugccaggcccuggagucuccugccuuuaugccauuuccuugcugugcauccccaggcaggccccugcccacugugagccuccacuuccucagccuuugggaccuugggugagacacaggggcgccuaaagcuuccuuuuacgucugagccugcagacccugagagggggcgugggcagggcugcaagcuuaucuguggugcagggaagcccagggcaccccugucugccagggcagcugggcgggucacgugagauggucaggaguggugcuugacacagggcauggcucagugggcacugcggccagcagcccugcaggagggguggcugccuggccccguggccuggagcagggagguggaagaacggcagcggaagcucagugguggucaguuuucuccauggaaggagccacauuucagcuccaccacaggaaggaagccaugguguuuagagcugguucuguggggcgugagcuccccaucacuguacgcgugugagcggcaguugauccuucuggggugcugggauguggggaucuuggcaggcauuuaugguugccaggaggaaugaguggaugggcuaggagcuccguggcucucaucucugaacucucaaagugucaagaaaacccauagguagagaccaagggcaaagaccguaggggcugagauuggagggcucugugaguuccagacacaccacacgcccauccucacuuccuccuccccgcacccuacgaggaggguccugccacuccauuuuacagaugagaaaacugaggcuccaagauguuaagucaauugcccaaauacccaggaucaaacagcagagggagaaauagaacccacaucugccuauccccggagacccucgcaagcuccuuaaugguagggcugaggggcuggcaccggcccaggagucauccccacgggcugcccuuugcccuagcugcagucaccccucccuguccgccugccuccgcauuuaguccugcucuggccuagggcacaggccauccuggggauacgggcacgggguuagaaacgcucccaaguggggagauaacgucugggggcacaaggggagccaaggccagaggagccgcuggggcucuguggggagcccggggaggaaggagcccccgcuccacucuucccuccucugcuuuaucuccugcagaauuaaauccuugauuaacccuuaucuccccagcgaggcgcuaucuccgccuuggcgccgaguguccagacacaccguacaagaugauugauuucuucaagauaugcacgccuuuccgauacuucauuuauugucuaaauauuuuugcgucucagcgggccccugucgcucuuggcugauaggucccaguucucuccccgaccccucccugaggaggacguugccuccugcccggaucgccccagcugcugccaguuuuucuucucucuuuguagaaggagaagggggaggggugcagaugcgaugcugugacccuccccgcuggccuccacaggccuggggcuugcucacaggccgggaugaacagggacaggguggcuucccccucgguuccccaccucuggacauggggggcgggcacccacagaggaaaaugagugcacaaguccccagccgagucaggagcguggacucuggcaccgacuugccgugugaccuggggcaggucgcuucccugaugcagcaacagcucccaccccugccacgccagggguuggaggaaaggggccugaggggcccagccagcuucagaauuuauagucagauacagaagaaacacucgugguggauggguagguggacggauggauggguagauggauggauggauggauggauggauggauggauggauggauggauggguggguggguggguggauggauggauggauggauggaugugugguuggagggcuggguggaugaguggguggauggacagauggaugagugggucgguggguggguagguggguggauggauggguggguggauaauggguggaugauggguggauggguggaugcauggguagauggauggguggaugguugugugaguagauggguagauggacagauguguagguaaauggauggauggcuggguggauggauggauggauggauggauggauggauggauggaugguuggauagguggguggauggaugagugggugagugggugaaggagggguggauagacuaauggauggauaaaugagugggugaauggauggacagguggauggauagguggguagauggaugguggauaaguggauggaugggaggauaaccagguggauggauggauagauguauggguggauggaugaguggguggguggauagauggauggaugaaugaauggguggguggcugaaaggguggguggguagauggauggaugaaugaauggguggguggcugaaaggguggguggguagauggauggauggauggaugagugggugaguggguaaaggagggguggauagauggaugaguggauagaugaauggauggauagguggauggauaaaugagugggugaggccaggcgcaguggcucaugccuguaaucccagcacuuugggaggccgaggugggcggaucaugaagucaggagaucgagaccauccuggcuaacauggugaaaccccgucucuauuaaaaaaaaauuagccgggcaugguggcgggcgccuguagccccagcuacucgggaggcugaggcaggagaauggugugaacccgggaggcggagcuugcgguaagccaagguggcaccacugcacuccagccuaggcgacagagcgagacuccgucucaaaaaaaaaaaaaaugagugggugaaugcguagauagguggaugggugggugaguagauggaugguggauaaguggauggaugggaggauaaccagguggauggauggauagauguauggguggauggaugaguggguggguggauagauggauggaugaaugaauggguagguggcugacaggguggguaggugcguggauggauggauggaugauggguggauggguggaugcauggauagauggaugguggguggauggguggguagauggguagauggacagauguguagguagauggauugacagcuggguggauggauagauggaugaguggauggauggauggauggaaggauggauaguggguagauggacggaugguuggguagguagcugguggauaaguggauggaugggaggauaaccagguggauggauggauagauauauggguggauggaugaguggguggguggauggauggguggauugauggacggauggauggauggauggauggcugagaggguggauggauggauggauggauggauggauggauggaugauggguggauggguggaugcauggguggguggaugggaggguagauggguagauggacagauguguagguagauggauugacgguuggguggauggauagauggaugaguggagggauggauggauggaaggauggauaguggguagauggauggaugguuggguagcuagcugguggauaaguggauggaugggaggauaaccagguggauggauggauagacguauggguggauggaugaguggguggguggauggauggguggauggauagauggauggauggauggauggauggauggauggauggauggcugagaguguggguggauggguggauggauggauggauggguggauggauggauggauggaugauggguggaugcauggguggguggauggguggguggaugggaggguaaauggguagauggacagauguguagguagauggauugauggcuggguggauggauagauggaugaguggagggauggauggauggauggauggaugggugggugagugggugaaggaguggauagauggaugaguggauagaugaauggaugaguggauggaugaauggauggauagauggauagguggauggauaagugagugggugaauggguggauagauggauggauggauggauagaugcaugguggauggauaaccagguggauggauggauagacauauggguggauggaugaguggguggguagauagaugaauggaugaaugaguggguggguggcugaaaggauggauggauggauggauggaugaaugggaggguggguggauggauggauggaugggagaguggguggaugcaugauuaggugggugaguggaugauggauagguggauggauggauggguggauggaugggaggguggguggguggauggacagauggaugggaggguggguggaugauggauagguggaugaauagauggacagauggaugguggguggauggauggauaggaggguggguggguggaugauggacagguggaugaauggauggacagauagaugguggguagauggauguguggauggguggguagauggguagauggagagauguguagguagauggauugacggcuggguagauggauagauggaugaguggauggauggaugaauggauggauggauggauggauaguggguagguggauggauggguggguagauagcugguggauaaguggauggaugggaggauaaccagguggauguaugcaugaauacauguauggguggauggaugaguggguggguggauagauggauggaugaaugaauggguggguggcugagaagguggauggauggaugacgggugaauggguggaugcauggguagauggguggguggauggguggguagauggguagauggacagaugaguagguagauggauugacggcuggguggauggauagauggaugaguggauggauggauggauagauagguagguggauggaugcgugggugagugggugaaggagggguggauagauggaugaguggauagaugaauagauggguggauggaugaguggauggauagauggauagguggauggauaaaugagugggugaauggguggauagauggauggauagguggguagauggaugguggauggauggacagauguauggguggauggaugaguggguggguagguggauagaugaauggaugaaugaauggguggguggcugaaaggauggauggauggauggauggauggauggauggauggaugggagggugaguggguggauggaugauuagguggguggguggaugguggauagauggauggguggauggaugggaggguggguggauggguggauggauggauuauuagguggauggguggguggauggagggauggguggguagauggauggauggaugggaggguggguggauggauggaugauuggguggauggauggaugaauagauggauggguggguggauggauggauggauggaugggagggagggagggaguguggguggguggauggauggacggauggaugggagggagggagggaguguggguggauggauggauggaugauucgguggguggguggaugauuagguggguggguggaugauggacagguggguggauggauggauggaugggaggguggguggguggauggaugauuauguagguggguagaugauggacagguggauggauggaugggaggguggguggguggauggaugauuagguggguggguggaugauggacagguggauggaugcauggauggauggauggaugaauauauggccugaggccaaccucaguguucccucccccaugccguucccuccucugugcuguuucccacugccacuccaugcuguuucccccgccuccaugcuguucccuccuccgugcugugaaaacuaaagggagaguggccugacucagcuccccaagcccagccuuccccuccuaugagaucagguucugccauggugaugaccccugacgccaggcucuggggcucccugcaugguuucagaggacugcucagacccuguggugccuccaggggucccagccccauccccaggugagaaagccucaggccaucgugggucagggaccccccgcuaagguauccugagcaccaacaccauguucccucccccgugcuguucccccaacccgugcuguucccucccucaugcuguucccucuccccugugcuguucccccaacccaugcuguuccuucccucaugcuguucccccaacccgugcuauucccucccccgugcuguucccuccccugugcuguucccccaacccgugcuguucccucccucaugcuguucccucuccccugugcuguucccccuccccugugcuguucccacacccugugcuguucccuccccugugcuguucccacacccugugcuguucccuccccugugcuguucccuccccugugcuguucccuccccuaugcuguucccucuccaugcuguucccuccucucuguuuccucccccgugcuguuccuuggcccccucguauccacacccuccccuccucacccuccaggucucggccaacauccuggcacagccacccccacuccccgucucagccugucccgugucucugucgcugccccuccaggugccuaccugcuauuucugggcggcuccacacuccaggacucacgggagaugcaguucuguucacuguguuccccacaccuggcaacagcuggugcacaaggccugccugccggauaagggagugagugagugugugacccaguggaugaaguggcagcagcaaggcggcaggggucucacggaccuggcuuguagucgugcaggccucaggcccucaccugggaaguguacuccuugcauggucgagggagacagaggcacugagggaccagcuggugccucuguuaaggugauggggagguggaggacuucucagggugggcuggaggaaagacgggcuggggccucagcagccucagccucagccucagcucccacccucccgugaaccugcugcuggcccacuaccccgcaguguccuggggaugaccaagcagccccacggggcuucugcaggaccggccguuuggcuccaugggccgggccaccccagcagcccugcaagcugcuucagagcuucacagcgagguuugggaacggccucagauaaaguugucacagcggaugcugcacagauaggguuuccgauggcuaucggugccaccgcagaaucaagacacugaccucuuuguugggggaaacaaggaacauucucagguccgcccggggaauuuaaaguggccacugcugguggggccggccagggcccagaggagggacagggcaaccccaaggggcggcaaacagggugggcucuagcguccuccguggacccuggacacaccugccugaccaggcugggugccgagccuguggcacccugggagggaagauggccgcagcacccacaucucugagagucuuggcagaagggccugguuuggaaguuaaaaauaggcccccucccaaggccaggcgcggugguucacgccuguaaucccagcacuuugggaggccaaggcgggcagaucaccugaggucagcaguucaagaccagucugcccaacauagugaaaccccgucccuacuuaaacuacaaaaauuagcugggugugguggugcuugccuguaaucccagcuacucgggaggcugaggcaggagaauugcuugaaccccggagguggagguugcagugagccgagaucaugccaucgcacuccaggcugggggacaagagugagacuucaucucaaaaaaaaaaaaaaaauaggcccccuucccccuugcuccccagugcccacaggcagagcagggucaggaagggccugcagcaccagagaaagggcuucuguuccaggcugaucagagguggggaaacaagaagagacagaaaaaaaucaacaggcagacccgugcccggccagccccuccgcaagggaagcagaagcugaaauuggcuuccugccccagcgucuccuggccgcggccccagcaguggcucccaggaugggcggguggccccgggcuggcuucagggguccggccacuuggcaccgggcaagacccugguucagggcuggccguguccaugccaccuccaggcuggggacccugguggccccaggcgaggcugugcucaccuguccccugagaggugucaggguggccccugcauccucagcagccagggcagacuggcagggaggcccucaccccuucccagccuguggucgcagaaguaggagcggcaggccccucugagaguguuuggcagugggggccguggcaggguggccggagcugcuuaucuugcaccccuaggucuccuaccuguucccucccgggucgggggcgggugccggaugggagccucacccuccuucccccugccccuccccacccgcacagccaggccaggcgccccgucgcgccccacauacgcggggugcacucggcggggccgggcgggaacauggcgccugcccuccacucgggaccgccacagaaaaaucgggggugcgugcagcgucagcacaguugcggcgcguguuuuuaucaugcugggaacacgcugcuccugggagugauaagcauuaaaccggccggcaggcugucagucucaguuugaggguuuagaaauauugggacgaauaauuagauuucauaucguuaccgcagcacccaucggaggaucaagcagauuaauuuuuuucacccuccucugcucauuaauauucauuagaggcucaggaaggccaggguggggagggccaggccccagcagccucgccgagcgcugcccgccuggcucgggagcagccgggacacaguagccgccggucacccaccuuugugccaggaaugugccugcccauugccccugggguuuaccccccagccugccccagcagaagcccccaucggagccggcagagccccacagcuggcgugcaguuccugagcccugcucugcggcccugggaaucacggggguguccuuuaaaaggggggcacccacccgaugccagccugcacaaagcaccuuucucggggcagccacucaccacaguggacacucagcaugugcugccccggacaugcccuguggacggcaccccaugcccacuuuguccugccaggucaacccaaaagcaacagccagggcuggagcuaauaugcauccugugcugggaaccugccaggcaggcaaaaagcuucacacagaucauggccucccaacauaccgggaggaaacugagucaaaggagauaggacugaccccccugagacugccccaaaggcuaauggugggcuucggguggguccagagugagcaggggcucggccgccccucuguccccccaacagccauguggggagagggcagagccccgucugcagaggagaaccugagccagggguugggguggcugcuggggacggcuucacacugggacugcaggguugcacccaccccagccagggcacccaccccacuggccagcuuagcucugcucacccguucuguggcugagccgugugguagcaggcaggugacguggaagccaccugcucugcuggccagcccgccugaaccuugccugaguagucacugaacgucccagcccaaaggcuguaucuugcuagauuccugagugcccugcggaugggccaagaggcagggguggcccagaggggucccugcauacgggucuggucgugcccugcccaaggucgcagcagggaggccgagccuggcugggaccccacugcccaccucugcggcccacagggucccacgcgugcuggcaaaguccaggaaagcucaugggcuggcaccuaguggggagguaccccagacccacaggggacaucccugcacugucaccagcccgaccccuuguaccauggcaggguugggcugacugccauccucaccacagggcugcacaaaccugucccgggccagcggcagcauuuguaggugacacuggcuuuucaggcaaaggucauggugcaggaaguuucugauuaaaaggcauucauuuguauagaacaaaaaguguguuuacaggaagugcuggagcacgcguguaugcugugccuccagauuggacacccagguggcuaagcuuggggaccaccagugcagugagcagcacagggcugagggucagggcacugaggcugagucagccuugcaggagggaccgaggccugaggggcagcggcggucaccccuuccuccgucaccauuuucuccccuugaugucugaccaguguugggcaccacagagcgaggccauggacugcccgccccaccucgcccugucccagcccccgacugcacugggauggggccccucgcauuuccucugccauucagcugggggccggggugcaauggaugcaggaaacgaggcggccuccacgggcucggcccagaguguuuuccuuccagacuuagccugagccaccgccgacagcauggcauggcccgaggcacuggcaugagcucugucccuccccuucccaggccucaguuuccucacccaugagauggagaggaggguacugccugcuuuccagggugacagugaggccaggggggccagggccgauccaacacagugcuggugucucaggcccacaggaaggggccugaccagccucaggguggggacagaccugcugaguccaccaggugcuccccagcguccgccgugugccggccccgggagcgagcgggaacgcagguggcccugccacgcccuguggcagggaggggagccaugcugucaggaggacacugaggcccgaggguugcuagggaagugccguaucuucugggcuaaucucggccccagcccacagaggucauucuggaggcaucuagggccuguguggaaggagccucuaccagguccagccccugugggaacagcgguuucacacccagcacucugggggcaagggugggcgagcaguggggagaacacagauacgcagacccgggugugaguucaggcucugcugcucccuggcugugugaccuggagcauguugcucgaccucuuugggccucagucuccacaagaacccugcgcccaacccuggaagguacuacucccugccaagccucccagccccagcacgguguuagccccaccggucaacuauggcacagauggcccaugccacaccucugccagcucuugggccaaugacuguccacagcuuggccuaccagccaagccgggaggcagauccgugucacagaugccccacauacucacgggaacccccaggcaggcugcugacggaccccuccccacguguuccuacccuccccccccagagcccagcccugacccugcugcugguggacgaggccugcuggcugaggacgcugccccaggcccugacugaggccgaggccaacacagagauccacaggaagggucaguaugacgcggcaccuccgucccaagccuuccggaaggugggggucacuuggcucccccugggcugagcccuuaaagggaaaccagccugcuagggcaggggauggggcacagggagcugcuggccccgggcgcugcagcaugaggcagacacucuacugggaccagucagcccagaccaugagucccuguaugagggucccgacuggcaggcugagccaggacagguguccguggcgggggggugggggaggauucugccccucugggggacaccgugauccccguaucuccucccugccuuggcugcaccucugggaacccaccaagggcagcagcagggaccccgacaccagacuggcuggcaggugccacuggaccauccuccaugucgucaggcuggcuccaggaacggucaagguggccguccaggaagucgaggggccuugccgugcugcugcuacugaggguggcacgucuggguggccugcaccuccgagcacccggggaugaagcgggaggcccucugggcuuaggcagguccacuggccaguggagucccuggccccagugcaggguggggacaggcuguggugcgcgugagcgggccggcucaggccugagggcggcaccgcaggggacacacagcccgggcgccccaggugaacaagccggccccgcgcagccugggcuuugugggcugaggcugcccccugcggguggcugcaggaagagccgcccuuggacgguuuccuggagagccggguccacucuagggccccaccucuggcugccgucccugaguggccacccagggucuccccuaguuacuccaccacccgcccuccacgucaucccuuuccugggagacuuccucggggcccucccacuaggaugggcccagagcaaggaggccuggaggcaggcaggcugugagcacucacaggggaccacccagccuugccccccaggcaggauggcccuggcagccagccagccauggcugugaacccggguggccgcucuccugaccccauccucugccccuuguuuaagacgggacagggaaguggggcacaaaguccuagguuuggacaccugucucccuccagaugacgcacucuggugcagggucaccaagccggugccugcggggggacuccugagcgugcuccucacggccgagccccacagcacccccggccacccugugaagaaggagccagcagagcccacgugcccggccccugcacacgaccuccagcuccugccccagcaggccgggauggccuccauccuugccaccgcagugaucaacaguaagugcugggcucuccgcacccagggcggcugcuccaccaaggaggagcaggcagggcaggagagggugggagcugagggugggaagcucgggggcugcaggcugccgacagagugagagguaaggcagggaaggaggugacguggguggucccaagugcagaacacauagggacaggaggguccccagagcccagggccaccacagggaaagccccugccagcaggcaagcgggcuuaggcacagacucggcucugccccgcacaccacacuagaagccagugcuuucccugggggcagacgcgggggcggcccugacugugggccagagcaggacccucaccucggcccuccuggcgucuggggccaggucacuccacaguggaggugucccuggacaccacggggggugagcggcagcccuggccccggcccacuaggugcugccaccaccuccaccuccaaguugugacaaccaagacaucuguugguuggguuuuuguuguuuuuuuuucgagacaaggucucacucuguuacccaggauggucauaaaguccuagucucaagccauccugccucagccuccuaaguagcugggacuucaggcacacgccaccaaaaucucucuacacauggccguaugucccuggggacagagccgccccuggggacaacugaaguggacagaugccacucuugcaguggcucucucggaaacucugaggguggcugcgggaaucaugagucacucacccccggccggguacaggagccauaccugugaucccagcaccgugggaggccgaggcaggaggaccguuugagcccaggaguucaaggccagacugggcaacacagaagaucccauaucugccaaaacuuugaaaaaugagccgagggugauggugcgccccgugcaccucuguggccaaggacagcgcguggccaucguggacaggcacgagucacgcagggaacacgcagcaagucuggcuccggccagcggcuggggcuucccaggggaacagggacggcaccggauggcguuuggagggggacgguaagacucagguuuagcuuuggugaccacagagucacaaaacuggaagaaaagcgaccuuugugagcaagucggaugugaagacggcuugaaguagguggaggcagccagugguuaggggcaaagagaccugcagggccaagugugcagccacuggggggaugucagcccguaugagagucaggggagcagacccccacucuuugaguguccugacaucaagacaccugcuacaugcaaaagagaagccacagaguccacugagggacaaggauggggcucagagagcccuggggccuguggacccuggagucaggggacaggggacaucucccaagguacggagagugagcugagauagguuagaggggguccuggagggcggcagguggucuggcacauccaggcuguggcgagaccaacagcagagaaaugacuacugguccugacagugcagaggucgccaugacccugaccgaggccgcuccagggagggucagagaggaggccugcacaggggccagcuggccagagggggaugggcuugugugccugguagccaggacauaauagcccauguuaugugcuggugggaauagcuggugacacuggagagaacgggccgagcggccagguccacaccuaagcccagguugggggcaggggcugggcaagccacugccccagggagccaggaggucagaagagaacacgggccgcaggugacugaaaggagccgggagcaaaggggguccccaucugccuucuccucuucccugaagaaggcacggaggggaugggaggccauugcaccccuccaccaggauggagagggggugcccccguagugucucggggugcccgggagacccaacuccaggggaacaccccgcugauaacgccaguaagacaguggggacagcaggcuggugagggucccguccuccagcaggguccuugcccacacagccugcggagaccaccucccagucccugaggggcagcugcgggugccccaggcucagccucugccucgguuucccccucgcgggucugacaugccucauccccaggcagcaguguccugggaacgcugcuucggaaggacaccaccgugagccacacaucuuguugacauaccugaguccugcccuagcacuucugcggcugccagggcacggccgacgcuugucugcugcucuggaagagccgcaggaaccaauuccagggucagauccaguuucauucuugagccuccggcacucugggcccaucucgccugugaagcgggaugcagaggcaccugccuggaggccccuccgcaggccaccagauuuggccuguggucaccagcaggcgggcagccuuucuaaacugcauggccacggccccucuccccacaccccugcagcaagagucccccacaaugaccuuggagacgcagaaacaaacccacccaguggccucccaggucugggacccagcucaaggccucagcugagagaggacagagcugccugcagcccccaaguaaaaggaacuugagaaacagaaaucaacagcacaggagggagaugugagccagaaaagucguuagaacagcgagguggaggaggaagagccaccucacccaggcacugaaauuccucccaagaggcagagguggcgagcaggccgcagaggggagggcgcggggguaggggccaccccugcgugauaacugcagacucaggaucaacaucggagaagccgggugagaaaccagcacuaaccugcagaggcagaaaccagauaucacaucagucucuaaguggaacgggcuugaaagccagauaaggaaucccagggccccuggguuccacacggaggccaaggccaagcugaacagguccuucccuucccugucuucagccaaggggccaugggcagauggggcagggcucuggggcagagaacauuccuuaaacugcuauaaagacaaaccgagaacacgcuagagaaguccuccccugcuggcaaaaccaccguaagcagagugcaagcccccaaaacucucaacaguuauaagcagcccauuuggggucagugugguaaauucgacaaaucugaccagccagguggucacugacauggagccgcccaggugugugggcgcaugggggcuuccuaacuugugcacuccuggucucaugcccacaucccuagaacugcagucagcagccaucgugugccugagugcccagggacugugugcguggguuuucuuugcagccuggcacucccacgcaccugcacgcacaucuguacacacacguuuccucuuccacggccucccggguccacacggucaccccaguaugucauggaugcuagccucaccuggcgguguccacuucuuccuucugcccccaugaggccaaagcaucuccuuauggggcucaccauuggaaggggacccauagggguucacucagaccccacuccccacgggucccagggcuccugggaucuacggaagggaguggggcugucacaggaccauccaggaggcuuacaguuacaggaaggggucaaagccucagcuccugggguggggaggacggugggguccgucacggccaggcccugccuccgcccacagccuugcccuggcuggcaggcuggccuucagccugaccccgccugcuucccaccccacagaagacgucuuccccugcaaggacuguggcaucugguaccgcagcgagcgcaaccugcaggcgcaccugcucuacuacugcgccagccgccagggcaccggcuccccggccgcagccgccacagacgagaagcccaaagagaccuaccccaacgagcgcgucugccccuucccccagugccgcaagagcugccccagcgccagcucccuggagauccacaugcgcagccacagcggugagcccccaccccggacgcggguccucaggaugccggcugcuuccccacccagucccgcaggccgcccgggaaaacccacaugcaagcacacacggugccaccauucaccugcgcggucuccggcacacccagggcccccgcaggggcccagagcaggcaggccggacugugggcuaucuggguagucagcugagggcugggcccacugcugucccgagagacaaaaggcggaggaggaggaggagggguuuaaagacccuucagcacagggucccccggcacagaucacggcccugggcccagucgccuuccucaucccuggagucccaagguuaagcuggcccgggcaccgcucuuacgcgcccuguguuccaggagagcggcccuucgugugccugaucugccugucggccuucaccaccaaggccaacugcgagcggcaccucaaggugcacacggacacgcugagcgguaggcaccgcaggggccggggggugugugggucccgccuccccgcccugggccuugaccaccucgccauggcccacaggugucugccacagcuguggcuucaucuccaccacaagggacauccucuacagccacuuggucaccaaccacauggucugccagccuggcuccaagggugagaucuacucgccaggggccggacacccagcaaccaagcugcccccaggugagcagcccugugggggccaccccugccccuuaggcccccugagcagugggaagggagugggcuugucgcccaagacagguggggguccguuucagccuucgcucuaaaccacucccgcccaccccuccccuuccggagcucgcccuccagcucugaccggccagguccugccccaggccugaggugccaccccugcgaucucucugcagacagucugggcagcuuccagcagcagcacacggcccugcaaggcccccuggccuccgcggaccugggccuggcgcccaccccaucgccaggacuggacagaaaggcccuggccgaggccaccaacggagaggccagagcggagccucuggcccagaauggaggcagcagcgagcccccggcggcccccaggagcaucaagguggaggcgguggaggagccggaggcggcccccauccugggccccggagagccugggccccaggccccgucgcggacgccgucgccgcgcagccccgccccggccagggucaaggccgagcuguccagccccacgccgggcuccagcccggugcccggcgagcugggccuggccggggcccuguuccuuccgcaguacguguucgggcccgacgcggcgccccccgccucggagauccuggccaagauguccgagcuggugcacagccggcugcagcagggcgcgggcgcgggcgccggcggcgcgcagaccgggcucuuccccggggcccccaagggcgcuacgugcuucgagugcgagaucaccuucagcaacgucaacaacuacuacgugcacaagcgccucuacuguucaggccgccgugcgcccgaggacgcgccugccgcgcgcaggcccaaggcgccccccggcccggcccgcgcgccccccggccagcccgccgaacccgacgcgccgcgcucguccccgggccccggagcgcgcgaggagggggcugggggcgcggccacgcccgaggacggcgcgggcggccggggcagcgagggcagccagagcccggguagcuccguggacgacgcggaggacgaccccagccgcacgcugugcgaggccugcaacauccgcuucagccgccacgagaccuacaccgugcacaagcgguacuacugcgccucgcgccacgacccgccgccgcgccgaccggccgcgcccccgggacccccugggccggccgcgcccccggcccccucucccgccgcgccugugcgcacgcgcagacgccgcaagcucuacgagcugcacgcggccggcgccccgccccccccgccgcccggccacgcccccgcgcccgagucgccgcggcccggaagcggaagcggaagcggccccggccucgccccugcgcgcucgcccggccccgcggccgacggccccaucgaccugagcaagaagccgcggcgcccgcuccccggagccccggcaccggcgcuggccgacuaccacgagugcacggccugccgcgugagcuuccacagccucgaggccuaccuggcgcacaagaaguacucgugccccgcugcgccaccgcccggcgcgcucggccugcccgccgccgccugccccuacugccccccgaacggcccggugcgcggggaccugcuggagcauuuccgccuggcgcacggccugcugcucggcgcgccccuggccggcccgggggucgaggcccggacgccggccgaccgcggccccucgcccgcucccgcccccgccgccuccccgcagcccgggucccguggcccccgggacggccucggcccggagccccaggagccgccgcccggcccgcccccguccccggccgccgcgcccgaggccgugccgcccccgccggcgccccccuccuacucggacaagggcguccagacucccagcaagggcacgccggcgccgcugcccaacggcaaccaccgguacugccgucuuugcaacaucaaguucagcagccuguccaccuucaucgcccacaagaaguauuacugcuccucgcacgccgccgagcacgugaagugagcgcccacacuacagccgcagacgcuuugcacgccccgcugcgaugcggggagggggccgcccccaggccgcacggacugccgcuccugggaaccccgccacgcacaggccucggcggagggggccgcagggggcagcgcccgccuggacccuuggcacuuaauaaagaaguucaguuugaugagcaugguggugggccagccuaguucucugagccagcaggc

SEQ ID NO: 15848 - RNA, 9945 nt, Homo sapiens
ugcuagagaugcucugagacauuuuauuuaaacuuuuuuuuuuaaaaaaaagacagcaauaauuaaugccaagaacagaaaagaauguugacguguugcccggcccgccaagcgggccccugcccaggcccccaagcucugccaccacuggggugccguccccucccgcagcggggcacagucagcuuugaaggugacagcgggccaaggccaggacucuggguggaggaggccccuucucugccggccccgccucugcugggagcagccacagccuguggcuggggugcugggauuucuuccuggucaucaaagagaaacguacaaaccucaaggacccagacacacaguggguggccagggcagaccccacagcagaccccauggcucgccugagcucuggcagcugccccacugcuccuuccauccuugccccaaucccccaaugcuuguuuugauuguuuucuuaaaaaauauaauuuuguaaauguuccauaaaaauacuauuauuccuagucaaacacagauauugcaauaugaagaguaacugcucugucuuugcucuauaaaacgugaaaagauuaucacacuggauaauauagaaaagaugccaggguuccuaaguaucacaaaagccaguaccaaaugcgcaagguggaaguggggccggggcagggucgggcugggcagggcagcagccuggguuccucccggcucgacugcggagcgcgacucgcgcgucggucccuucuucccacgaggggguaucauggcuuugaagagacggcggcagcuccaggucccagcguccagcccugcccaaguaggccgccugcucggccagaagcaccgaagaacccagcgacgccggugggaccaggcggcccugcucuggcggccucggcggcuggcccguauucaggcccggaggcucggccccggcuccccuucugcgcgggugcaggcuccuccugugagcucaguccggugaggugcgcucccgagcaggugccaggugcgacacaggagcggggacaucccugaccccagacgcaggcggguggcugcgcuucccuucaguucucagagagagacagggccagagcagccuggaaggcggccuccucgucaauacuguaguccuggagacaggaaggagagaugcaccgggcucgagggagacaggaaggagagguccccucugcccaucacccacacaggcguguccacccuuccugccucccuccagcaggacacaggaaggacccagcuccacuguccccacaggcucggggccugcacgguccucuggggggugagaaggugaagguguguccaucacccgcuggguacgggggcacucggaauggauggcugcugguucaggucggacucuaagcccgggguuuccgaggugagcaggccggccagggcucccugaccucuaacaauuuccauccugaggcaggcggagcgugggucccggacgacuggcagagggagugacagccaucgccaggacuguuagccagggccaggaaugaacagggcggcgcagggaggggccgcaccaggagugaggaguuugugcgagggucugcaggcccgggggccaggugugugccugacccgcggcgggugggaaaaggagacagggcuggaguguucgauguugaugaaaguccuucccgcgcucucuagaaagcuuccagaaggaagccuggcucacccucgagggguucuguggggugggcaggcagggaccugcccugugcgguccauguccccgagaggccugggcacccucuaguggccacucaaacucagcugccaucacuccccaccugcaggcagcccccacagaaccugggggaauguggccaccugaaacgaggcuucuguuucuggcuuccucugaacccugcggacccugaggcuggcgaggggcccgagcaggaggaggguggaugaggagggcgugggggaggacggugcuggcgggaugccuaccacaaaggugucguaggagaacuugugucggugaagcaggugcugcaggaaguuggcgcucuuguagcugggguccccccagggcauugccgagcagauggggcacaccuggaacaggcacuggggucaagccgagccggaccgcggagaggcgggguagccgcaguaggacugggggcccuccacugagccccgucagugcugccucagccugggaaggcaccccagaccuggaggcgcgugucccggugacaagcgaguuauucagugcgcgucacccugaaggacucauggacacuccccgguuuccgccaggugcugcucgggcagccaaguucccacccugggucccaggaggccuuuguggccugggcacccccggacucgccgcgagcaggcuccugggccuuguacugucccccacaggccuccccuggcgcaggcgucgcuuggggcaggcacugcucaccacgcgguuggggucgcugcgguggcuuuccacacagugcuucaccagcuccugcugguccagguugcgggcaccacaguacgggcaggcgaagguggaccuguuggggauguugcuggcggggcggggguagagugaguggcacggcuaggugucuaggggcucugccuccccgcuucucucaaacacaggcguggccccaggccugcccucuguaggcugcaagagcguggcaguggcugggugccccccgugccucugcacgccauggccuccugaggacacacccaggacccucguccaccccacacaacuaggccagccaaacggcagagacucugcuggcgcugcccuggcaggagccgucucucggcccauccaccugcugggaggcgaugugugggcccggccugcgcccuccuccugcuccccacagcugagcugucccuaccccagggggccugguggguaugccagggagggcagcacaggagccuuccugcaggguggcaaggaagguccacuuccccagaguggacccggccccgggugacucccccagccucucugggauggggcacugcgcuugcucccagaacgaggaaaccgccgaggacaguuccucucccuugcccggcagcgugccuaccuggggauaggcugugaugugggcaccacggggacgaacuuggggcaguuggccaucugcuccuggaccuucaggcaggacgaaaugugcacucucaucuuugccagggucaccuaggagacagggcagggagggcaaggcgguccugagaaucuggaagggccguccuggggaggccgagaccucagguguccaggaccagagaacuguaagcaagcgucuguguugccagcagcagggggacccggucccuucugcugcuaaaacaaucucaggcacugagcagccacuacuccauggccaaaagcaagucacugcaggacaaucuggccgagggcagaaaccuggcuggagaaggguagcgggaaacagguaaggagaucucuggcgccugcaggaguucaaauacuugcuccagaaaaaggaagaggccaaguggaggccacucagaaaugccccaggcuggggacagacgcuucgugugacugaggggcaagcuggggaugcuuccguggaggcagggcgccauccuccacccacagcacacccacuguccagggcaacaggcugcaagaucgcaggugucugaggcccuccuggacucaagcucggcacccagcucugccuaagggcugcuggacuccgagggaugcaccacauuccagcaaggugccgggagacacagccgcaucugaagacccagauuagagaacggagcugcugugggauacgggaggccgcucugcaugugaccgguucugauccuuucuggcugcccaggagagaagaacucugagcagggagagacgggaggugcccaagcacccaagaccacagccugcucagccgcaccacucuggaguccagggcagccccuggacaucuggaccuucgaccucgaggacaaaccaccgaggggccacguacuagugugagcgcuucauagaacuuauucaccugagauguggcaacgucgggaaacgcaaaugcaaaaucaccucuagcugcucaguccuccggaagccacugaaagaacggggcgcuggcuggggccucuccacccugaagcggaugugccagggagggccacggggcacgggccaggcaccaggacaggauggacaugggggccaaugaggcccaugacaagcugcaggcccuuacgcugcucugauguggguguggcagugcccaucagcccggcucuggcccuccuggcagcuggagggugcucggcccuuagauguccuugacugugcccgcggcccuugugaccuuggagcccccagcgccguccccgguaucggcuggcaggggaaggcugcauugggaagguuucagcucagcccccugguccuuacccuggccacaacccacguggguuccccuggcccgggcuaggcggcucugacagugcuacccccaccgggcuggcccccccgucagccgucaccacaggaagugagagaugaagacgggaggggagggaggcgccggggcuggcuuccuggugcaggagcagagaccgcgauuacucaacaggaaagagagagggccccggcccccacccucugcagaacccgugggcugaggcugcccaucaagugaccccggcuccagggcggcccaagcaggcggguaccuuuuuguugcagccucgacagggcgcuuuguaggaugagagcugcuucuccacguggguggccuuguccaccuucuuggggucgaagggcaggcggcagagugggcacagcggggauggcaccugcaggcagggcuggagacacuccccgcagaaccugcagggcacaggggccugagugccagcccgccccucgggucucccgaaccgcaggccuugcucggggcccuucuuaggacccagcauuugugggguccacaggggcagcucccccuaccgcugucgccgucucuggagauggucacuccuauguccggggcccaccagcuggaugggccccaucuggcuaaaggguggccccggucccuccugacaguaggccccugugguuucuggcuagcggcagagccgucacuauggcuguccccgcgagugggccagaggagcucccauaggcaggaggccccagcucgggcuaccagguucacguucacguggcgacaacaccugggugggcuguggggcgcagggacagcccggggacucuggaaacucucccggcuccacacucugggggauaaaaccucaaacaaucgugggaaaggaaacggccaggccccaggggcuccagaugcacuggacagggaagggccaaagcuagccaaguggcagcacauccugaggcuggguggcagucaccaggcuugggacagcuucgcaggcaggaggggguccugcuccaucugggcggaggcucggguccugggcacccaugggcccuggcucuuggcacugccccuggggacaccacaucgugaggacagacugagcgucccacagccccgugcgcacuccgggcuccagcagcaggggcuuccuugggcucgcacacccucccgcucugcagacgcacacagcccuuggaggggugcaccaccagccagugggagcaccaggcgcgagagcccccagugcaaacacagagaaggagcuuaauacuggggcagccacaucuggccuugugaggagcacuguggggacagcugagcugcggcgaggagcuggaacugaggcagagccccccagucccaggaaggcuacagcacccggggguguagcuucccuucucccuggcaaggccacagggcugguacaggagccccacuggacagaggggcugugggcaggcccuggguucacaaacgacucagcugaauucagggccagaguccucuuugcugucaagagauuuccacaucccucaagaaaaggcccuuucugcaaggaggaagucugagggccucaggcaaagguggccaagcaggcaucuuaagucccuccugcugucccccaggcccucuuugccaccacuggauucccacagagccaccaccuggcugguggcucccacaugaaacuucgugugagagaaagcgggacucagcuugagacccgucagaaagugaacaagccuuuuucugcagaguaaagaggucgcucacuuuacccaccucacccgaguucucaccaggcgccccagcagauauuuccagggucaucccuggcacugaccccuggauuugagccgggggggccgccuacuucacccguucacgggaggaaggugcuggcaagaugguccaccuggggaggccucaggggacccccauacucaggcacucauggcaggagaagcggaagcagcucaggugcccgucgguaaacggaugaagagacggcguggcgugcacacccauggaaagggcguucggccgggaagaggcgugcagccccaccacgcaccggaaggccuggaaaacagugcagggcagacagcaagcacgucccacccgugucguggggguccacucacgcucaacguccagcagagagaaacccagugaccagaaagcagacgggugggugccaggcgagggggagaguccuggguuucuuucuggagugggaagaaucuucuagaauugcaucgauuguugcauaauugcaaacacacuggaaacgacuggauggugcaccuccugagugaacccugagcugccagagaccaggccggggcucggcugcacagcacggccacgggcugaggggaaggaaaagggucccaggcagagcuugggaagagaggaaaggugcccagaagguuggcugggaggaagacagccucguccuccccggaaggacucaggaaagacacaagagggaacccagcccgacuggcagggcggcugggcccgaggagcaggaggcagaacgaggcacccacagggugggugcucuaucggccuaguuuccagugacugccagccugguguucagagagccagcagccgggaguagugcccgcuucccccacaggaaguuccugucugcgcccacccaggggcuggugcugagcagcuucucagcugaaggaaguggcugagggcgaugggugugggggcgucgacagccuuacaaagggaggggcgaucgcgcacuggcccucccagcaggcacccgggacugccaaugugucucccacacuggccgcugcacaagcugagaagcugggacggcccgugccucagggaucugccuggcuggcaggccagcacccucagcaagccccacagcuguccugcacgaguggaggcugcucacacagcccuuccaggcagguucgugaucacgcguguccuggcccacaggcuucugguuacagagguggcucacugcucagacuguccccuggcugagaacagcuccugcugggcccccagggggccuccugcgcgagggcuagagcagggugcaugcccccacacugggauacucuugccaugagagaucuacccuggaggaggaaguugcucugguuggggagcuugcggaggggacagaaccagaccagcaacaaacuuccgaagggaaccugaagagccuuuaaacuuucuguggucauuugcaugcaugccuuagcaacaccaacaagaaacaaaguuagaagcagagagagaacagccagaaaacaaaagccagcaggaaaagucggggagaaaaaucuuugaaaggcaaaggcugugugaaaagcucuugcaggacccgcggugagacuaggauggucgucauucuaccaagaaaagcauggcagaggggaguuuuauaggaaagaugcuccacaauuccaugugguucugcauucuguguuauggaaacuacauuuuaggaaaagacauauuugaaaaagaagggcaaagaccaauuugugcagguuaggaaaguggagaugcuguggccgaccacacggugaagguguuggcacccaaagccuacgggaggcuuuucuaaaacaaggccuaagucaagccucacagcgcucaguaacagaugagaaggugcggaacacaccuucaaacacccgcuaccugcucacaagaaggaaguccugccaggcgcgguggcucacgccugucaucccagcacuuugggaggcugagacgggcaggucaccggaggucaggaguucgagaccagccuggccaacauggugaaaccccuugucuacuaaaaauacagcaauuagccgggcgugguggcgggugccuguaaucccagcuacucuggaggcugaggcaggaggaucacuugaacccaggagauggagguugcggugagccgagauggcgccacugcacuccaggcugggugacaagagcaagacucugucucaaaaaaaaauauucccguucagaggcugcccccccaaaaugucacggcuaagugagauggaggagcaggggcagagccuguagcagccucacaagagaaguagguagagcugucccagcgugggcaggcgccugugcugccugacacagguaaugaaggcagcucugcauccugacacuggcccugccaccuccgugggugaccagcacacauccaccuagcagucccagcucccucuguaccaggagccccugaagucagcugacuuugcuugcaaaauguucuagagccuccuaccagucugggugcaccccccuccacuccaccaccucagcagcuuggaugucugcggggaagcccuccugcucucucucuccccugccacugcugauuuugcucaagagcuguauuauucagcacuuaggagggagcagacacugaucuaggcuuccucccaacggggcuggcagcuccagaauacuugagcacagcuccccgccaggagagccacguccuccaguuucuguuccugaaacacccuggaggagccggcugugagcccuggugcagcuggaaaccccagcaagguggucagugucugcuccucuguggaccagccugccuggcuacucagugaucggugugacucaaguucuccuucaaacaaaacuaagaacaucagacuccaaacaagccccucuaaacuuuagggaacuccuuuccucuguagucaaaacaggcagacagcggguccgaacaagaguugauagcaaaaacuacaaguuauuuauuuacaacugcccauuccagccgcacaagcccaaauccaccaccacuggcggagcgguggcaccugcugcccucugaguaccggagcgcccgccgcagccgccggggaccccgagcuugggcagggccgcaggucgcccggugaaccgaagcagcagucggaccgggcgccugcggcuggcgcgaaggaggcugggcgggggaugaacgcgcccagagggcagaggcggcgcggcacagggaaacccggaccccacgcgccccgaggccccggcgccccgaguccccgcgcgcccaguccggagcugcaccggggcggccgccggccucgcgaccccucccgcggcggggcacggcccccuccccgcggccccugggcgggcgcgcucacguguggccgcagcugccgauggccacgggccggugauagaccuccaggcagauggggcagguguacugcgccuccaggccgcugucgccgcccgccggcccggccggcggcugccgcugcugagccgaggccaccaggcugcggaacauagccaucccggggccaggcccgcgccgcccgccgcccgcuguccuggcccgggccggcccgcuagucacagccgcuacugcgccgcgcugacgucaucguagggcgccgcccccagc

SEQ ID NO: 15849 - RNA, 9945 nt, Homo sapiens
gcugggggcggcgcccuacgaugacgucagcgcggcgcaguagcggcugugacuagcgggccggcccgggccaggacagcgggcggcgggcggcgcgggccuggccccgggauggcuauguuccgcagccugguggccucggcucagcagcggcagccgccggccgggccggcgggcggcgacagcggccuggaggcgcaguacaccugccccaucugccuggaggucuaucaccggcccguggccaucggcagcugcggccacacgugagcgcgcccgcccaggggccgcggggagggggccgugccccgccgcgggaggggucgcgaggccggcggccgccccggugcagcuccggacugggcgcgcggggacucggggcgccggggccucggggcgcgugggguccggguuucccugugccgcgccgccucugcccucugggcgcguucaucccccgcccagccuccuucgcgccagccgcaggcgcccgguccgacugcugcuucgguucaccgggcgaccugcggcccugcccaagcucgggguccccggcggcugcggcgggcgcuccgguacucagagggcagcaggugccaccgcuccgccaguggugguggauuugggcuugugcggcuggaaugggcaguuguaaauaaauaacuuguaguuuuugcuaucaacucuuguucggacccgcugucugccuguuuugacuacagaggaaaggaguucccuaaaguuuagaggggcuuguuuggagucugauguucuuaguuuuguuugaaggagaacuugagucacaccgaucacugaguagccaggcaggcugguccacagaggagcagacacugaccaccuugcugggguuuccagcugcaccagggcucacagccggcuccuccaggguguuucaggaacagaaacuggaggacguggcucuccuggcggggagcugugcucaaguauucuggagcugccagccccguugggaggaagccuagaucagugucugcucccuccuaagugcugaauaauacagcucuugagcaaaaucagcaguggcaggggagagagagagcaggagggcuuccccgcagacauccaagcugcugaggugguggaguggaggggggugcacccagacugguaggaggcucuagaacauuuugcaagcaaagucagcugacuucaggggcuccugguacagagggagcugggacugcuagguggaugugugcuggucacccacggagguggcagggccagugucaggaugcagagcugccuucauuaccugugucaggcagcacaggcgccugcccacgcugggacagcucuaccuacuucucuugugaggcugcuacaggcucugccccugcuccuccaucucacuuagccgugacauuuugggggggcagccucugaacgggaauauuuuuuuuugagacagagucuugcucuugucacccagccuggagugcaguggcgccaucucggcucaccgcaaccuccaucuccuggguucaagugauccuccugccucagccuccagaguagcugggauuacaggcacccgccaccacgcccggcuaauugcuguauuuuuaguagacaagggguuucaccauguuggccaggcuggucucgaacuccugaccuccggugaccugcccgucucagccucccaaagugcugggaugacaggcgugagccaccgcgccuggcaggacuuccuucuugugagcagguagcggguguuugaagguguguuccgcaccuucucaucuguuacugagcgcugugaggcuugacuuaggccuuguuuuagaaaagccucccguaggcuuugggugccaacaccuucaccguguggucggccacagcaucuccacuuuccuaaccugcacaaauuggucuuugcccuucuuuuucaaauaugucuuuuccuaaaauguaguuuccauaacacagaaugcagaaccacauggaauuguggagcaucuuuccuauaaaacuccccucugccaugcuuuucuugguagaaugacgaccauccuagucucaccgcggguccugcaagagcuuuucacacagccuuugccuuucaaagauuuuucuccccgacuuuuccugcuggcuuuuguuuucuggcuguucucucucugcuucuaacuuuguuucuuguugguguugcuaaggcaugcaugcaaaugaccacagaaaguuuaaaggcucuucagguucccuucggaaguuuguugcuggucugguucuguccccuccgcaagcuccccaaccagagcaacuuccuccuccaggguagaucucucauggcaagaguaucccagugugggggcaugcacccugcucuagcccucgcgcaggaggcccccugggggcccagcaggagcuguucucagccaggggacagucugagcagugagccaccucuguaaccagaagccugugggccaggacacgcgugaucacgaaccugccuggaagggcugugugagcagccuccacucgugcaggacagcuguggggcuugcugagggugcuggccugccagccaggcagaucccugaggcacgggccgucccagcuucucagcuugugcagcggccagugugggagacacauuggcagucccgggugccugcugggagggccagugcgcgaucgccccucccuuuguaaggcugucgacgcccccacacccaucgcccucagccacuuccuucagcugagaagcugcucagcaccagccccugggugggcgcagacaggaacuuccugugggggaagcgggcacuacucccggcugcuggcucucugaacaccaggcuggcagucacuggaaacuaggccgauagagcacccacccugugggugccucguucugccuccugcuccucgggcccagccgcccugccagucgggcuggguucccucuugugucuuuccugaguccuuccggggaggacgaggcugucuuccucccagccaaccuucugggcaccuuuccucucuucccaagcucugccugggacccuuuuccuuccccucagcccguggccgugcugugcagccgagccccggccuggucucuggcagcucaggguucacucaggaggugcaccauccagucguuuccaguguguuugcaauuaugcaacaaucgaugcaauucuagaagauucuucccacuccagaaagaaacccaggacucucccccucgccuggcacccacccgucugcuuucuggucacuggguuucucucugcuggacguugagcgugaguggacccccacgacacgggugggacgugcuugcugucugcccugcacuguuuuccaggccuuccggugcgugguggggcugcacgccucuucccggccgaacgcccuuuccaugggugugcacgccacgccgucucuucauccguuuaccgacgggcaccugagcugcuuccgcuucuccugccaugagugccugaguauggggguccccugaggccuccccagguggaccaucuugccagcaccuuccucccgugaacgggugaaguaggcggcccccccggcucaaauccaggggucagugccagggaugacccuggaaauaucugcuggggcgccuggugagaacucgggugagguggguaaagugagcgaccucuuuacucugcagaaaaaggcuuguucacuuucugacgggucucaagcugagucccgcuuucucucacacgaaguuucaugugggagccaccagccaggugguggcucugugggaauccagugguggcaaagagggccugggggacagcaggagggacuuaagaugccugcuuggccaccuuugccugaggcccucagacuuccuccuugcagaaagggccuuuucuugagggauguggaaaucucuugacagcaaagaggacucuggcccugaauucagcugagucguuugugaacccagggccugcccacagccccucuguccaguggggcuccuguaccagcccuguggccuugccagggagaagggaagcuacacccccgggugcuguagccuuccugggacuggggggcucugccucaguuccagcuccucgccgcagcucagcuguccccacagugcuccucacaaggccagauguggcugccccaguauuaagcuccuucucuguguuugcacugggggcucucgcgccuggugcucccacuggcugguggugcaccccuccaagggcugugugcgucugcagagcgggagggugugcgagcccaaggaagccccugcugcuggagcccggagugcgcacggggcugugggacgcucagucuguccucacgaugugguguccccaggggcagugccaagagccagggcccaugggugcccaggacccgagccuccgcccagauggagcaggacccccuccugccugcgaagcugucccaagccuggugacugccacccagccucaggaugugcugccacuuggcuagcuuuggcccuucccuguccagugcaucuggagccccuggggccuggccguuuccuuucccacgauuguuugagguuuuaucccccagaguguggagccgggagaguuuccagaguccccgggcugucccugcgccccacagcccacccagguguugucgccacgugaacgugaaccugguagcccgagcuggggccuccugccuaugggagcuccucuggcccacucgcggggacagccauagugacggcucugccgcuagccagaaaccacaggggccuacugucaggagggaccggggccacccuuuagccagauggggcccauccagcuggugggccccggacauaggagugaccaucuccagagacggcgacagcgguagggggagcugccccuguggaccccacaaaugcuggguccuaagaagggccccgagcaaggccugcgguucgggagacccgaggggcgggcuggcacucaggccccugugcccugcagguucugcggggagugucuccagcccugccugcaggugccauccccgcugugcccacucugccgccugcccuucgaccccaagaagguggacaaggccacccacguggagaagcagcucucauccuacaaagcgcccugucgaggcugcaacaaaaagguacccgccugcuugggccgcccuggagccggggucacuugaugggcagccucagcccacggguucugcagagggugggggccggggcccucucucuuuccuguugaguaaucgcggucucugcuccugcaccaggaagccagccccggcgccucccuccccucccgucuucaucucucacuuccuguggugacggcugacgggggggccagcccgguggggguagcacugucagagccgccuagcccgggccaggggaacccacguggguuguggccaggguaaggaccagggggcugagcugaaaccuucccaaugcagccuuccccugccagccgauaccggggacggcgcugggggcuccaaggucacaagggccgcgggcacagucaaggacaucuaagggccgagcacccuccagcugccaggagggccagagccgggcugaugggcacugccacacccacaucagagcagcguaagggccugcagcuugucaugggccucauuggcccccauguccauccuguccuggugccuggcccgugccccguggcccucccuggcacauccgcuucaggguggagaggccccagccagcgccccguucuuucaguggcuuccggaggacugagcagcuagaggugauuuugcauuugcguuucccgacguugccacaucucaggugaauaaguucuaugaagcgcucacacuaguacguggccccucggugguuuguccucgaggucgaagguccagauguccaggggcugcccuggacuccagaguggugcggcugagcaggcuguggucuugggugcuugggcaccucccgucucucccugcucagaguucuucucuccugggcagccagaaaggaucagaaccggucacaugcagagcggccucccguaucccacagcagcuccguucucuaaucugggucuucagaugcggcugugucucccggcaccuugcuggaauguggugcaucccucggaguccagcagcccuuaggcagagcugggugccgagcuugaguccaggagggccucagacaccugcgaucuugcagccuguugcccuggacagugggugugcuguggguggaggauggcgcccugccuccacggaagcauccccagcuugccccucagucacacgaagcgucuguccccagccuggggcauuucugaguggccuccacuuggccucuuccuuuuucuggagcaaguauuugaacuccugcaggcgccagagaucuccuuaccuguuucccgcuacccuucuccagccagguuucugcccucggccagauuguccugcagugacuugcuuuuggccauggaguaguggcugcucagugccugagauuguuuuagcagcagaagggaccgggucccccugcugcuggcaacacagacgcuugcuuacaguucucugguccuggacaccugaggucucggccuccccaggacggcccuuccagauucucaggaccgccuugcccucccugcccugucuccuaggugacccuggcaaagaugagagugcacauuucguccugccugaagguccaggagcagauggccaacugccccaaguucguccccguggugcccacaucacagccuauccccagguaggcacgcugccgggcaagggagaggaacuguccucggcgguuuccucguucugggagcaagcgcagugccccaucccagagaggcugggggagucacccggggccggguccacucuggggaaguggaccuuccuugccacccugcaggaaggcuccugugcugcccucccuggcauacccaccaggcccccugggguagggacagcucagcuguggggagcaggaggagggcgcaggccgggcccacacaucgccucccagcagguggaugggccgagagacggcuccugccagggcagcgccagcagagucucugccguuuggcuggccuaguugugugggguggacgaggguccuggguguguccucaggaggccauggcgugcagaggcacggggggcacccagccacugccacgcucuugcagccuacagagggcaggccuggggccacgccuguguuugagagaagcggggaggcagagccccuagacaccuagccgugccacucacucuacccccgccccgccagcaacauccccaacagguccaccuucgccugcccguacuguggugcccgcaaccuggaccagcaggagcuggugaagcacuguguggaaagccaccgcagcgaccccaaccgcguggugagcagugccugccccaagcgacgccugcgccaggggaggccugugggggacaguacaaggcccaggagccugcucgcggcgaguccgggggugcccaggccacaaaggccuccugggacccagggugggaacuuggcugcccgagcagcaccuggcggaaaccggggaguguccaugaguccuucagggugacgcgcacugaauaacucgcuugucaccgggacacgcgccuccaggucuggggugccuucccaggcugaggcagcacugacggggcucaguggagggcccccaguccuacugcggcuaccccgccucuccgcgguccggcucggcuugaccccagugccuguuccaggugugccccaucugcucggcaaugcccuggggggaccccagcuacaagagcgccaacuuccugcagcaccugcuucaccgacacaaguucuccuacgacaccuuugugguaggcaucccgccagcaccguccucccccacgcccuccucauccacccuccuccugcucgggccccucgccagccucaggguccgcaggguucagaggaagccagaaacagaagccucguuucagguggccacauucccccagguucugugggggcugccugcagguggggagugauggcagcugaguuugaguggccacuagagggugcccaggccucucggggacauggaccgcacagggcaggucccugccugcccaccccacagaaccccucgagggugagccaggcuuccuucuggaagcuuucuagagagcgcgggaaggacuuucaucaacaucgaacacuccagcccugucuccuuuucccacccgccgcgggucaggcacacaccuggcccccgggccugcagacccucgcacaaacuccucacuccuggugcggccccucccugcgccgcccuguucauuccuggcccuggcuaacaguccuggcgauggcugucacucccucugccagucguccgggacccacgcuccgccugccucaggauggaaauuguuagaggucagggagcccuggccggccugcucaccucggaaaccccgggcuuagaguccgaccugaaccagcagccauccauuccgagugcccccguacccagcgggugauggacacaccuucaccuucucaccccccagaggaccgugcaggccccgagccuguggggacaguggagcuggguccuuccuguguccugcuggagggaggcaggaaggguggacacgccugugugggugaugggcagaggggaccucuccuuccugucucccucgagcccggugcaucucuccuuccugucuccaggacuacaguauugacgaggaggccgccuuccaggcugcucuggcccugucucucucugagaacugaagggaagcgcagccacccgccugcgucuggggucagggauguccccgcuccugugucgcaccuggcaccugcucgggagcgcaccucaccggacugagcucacaggaggagccugcacccgcgcagaaggggagccggggccgagccuccgggccugaauacgggccagccgccgaggccgccagagcagggccgccuggucccaccggcgucgcuggguucuucggugcuucuggccgagcaggcggccuacuugggcagggcuggacgcugggaccuggagcugccgccgucucuucaaagccaugauacccccucgugggaagaagggaccgacgcgcgagucgcgcuccgcagucgagccgggaggaacccaggcugcugcccugcccagcccgacccugccccggccccacuuccaccuugcgcauuugguacuggcuuuugugauacuuaggaacccuggcaucuuuucuauauuauccagugugauaaucuuuucacguuuuauagagcaaagacagagcaguuacucuucauauugcaauaucuguguuugacuaggaauaauaguauuuuuauggaacauuuacaaaauuauauuuuuuaagaaaacaaucaaaacaagcauugggggauuggggcaaggauggaaggagcaguggggcagcugccagagcucaggcgagccauggggucugcuguggggucugcccuggccacccacugugugucuggguccuugagguuuguacguuucucuuugaugaccaggaagaaaucccagcaccccagccacaggcuguggcugcucccagcagaggcggggccggcagagaaggggccuccuccacccagaguccuggccuuggcccgcugucaccuucaaagcugacugugccccgcugcgggaggggacggcaccccagugguggcagagcuugggggccugggcaggggcccgcuuggcgggccgggcaacacgucaacauucuuuucuguucuuggcauuaauuauugcugucuuuuuuuuaaaaaaaaaaguuuaaauaaaaugucucagagcaucucuagca

SEQ ID NO: 15850 - RNA, 4759 nt, Homo sapiens
cgaugguucgguccgcgccgggggcggggccagggcgcccgcgggaaauuuggcgggaaccgcgcccgccucuuccucccuuccuucuuuccuugcuuucgccgcgcacuccgccgccauggagcagcgccgcgucaccgacuucuucgcgcgccgccgccccgggcccccccgcaucgcgccgcccaagcuggccugccgcacccccagccccgccaggcccgcacuccgcgccccggccuccgcuaccaguggcagccgcaagcgcgcccgcccgcccgccgcccccggacgcgaccaggccaggccaccggcccgcaggagacugcggcugucgguggacgaggugaggggcguggggagacugaggccggggaguugggggcggggagacugaggcccggggggcagggcucggggaaacugaggcggagggacgggggcggggaaacaggcgggggggacggggcgcagggaacucugggacaggccgggggauccugggggcgcccugccaccacuggggacuuggcuggcuccugagaugagcaggaggcacuggggggcuugcaccgggauccgaugauggggcuggaaguccagcuucucugcgaggccagggcagggguccgaccuggaaacggccccggaagacgagagcaaggcuguguccccggccuuagcacagaccaccaucuacgggaaguccuaagccccccagccaugcccgucccaguuaacucagagcggcuucugauccuucgggguccucugcagagccaggagcaccaggucuugucaugaguucacccuuggggucccucccaccagguuuccagccccaguacccccgaggccccagacaucccagccugcccuucuccgggccagaagauaaagaaauccaccccggcagcaggucagccgccccaccugacauccgcgcaggaccaggugaggggcggggccuggggcagaugcgggagggcugaguggugccggccugccugccugccugacggcaccguguccccugaucccccugaaggacaccaucucugagcuugcgucaugccugcaacgggcccgggagcugggggcaagaguccgggcgcugaaggccagugcccaggaugcuggggaguccugcaccccagaggccgagggccgcccugaggagccauggugagugcugggugggcggccacgaggccccggcaaaggccggguugguggcaggcguggcccagcgagccugucagaggcccaggucugcuccuuccagggagggugguggugaggucaccagggcgcggacccagaccccugagaaaaaggucccgggcacugcuggcgcugugcccucagucccuccugcggggggcagcuccugccucggggacucuggcagguuucaaaugcuccugaugcauugguguguugucugccucugccccugagagcugacgaaacugcgcuggggagagggcagagcuucccugggggagcugcguggacacagcagagcugggguguggagccgggcuuucccgucaccacugcuaccccuaacggugccagugcuggugggugugcaagggccgcgaaagccaucguguguggcauggcaggccccaucggagggucucccuggccgaggggccugcuguggcguuggagggguaggggccuacugcuucucaugaggcuccucccucccugacaguggcgagaaggcgcccgccuaccagcgcuuccaugcccuggcccagcccggccugccgggacucgugcugcccuacaaguaccaggugcuggcggagauguuccgcagcauggacaccaucgugggcaugcuccacaaccgcuccgagacgcccaccuuugccaagguccagcggggcguccaggacaugaugcguaggugaguggccgggggugggcuguggcuguccuggaguugggggugggcccgggccugccuccugagccgcccccauccucccauaggcguuuugaggagugcaauguuggccagaucaaaaccguguacccggccuccuaccgcuuccgccaggagcgcaguguccccaccuucaaggauggcaccaggaggucagauuaccagcucaccaucgagccacugcuggagcagggugagugcugggugcgggaccucgguuuccccaucugugagccgcacaguuuccagggugggugugaggugcugggcaucuggcccaggacuggucacggguggguggcuggguggccugguggggacuuaggccuggacucgucccacagaggcugacggagcagccccccagcucacggccucgcgccuccugcagcgacggcagaucuucagccagaagcugguggagcaugucaaggagcaccacaaggugagcggcccccggccccgcugugugaagaugguggcaccagcacugccucagcaccuaacccugugcuuggagcaucccugccacucacagcuucucccgggauggaacugggcuggguucacccugagcugagggcuggugugcucagggugcagccgcaggcacugaggagguccccaaggcguucagcgagcgcggaccaugggaggccuugugcucucccuccaagcugagcacugggcagaggcugagugacuugcccgaggcggcccggcugggacguaagcacaggccuaccucacaugcagucugcccuugucucagaugugcccagggucacccaucuacuccuucuccccaggccuuccuggccucccugagccccgccaugguggugccggaggaccagcugacccgcuggcacccgcgcuucaacguggaugaaguacccgacaucgagccggccgcgcugccccagccacccgccacggagaagcucaccacugcucaggaggugcuggcccgggcccgcaaccugauuucacccagggugagacugcgaggcuugggcagcccauuucucccgggugggugggccagccugaccccaggcuuaagagguggaagccuuggugaugagcuugacgccucaucuggcuuccuccuuggcuggcggauccagagaguugguggcauuugcccucuguccccagcugcagccucuaagccuggcucugccacuagccccauguggggaguuggccugggcaggcgaugcugcacacugggacacugcauugaccggcacagaccacccagugugcugggugaacuugugccuugagagauaccggggacuccugggcagacagccaggggcacguugcaucuugugaccucuccaguccaaccugucccucccgcagauggagaaggccuugagucaauuggcccugcgcucugcugcgcccagcagccccgggucucccaggccagcacugccggcuaccccaccagccaccccgccugcagccucucccagugcucugaagggggugucccaggaucugcuggagcgggugagucguccccagugauggcgggugggcgccuggugaccugcugcccacuaaccaggucccgguaccugcugcagauccgagccaaggaggcacagaagcagcuggcacagaugacgcggugcccggagcaggagcagcggcugcagcgcuuagaacggcugccugagcuggcccgcgugcugcggagcgucuuuguguccgaacgcaagccugcgcucagcauggagguggccugugccaggauggugggcagcuguuguacuaucaugagcccugguacgugcagggcggggugaaggggcgugcaggguggaauugccuggugcugcagcugccuccccagcuuucugagcagaggugucugucacugaucuguucuguucagaugugcagugggcgcuggccucuugcacugguguguccugggcgcucugcccuccuuggagccaccccugagccuccgcccggccccuccacaccugcagccucuggaggcagcuucccccucacagcucuggcccuuucccugaccaccugcaguccuuggucagaaggggccccacaugcacccuccacugccucccaggccucuggugaccaggcccugagcacauagggguccugacgcuacagggcaccuccugccucagggcuuucaugggcuggcggccuccaugcucggugccuccucacagggccucaacuguaggccuggcucucuccggucacuguucacaccacccagaccugggccucugaucagaaccaccucugcccuaaguccuggugauggggcccugagggcgaccaggcaggcacagagguuggguggucaggcugguuucaagugcugcccgugcagggcuggggcccagcaccagccucaguguccuccucuccucccccaggggaaauggagaagcaccugcugcuccucuccgagcugcugccggacuggcucagccuccaccgcauccgcaccgacaccuacgucaagcuggacaaggccgcggaccucgcccacaucacugcacgccuggcccaccagacacgugcugaggaggggcugugagccugggggccacuguggacagacgugggcuucagaagcucgcuggccugggcccaccagcauuuucuuuuaugaacaugauacacuuuggccuuccuuuccccagcgccccugagggccagaggcagaugugggcugcaggcugcacagcccgagggucucuggcugcgggcggugggccccuucauggggcu

SEQ ID NO: 15851 - RNA, 3326 nt, Homo sapiens
uugcuuuuaaaaagagcccaaguuuaauaauuuaugcuucaccauuaagacacacguuucuauuuuucuuaaaaugacuuaguugaagagcugagcaugccaaccccaagcuggccuggcacugccugggacucugcuccuccccucccucaacacccagagccccgcagauccccguggggcccaugccaggcucaccaccgggccguggcugugacucguggcuguggccuugggucuggaccaccauacaaggcccuacugggccauccccccgccaagagggggccaguggcugcucuggacaccccucuccucuggccucgcccccgcgccacucccugccccagccccaggauggagcacaagugguuuacuccugauccaggccccagccccucucucaaaaucgggucuucccuuuaauacggugaaaaccauggugagaauuuuccacgggcccugcacggagagagaacacacacugaguggccuuccagaggagaaggggugguggcccagggccccgggggacaacaggauaaggaugcagggaggucaccuggcugcucaggcaaugccccaggggccuuucuggugacucccagcugcucucuugggagggucccacgaaaaggaaaggcagugccaggagagccccuuggggcagcuguagcccacccuggggccuuugugggaacaagaaggggucaccucucccagcagagaggcuacaaaaagcgccccccccaccagcugaugcagcagccacagcccucacccaggccccgccagguacauuccugcagccccaugaggaacgagcucagggacccccuccugccccugaugcccuccaccauggcccucgcccccaggcugcccccacaggcacccacucaccgguucugcccuuguggucugagccggggccugcccuggaggccgcugugggggaagggugccccccuggagccuggguguccucgaaggcccccgcggucuguggagcugaucccagggaaguugguucuuuucggcagcaccuggagcaaaggccuguuuugaguccuccucaaggagcagccgagacccagcucacagcccccgcagcccccaccaccccggagcaugggguccugcccggcucaggauaccauucgggccuacaggguucccugccuuugccuaccauagcugucauaugacaccccgucacggccagcaccccugcagaggggggggucacggccagcaccccugcagaggggggggucacggccagcaccccugcagagggggcucccgcccgagaggggacacuuccccaccaugccacuggcagaccaaacccagcuucagguccgagggucccgccacauccuguccaggcccagccaagcaccgugccugagacacgcugugcagagaggagccagcuggggcugcugugugucccagggccagugggccagccccucugcgcucauguuccuggaccuggggagcaccggcgcaccuugaugacccggccccggaagaggcucugguccagcuccacggcggccugcacggagcccuugguggcaaacucuauguaggcauaacugaggggaggggcagggaggggaggggugaggcugggcccuguccgcauggccagugcccccaccaggccccacacugaccccuugggguguccagagaacuugucacacaggaucgugacucgguggaccuccccacagcggcugaagugggccuccagcuccucggcggagcccccguaguccaccugcacccaggcccagaccagcaugugagggagacgccuggcccugacucggggccuucuuguuagaggugaggaaagaaaccccaaggcugggccccguggcggggauggccccaggccuccaccccacacccccgcugggguuggagggaagagaggaaaggauaucucguauggagcgcuuccuucuggagagcuggagccuuuuaaaaagcuucucaaaaguggagauuucaugugcaaccccgaauuccagcucauguugaaaaacuggaauaugugcccaggccaguguuuccucaaggugacggggcugcccccagggucagacccccuucccagcaaggcugccuggcccauggccgggcgccagacccucugguagagauggggccccauucgcugccugccccuucaccccgcccaccacucacguugcccacguagacggaucuguggucagccuccaccuucuccucgggggucccagagagggggcagccugcggagaacacagcucaggcccgcaggcccuugguuccuuccucacuccucucacggggaaggucgcccaggcuuauaggggaggugacaccuuggagccugccaggcccaaccuuaauggaaacugugggacccuugcucaguggggggcggccugugcccuugguuccuacccacggucucagggcucagcagcugcccggccgcggugcccuccucuuccucggccuguugcugcacuccuggaggccguggcguccccucggccugcuccauggcacacaccuucaucuugauggccuccagcuccugccgacacacggcccugagccgggcaggcagccugcaggcucugcucaaggaagguggguguguggccugccagcuccagcagagggucacagccccaaggggcagcccuucucuggacagggacacuccuuccuggggcagcuggcuggggaugaacucgccccugcagagaagcccccgaaaccgcaccucaagggcccuuccccaggcgagagaggccaccuugacccugcagucuguguggcugggggcggggggucuccuugccaccuucguccaggcaggugggcaauggcccucuccccuccuaagucagcugcagccauccgucacccagaccccgugucuccaccagccccugugccccagguccccugagauccccagggccuccacacagcuguuaccuggucaggcaaugggcacucagccagguucucuugcuccagcagagacagcagaaagccugcauccccauccuggucuuccucugcauccucuuccuccucuuucuccuccuucccuuccccacccucuggccccagaaucuccuuggucucguuccaggccccccagcccugggccucagggucugaggagaccgucuggagccaggccugagucgggggugggaagagagagcggcucgggaagggccacaugguagaggggcaggaggaaggugggccaggcgaggccuccccuccacuccccu

SEQ ID NO: 15852 - RNA, 319 nt, Homo sapiens
uggagggagugggaagagcagcagcucagcguccaggcuguucuuucuccugcugccgaggcgaguacaggcaggaaguugugacuaagugcuuguaauuggugcgggggcuguggcagggcugucagacaggaguaccgccggccccuggcacagcagggccgugggcgaaagcugucuuccuugccaccucacgccucaccugucccugcacuggggccccacccccaucagagcccacccaggaccccuguccagcuggugccucccuccccucaccccaucaagacccaccacagcccaggaguacugaguauuc

SEQ ID NO: 15853 - RNA, 319 nt, Homo sapiens
gaauacucaguacuccugggcuguggugggucuugauggggugaggggagggaggcaccagcuggacagggguccugggugggcucugauggggguggggccccagugcagggacaggugaggcgugagguggcaaggaagacagcuuucgcccacggcccugcugugccaggggccggcgguacuccugucugacagcccugccacagcccccgcaccaauuacaagcacuuagucacaacuuccugccuguacucgccucggcagcaggagaaagaacagccuggacgcugagcugcugcucuucccacucccucca

SEQ ID NO: 15854 - RNA, 9671 nt, Homo sapiens
cgggcagccccagggccgagagccuuaugagggcacugguuuccugggcuguugggagcaggcagccccggggcugagagccuucugagggcacugguuuccugggcugcugggagcggggagcccugggcggagagccuucugagggcacugguuuucugggcugcugggagagugcagccccggggccaagagccuugugagggcacugguuuccugggcugcugggagcgugcagccccggggccgagagccuucugagggcacugguuuccugggcuauugggacugcuaguccugcuggccaguguggguguggcagggcccagcugggcuucccugcaggcucacccugacugguaccucugacccucugcacaggucaagugcaucgugcugcaggugcuccggggccuccaguaucugcacaggaacuucauuauccacaggugggugacagcuaggcagaguuggaagcacaaauucggcugaggccuaacucugcugccccuguggaguuacuaaaagcucagggguucccagcugcagcagccugcccgcugcucgcacuccauuuguguuuuuuucuaaaauagagaaggggucucucuguguugcccaggcuggucucacacacuugggcucaagugauccacccaccuuggccucccaaagugcugggauuacaggugggagccaccacacccaggcaugcacuccgauuuuuaaaagguccaaacaucaacagcauguaagaguuaaugaaaaaaaaaauaauaaagauacuacgccgggcacaguggcucacgccugugaucccagcacuuugggaggccgaggcaggcggaucacgaggucaggagaucgagaccauccuuguuaacacagugaaaccccaucucuacuaaaaauacaaaaaaauuagccgggcgugguggcgggcgccuguagucccagcuacuugggaggccgaggcaggagaauggcgugaacccgggaggcggagcuugcagugagccgggauugcuccacugcacuccagccugggcgacagagugagacucugucucaaaaaaaaaaaaaaaagauacuaaaaagcccaaagcugaggaaacgugcaggaagucuacgggcauuggugccgugggggagcucucagccccuguggcccucugggagccaccugccacuguuuuuccaucacagggaccugaagguuuccaacuugcucaugaccgacaaggguugugugaagacaggugggugcaacuugggccaggcccugucccuagauggcacuuggugacacacacuccccucucugcugcagcggauuucggccuggcccgggccuauggugucccaguaaagccaaugacccccaagguggucacucucugguaaguccuucugaagcaugguggccccuggggaccaggccugucugguggaggucuccuuggggaugucaggccgaagcugcaacuggccuugggaauguuaagcuacagggucugugcacacucagaaacguugggucuaggacagccuccaggacacagcagggcugugccacaaaauggugagagacgggcucaguggcgucaagggccugccuagaucagacacaccucgccuugagagcuggaaacaccguggccgugaaaccaucucuggagggaaggcugcuucacggacugaaggacaggcagcuugcaugcuuucccugguucuuccuccuggauacuuuuaaccaaacagggucaugcuuagccagggcugaauaucagaguuggucagaaucaggucaggaccccagugucguguacuccccaucugagaacggguugguaguggcugguguggcugugugccgaggguccguggucccugcgacucucaggacaccgcugcacgugacagcucucgcccccggcaaccauugcugugugugccaccuggaucugcagggccuggggcagagggugguccgaguugggacagguuuccaggccaccacaggcucucggggaggcuguguccuguggaggccugggcugggggagaggagccggcuguauugaggugggugcuucuguguguagguaccgagccccugaacugcuguugggaaccaccacgcagaccaccagcaucgacauguggugaggagauacgguuaccgcuccuggggccucaggaagggcugggacaggagccgggucaccugguuccugagcucagccucaggggaggggcaggagugcaguggggucuuugccagccucccacucccagggaggugggccugagccuggaaacccaggaggaggugugagaacuuagcuugcuguucucaggcugggagcacagaggucuggaggaggcacgccugccccugcacuugucaccccgggaggccugcggggcccaggaggggagccaguggucccugccuguccuucacagugucccugacccagcgugccucacacuggcagggucagcaaaggucuggcugcagucagguccucuguuccucgcgcuggcggggucagcagacgucuggccgcagugagguccacuguucucugcagggcugugggcugcauacuggccgagcugcuggcgcacaggccucuucuccccggcacuuccgagauccaccagaucgacuugaucgugcagcugcugggcacgcccagugagaacaucuggccggugggcguccugggcagacccgcagcccccgcccgugcccacgcccucugcgcccgcagcccccgcccgugcccacgcccucugcgcccgcagcccccgcccgugcccacgcccucugcgccucagcuccugccucccauagggcuuuuccaagcugccacuggucggccaguacagccuccggaagcagcccuacaacaaccugaagcacaaguucccauggcugucggaggccgggcugcgccugcugcacuuccuguucauguacgacccuaagaaaaggugcugaucucugcacggggggcagggacccucaccacccacacuguccagaccguuucccagagcccagccucacugcgguggagaggccccuccccaggcacagccgcucggaguggccaccuggcuuccuuugagcauuugaaucacaggcugcucagcugggugggaggugaggaagccgcacucacaagucgcacuaacgcaggcugccuccuccagggcgacggccggggacugccuggagagcuccuauuucaaggagaagccccuacgugagugugcaggguuccugacucgcucugugggguauggcugggagcccguuuugcccggggugggugguggagaaguggccugcugcccucacugacggcacacccuuucugggguaagaggacaggggcauguggaggcacagacagcccagggccagguccagaggcagagcuggacucagaccugggccugcuccuccuaucuggggcccugccccgcccagcacugaacccuucucccugcagccugugagccggagcucaugccgaccuuuccccaccaccgcaacaagcgggccgccccagccaccuccgagggccagagcaagcgcuguaaacccugacggugggccuggcacacgccuguauucccacaccaggucuuccgaucaguggugucugugaagggugccgcgagccaggcugaccaggcgcccgggauccagcucauccccuuggcugggaacauccuccacugacuuccucccacugucugcccugaacccacugcugcccccagaaaaaggccgggugacaccggggggcucccagcccgugcacccuggaagggcaggucuggcggcuccauccguggcugcaggggucucaugugguccuccucgcuauguuggaaaugugcaaccacugcuucuugggaggaguggugggugcaguccccccgcugucuuugaguugugguggacgcuggccugggaugagagggcccagaagaccuucguauccccucucagucgcccggggcugucccgugcauggguuggcuguggggaccccaggugggccuggcaggacuccagaugaggacaagagggacaagguauggggugggagccacaauugaggauaccccgagacuaccaggagagcccugggcuggaggcugagcugcaucccugcuccccacauggaggacccaacaggaggccguggcucugaugcugagcgaagcuauaggcucuuguuggauaaaagcuuuuuuaacagacaugguuucaccagcguuuaaugugcucugauguugaccgucccucugaguguucuggggaggaggggguggggcggagggucaggaaagcaggcucagcuuccagggucagggaguugugggcccagaggggcugucacaguggaugcacccugcccucucccucgccagacccgaggguagggcagaggcaccuccucgccagccugugggcugcacccacagggaauggaggggaggggcaccauuaccacuggacccaccaagaccccgccgccugggcgggcuguccacaggcccuuccgcccagcagcagugacgcucagggccuucccagcugucagccacugcccguuccugcgccucucgugcaccuccacaucugguuugaggucaggucauuuccugucugugggcccagcugcugugacacccaaggggagggccggcguccccgaagccaggucagccgugcacccggcagagccccgcagauuggcuccagcagagcuugggguggggggagcucggugucaccaacaggcccuugaggacacucguguggagaaucccugggacacguggaggacccccaaguccugagccccguacuccguacugcagggagcaggccaggagccacgggccuuggggcacaggguccuucucagggacagguucaggcacuggcuggaacaggcuggaccccucuacccagcacaugugggcaugcgucuggguuccgaggguggggaaauguggaaaggcuccugcuggccggcuuaggccugcugcccuuggagccuuccauauacagagagucccaccuccagcaaggguuggccuggacucuccaacccccugcugugcccaggacucccccagggacaaggcaaccagaggcccagaccccuccccagcaaagagaagcaccacgggagcugucucccaagagcccuugaccuggggcccagcuggccuagggccgggccccggggcuguuguagagcagaguguccaucugugcacgcuguagccacaagcgccgcugggcgucgccaagcagcacacgcagcgaguggccuggacggcaggcgggcagggcugcacagugggcagcaugcagcuggcgacaggugucgcagcagagggugggcagggcgccaggggacaggcagcugugugccugguagccugggggcuccgagacagaccuauaggcugaggcugguacccccucugcccgaauacgccucgggcuggccgcugcagagcuuucagggguggccagguccccaggccuacucagcucacggcgcagagagaggaaggagaaggcggaagguucagguuccagccccuccuccaaggccccauauggugggcugcuggccugcggcagcuccucagcugggggcucccaggcccggcccccagugccccacaguuuggcacucugcucccagagugguggccuguaggccagcuccgccgggggcgagucagggccuggugacggcuccccauacaggcuggcguccuccgaccccucgucuuccugcaagucccgguauaaguccaguggggcccuguaagcagcaggggagccucgggggggcagggguggcggcuccucauccugggccagccgcugcugcagccaggccacacaggaggccacguccccgcuggcacgccgugccugcagcagcuccucagcuggcagcacacuggugcccagcugggccagcaccucacccaggaucucacacuccagccggagggcgaagcagcccagggccaccugcaccagcuggcaggcggggggcagggcggucaccaugagccgauggcugucucugcguacguagcccaucuucuggaagcucuucaggaggaggucgucugagagcacacccuucagcacgugcacguagcccccagagaaggucugcaagggagcggccaggucagugacugcccacccucccauaggccagacccuaggguacaguggguccgggaucuguuggcucaggccuuggcagcuucugaugcucagacccaaccccagagacuaggcuuagccagcuugggccaggcccaaacaugaugauuucuuuuuuuuuuuuuuuuuuuuuuuuuuuuugagacagagucuugcucugucauccaggcuggagugcaguggcuccaucucagcucacugcagccucugcgucccagguucaagcaaguuccccugccucagccucccggguagcugggacuacaggcgcccaccaccacacccggcuaauuuucauauuuuuaguagagacaggguuucaccauguuggccaugcuggucucaaacuccugaccucaagugauccgccugccuugagcucccaaagugcugggauuacaagcgugagccacugugcccggccuagaauuuuuuuuuuuuuuucuuuuuugagacagagucucgcucugucuggaguacaguggcacgaucucggcucacuacaaccuccuccucccggguucaagcgaucuuccugccucagccuccugaguagcugggauuacaggugcgcaccaccacgccccacuaauuuuuguauauuuaguagagacgggguuucaccauguugaccaggaaggucuugaucccuugaccucaugauccacccaccuuggccucccgaagugcugggauuacaggugugagccaccgcaccuggccgaauuucuuaaauuuaauggaaaaaacaaugaauacauuaaccuagcucacaaaucagaacaaaaugaagagccccuguacugagaaauuccacugucuucugucccaccgcucccuucaccccuggagauggccucaucuaauuaguuuugaauguacuugcccagguguuuguuuugcaaacccaaauacagauuucguuugcuccucguaugagguaguccccccuuuuuuuucaccucuuuguaaggucucuaaccaaagcuagacagguagccucuuaaacguguuguucugaacuuuguuuuuuuccacuacagucuugcagacaaggacagaagcuguaacguucauucccccugcuguguaguauuccaccaugggggugacacgucuguuuucagcgcucuccagaggcuguccaugcacugggcugacagccgugggacgguagaagggugagugcucuuuuuuuuuuuuuuuugagacggagucucacucugucaccaggauggagugcaguggcucgaucucugcucacuacaaccuccaccucccagguucaagugauucuccucccucagccuccugaguagcugggauuacaggcgcgugccaccacacccagcucauuuuuguauuuuuuaauagagacgggguuucaccauguugguuaggcuggugucaaucuccugaccucgugaucugcccaccucggccucccaaagagcugggauuacaggcgugagccaccgcgcccggccuggcugagugcuuucuagccuacacuuaggugaagaacuaaaggagcucaggacaaucacugcgagcgucuccugacucucaaauucccuaacuccgggacuccuagcaucuaaugccuggacacggcccacguguggagcgcccagugccugcagcacugagcucggggcuuugauucauuccucuggccccaugaacuggacuguucccgugucgcugucucaggaggaaaggggcugacagagauuagcuaauuuggccaaguccucgcggccaggaagcagcagaacuaaguccaaaccagggcuguccggcacugaagccgguuauucccccgccccgcccccugggaggccucaagggcgggccuguccguccucucucaugaaugaaaguccuggcgccuccgaccagcagguguccccggggagccgcggagagacugccgcugccauggcaaccggcggaggcguagcucgcccacgugcccagugacgucaucggcuuccuacucuuccgaauuagcucagagcucccggcggcccugcccccuccugccgccaggagcucaccuggagaggccaggccagcccugggcacagccucccgccccaggccguggaguucacuaggucugagcccagcccugagacuucacagggaugcacccaucugcaguccucccagccucggcggccuccucugcaaaugggauuggcccauaaccuggaggaauuaggaugaccaugggaacucaagucccuucugugcccccguccuaagauuuccauggcaacuggggccgcgaggccucuuagggaagacacugacgcaagcucucagggcaggaccccguaggcagcacccaagccugcccucgcccaccccauguucucagcccuaggagugggugcccccacacgcccacgaccccucagcgcucggagccuugaggagcccaccaggcacugaggacacuugaagccccucucucucgaaaggcguggucccccauggucggcggccccgcgacccgcaggccaggacgaggggcgcgcuccuccuggccuggcgccuaccuugaugguggugaacuccuuccuccagggcagcagguacaggugcaccgcggcgagcuccagaagcucgaaggcgcgagccaggccgcguagcgcgggcgccaggucggcgcggccccacagcccgucggugagcagagccagcgcgucguccugcagcgccccgugcaggucgaaguccuccaccaggaucugccagagcaccgcgcgcagcgagggguccccgcacacgcccgcgcggccccgucgcagcucgcgcuccaggcacuggcgguaguccucggacagcgagcugcugcccauccugcggcggacgggggucgggggggucagggaccuaaggccgcgcccagcccgccgcgcucuccccgaacccucacccagcguccccaggaccccucgagccuggagaccccgcccccagcggcugggcgcccccgguaucuucggcacccccuacgcuggagaccucggccccaucagcugcccgcccacccagcgauccaggccccuccaguugagcgcccccgcaccuccagccccucccuccagccuggguaccucggccuuccaggggcgcccccgguuaucgaccgcacccuucucuagagacgcgcuuccgcccgcugagcccucucccgaccagagccccuucgcccggcagauggagcugcggaucccgcgggugacggcgcuaccugucuguccccagcggucuccggccgccgcggaucaguucgggccuccccgcgcgccgcgcgcuuccgccgggagucggcuccgcccgggguccgcggccgugacgcugg

SEQ ID NO: 15855 - RNA, 14936 nt, Homo sapiens
cucccccagccugggcuaccuuuacgugcacguggggcgggacuuucacuucuuuaaugauuccuucuguugugugacuuugggacuggaaauccaggucacucaucccccacaugugacccaagugagcacagcagagcccucaggcugcugcagcuggagaaugguccgggcacggagcccagggcagcucagcucacaaccccucagcaggcaccucguucacucugcuauuggaaaggaagagacuguggccaggccuucgaaugcgcagugaugcuuuaaucccccuguuugcaaacgagcucuguggaagcucagcaggaaggauggaaagauggggaggaagacccuggcggguggaaguguggccagggacacaaggcugcccuuaugggacugaaagagaaagcugcugggcucugugugacuggaaaccagggaaggagaccuggcugaggcaggaacuggguuugccagcagugcggaggggcagcggguggcucagaagugggagcagguacacagaaggagcucagggcaugccuggggcaucuccaaagcucugcugagagugaaggccaggagccuguuuuccuuccccagaagugugcucaugggaaauggggcagggggcaggcuggcuuggggauggaaaguaagcuuacacuuugauauuaaacucauucuuugacuugcugucaggcaagaagcccauucugugagcuucagcauauaagcauugggagggugugagcuggggcucccagacacccccagagcagagggagcagggccugucagccuccucugcugcuccuggacagagacccacggggucccaugggcuccaaaccugcccagcaaguuuaagggccgugggcaggccuuguagccgggcaaugggaugugagcagaaacgagaauguggccuagcagugggugcaggacaaggagaggugaaccccaccccgagagcauuccgggaggugucaucaagucucuuaggcagucuggugauauuugguguucugagcuaaggagggaauggacuugucugucacgcaggggccaagagaagcaggugcaggucuuagagcugagccuuggggaggggacccuagugagacagcgccuccguggaguagaagaaggggcaggauggaaaucaaggugggaauuuuggggccgcuucuccaugugugcuuugcuggacagcacauugucccauuagccacuaccaaacccgccucuggcuucugagcuuggcagcacaggaaaacgcggagguuggagcacccccaggaguuccuggaguggcugucacaggccuggguccccuucaccccaaggccgccgugggccacuccauuccucagcacguuccuggcagugacuccgugacgcugucuuccugacucggggcccaggaacgagcuggacguaaggccacugggcugugcuugugcuggggcucccagaggcauccgggggccccgugugucccccaggaaagccggcuggucuccaagugaggcgaagacccgugcccagcagacaaggccggucucggggcuggcagagagcugcccccagggugugugucaggaggugacggcuggagccucgugggcgggugaagugugucugcugggucagcacugcccagaucugccaucguguucggaccccaucccugcaggagcuggggcagguggagauggucuaguccuccuggggccucuccacagugagaaacguguccaggacuguggccugccgcucggggucgccuaggggcugcuucucguggcucugcucagcccuuguccucguccaggaaggggagcgcagguagccggcccggggcagcgggugcagaccuaggggcaugcgggaaggggaacucgguguggcugagaggccuggguggaugcugcggagcuccaggugccgccggccuccugcgccacuccugccaaugcucugcaccagcccccugcaccaggcaugcacacaucuaccucuaacgggaggcccccaccacacacuggccccaccagagagguggauguuguggucuggguggggccugggcagggucuuuucuggugcuccccggagucacuguauagucuaggcugagccucuccuguuuggucauuaagugacccugguggggccucccuaaacuguuccccccgcaggugucccaccucagccaaccacccuccaugagcccugcaggccucuuggagccucugccccaucaugggccuuguguguccccggccucuuggagccucugccccaucaugggccuuguguguccccggccucuuggagccucugccccaucaugggccuugugaguccccggugcaggcucuguggggcuggggauucgggugggcuggagucugagccccucacuccaccuccccagccacaacagccaugccugggcucacgggcugggugggaaggguugccgccaacauggagcuggugggaacuggccagggucaggcaauggccuuguccuggaggugagcugggggcugacucaugaggccccauucccucccagacaccuggggcugcagcagccugggacacacaggccgacaccccuuccugacaacuccaggaaccaugggagcagcuggccaccggcaggagucacaguggggcugguccuuuuaaugagguccugaguggccugggggguugggaagcagaggcugggccaaacugucccaugcggagaaggcucggcccugaugcucucacaguuacugaaguucacacaggucacgucaguguccuucacuggucacugucagagacugaggacgcgcugucgcauccucaugaguccugugcucucgucacggcuuaggaaggagacacgacaauggccgugcugggggcccugcucggcagugugaggacacuggagcugccuucaggccaauggcaacgcucccgugggaaucagaggaaguuaagugagcugaggaggggcccgggcuggugaccacccccaccuuucguucuuggcccauuuuaugaugaaaauucacauucauuaaauucugcuuuugaggggacaguggcuuuagccgucuguugcucacuugaaaaguaaaguuuuaagcagcugugacggggaaguugcuucaaguugggcagauagcagcguggugaaaugaagugcugagggauucuugcuaaaacacacgcacaccucccaggacuucccaaggggccucagcccaccacccacaccucccaggacgucccaaggggccucaccccccaaacacaccucccaggacuucccaaggggccucaccccccaaacacaccucccaggacgucccaaggggccucaccccccaaacacaccucccaggacgucccaaggggccucagcccaccacacacaccucccaggacgucccaaggggccucagcccaccacacacaccucccaggacgucccaaggggccucagcccaccacgcacaccucccaggacgucccaaggggccucagcccaccacccacaccucccaggaugucccaaggggccucaccccccaaacacaccucccaggacuucccaaggggccucagcccaccacccacaccucccaggacgucccaaggggccucaccccccaaacacaccucccaggacuucccaaggggccucagcccaccacgcacaccucccaggacuucccaaggggccucagcccaccacccacaccucccaggacgucccaaggggccucagcccaccacccacaccucccaggaugucccaaggggccucaccccccaaacacaccucccaggacuucccaaggggccucagcccaccacccacaccucccaggacgucccaaggggccucaccccccaaacacaccucccaggacuucccaaggggccucagcccaccacgcacaccucucaggacuucccaaggggccucagcccaccacccacaccucccaggacgucccaaggggccucaccccccaaacacaccucccaggacgucccaagggcccucagcccaccacacacaccucccaggacuucccaaggggccucagcccaccaggcacaccucccagcccagcccugaugccggccucaccugcuggggacucgguguugagguucucgucguccgagucagcaaagaccucggccagcuccugguccgacaugucggugagcucagugagguccaggaggucgaaguggaccuccagagaggagacgcugcucagaggcucugagggcagaggggguacagucagcccucaggcccucccacaaggcugcucagagccccgggggucuaggagagagugugcuguguccucccacaaggcugugggugaaccacagcuuccugcaaagcccacaccggcaggaucugaugaguguugcguauacucaugacuagaaggcuuucacuugacagauggugcagcugaggcucagagaaccagagcugcaagagccuagcacacagcgccggaccuagaccccccagggaguguuuggacaggagguggacccugcugccuugucucuugggggagcucacgggguccccauagcgugcgcugggcagggagcaguacuuacgccuccucuccgugaccugcaggagccccggugcugguacugggaugcccccgaccuccuccuccacaggcguguggccauuguccccuguccccugggcugggacgcccagcgcagccugcggcaccucagccuccuuaacgaucucugcauccaaagacacagugucaccuugagauccacagggcucccacauccccccaggacgcggggcugggugugaggacuuggcacauccaguccuuugaaacucugggcagugaccagcaggugaugggauggcugggcuuguggccucaugccuggacccagacaagggguugaggggcuucaaggaggcugcuccuuccccuugggcccuggccuccccuagugaacaaggaaucugagauccagaucaccuuugguacgcaagcacccaugaaagccgaccaugcaggcguggaagucccaccagggcccgcguggcugcauuccagugccguccuggccucugauuucuagcucggcccaggguccccugaaggaucgcccauggauuuccauguccagccucuugguccccuucaaaccagaacagccccucuccacuguggacugacuuuuccuuuuaaaaacugaugucguauuugaguucagaauaauacauucucauuaaaugaaaguuacaaaccaggaggaauaggcaggccugccauucugugaucccuuagccaccaaccaugccucacaguugagcaaauauucuuccagguuucucccauguuuauuuauuuuuuuuagauggagucucgcucugucacccaggcuggagugcaguggugcaaucucggcucacugcaaccucugccccuuggguuugagcgauucuccugccucaucccccugaguagaugggauuacaggcaugcaccagcacgcccggcuaauuuuuguauuuuuaguagagacgggguuucaccauguuggccaggcugaacuccugaccucaggugauccgcccgccucagccucccaaagugcuaggauuacaaggugugagccaccgagccuggccucauuuuuuuucacaaacguaacuaccuuuuuuuuuuuuuuuuuuugagacagagucucgcucugucaccaggcuggagugcaguggcgcgaucucggcucauugcagucuccaccucacggguucaagcgauucuccugccucagccuccuuaguagcugggacuacaggugcccgccaccacacccagcuaauuuuuuuuuuuuuuuuuuguauuuuuacucgugauccacccgccuuggccucccaaagugcugagauuauaggcaugagccaccgugccuggcccaacuguuucuuuuauauacuuaacaauuguuuugucagaugagagcaggaggccccuuggcugcugacccaaagccggggacauuggcgagucuuauguccaucccuccacagauccccucagccccuccucagcugcucacccucucauccagggccacgccguccuagcggccaccucacuugccucaggcagccagugaguccuguuagucagagucaggccugucccugggugcaugccccccuuuggcccuaggcccugugggucuaucucucagggaagagacaaagcgcuggcuuccuuccccccacccauugccccugcaggaaccuguuuccagauggcccuccuucccucagcugcuuccuggacccugcauggcaggggccuucuggggacaccagcaccucccaccugagugggugcccagcgcacgcuugucagauggauaggugccuucccguugcugccagcagcacccugaggacccugugggguauuuuuggcagcccccagcggugagcacugaucguagcugggugugcuugaagccgaggggagcagcugcugccaugaggcucuugcugagggggcugcagcugggguucacagcgccagcagcugccugugaggggugggccuguccucccccguggcacuagcuggcagccuagauacugccaggugggccuggagcguccgucccggugcacccccaccccuccccagcagagccaagggagcugaggcccgcaggugcccggccuccugagugaggggcaccggugcagggcugggagguccccaguggcuuaagagcugggcagugugguugugggcagguggccuggcagcgagccgaguguuaggcugugccugggggcagcccuguggccugacaguguccccucgccccgucggccguguggucauucuguguggcccaccugccuccugucugagaagccgagugcugugucauggcauggcccguuucaggccuggggguugggcgggcuggacggggcucucgcggaaucugguuuccaccuuuccacuggcaucuggaaugagguuucugagcauccuaaagggucaaguuacugguguccuggcccacccccaagcccagcagggauaccucuccgcccagagggcacaggggacagggggugagauguggacucuguucuaaggcugugagcagggggaccucccggacaccagcaggaagaagccugcuugaccauuguccauagcgcugagggggugcccaggagaggggacuccaggagacccagccuggcccuugggcccuuccucaaggagagacaguguagaccaaagccccaggcccccgcccacaguguguucauguccugcuggacugugcuguggucacaauuccaaaaugcuuccacacagcucagagcaguggccguggcugcagagggcguagcccuguccuagccucgagucucaggagggugcugcagccggcccugagggugcggcaggggccucagaccugccagguccaggacagagcaggcgcugucccucuggcauggcugacccagagcccugagagcagguacgaguggggaaccaaggugcagggauguacgucaccggccaggaggcccugcucucaggauccccagcugaggaaggcuacaggggcucuuaccuccccagguuuacaggccaggcaugaacuccauggacacccuuaccccagagcagcacucugggguguagcugucagcuccaccucugucccuccccgccccuccuucuguccugaggggcacccccuccucuccucucucuuuuuuuuuuuugagauggaguuucguucuuguugcccaggcuggagugcaauggcgugaucuuggcucaucaaaaccuccgccuccuggguucaagcgauucuccugcgucagccuuccgaguagcugggauuacaggcaugagccaccaugcccagcuaauucuguauuuuuaguagagaugggguuucuccauguuggucaggcuggucucaaacuccugaccucaggugauccgucugccucggccucccaaagugcuggcauuacaggcaugagccaccgcaccuggccucucucucucaagagacaaggucucacuguugcccaggcuggagugcagugguaaaaccauagcucacugcagccucaaccucuugggcucaagcgauccucccacuucagccuccugaguagcugggaccaccacuccuggcuaauuaaaauuuuuuugguagagacagggucuugccauguugcccaggcuggucucgaacuccuggguucaagcgaucauacacccuggccucccacccccuccucucuggcagcccccuaauaucaaggaaaccuggggccagaguaguucugcagagaaucucuggggacagcacccucagaggcagguggggcaggugguucuguguuaauaaugacagcuaggugugguggugcacaccuguguggcagcuacucgggaagcugaggcaggagguccgccugaaacccaggaagucaagaaugcagugagcugugaucgugccauccagcuugagcaacagagcgaaaccuugccuuaaaaaaaaaaaaaaaaaaaaagacaguggcuuaugguuuucuaguacagucccagcauucuguguuuauugacuaacuccauucucaccucacccuaacucccagcuacauggggaagacucugagcuuuguacuugagaggaggaagcugaggcacagagcagcucagcgucuguccccagcaugcagcacagggcuggccagggacgcagcuggagcucucagccaucaccugucagccuguuccugaucauggcguggagaugggaaccagggaucccgguucagggcccagcagagggagcaggaaguccccacuugcuggcuuagguucccuggguccugaccuggggggacguggaucucugaaggaaggugggacagagguggcgucuccccuuguagucccccucucacugggcggggccccucaucuagacgaaggcucugauucauucauucacccaaccaagacuuccgaaucacccucuguucuggggacauggcauagacaaaauagaugauuccugcccuucugagggacggccagugccagugagcagugcggggcugugcucccauuuuagggggcaucuggggagggugcucuaccaaacuuggaggaggagccuggaggugggagggagccgugugauacuggguggggcggggggggacaugcauaaaggccugagcagagugcauuugaggacagcugggggcugugaggcagggcagggguggugugugcaggucguguggagaucgucaggacuuugguuucuauacugaguaagcugagagaagccguugaaggguuuugaauggagugggacagcaucuaccugaauuuuuaaauuauuauuauuauuauuuuuuuuuugagauggagucucgcucugucaccaggcuggagggcaauggcgcgaucucugcucacugcaaacuccaccuccuggguucaagggauccucuugccucagccucccaaguagcugggauuacaggcgugcgccaccaugccuggcuaauuuuuguaucuuuaguagagaugggguuucucccuguuggccaggcuggucuugaacuccugaccucaugauccgcccgccuuggccucccaaagugcugggauuauaggugugagccaccgugccgggccaauaccugcauuuuuacgacgaggccagcaagggcacaguccagagggagguaagucugcaggcacccucugcuugugcugagauggaggucccaagcaggaccucagccaaacagcaauccccuuccccaucuugcacuggagagggggcaugcgaaugccagcaguccucauuauagauccuggggucccaaggggcuacagacagcuucugggacaaagcucuagcccuguggaagcuucacagcagcccuguguggaaugaauaucauaguugacucuuaagaaguauccuuucggccgggcgcgguggcucacgccuguaaucccagcacuuugggaggccaaggcgggcggaucacuugaggccaggaguucgagaccagucugggccaacauggcgaaaccccgucucuacuaaaaauacaaaaauuagccgguguggugguacgugccuguagucccagcuacucaggaggcugaggcaggagacucgcuugaaccuaggagguggaguuugcagugagcagagaucaugccacugcacuccagccugggcgacagaacgagacucuuguuucaaaaaaaaaaaaaaaagcaucuuuucuuauuuccacauucuugagacagcaacacaucuguagcugauggugucagcguugaugagauccaguccuguaagcauuugaagccaccaggugucuagucugguccuuccccaucucccuuuggccuggucuuuauucuguaaagucuggugccguggucuguguuggggcuuuggggaaggaaaauuuggaagaugcagcuucugccaucaggacacgaauuuuuuggccagaagaaugugauaccagggacaagaccugagcccccaggaggggcacgauggaucuuggcaugaagagcgugcagcugcuauaaggcaugcucguggguccucaaaugacugagccuacuguguaauacaugcagcauacagauauguguucguugaccauaucaguaaaguucuggucaacaguaggcuauuagcaguuaaguuuuuggggagugaaaaguucuauguggauuucugacuuugagggaggugggcaccccuaacacuuaacguuguucaagagucagcugcacaugcauguucauagcgugauucacaguagccaaaaguggaaauaauccaauguccucaguggaucaauggauaaacagaauguggucugugccuaccauggagugagauucaacccaagaaggacggcgguacugacaccggauaucacaugcaugagccugaucaccucauucgagugaaggaagccaggcccaaaaggacaaaugcugugugacgccguuccuaggaaauguccagaauaggcaagcgcguagacauuccaucagugaucgucagaggcuggggggugggcaguggagaaggggagaacggguauggguuucuuucuggggggguaaugaagauauuauaaaauuagauagugguggugacugcacaauuuugugaauauacugaaacagugaguuguacacuuuaaaagggugaacuuuauaugugaauaauaucucaauuuaaaaacaauccucaauggaaacaaagguugaucuuggcuggaacugauaggcaaagccgggaggaaaugacagagacucacauacacugugagucggccacacgccagacccccaggcacagccccagagcaggcugggacuggguagagcgagaagcaucagcucuaagcggcuuguaucuaguucauggcugcauuccugggaccuagcgcacaguaggugcgcaguaaacaaaugagggugaaucaacuagcccacgguuagugagggacugcgcuaggaaucacccaggccugucugacacccucucaacaagcuuguaggaagaagaaaauuccucacgggcgagaccugcugcuuuucccagggugggaaccagaggcucaaugccaggcaggcaugggggcgggugcuggcagcccccaaggucuccagggccagggcagaggcaagcagguguuucugaugucccaggaaggaccccagaguguggggacacagcaauguucugguccuuaccccagcacagccccuaucaagggggacccaaccccccugcaggggcugcuggugcccucgcugaugagugggcacugaaggagcaccucagcgagggagccaggaguuggggugccucagcccggccccccaggcuucccugagggcugauugcugaugcccugugcucugcugcugaccuauuuuccagcacauucucgacugggaaacuuggcccaaauccuguucccuguugugugcccagggccccguccagagcaucgaggaggcacuuggcacacaccacuguauggacggaugagcuaaugaagugaaugaaugaauaucauaaaacuaaauggcuggaaggagagauggucgcagaggcaggggccaccugccccccaucccccagcaccuuccucucuggauuuggacccccaaaguauuucagggaugcuggaguggccgugucuagacucucagccuccugaggaucccucugucccuguggacccuugggcagacugaguugggguggguuacagcccuggcuuccagguggggcccucagagagggcacaggucacauuccugugcacacgugcaccuccguguucuguacauuucauauuaagaaaucauuaauuccuuuaguugcaaaaauaguguuuuaauaaugcuuuauaaaaauccuauuuugccgggcaugguggcugacgccuguaaucccagcacuuugggaggccgaggcgggugggucaugaggucaggagaucgagaucauccuggcuaacacagugaaaccccgucucuacuaaaaguacaaaaaaucagccaggugugguggcgggcgccuguagucccagccacuggggaggcugaggcaggagaauggcgugaacccgggagguggagguugcagugagccgagaucgcgccacugcacuccggccugggcaacagagcgagacuccgucucaaaaaaaaaaaaaaucauauuuuacagauauuucugaauuauuuaucagugaaauaauaugucuagauuugguucaaaccacuaaugaagggagguuggugguagucuggagaggaggcugugggccugggggcugggaugucacacaugggccuuugucccgccguucucucuacuuuuguaagguuuucaaaaguaagugauaaguaaugacagagucaccaaugugugaucucaugagguuccacaaaguaggcaucacuggccacuuugcagacaaggaaacaggaguuggugucaagagcgugagcccucagaggacagggcccugucuucccacuaacuccccaccccaggcaggguacugcacagagcugcgaccuguagguaaauaccugugcacugauugagucaggugucugaagcccccagccagugacugaugggcucagaaacugaaccugcuuucucugccuuuuaagcugcugggaaguccuccuuuuuucccaaaggaggagggaaaacauauuaaccuccacucccaaaugccuugggcucccacagcccugcaggggaagcagaacugucuccacugacagaaauggaaauugaggcucacaggggccugacugcccacaguucacagcuggaaacagcucggagacccccaagcccucacucccaaccuccaggcuuccuauguccacaaagcugcuacugggaauacccaggagccugggacuaucaguguuaagaaagagcucuggucccucccacaaaugacaaaucaaaacccaaacccaccagcccuggggcauuugucccuauaccuuggacugcagauacacaggguggguggaccugcuccucccggggacagcccuucgggcuccagaggaugccacugugugcggcugggggacugagagguucccauguaguuccagagcggcaggcuggccugccugugcccucaggcaccugcuggcucccuggaaugggagcucuaggaaaccaggagguggugggcuuggcugggcagguggaggagucugcaguuugcauccaaguuccuaccuaggcaaauggaaccccgaaagcccuuuuggaaaagucucugaucgggaaggggggagguucugagagcuuucuucccguuaccgacuccaagguccugcaguagggccuccaccaucagggcagggagcgcuccacgcgcaccuacccuccccgaugagcgugcgccugggccacucccggaccagccacccuugcagcucuggaguccccggcaggccgcgcccgugcaugccccacauccccaagacccaucucagccccucgccccuggcaggaucccugcccgcgagucuacggcccucgccccccgggacucgcggcugggcgaacaaagcggacgcgcuugcaagcggccagcgucgcccucacgccccaccgacagggaccccaaacuccagccccggaaccccccucccccgcuccccgggucaccggcuggcuuggcugggagggggcucaggacgaaacuccgggccacccaccaaggagcgugccgggcacggcuucccgggccgggagcgcagagaacaagggggcggagacucgguccgugugcccccagccccgcgcggggaccgcgcccgggaggugccccuggcccgccggacgaccccgagcugccaaaggggucuucgcgacucccgggagcggcgaagggugagcccuggggggaggggcugcggcucgcugcggggaagcgcugcgcgggggucucgggggcuggggcugaacucaccuccggugccggcgcccuccgggggcuccaugcggccggugcggucugggaggggcacgggcgacggcggcgucgccuggcccgggcgccccaacagcugcggcagcgacucggccccggcuccgggcgcagcgcaucggggcagcaaccggggggccgcggcggcagggaggagcccgcggggcggggcggggcgcgcagcugcucccgggccccggcccccucccggcgcccc

SEQ ID NO: 15856 - RNA, 9322 nt, Homo sapiens
gugcugggggauggggggcagguggccccugccucugcgaccaucucuccuuccagccauuuaguuuuaugauauucauucauucacuucauuagcucauccguccauacaguggugugugccaagugccuccucgaugcucuggacggggcccugggcacacaacagggaacaggauuugggccaaguuucccagucgagaaugugcuggaaaauaggucagcagcagagcacagggcaucagcaaucagcccucagggaagccuggggggccgggcugaggcaccccaacuccuggcucccucgcugaggugcuccuucagugcccacucaucagcgagggcaccagcagccccugcagggggguugggucccccuugauaggggcugugcugggguaaggaccagaacauugcuguguccccacacucugggguccuuccugggacaucagaaacaccugcuugccucugcccuggcccuggagaccuugggggcugccagcacccgcccccaugccugccuggcauugagccucugguucccacccugggaaaagcagcaggucucgcccgugaggaauuuucuucuuccuacaagcuuguugagagggugucagacaggccugggugauuccuagcgcagucccucacuaaccgugggcuaguugauucacccucauuuguuuacugcgcaccuacugugcgcuaggucccaggaaugcagccaugaacuagauacaagccgcuuagagcugaugcuucucgcucuacccagucccagccugcucuggggcugugccugggggucuggcguguggccgacucacaguguaugugagucucugucauuuccucccggcuuugccuaucaguuccagccaagaucaaccuuuguuuccauugaggauuguuuuuaaauugagauauuauucacauauaaaguucacccuuuuaaaguguacaacucacuguuucaguauauucacaaaauugugcagucaccaccacuaucuaauuuuauaauaucuucauuacccccccagaaagaaacccauacccguucuccccuucuccacugcccaccccccagccucugacgaucacugauggaaugucuacgcgcuugccuauucuggacauuuccuaggaacggcgucacacagcauuuguccuuuugggccuggcuuccuucacucgaaugaggugaucaggcucaugcaugugauauccggugucaguaccgccguccuucuuggguugaaucucacuccaugguaggcacagaccacauucuguuuauccauugauccacugaggacauuggauuauuuccacuuuuggcuacugugaaucacgcuaugaacaugcaugugcagcugacucuugaacaacguuaaguguuaggggugcccaccucccucaaagucagaaauccacauagaacuuuucacuccccaaaaacuuaacugcuaauagccuacuguugaccagaacuuuacugauauggucaacgaacacauaucuguaugcugcauguauuacacaguaggcucagucauuugaggacccacgagcaugccuuauagcagcugcacgcucuucaugccaagauccaucgugccccuccugggggcucaggucuugucccugguaucacauucuucuggccaaaaaauucguguccugauggcagaagcugcaucuuccaaauuuuccuuccccaaagccccaacacagaccacggcaccagacuuuacagaauaaagaccaggccaaagggagauggggaaggaccagacuagacaccugguggcuucaaaugcuuacaggacuggaucucaucaacgcugacaccaucagcuacagauguguugcugucucaagaauguggaaauaagaaaagaugcuuuuuuuuuuuuuuuugaaacaagagucucguucugucgcccaggcuggagugcaguggcaugaucucugcucacugcaaacuccaccuccuagguucaagcgagucuccugccucagccuccugaguagcugggacuacaggcacguaccaccacaccggcuaauuuuuguauuuuuaguagagacgggguuucgccauguuggcccagacuggucucgaacuccuggccucaagugauccgcccgccuuggccucccaaagugcugggauuacaggcgugagccaccgcgcccggccgaaaggauacuucuuaagagucaacuaugauauucauuccacacagggcugcugugaagcuuccacagggcuagagcuuugucccagaagcugucuguagccccuugggaccccaggaucuauaaugaggacugcuggcauucgcaugcccccucuccagugcaagauggggaaggggauugcuguuuggcugagguccugcuugggaccuccaucucagcacaagcagagggugccugcagacuuaccucccucuggacugugcccuugcuggccucgucguaaaaaugcagguauuggcccggcacgguggcucacaccuauaaucccagcacuuugggaggccaaggcgggcggaucaugaggucaggaguucaagaccagccuggccaacagggagaaaccccaucucuacuaaagauacaaaaauuagccaggcaugguggcgcacgccuguaaucccagcuacuugggaggcugaggcaagaggaucccuugaacccaggagguggaguuugcagugagcagagaucgcgccauugcccuccagccuggugacagagcgagacuccaucucaaaaaaaaaauaauaauaauaauaauuuaaaaauucagguagaugcugucccacuccauucaaaacccuucaacggcuucucucagcuuacucaguauagaaaccaaaguccugacgaucuccacacgaccugcacacaccaccccugcccugccucacagcccccagcuguccucaaaugcacucugcucaggccuuuaugcauguccccccccgccccacccaguaucacacggcucccucccaccuccaggcuccuccuccaaguuugguagagcacccuccccagaugcccccuaaaaugggagcacagccccgcacugcucacuggcacuggccgucccucagaagggcaggaaucaucuauuuugucuaugccauguccccagaacagagggugauucggaagucuugguugggugaaugaaugaaucagagccuucgucuagaugaggggccccgcccagugagagggggacuacaaggggagacgccaccucugucccaccuuccuucagagauccacguccccccaggucaggacccagggaaccuaagccagcaaguggggacuuccugcucccucugcugggcccugaaccgggaucccugguucccaucuccacgccaugaucaggaacaggcugacaggugauggcugagagcuccagcugcgucccuggccagcccugugcugcaugcuggggacagacgcugagcugcucugugccucagcuuccuccucucaaguacaaagcucagagucuuccccauguagcugggaguuagggugaggugagaauggaguuagucaauaaacacagaaugcugggacuguacuagaaaaccauaagccacugucuuuuuuuuuuuuuuuuuuuuuaaggcaagguuucgcucuguugcucaagcuggauggcacgaucacagcucacugcauucuugacuuccuggguuucaggcggaccuccugccucagcuucccgaguagcugccacacaggugugcaccaccacaccuagcugucauuauuaacacagaaccaccugccccaccugccucugagggugcuguccccagagauucucugcagaacuacucuggccccagguuuccuugauauuagggggcugccagagaggagggggugggaggccaggguguaugaucgcuugaacccaggaguucgagaccagccugggcaacauggcaagacccugucucuaccaaaaaaauuuuaauuagccaggagugguggucccagcuacucaggaggcugaagugggaggaucgcuugagcccaagagguugaggcugcagugagcuaugguuuuaccacugcacuccagccugggcaacagugagaccuugucucuugagagagagaggccaggugcgguggcucaugccuguaaugccagcacuuugggaggccgaggcagacggaucaccugaggucaggaguuugagaccagccugaccaacauggagaaaccccaucucuacuaaaaauacagaauuagcugggcaugguggcucaugccuguaaucccagcuacucggaaggcugacgcaggagaaucgcuugaacccaggaggcggagguuuugaugagccaagaucacgccauugcacuccagccugggcaacaagaacgaaacuccaucucaaaaaaaaaaaagagagaggagaggagggggugccccucaggacagaaggaggggcggggagggacagagguggagcugacagcuacaccccagagugcugcucugggguaaggguguccauggaguucaugccuggccuguaaaccuggggagguaagagccccuguagccuuccucagcuggggauccugagagcagggccuccuggccggugacguacaucccugcaccuugguuccccacucguaccugcucucagggcucugggucagccaugccagagggacagcgccugcucuguccuggaccuggcaggucugaggccccugccgcacccucagggccggcugcagcacccuccugagacucgaggcuaggacagggcuacgcccucugcagccacggccacugcucugagcuguguggaagcauuuuggaauugugaccacagcacaguccagcaggacaugaacacacugugggcgggggccuggggcuuuggucuacacugucucuccuugaggaagggcccaagggccaggcugggucuccuggaguccccucuccugggcacccccucagcgcuauggacaauggucaagcaggcuucuuccugcugguguccgggaggucccccugcucacagccuuagaacagaguccacaucucacccccuguccccugugcccucugggcggagagguaucccugcugggcuugggggugggccaggacaccaguaacuugacccuuuaggaugcucagaaaccucauuccagaugccaguggaaagguggaaaccagauuccgcgagagccccguccagcccgcccaacccccaggccugaaacgggccaugccaugacacagcacucggcuucucagacaggaggcaggugggccacacagaaugaccacacggccgacggggcgaggggacacugucaggccacagggcugcccccaggcacagccuaacacucggcucgcugccaggccaccugcccacaaccacacugcccagcucuuaagccacuggggaccucccagcccugcaccggugccccucacucaggaggccgggcaccugcgggccucagcucccuuggcucugcuggggaggggugggggugcaccgggacggacgcuccaggcccaccuggcaguaucuaggcugccagcuagugccacgggggaggacaggcccaccccucacaggcagcugcuggcgcugugaaccccagcugcagcccccucagcaagagccucauggcagcagcugcuccccucggcuucaagcacacccagcuacgaucagugcucaccgcugggggcugccaaaaauaccccacaggguccucagggugcugcuggcagcaacgggaaggcaccuauccaucugacaagcgugcgcugggcacccacucaggugggaggugcugguguccccagaaggccccugccaugcaggguccaggaagcagcugagggaaggagggccaucuggaaacagguuccugcaggggcaauggguggggggaaggaagccagcgcuuugucucuucccugagagauagacccacagggccuagggccaaaggggggcaugcacccagggacaggccugacucugacuaacaggacucacuggcugccugaggcaagugagguggccgcuaggacggcguggcccuggaugagagggugagcagcugaggaggggcugaggggaucuguggagggauggacauaagacucgccaauguccccggcuuugggucagcagccaaggggccuccugcucucaucugacaaaacaauuguuaaguauauaaaagaaacaguugggccaggcacgguggcucaugccuauaaucucagcacuuugggaggccaaggcggguggaucacgaguaaaaauacaaaaaaaaaaaaaaaaaauuagcugggugugguggcgggcaccuguagucccagcuacuaaggaggcugaggcaggagaaucgcuugaacccgugagguggagacugcaaugagccgagaucgcgccacugcacuccagccuggugacagagcgagacucugucucaaaaaaaaaaaaaaaaaaagguaguuacguuugugaaaaaaaaugaggccaggcucgguggcucacaccuuguaauccuagcacuuugggaggcugaggcgggcggaucaccugaggucaggaguucagccuggccaacauggugaaaccccgucucuacuaaaaauacaaaaauuagccgggcgugcuggugcaugccuguaaucccaucuacucagggggaugaggcaggagaaucgcucaaacccaaggggcagagguugcagugagccgagauugcaccacugcacuccagccugggugacagagcgagacuccaucuaaaaaaaauaaauaaacaugggagaaaccuggaagaauauuugcucaacugugaggcaugguugguggcuaagggaucacagaauggcaggccugccuauuccuccugguuuguaacuuucauuuaaugagaauguauuauucugaacucaaauacgacaucaguuuuuaaaaggaaaagucaguccacaguggagaggggcuguucugguuugaaggggaccaagaggcuggacauggaaauccaugggcgauccuucaggggacccugggccgagcuagaaaucagaggccaggacggcacuggaaugcagccacgcgggcccuggugggacuuccacgccugcauggucggcuuucaugggugcuugcguaccaaaggugaucuggaucucagauuccuuguucacuaggggaggccagggcccaaggggaaggagcagccuccuugaagccccucaaccccuugucuggguccaggcaugaggccacaagcccagccaucccaucaccugcuggucacugcccagaguuucaaaggacuggaugugccaaguccucacacccagccccgcguccuggggggaugugggagcccuguggaucucaaggugacacugugucuuuggaugcagagaucguuaaggaggcugaggugccgcaggcugcgcugggcgucccagcccaggggacaggggacaauggccacacgccuguggaggaggaggucgggggcaucccaguaccagcaccggggcuccugcaggucacggagaggaggcguaaguacugcucccugcccagcgcacgcuauggggaccccgugagcucccccaagagacaaggcagcaggguccaccuccuguccaaacacucccuggggggucuagguccggcgcugugugcuaggcucuugcagcucugguucucugagccucagcugcaccaucugucaagugaaagccuucuagucaugaguauacgcaacacucaucagauccugccggugugggcuuugcaggaagcugugguucacccacagccuugugggaggacacagcacacucucuccuagacccccggggcucugagcagccuugugggagggccugagggcugacuguacccccucugcccucagagccucugagcagcgucuccucucuggagguccacuucgaccuccuggaccucacugagcucaccgacaugucggaccaggagcuggccgaggucuuugcugacucggacgacgagaaccucaacaccgaguccccagcaggugaggccggcaucagggcugggcugggaggugugccuggugggcugaggccccuugggaaguccugggagguguguguggugggcugagggcccuugggacguccugggagguguguuuggggggugaggccccuugggacguccugggagguguggguggugggcugaggccccuugggaaguccugagaggugugcguggugggcugaggccccuugggaaguccugggagguguguuuggggggugaggccccuugggacguccugggagguguggguggugggcugaggccccuugggaaguccugggagguguguuuggggggugaggccccuugggacauccugggagguguggguggugggcugaggccccuugggacguccugggagguguggguggugggcugaggccccuugggaaguccugggaggugugcguggugggcugaggccccuugggaaguccugggagguguguuuggggggugaggccccuugggacguccugggagguguggguggugggcugaggccccuugggaaguccugggagguguguuuggggggugaggccccuugggacauccugggagguguggguggugggcugaggccccuugggacguccugggaggugugcguggugggcugaggccccuugggacguccugggagguguguguggugggcugaggccccuugggacguccugggagguguguguggugggcugaggccccuugggacguccugggagguguguuuggggggugaggccccuugggacguccugggagguguguuuggggggugaggccccuugggaaguccugggagguguguuuggggggugaggccccuugggacguccugggagguguggguggugggcugaggccccuugggaaguccugggaggugugcguguguuuuagcaagaaucccucagcacuucauuucaccacgcugcuaucugcccaacuugaagcaacuuccccgucacagcugcuuaaaacuuuacuuuucaagugagcaacagacggcuaaagccacuguccccucaaaagcagaauuuaaugaaugugaauuuucaucauaaaaugggccaagaacgaaagguggggguggucaccagcccgggccccuccucagcucacuuaacuuccucu

SEQ ID NO: 15857 - RNA, 1098 nt, Homo sapiens
accugauguuacaugauggaauaccuuaugugcaguuuauacaugaucuucuucacccuaccugagauaaugucaacauuauaaucccuggaaaggugggacaagcugagaacaucuccuuuuauagaaaacaugaaugaugccacaguuacagguacuuugaucuuacuuuguucacuggacagaugccuguacaccaggccuuuaacuuucaugcuguaaauggcaaaccugcaguuuccuauucucuggguuguagacaggaugaugcuugcuugugcuguuuucagcuaguuuguuguuuaaaauggccacuauauaaagaagccauggaugugauuucuggaguuaacacuuacugcagucucugugaugagcacuuggucacauuuucccucaucccuacccucugcucugcucuuuuuagggaaaguacgguggccagacuuuaaccaggaagcuuauguuggagggacgaugguccgcuccgggcaggacccuuacgcccgcaacaaguucaaccagguggagagugauaagcuucgaauggacagagccaucccugacacccggcaugaccaguaaguaccccacuaagcaccugcugcagcuucauuugcuuucacacaaaccaguacgucgcuuucaccugugacacuagaacuucuccauuacucugggaaauugaauguguguuguaaaacuaggaaaaauccugagguauauggcaauggaacuucauccauaggcaguggaaggaugguucuagauucagcucuagucuuuaggugcccuguggcagugugcagaggcuguggguuucuggccagagcguggaagucagaaagagaguugugugacuggcuuuauauuuagugaucacuuguuauuuuuaugauccauucacaaaaaugcaaaauuugucauuguucccaaccuuggaggaagaaaaucuaaauuccugcuuauugugacagcuuauauuggaaauguucuaaagauuagaaaggagaaaugaacuacccagcacaauagauguuaaauugagcagaaacacaggagggacaggugccacaucuccacacccuguacuaaagg

SEQ ID NO: 15858 - RNA, 1098 nt, Homo sapiens
ccuuuaguacaggguguggagauguggcaccugucccuccuguguuucugcucaauuuaacaucuauugugcuggguaguucauuucuccuuucuaaucuuuagaacauuuccaauauaagcugucacaauaagcaggaauuuagauuuucuuccuccaagguugggaacaaugacaaauuuugcauuuuugugaauggaucauaaaaauaacaagugaucacuaaauauaaagccagucacacaacucucuuucugacuuccacgcucuggccagaaacccacagccucugcacacugccacagggcaccuaaagacuagagcugaaucuagaaccauccuuccacugccuauggaugaaguuccauugccauauaccucaggauuuuuccuaguuuuacaacacacauucaauuucccagaguaauggagaaguucuagugucacaggugaaagcgacguacugguuugugugaaagcaaaugaagcugcagcaggugcuuagugggguacuuacuggucaugccgggugucagggauggcucuguccauucgaagcuuaucacucuccaccugguugaacuuguugcgggcguaaggguccugcccggagcggaccaucgucccuccaacauaagcuuccugguuaaagucuggccaccguacuuucccuaaaaagagcagagcagaggguagggaugagggaaaaugugaccaagugcucaucacagagacugcaguaaguguuaacuccagaaaucacauccauggcuucuuuauauaguggccauuuuaaacaacaaacuagcugaaaacagcacaagcaagcaucauccugucuacaacccagagaauaggaaacugcagguuugccauuuacagcaugaaaguuaaaggccugguguacaggcaucuguccagugaacaaaguaagaucaaaguaccuguaacuguggcaucauucauguuuucuauaaaaggagauguucucagcuugucccaccuuuccagggauuauaauguugacauuaucucagguagggugaagaagaucauguauaaacugcacauaagguauuccaucauguaacaucaggu

SEQ ID NO: 15859 - RNA, 72785 nt, Homo sapiens
uuggaaacagcaacaguuuuaauuaacucauuuuacucacugucauuuacccugucugggaaaaaaaacaagagagacuuucugaauguucuuauaccugaaagugaaacugguucacaaaauaaacacauacauaauccaaugccaaaaacuggugauuuauagaaaucacccugguuuauuuuuuucaacaaaggaaaaaaaaacaugguucaauaauucagcauuugggacucuggcaaguacugucugcauuguucaaaauaaguguuccuggcugugagcucugcaacacauacugauggcccaggaaccuucuuccaugguucuaauaaaacaaaggacccacacauggagguuacgugagucaacaaaagaugcucuaucacaaugugcguaaaaagcaagucuuugaaaaauauccagaucucuaaaggaauacaaacacuccuauuugguuuuguuuuuguucaucuucaguauuauauuuuaguuguugaggaaaauuuuuuuuacuguaaggaaggaguuauaugacuuuauaagugggaaccaacaggcugccggcuaauacauacgcuuucccuccaagucaaguagcuuuuuccccccgaaagccucuuucaugauuuucauuaugguucagaaaaguaaagaaaaugauuucaaguauucaauuccuauaaaaauugguaucaaaaguaauagaggaccuaauuucuuuauaauuccauguuuuaaaaaauaacuuaagaagcaagagguccggcccuuuacuuguauaaauacagcagcagaacuagaguuucuuaagacaacguggagaagagucuguguuuagcaccucaaucaucgaucuuaacguuggaaacguuucugauacugauggaagagucuuauaagaaggugaaauacugaaaaagaaaaacacaaaguagcggcaugaaaauuaacaaaauuugcaaaaaaagggcagagcuuauauuuauuccuaucauuauauuuauuauauucauguuguaauaucaaacaguguuagaaaggcagggaggagcugugaacagaauggcuccucucacaacaacggccugcggcaucagccaacacguuacaagucgcuuggaaguuaagccagagcuuugaaaaagaaaauuaaacucugauuuacauguccagcuguggugcaugcugggcuuggaaucaaaagacacagguuucagguccagcuucacuccuuauuagcuuucuuuacuucucuaggcugcacuucccugaucugucacagggacaguguucuuaacucgcaaaguuaccaugagcucugaaugagauaagguauuucaagguacgcuguaaagcguuaacugcaggauguaagguagcauuguuauucuuuccuuaaagaauugucaaaagauucacacuguacaauuauguaagaauagaagcaagaccuucggccuggugguuguauuacuaaaacaugugcaaacuaauaagccugaaacaacaauguaccaggacaagguguaacuguuagaagcuuucauugcaaagcuaaauuacaaauugagcaaugguagacuacaggcacaaauauuucuguuuuaaacagaacauaaauuacccagcaauagagugguugcuaugucaaauagacgugaaaggcaaaacugggggugguugggauguaaaaaaccaggagaaggggcaaaaauaacuaaaguugaacagugaggcuuacuuauucuucauuaacuacugaggcaucuaugaguuuaauuucacacacuucaaauucacacaguccucuccagugcuucuggaaacaagagccaggaacgaucauggucugcuagacuccucacacacaguguccgucagggauaauuccuggcugcaauaaaaugcaaccaaguaggcuaagugcuaccacucagaguaauguaaaaugggcucugucuacaaguucaaacacuccugaauacugagccuaagaguaaacaggccaagagaagugaauaccugaucauauaaauaagacuuugguaauuuucuuucaccaacuacuuuuuaaauuuuuuauucaugguucuuuaagagucagggucucacucugucacccaagcuggagugcaguggugcaaccauagcucacugcagccucaaacuccuaggcucaagagauccucucgcuucagccucccaaguacuugggacuacaggcacacaccaccaugcccagcuaauuuuaaauuuuuuuguagaggggagcaguuucacuauguugcccaggcuggucucgaacuccuggccucaaaugauccuuccaccucagccucccaaagugcugggauuacagguaugagcuacugugccuggccuucauaguccauuuuuauccauacauucacccuuaaaagguuaucuuauacaacagcaaaacauuuuaaccuugaaaaagugaauuaaauucauuguauuacauauuaacuuauaaaaaugaguauaacaguuccaguuuucauagcgcuccaaaguaacaggaaacuccuuuuccuccuccaguuaugauacccuuguguggaccccccucaaguaguuaccuuuucaaguucauccagcuuuuggcgacuuugcuaaaggccucugaaccaggggcugucauagcuucaaagucgacuaacugaaaaagaaagacauuuaggaauguuacuaaacauggaggacacaggcucggcuggagaucuauguaacucguguaccuuaaaauaaaaauccauaaauugggacuuaauacauaaccaagcauuucucccuucccgcuccaacauaccuucccuuugggaauuuuuccugcuacuucuuuuccacuugccaucagugcucccacgaugaccgaguaagcaauuacacuauuuaaauaaagaacaaaggucaauccauccuggacggucuacaguuaccauguuaaauuucaccauggacuucccaucaugaaagauaaaauuuauucaaaaauucuuucaaauaaaacaccgaauguuucauuuaacaugaaaauaugccuauuuguuuaagaauaguuacuaauuuacuauuagaauauauuuacuggccaggugagguggcucacaccuguaaucccagcacuuugggaggccaaggugggcggaucgcuugaggucaggaguuugacagcaacauggcgaaacccugucucuacuaaaaacacaaaaauuaggccaggcaugguggcucacaccuguaaucccagcacuuugggaggccgagguggguggaucacuugaggucaggaguucgagaccagccugaccaacauggcaaaaccccaucuguaacaaaaauacaaaaaauuauccaggagugguggcaugugccuguagucccagcuacuugggagacugaggcagaaaaauugcuugaacccgggaggcagagguugcagugagccgagaucgcuccaccgcacuccagcaaugcauguauacaauaaaguucauaaauacaaauacauauguuagucuuacuuuuuaagcauuagaaaugcuggccuucaaagaagaaaugcagaauacauucucacaauguacuaacggacagaugguuuggagauuugggcaugugugugaacugccagggcuccaagguggcuguuagaggccaggggauugugggguaccuuugccugcuggcucggaggcucguggggcaaggucugcugcccugucacuccagaacgaguguagagcugcgagugugcaggucugggguaggaggcauuuguaagacguugugcuucugcucuuggugagggaagagagggagcugacugguuuuggguggaaggggcuggcaaaaggccaugggacccacuauuguaaccacaguguugugcuuuucccaaaacaaaucggcucaaaauaaagacagcucucacccaugagauaaugcauccuagcagguggaaaggauggcacgagcaccugagaaagcuaacaagugccauggguggacaccaagaaaagugagucaaggugauucaugggguucuccagcagggaagacuucagaggcuaaagacaugugcucugcaaccuccagggucccagggcugaagaugaaaggggcagagaaggcagggagauguggcagagagcccacguggaaagccaaggggaagcaaaagagccacggaagagagcggugcugcagccaaggcaaaccagggcagggcagggcuagcacugcgcacuguguaugcugccaagcucggcuuaaacccaugguuuucagaaggugcuggagagccgcagggcacagagaggagcaggagcaaagcuagcuguggcggguacagggaagagagaaacagaagugugggaggcagaaucaacagacuauuuaggauugaagagauguagggaugaggcagaguugaggacaaucagagcugcacguccuucaaugucacacgugagccagcagagcugcugugaggacaaaggacggaugcuggcuguugaguacaguggggcccacaagcggugaugugcacaggccucacaucccuuauucaguggacacaacuagcaauauuaugcugauaagacaacauuuauguuucuauuuuguuucaaugagucuuaaauucuauaaccaaauuuacuaccacacuuaggggaguuuuacuuucuaagccauuaaucaaagauaaagacauucaaguguauuauuuuuagccaaaacaucuuaaguucaacuaugugccaguaauggcaaaaggccauuuacauaauuuacugcacacagugcugggaaaaggagaaugaaaugaaaacucuacagucauagcucuuguuuuaaugauaccuaaaaaacuccugauauacaaguagcaagaauuuauccaaaauaauaaaaauaguacagagugacuguuggcccaaaaguauaaaacaugaggauuaugggucaccugacagcccaaaauggaaaaggaagaggaggaggaagagguucaguaagaggcuggcagauacaaaaaauuaaaacacacugagcacggcacaugauacacaguaaacuuuccaugaacuuguguugaauggaugaaucccuauccuauuaaacguaagcacacuauauuagaacugucuucuauaauucuuuugcugaugugauagacuaaggaaauauuuuuuugugcagauuuuggaaaaaaauagggagcuccuuaccauuucuuuguguacucuguaccuauauccauaacaggaaggauaagcaaaaaagaacacauuucucaauuuaaaauaauuuuaaugacaggauauuacuuaccuggauccucgagagaguggcauuaaauuauaaaaguaauaaacuaaggauaagauuaaguugcagacagcaucagccuccuagaaaaaaaagauacagacucauaaauacuauaaagauuacaaacuaauuuuucauuaggugacagaacacacaagaauaaucuacaucaagaagaggauuguuuucuuccucccccauaagaaucuacuuuucaaauucuugaauauucuauacccuuuuguaucauuuuuuuccaauuuaguucaauuuagagcaauguuuucccagcuguuucuuaaacugcaacucuuggauaaacauaaaaaucucagucuccuuuaacguuauuugaaaugucaaaauauauauugugacuaaaauuuuaaaaggcauuuauuaacaccaaauauguucucucaaacaacauguaccuuaccccaaaagaucuggguaagccccuuccccuacuccgcauugagauuuggaugaugcucaauuauguguauaaacuuagauguuuaauuauauggaugcagugauuaaauguuggagaaauaaggugacuuuucaaggguaaggggcacccguccacugcagaacacagagaaggggcgugguggggagagaauguccaccauacccugcugccuguaacgacuccaccucgaguccaagcagacaaccaaagaagaaggccacagaccaggaaagggccgccaagugcaaaguauacacaacuucauuauacuuuccuugccauuaacucaucagaaugcaucauccaguuuacauucaaaagcuccuuguaaauauacgguuauaagcaacaaccgcaacgaagggaagaaaauggaagaaaaaggugaagcccaggucauuuucauuauggaccagcuuuuuuauaucuugucaaagcccaaacuuaugauaaugucauagugcaguacuaaauuauuaauuuauuauccuccccauuacuguaguuacuaaauacaagaauuuuugccuauaagaaauaagaaauauuuuuaggucaauucaacccaauuucaagcauaagauguacaaucucagugaaagggcagagguucaaaaaauuuacaaaagaaucauaggaagagcagaaaaauggaaacaaagagaaaccuaccccaaauucugaugaaagaaucaauacuuuuccuuuugcugucaaaucuuuauaaagugcaucuauuucagcaugauauaauuguguccuuucuuccgugguuugaguuuccacagaaaauaauauauugccaacucugaaaauacaaaaauaagugugaaaggcauguauuauaaguucaaacagccaaacacagaaaguuuuuuuuaaaaagcaaauagcauacugacguagcacuaaacauauacaagaauguaccuuaccuuucuaacuauagacaagcaagguagguuucaugagaaugcauucuuucuucauaaaaugugauaguugccucaccuuuaagugaccaguaacucauuugcucacaguuaagucuaacuacauguacuuauuacacaaacuuaagcuaauauaugggaaaacaaugacacauaguaaagaaugcauuuaaauaaccaguaaauauuuucuaagccaccccauuaggauuaaaggucagaagcaagaacuguguguaggaagaaaguucagggacuacaccaugguucuguuuuuuaucaaaacaaaaaaaaaguggagcugaagcuccacugagguucuguggaggauauaaguuugauacaacaggcauuuuuuguauaacgccacuagcaaaguguugcauuuaguccucggagccuacaaagaaaagcucagcugcugccuugauugaggaaggaaggaagaaacggggccacaaauuauuauuauaagaaaugggaucuugcucuaccacccaggcuggagagcauuggcaugaucauagcucacugcagccucaaacuuuugggcucaagugaucuucccgccucagccucuugaguagcugggacuacugguaugcaccuguaguuauuuuuaaaaaucuguugcagaggcagggucucaccauguugcccagccuggucucaaacuccuggccucaaucuucccaucuuggccucccaauaugcugguaugagccaccacuucuggccaagggccacaaauuauuaugaaaccaugacucaggucauaauguagcucaucagagguucaaaaaaggaaucuaauuuggacaacauagagaaaagcaggaaaggucucaugggagaaguggccugaacaugggucgggaugggagugagagacccagacauuggaaagcaggggugaacuggggaacaagcauuccagucggacuagcaggccagguuccaacagggagaugguccaggucaagcaggaaaugucugaggccacuuugugagaggcugugaaugccuggcagggaagcugguuuggguagccacaggcaauggcuggguauggagaggggagagauuuguggagcuaggggaacguccagugagguggagcucuagcaacauuggugaagugcuggugaagcaggagacagaagaugggaugccaggcagagucgacucgaggggucaggaggcccagagcaagggaggcaacaagugaggugaagcaggaaauugaggaaagaugucacguuucaaggggagaaauuucauguacaguugacccuugaacaacauggguucgaacugcauggauccacuuauacgaggauuuucuuccaccucugccaccccugagacagcaagaccaaccccuccguauccuccuccucagccuacucaacgugaagauaguaaggauaaagaccuuuaugaggauccacuuccacuuaauacauaguuaaguauauuuuccuuauuauuuucuuuuuuuuucucuuuuugagauggaguucacucugucaccaggcuggagugcaguggcaugaucucggcucacugcaaccuccccgucauggguucaagcgauucuccugccucagccuccagaguagcuggaauuacaggugcgcgccaccaggccuggcuaauuuuuguauuuuuaguagagaugggauuucaccauauuggucaggcuggucucgaacuccugaccuagugauccgcccgccuugggcucccaaagugcuaggauuacaggcgugagccacugcgcccggccgacuuucuuaauaacauuuucuuuucccuagccuacuuuacuguaagaauacaaaauauaauauauauaacauauaaaauauauguuaaucagcuguuuauguuuuugguaaggcuucuggucaacaguaggcuauuaaguuuugggguagucaaagguuauaugcaaauuuuugccugcuggggugggaaggucaauccaccuaaccccugaguuauucaaagaucaacuguacuuauauaguaauuucauuucugcuuaggaaucugaucugaggauacacaucguggaugugugaaaagguaggagaacacuuuuuauguuaaauagcacaaccugcaaucaggggagaaugaucuuuauugggaacguacuuugauaagaagcuugagguagagaucaagacuucaaagauauagaaaagcccugaaaucuggaaguugcugaacugguguuuacucaugaaggccuguuuaaguuuugacauggaacuugaagagguggcuccuuguaguuuagaggaaaaguaugugagaaagccagagcccaagaggcagaggggcuggagaaugugagucauagucucacugcugagcagguggaaaccagggggagggcauggcacuucccaaggcuaugcaccugaauaugggguguguguguaugugugugugugugugugcacagcucaaggcaauuccacccacaauucaaggaauauggaggcugacagacaaagcuuggauuucagauguaaauaaaacuagaguuaauaaaaauguuuacugcagugcuauuuauaaagcaaaacaaugagaaauacccuaaguggucaauaacaaaaagaucagucagagaaauucuacaucuauacaauggaauauuaugcaguuacuaaaaauacuuuuaagaauaugacuggggaaaugauugugauaauguaaugguaaggguaaauaguagaacagucuaaccucaguuuuuaaagaaaauaacuugauuuuuauuuuguuaauuuugcuuaucuguauauucuaaauuuucuacaauaagauuauacuacucauuaauuauuaaagcuguuuucucucucucucucucucucuauauauauauagauuggcuuuuauacauauauauuuaaaucuacaauggacuucaauccgccaacugcucaucuuuuuucauuuuauuaguaaaagccucccucgcccccccaaggaacuucaagaacccagaagaaugucucccacaaacuacaucauacauaguaucuagaaaguccuuagauuuagacagucagaaaauguaucugcugguguaauacuuuagaugucacauuuuuuuaaauaacugguuauaacugcucacuggaccuugauacuuuucauuucaggauggagcaaaaguucaacaccacaaaacucuauagugacaauaagcacaggcacccuuccugccucgucucuaguuuacacccacauuaagaagcgcacauacuugucuccuguaaucgugauugugaauccaucauauuccuucccuuggucuuuaaggcugggaacuuuuguguucacggugaacccauccuucguuuuaguauuaaacugcuuucagggaaaaagaaaauucacguuacuaguguuucauucacuguaaaccccaacugcaacucuguagugcuggcucuaccuuacauguuuuuaaaaagggccaaggaggucaucugauacaagagaugguggccugguggccaaggacaucucugccugucuucaggccccaacagagcccagguuacgcuccccacagcuccuaccagaggccagcagagaaccucagcaccaaaagcucacagguucucuucgucaacaaggggcacugcucacuucuaagagcucccuuugaauguuuucucauguccaucuuaguaggcagcaaccuugaaucauggcagaauaguuguaccuaacaucccguaacucaaaaaugcaacuuaugcucauacuagugcucaaagcagagacugauuuuucugaagaguacccaggauuauauccacuaacuggagaacuucauucacacccacacccacacccacccaacucugugagccacagauaagucgguuaaguuaaaagaauuacucggaguuaagaauggcuuucggagugauaaauguaugaacacaguuucagacguuagcuuucuguuuaaaacauuugggacaaaccugcaauggcaauaaauagguuucagaaaaugacccccaaauuuaguuaacuuaauauugccaauuuuuuuuuuuaauugauggacuggaaguuaagagaagcaacaguaaaguacaagaggcugcugcuucaugaggggagagcuugucuagaaacagaaagaugcaccaggugucaccagcagcccagaagccagaggaugaguggcacaggucauaaggcccacagcaggcacugagcaggcaagcaucuuucacgccaaaaaaaacgacuuucaggagaagaaaugcguuaacacacuaugugccaauucucaucuaauccucacaacauacugauagcacuagguauggucucaaucuuacagaugagaaacgaacuaggugaggcaaagucuggcugagucccagccagcagggaagccgcagagugggaaugugggcccaaggucuuggugaauuccaguccgcguuacuugcuaauaaaccgccucuagggggcgcugacauacacguuaacuugguuuuucaucaacaguaccauugugccuuucaguggaaguugaccugguacauuccacuaagcacuuuaaacacucaaauaucuuguuguauauucugcugugugugccuugcaaaguaccaauauauccguaauccuggguaaaggcuagauguauaaugcugaaauggaaugucaucccaccgcagagaacaaacaucuuacaucuuucagacaacaguuggugauuucacaccgagaggcacacugaggcuggcgaugccgcgucucaggcugcaugcuaagugacuacagucuuguagcccacucuguuuuucuucuuagacaaagacauauaaaauauuaaaaucucccuaaacugacguuguauucugccuaauaccacaggacaucuaaaugccuaacuagaauacccacaggaaggcagcugaagagcccucacacaccaguuuccuuucuauaugguacaucucagggccuguggugaagccauucugcccccuggggggcgcuggggaaauuuaugggagacugauuauuacagggauuggacaguugggagccaagauuacuauaugucccacaguacaggggauugucacacauaauguaugauuuucuaaugucccacuggauuuucauguagaugaagaacauguuuaucauuuaaucaauaugugggccuggaaccagacucuguuuugcacuuaaacgcuaacuauuuauuauauaguuuucauacauacugaauuugccaggaaugcaaauagcauacacauugaguaaggagucuacuauauauagcuuggagcuuuacuaagcuugguuuaccauuucagaaaaccacaucgccaaugacaauguagcucaccaaauaacacacagauauggggcuacacuuauaacugucacauucaccaugauuuuacaugcaggugugaagcacuggcuacugcuuuccggcuucuagagaaggccugccccaauuucugcauacugagauacacuguguggacacuguguggacugagauacugagaugacuuugcguggacauuuuuuaggaggugagacauauucucugugaaguucaucuuagugcaauaaaggagucaguaaagggggcaucugaacauguuuacugagucaacgcaguggguuugagaagguugaggggcacuguguuagugcaucagacccucacaauaaacuccacgagguaggucuggccacaauauuuggucuucagcagaccaaaaaccuggaauaacuguaaaauaggcucauccacacccacccaggcagauguggggccugggucagaugcucagcucuguucaugacaugcuacuuccuugcuauuccuuagaaauagauacacuuugcuuauucauacaaauuuccuaaauuuuacaugaaucaaucucaucuacuauagcugcaaggaaaacauuuacugaaguugcacauuaguguuuaaaccacuaauuggaaaagcaauucuaacugcuguuggcauguuuuggggcaguuuuacuccuagauggaggaaagguucacacaguuauaauucuuaauggauuauacuuuaaucaaauaauuucugucccuuuuaguguccuucccauugaauucaaauguuuccauuauugauauugccacacauacuuuucuucucauuagcauuugccugguauaccuggaucauacuaucauacuuuuguaucuagcuuuuuguuuguuuguuuguuuguuuuuaggagauggggucucacucaucacccaguguaggcaagagagcaagacccugucucaaaaaaaaaaaaagaacagaaauuuauuuuggaggcugggaagucugagaucaaggugccagcgucugaugugagccuucugacugcugccucacaugacggaagcuggaagggcaagagaggccacuccccaaagcccuuuuuauaacggcaugaauccauucaugagggcucugccauuaaacacuuccuguuaggcuccaccucccaacauaugugcacugaggauuccauuuccaacacauucauuuugaggggaacacauucaaacgauggcauuuacuucucuaguaauuaaagaguauagguuauuuugccuuucuuuaaaggguaaugaguuuugacagguagucaaaucacuagcagauccacuuaauccuuuagacuuaguuuuauucuuuguuagggcagucuauuuagaaauuguucuuaguccuagguugugggccuuacuguaaaguauggucuuacuuuuaaacuguguccuuucuggggucuuaacuaaacgcccaagguguucacaggauccauccacauuggcaaggccgaaacuccaaugucucucagcacauacaccucugauaccucugcucagcuuucguucccacaguagccacucucugcugagccucucauggucuuuuauugcauguucaugaccaaggucuuagucaaggaugaaaaggagugcucacauuaaccccugagcacuccccagccuacauggccuccuucucuccuauacucugcucugcaaauuccagccacuuuggcagaaccaaacuccacucucuaccuccuuagcuuagcaagaccacuguacucugcuugggcuccacauuaccgugcaguggucuaauaaauaccacaguagaaagcuggggugacagugggauucacauuauuguaauuagccagugccugaaaauaacuaacuuuuguccaguuuuauaacugcaaucauguagaagggcagcugaguaccaguuacucagcuguggccagaagcagaauucaauuauauguauuuuuaaguuuucuuuuuucuauauuaacugcuuccucacaaguuguuuuuucuguuugagucugaugccuguagguucuuuuauuuugguuauuauucagaauguguucauacgagugauuucaaauagcauuuaauaauucugaguucuuuuuaaaaaagugcuguugguuuucuuuuccucuaaaaacauggacugccauucugaugcuaaaguuaccuucauaaucggaagaaggucuucuacuuuguguaccuuuuccagggcuucccgaacuuccagcaauccuuuaggauuauuagcucuuaaagagagacagagagagauggcaacugagauuaaugcagaauuguaauaauuaaucaugcaauuaucuuuaauuuaaauaaauugaccucaauuuugaguagcuaaacauucaaaaugguaggccacaaauaaaccuuccaaauaacgggauaguucaauucuaaugaguuuuggacugcagaugaaaauuaaggaaacagcagcagaugagaauuaaggaaacaucuagaaggcaaaacaggaaaaagcagaauggaucaaaagccaguguuugugugaacauguaugguuaugaguuugguucuuaaacucugauuuuccuauuccagcucuaaaauuauauguggauguuuuguguuguuuuuuuccuuucuaaagcugcucaaaugaaaguauucugcuagguuuuuccaccgauuuuauauuuacuuggugauauuuaagcauucagauuuuuuuucuccuaguguucugcucauuguuuugucuaucccauccugccuuucaagugaaggagaguaaguauuaaagcugaaaucccuaaaagauaaauccaaagaaacauccugcuuuauagaagaaagagacuagaaaagucacaauagugcacauaaaguuaaaaacacuucaguugaggucuguggauuuuguauuaaaaagaaagugauuaugaaagccuuuacgauucuaaacacuguguaaaaauuugauagaccuuguuuagcccgucaacaggcuuaguucucaaguuucaaaaauauaacaaauauaaaacacaugaaaucaacucauuacuaagaaggagaaaauuaaaggcuuacccaugauaaacaagaauucugucuuuaauaaaaugaaguauuuucucaaaauauucuagguaucucauguugaucaccugaccccuauaaggcaaaaauaauaaaauuaagaauauuuuuauagaagaauaugcucaagccaacaucuaauuucaaaguuaauuuaaaaaaauaagaaacuaugagaauaauguagaaaaaaaaagucugggaaauucgcuuguucauagucaaugaguggugaagcaaagcaccgucuuagcaagacugccugccagcucacagggccuauucuggcaucaaacucagugccagaucagccacaaugggaagacaaaucccccagcacuaaagugagguccagacuuucauaucagcguccucugacggaucccaucacuugugggcagugugccgucuccccucccucaguucucccaacagcauuauccaauacccugucuugcucucuagcucacuagcagucuccuuuccucuacccacucggaauacucuuuuccucacauuucuaucccuucugaucuuuuccuuuuaaacucacucccagaacuccauguucagccaacaugcugagucacaugacacagccgacugcucccaggacaucgcucccuggguucccaccaggcaucucaaaccucaaagguuacugucaaguaagaauucccuccugcaacccacacuucucccagccuccccacuaaacauguccaccuacuuuucguucuggugcucucuggccuaaugggacaaccacguaccugagggaagguggccuuccucuagcuccaugcccuucccacugcagcccacugccagugcuccugauucuaucuucuaagagucuagcucuuccucuccaacucacuaccacacagcuuuugaggccuuugcacuuguccaccugaacaacuacacaauuuuccaaccuccucccuuaccuccgagguuccugccuccucuccaaucuauuuugccaucuucucccaaugugcaaaucuguuccuguuacuucucugcuuauaaucccugaauggcucaccauugucuucaggggaaaaaauuccuuagcuuggacuauaaaaugauuuauguucugacuucugccuaucuuucuagccuuaauuccugauacucccuuaauugcaaacucaccaccaggcguaaugaguuagucacaguuuccugaccauaccuaacucauccauggguccaaguuaaucaccccaccucucucuguuuuccauuuuuccaaauagcccuguagcaccagaaggcuuuaucaggcaccccuucuccagguucccauggcauccugugcaugugaucagcucacucuuaacacacugcauaguaguugucugcuggucugucugcugugagcuuucagcagguggggcuguaucucccuucuguauccccaacacacagcacagcacagcacacuggcugaucuacgguagccuucgauuaaaguuaguugcuugagucuaccuaucuaugccacaaauuauuccaugagaaauaggaauauacaagucacaaggugaaaagaaauuuguuuucuagaaauuaaaaaaauaaauauacauacaaauuauauuuccauuaaaacccaaacuuaaagguguauagaaaaauauuuucuuaauucagcuuccuggaacuagaagcauuuuagaggugacacaacuaccauaucuauacauuuuaucuaaaauuaaauucacuaaaagaugggcugauaauauagguccccaagaaacugauauccuuuaauauuuguucaccauuuauuuagaaggcagcuaggcacauaaagaaagagugaagaagugagcauuucacccauguccccaacuagcagagccucuggacaaaacagaaguuuuccagccaaccugacuugcccuccccagauggcagcuuaguuaccagauaguguuauuuaucuaagcccuuuguguguugggguggaauggggagccgcccaccgugagagacuccaccacgagagacuugucaaauaauuuauuugagccauguacuaucaaaagaauauuaugguuacuguaauguucuccaucuaauaauuuucuauauuuuaagacuccuuaaagacugacgcccuaggaaaacaucugcaaucuacccuucgguugugcucuacaccagacagaagggccuggggaaggaguauggcaugcgcuauguuucuuucugcagcugggcuagaggaaaggaaugcaggcaggacuccacaggugcagagucaaucaguauguucccuggucaaaaagucaccaggaaaggagcaaugggucacuccuggucuccauggccugugucuugagaauaaacuccuaggaaaagaagaaagaugcacaaaagguucguaccugauuaaauuaaugugguuguuaaaaccucugcuaagacuucgugcuggcauuugaucuaaccacagcacgggcuggucugggucagcaauccuauaaaacagagaccuuuauaaaaccagaaguguucagaagcauuccaaauaaaacauguagaaguguuugcaaagguggggauaaagcaacagcuaguccaucauaucuaaaaacgugauguccauaccuacaaauuccaaacagauguuccagcuggaccaggcgaaaagccagguaaagguaaagguuuaggagcagaggacaguuuuugucacgcaaaugaauaucaaagguuacucuaaacuagcuaguugccaggcacaccauuaucuguaaagggacugguccagcgaaguucauucagagguaccacagguaauggaucuguucuuucaaagagacuguuucuaaaaugcuucauguaaauaggugauugaaaaugugacaacaaucaauucguuuuuuuuguuuuuugagauggagucucgcugugucgcccaggcuggagugcaguggcgcgaucucggcucacugcaagcuccgccuccuggguucacgccauucuccugccucagccuccggaguagcugcgacuacaggcgcgcaccaccacgcccagcuaauuuuuuguauuuuuagcagagacgggguuucaccguguuagccagaauggucucgaucuccugacuuggugauccgcccgccucggccucccaaagugcugggauuacaggcgugagccacugcgcccagccaaucaauuccuauuuugaaaauauuaguuaaguguaugucaaauaauaaagaugccagcaauuucuaacaaacuuuagagaggaaaaccuaacuuggaaggccugguguuagcaagcaaaacaggguucauagccuguuagcuaaaacagacugacguuauuugacaaugauaagacuuauaguuuauuuucacugagauguuaguuaccuucuccauuuaacugcaaugucaaacaugucucuccacugcaucaaccgugucuucccauucauucgaacuuucgaguugguccauguacgcugcacggcuugcaugaccuccaaugcggccaaacccauagcuacgagaaaggaauaucgagaagaguuaguacacuuuagagggacugaguuccaccuacuuuacagagucucagugauaacucaagaguuaacacauaaagggucagaaguauuggugauauaacaagacccaaggcacguuucagucaugaugguccuacuaaaauuaaaacccaucagaguuaacugaagacaacucaaguugucugcucccaacucugccuccuacugaaacaaguggagguuugcauucuuccucacuccuauaguaaggaaauagcucccuggaucagcugucugauuuugaguaaggacuuaagaccuauauucuaguuuauacuacagcaauagcaaaaaagccaaggauggaagcagucuucuuucagaauucaguuugaaugauucuacacauuucuauucugaucacauggagaauuugaauaagcacaauaaauacuaauuuauuaaaaugcacaacauggcuuaaccacccuuccucuuaugccaggaauauuuucauuuucagguaguuuccagaauaccucuguguauucucuuguuuggcaggaaaccagguguuucauauugcaucagggaucccaaacgaucagccacacaaaucagcuccuguacuucaggcuuauaacucucaaaauucugauguaacacaucucuggaagaaacaucauguacaugauaaggacuuuuacaacagacauuugguaauccaauuccaccugagaagcagucacuuccuccacgggaaaacuaaugaagcagucuacgaccacauaauccuuacuucaguccuuugcacccaaccauaccucagcuuaaaagggaaucucuaugauggcaugugcauaauugccaucacaugcugguuaguaacagugaaaacuaugauaacuaguaugcaauucagaagacaccucuuuccauuauuugcuuuguaaacuucuccagaauacauuccugaauggacugccuuuuucaacaagcaaccaaaccucugcccuuuguccacuccucaacccugcccaaguuguauuagaacaaguauacuuggaaugauacauugaaauacuacuguuuagcugccaaccugcuugaugcuuuuauaacaaagacugaaacucuaaauuacagguuguucuggggaucuccaagaccauccuuacucaggcucagaaauuggcugaaagggcucaguggacuuagcacauaaugauacucacaauagugaguaucauuuuuuauuuuguguccuuuacaaaacaaaaccggcagagggaagaggcacauugggagaagucuggaggaaaccagucacaagcuuccaaggguccucucccaaggaagucauauaugacacauuaaauucucccagcgauuaguugcgaacacguguaaaaugcugccaaccaggaaagcucauuaaagacucaguggccaggguuacagacaacuuaugccuggcaaguucccaaauuccagauacccagaaggaaagcaaguguugaauagaaaucacacuguuugaacacacaguuuaggcacagggaaccucuccuauuaguuuugggagugguaggaauccccucgaaauccaaguucccagauaccaaccaagggucacucuugcaagcaguccuuucuaaggacagcagucauagaccugcuacuauguuaacucuuuugugcaucgaaauauuucucaaaaaaggaguaguucgagaacaugcauaaucuccaugagcaaucaauuuucuuuuuauuauuuuugcucauuuaauaguugagacacauagaaaacacgaagucaaauuacccaguuuaagaacuagagcaauucaugcaguuguaucuacuuguaugcugcuuuccuaucccauccucccaucucuugaaaugugugcuccugacucacguaccuuuuuaaaaacuagguuuguuacauacauguauauauacaauauacucuacaguuuggcuuaugagcuuugggagaaaaaaauaugugagagcacagcuuacugacuugcugcuuuuauucaacauuacauuuuacaauuaauccacauuguugccucggucauuuguuuauacugcuguauaauaucccauugugugacuguaucacauuuauccauucuucuguugauggcauuuggguugauuuccaguguuagcugugaacaaauucugcuggcagaccuguauaaaucucuccugguagacaugugcacaaguacaaaguucucugaauagacacaggaacagaaucuuauaucaaguaugagaauauucagcuuuacuagauaaugaaaaacugcuuuccaaagugguuguagcaacuuauacucuaaccaggaguauaaaaguucuccauaaucucccuuaugaccaauauuacuauuaucagacuucguaacauuugcucaucuaguggcugaaaaaaaucucaugaggccuuaauuuaugaacuaaaguaucucuucauguuugucauucauguuuucccugugguaaaauuacuuguucaugucuuuugcacacuuuucuauugguugucucuuauuuuuuaauuuguagugauacuucauaaauuuggacaguaauucuuggucaguuauuaaauuuccaaguaucuuuauccaauuugggcuuauuuuucuuuccuuauggugucauuuguugaacggaaguucuuagguucaagguaguccaauuuaucaaccuuuuuguuucagaucuaugcuuugugcuucuuaugaaauccuugucuaccccaaagucauaaacaucuucauuuauauuuccuccuaaaguuuaaaauauuuugccauucauacuucagauuuucauccauuuggaauuagauuacuaugccaucacaaauaucaauuuuauuuuauccauaaaauaacuuaauuggcccacucccacaucuuaaccagucccacucugaucucuaacacaccuuucccauuuaucuaaguuaucuauucucuuccuuaguccacuugucuaucccugcagcaauaccauucuguucauuauuauauuaaguuuugcuaccugguaagaugagaagcuuccccuucaagccugagcauccucuucuuugggaguaucuugauuacucuugguccuuuguucuucaauacauuugcuuaacaagugccucaaaaaaacuugggauuuugaauggcauuuuauuaaauauauaauuaauuugcagauaaauggccuacuaauguuacugaacuuccaauccaugaacauaguauuucucaccauuuauuuguuuuaucuuaguaacuuucaauuaaguuuugugaucuccauacagauuuuauacagaucuuguaagauuuacuucuaaguauuuguuacuacuauaaaugauauuuuuguugcuuauauauagaaauguaacugauuauuguauauugauuauaaacaaugagcuugcuaaacucucaucauuuccuauaauuuguagaucuucuagguuuccuuuguagaaaacuaugugaucugcaaacaaugacagcuuucuauuuuccuuucuaauccauaucacugauuucuuuuucuucucucugugcacugucuaggacuuguaguucaguauuacagagaagcacugauucugggcuuuuugcuuugacucccaaugguaauguuaauguaucuaccauuucauaaguuaaaaugauguuugcuauagguguuuuuuguuuuguuuuguuuuuagagauggggucuuugcuguguugcuguagugcgauggauggauauucacaggcacaaggauaguaugcuugauugaacuccuggccccaggcaauucuaccucacccucccaaguagcagggaguagcgugccaccaugcccagcuuauagcucaguuuugagaaaggaaaaaaaaaucaucuucauuuaaagcacuuacuuuaugugggguugcaacccuggcugcucuucguagucuucuaugaggaaaggcaaauuuuuagcccagugguccuuaaagcuuccaggcagauccacaucaauguuauauuccguaagggggguaucaaggugugcaugaagauaucgagaauacucugcagaaaggaaaugagaucugacacauccaaauacugcuaaagaaacuuucuuauggcuagcugccauacaaauacuuuguaacaagcuguucuucaauuauaagaauucuaaagaguuucuaaauuuuaguaagucacuauuaguauaugauagagguaaccugccacugacuugagauaacaaggucaaauauaagucagucagucugggucuacuuuggcuacauuuuuuuuuuuugagacggagucuugcuccagcccaggcuggagugcgguggugcaaucuuggcucacugcaagcucugccuccuggguucaagccauucuccugccucggccucccgaguagcugggacuacaggcacccgccaccaugcccagcuuauuuuuuguauuuuuaguagagacaggguuucaccguguuagccaggauggucucgaucuccugaccuugugauccgccugccucagccucccaaagugcugggauuacaggcaugagccaccgcgccuggccuaguuuggcuaaauuuuaaucaccuuuccaggaaaaccacuaaaaaucucauuguuuucaauuccagagcuuaagaauccaaguucagucucagauagagccugguacucugucaacugguauauagauugauuggguauauaauuucaccaaccgacuaauggacugcugcuuaucucuaugaaagcaguguaggaaaaaacccaaaguacagaauaccugccccuucugccuauaauucacaagcgcaagcuccacugaaccagaaaaaagggaauuguaauucagguagaagaaagauguucucuaauagguagccccuagccaccuggcuauuggauacuuaaugaggcuagggugauugaaacugaauuuuaaacuuuauuuaauuugaauuaauuuaaacuuacaaacugauacuugauucaaucaucagaaaacuucagugcauguggaacaacuuacacauaugaaccuacuuucuuaacuauaaauauuauaaauucuaaauucagaucaaguauuuccaaugaaaauuuaacauccaaauugagauguacuauagcauaaacuauacaucagauuucaaagacuuaguacaacaaauaauguaaaguaucuaaugaauagcagcuucauauuaauuauguuauauauugaauggauauuuuggguauacugaauuuaaaauuauacauuauuaaaauuaauuccacuucuuugauuuucacuuuuuuaauguggcuaccacaaauuuaaaauuacacacacagcuuuccccuuuuuuuuauuuuggacagucaugguauaaagggcucacaauaacaaaaaagaauguaggcuuuaauuaaaaaaacugucuucagagacaggagauaaaaggugaguaaaacuacaacuaauaaaaggguaacugcaagauuugcuuucuuccucaccucauauuucuccaaaauauaugagaauuuugauaugaaggaaugacaagucaaagauaccaaguucacauuuaacaguaagaaccagcugggcgugguggcucacgccuguaaucccagcacuuugggaggccgaggcagguggaucacgaggucaagagaucgagaccauccuggccaacauggugaaacccugucucuacuaagaauacaaaaaucagcugggcaugauggcgcgcccuuguagucccagcuacucgggaggcugaggcaggagaaugggaugaacccaggaggcggagguugcagugagcugagauugcaccacuguacuccagccuggugacagagcaagacuccaucucaaaacaaaacaaaaaaacaguaagaaccucacagaaugucaguuuccugcccuuccuguauucuuggaugagaugugaugagacacaaauauuccagaugcuugucacauuuaguucaaaauauggcuuuucaacuuaaguaaaaaauguuuuaacuuuagaaaguaaaaauguuaaaagugguagaaaaugcauuugacugaucuuuugaagauagaaacaucuagucucgacacuagcacugacaagguguggcuguggaugagucaccuggccucuuucagacuccacuguuucauacgaaacauaaaagagucaagcaauaugauuucuacagcuuugagcaugaaaauccaacaauucugugauuuucugacuuaccucggagauacuuuacuuuaagauacucagggcuagccuucuggccugggagaggaucauucagcauaacuuuuguuugugcuuuuaucccuucauaaaacugucccauggcaacauggcugagcccuuucauauacuggcacacuucauuauauggcucuagcugcagacaccgcugaggacaaaaugcugcauuaguaucaacacaguuuaggaaaacuuugaaaugcuuuauucuuuacucuggaauuaguuuucccuccagguuaaaccagaccuguaaacuagucuacaggacaagagcaaugauuucuucucuuucuuuuuguuggaguagaaacacuauucucagucccccuucucuauucauuucacuaaacuucaaugaagaauaauccaguaauuccaauuacaguguucuuauuuauggaugcucaccuuaaaguucuuaagggcuuccuguaagcugccguggugguagagcaucauuccccggagcuggaggguuugcacaugauuuugguugagcaacagugccuuuugaaagcucucaguggcugcuucaaaauugcccaguucucuagguauuuaauaauaguuaugaauacaguauagauauuacgggaaacauacagaauaagcuauccucagaauuauggaccaauauguaaacaagauaccuugaugggaguguucccuuuguugcuuuuuuauagccucugacacauuacauuucacuuacuucuaaaucucaccagcucauaggauaaccacagagcucuugaaauucuguggggaaaauucaucugcugauuuccaaaggcagacgcuuauucaaaccccucuccuugauuauucacaaugagucccaaacccuaaaaacuguguaaauguuaauauauggauagaaacacacuuuucccauuuggaaaaaaauauaccaauuauaaucauaaacaguucaucauucucaaucaaauucauagccuuaaaaaugcauuuuuuuuuuuuuuggucaccaaaguugcuuugcuuaaaaucuaguaaaucauuauauaauuuagaauucugaaaaaagaaguguauuuuagaauuguaaccauuccaggauggaaaugguuguuauggaucaaucugcuuuuuauuugcuuuucaaauagguuuagaaaccgggucucacugcauugcucaggcugaaaucagccuccugggcucaggcgaugcucccacuugaccuccugaaaagcgggacccaauucucuauaaauagugaacauuuuuuaaaaauauaauuccugcuuacauucauacagcacuuuacaaggugcuuucaaaucuguuuucaauuuauauucaauaauucugugagacaggaagcacaaauaucaucccuuaaaccccaaacaaauccaaacacacuucuuccaaguuaguauaagagcuccucaaacuaucagauaaauaagcucuugaauguaauccuuccugaauaagguaccuaauaaagggacuuuccgucgcugucuuucuuuucuagcuuuuguagcaccuuuacaagugagaagccagaagcucagggaaguuaagcacucauaccugcagaacgaccaaggcagaacuaagucaugagcuccuucacucaugccauccuaccuccuuuucauaacacaauauacuuuuuuuuuccuguuuugagauagagucucgcucugucgcccaagcuggagugcaguggugcaaucuuggcucaccgcaaccucugacucccggguucaagcgauucuccagccucagccucccaaguaguugggauuacaggaacccaccaccaugccuagcuaacuuuuguauuuuuaguagacacaggguuucaccauguuggccaggcuggucucuaaccccugaccucaagugaucugccugccuuagccucccaaagugcugggauuacagggaugagccaccgcucccggcuuacuuuuuuuuuuuuuaagccaaaagucacaauggcucuaaucaucagggcaaugcauggcgucaggaagccaaguucuaguuacaacuucucauucucagcagauguacauuauaaucacaacuuuuccaucccuucauucuaggacucuucaaagagaucauaggaaauuuaccuuaguuacugucuaagaaaguagcagcagcgucuacaccccaauagcuuacaaugccacuauucaaaacaacccuugaaggaugaacguuuucuagaccaauacacacgcugaaguuaagagagaauacugugcaucaugacauccucugguacaauuuauuuuucugcauuucagagaaaauaucaacaagucuauacauacuugcacaauucaaaauacccaucuccuuugguuaagaaauacuauuucuuuuaaauauuaugugaagcuaucuugucuccccacucuucagccucccuccuaccccaacuguuauuauuuuacucaccuauaugccugcccuagacuuuuauaugcaucaauaaagucaacuuucugcuucaaagcuucuuugaaggauucaauagcuuccuauaaaaaguguagagaaaauuauuucauuugcauaauuguuaaaauugagauucacuuaaaucauaaaaggauuuaaauauauauccuagucucugacagauuuucuuuuaggaggacuuuuaaaaaagagaggcagaaaaugcaauaaacuauaagucagaaggauuuaauuucaguaaacaaaugcauuacuaugaaaaauaugagccuuaaauuucuccccuuuacaaugggacaucagcuuuccauuuuaucuacuucauuacuagcuacuucauuaaaacuuugaauacuaaucauuucaccuucauauuauuaauaucauauccuuaauuaagaaaggcccuaggaccaaaagcaagccuaacagcugugugaaauaauuuaaaaugaucauaacuggcaacauuuaaaauugaaccaagagacaaaaaagaaagcccaaugugaaacuguuccuaaaacaagcaaaaaggcuccuagauucaccaucugaaggauucccaugaucuacgaggaaaaagaaaaaguaaaacaaaacaaaacaaaaaccuuaaguuggagguguuugggguuagcuuccaucggccuaacaccaagucuguggcuaagaaagugagaacugcuaagcaggcacuauccuuugggaagcuauccuuggaaaugcaugguguacuuggcuacugccuaacucccucuccaucuaugaaaacuauuaaucaaguguaccauucuauuuaaguagaaacaaccuaggcuuaaaccaacauuaaauguacuuuucacugugacuuauacacugcaauaaaaaaaauuacgacuauauagcuuacuaacacuuuuccuaaggaaaagacauaucuuacuaaaguuaccugcuauaaagcaucaugaucucuaaucgcuuuaaugcaaaagacaugacuuuagauaauuuuacaccugauuagauaauucauagaagaaaacuacugaagaugucacauaccuuguacaugguaggcacucaauaaauauuuaaugauuugguaaggcacacaaaauuguuuugcaaaagcaguaaaauucuaauucuuuucaaaaaggcauucauucccugcaccuugauuuucucuggaagggagacagcaggacaagacaggcuggugugcaaacucuucaaaggcaacgaugggaugacaaucuacuaauuaaggacuccugcugaauaucuacgguuggguagagagaugagaauggauaaacuuuaacauuuaagaaauguuaaagaucacuuuuaguuaggcuucuugccaugguguaaccuugaucuuuuaagacuuuaccacuauauucuuaauucaguaaacauauauugagcgccuacuaugugccagagacagugugaggugcagggaaggcaaggaugagccagucauuaucucuguccucuaagaauggagucuaguuagaaagccaguugugucaccagguuaucggaauacaaauuaagagcuggaauagagauauaaguaagucucugagaaugaagagaaagaaaucacuaacugagccugggguaagagaacaggcuucagggaggaagugacaauugaguugggccuuggagaaugaaaagaaauuugguaaagaaagagggcauuuuggagaggggaaauaguacuguacaguggcacagaucacucagaaaugguacaggagugcagggugcaugggugggugcaguggagagggaaaagaugggagaccaggcuaacgugggaagcugggccaggaaaggaagggccuccugggccaagcaguguaggcagugaggacuggggggcuucacacaggugcaugaccucaggaaauguacuuuuuagagaugauuacuacuagcagcaacaaagacagacuagagacagaagggaauggagacagggagccaauuagggaguugcugcaguaguuggagcaagagauaaugaaagcucaaacuaauaaagugucucugaggagagaaaagaagggucaaccucaggagacauuuugaaaggcaaacuacaacagaguuugguggcugccuggguaugggagaugagggagaagaaaggguaggaagcuuuuaagcugaagagcuuggguggguggcaagaacauuaaccaaguaaggaaguacaggagaaagggcagcugcagguggggaugggguggggcaggagggaauaacgagcccaucggggcguguuaagucuggagugcuuguggacagcuagguggagacgcccagggggcugcccacuccacuuacagcaugcuuggacgccacaguucuucaaagucugauuucucuucagcuuuuaagagucuuugguuucgggguuccugucuaaucacugcacagcucucuaccucauucugccaaagaggggacauaguagaaucaagauuuuaaggcguugggaacaaagaaacuacguuugaaugaaucaaucucuaagcauaugaacuggcucugaauuaauuugcuuggcaaaugccaucccaccauuuucaguccccaucuuucuuacuaguugacaggcaaccaccacccuagggcuguuccuuguaacuaagagaacacucucagaaaacucucaaagugaagacugauggugcuugggacgcaugguuugugaaauauccuuacaacauagauaaaacaauggaauucaauagaaaaguuuuuguuguuucccugggaagauccaaaaugccugauauaaccccuggauuagauaguuguaaaauuuguaauguaauauugccuaauauacuucuaacguauuacaucauauaguaaauaagcaaucacccacucaauuaauuucuaaauugcuguuggccaagagagaccaccuuuaggauauaaagauagcucaaacucacugguccauuuaauacuugucucugcgguuaacaagagaaacagaaaaaccuagacaaaguucauuuauuaauucagccguuucacuaccgacucaguuuuccaaucuguguaacagggacacccuccacuccuucuauaccucauggagaugccguugggaugaaggagucaguaaguaacuacucuaaccuccucagacaguggaucuauaaaaaugcaaagcaagaguucccaucuauuauacuugcugaugcugugcuuaugagcauggugaaaaggacagaguaccaaauaacuugguaggacuaguuugcugaggggcuuuuaaugcucaaaaugaaagcacuguuucuagguucuuaucaugcagaucuaaagcaaaucaaacugaauuucaguucuugugcaauuuguaguuaguuucucuuuucugaaaaauucucauuuucaaauaccccaaagagccccauccauguuccuaaaccuggcuuuacaguaacaauguuaaaagugaaaccguuugcauuuguuuacuuuuaaaaauauuuucaaccucuuaauacaaauagguugguauuuuuuguauuuguaaucuuuuucuccuccaugagauauccaagggauauaauuugaguagaguaccgaaguucugaguuuuuaaaauuuaaggugacugucagagaagaugagaggaacagagggcagauacaaaauaaacuggacaagucuaucuggcagcugcucaaagcauguuuuaagaaauuguucucaaagccugcggcugccagucugaauccugaggggagagagaggucuuuauuaggaguauccuccacauacuuccaaaaggaaugugagguuuaugaaauagaaucugcaaaauuccuuuugguuugguuuuuagugggaugggaguuuucuuuuagaaucuguaaaacuuuaaauuuucacagauaaaauaaucuauaauaauuaauauuugauuccuguuuaaagcuuacaaaguacuuuucacauagaguauuuuauugaauccucacgaucacuccaagaggcagaaaguagaauuguuuccacuuuauagacauggaaggagaaacugauugcccauggagcuuggagcgagagcucaaaccaagaccauucaacaucaacuucaaugcucuguccuugaaauucauuauugcacuaauacguauugagcaccuacuuugugacaggcacugcccuuaacacugaggauuugcaaugugcagccuuuucacagguaaacacucuccccacaacccaaauauauguaugucagauccucaaaccucuuucaauaauaaaaugucuguucuuucugcagaauacauaucccugccacacauuacuaaauuucuucacagccuucaaaguucuuguuaaguaccaccuucuggggcuccugucagaaugaauugcuuuuuggcugugcaggcugccucuguuucguucucaggcccgucugucuuccaucagguagcuuggauauguccugugugagagcaccuacugugugccaggccuugagcggcacuaaggaggcccaggugagagaggcagcuccccgucagguuccaggcccccggcuccugucacaagccuucucacaguggguuccccgcacagacucggaacauggaaucgagugcccaggcaggaggaagggccaggcuggaggccacguuucugcccauacuuucagucaguucagauagcuuuccuguuucccucuaccuccucugcccagcagucaggcaguucucaagcaauacuaauacagucaaucaaagaagggucucccaaccuguuccuguggucucucaaggagcugggucaaguuucaugcccacugaccuagacccaaccaaugucaccuagucaguccuucugucccucaucuccucagccaccacacugucagaaucuacuuccuaaauuacagauuuggucucagugcuggaaucuaugcauuuuggcaaccuagaauuuauagauccucuggucugcaaauuuaagucaaaaugcuuagcacaguacuccaggauaaggaccugcccuccaccgaccuuccagcuucaucucccuuaaaccauacccaacuacuucccacucugugaacugcccauauuuccaucuccccaagucaucacccacgcucuccucucugccugaagggcuuuucuucucccaccuccacccccuaauccuacucagucuuccagcuccaggacaaaguccaccuguucuuuggaacuuucucuaacucugcaguuccaaugaaucuuucuuaucuacauuuucaaagcacuuuguuuauauuacauucuugaguauguuuaccauaugauaaauuauauguggaaaaagcuuugcaaacuguauccucuauaaagguaaaguaucauuucuuccacuuauuaaccuuugauccuuucccuuucuguaucucccuccaagaacccaucaaagaguaggagcucaauaaauaauaaauaccagccaucaaucaaacgaaauuccucccacccacaaaagagaagcagagucaucauaugguacacauaugcacaacacuuucaccuucagaaguccucugugaaagaaaguuaaaccuuuguauagcauagcuauaggcugguuuuuguucaguucuaaggacugcugaaagucuucaugggcuguugcauaguccuacaaaaaggagaguggggggaaaaauaaaauaguauucauuagauaugugaacauuuccuaauuuuuggcugguagagaaaaaaaaucucaauucauccucugcccuuuuuggcuuuaaaggaaacauuucaugacacuauauauugguuaagugcuuauacuacucauucaaacaguugggaguuuuuuaagaaaagcgauugugagaaaaacaaagguuuaauuuaagcacucugucucaacuacaaaaaaauuuaucucaaauaguauuaugguaauaaucuguuagagaaauuucugguacuagcauuuuaucauacuggauauucccagaauaauuaugccacagauuaacauuaaaauguguuaugcugagacucuuuuaauauauuuucuuuggcacagaaaauuguuauuuaaaguacuauaagccacagaaauaauuguggcaaucauaaaugccacucugaugauaaaagacaaccuugucaggcuugggucacuuacauagagaagcuacagucuggaaagccaugcuaguucaggguguguuucuugggcugugaaacccaaagaaauucaaauuguaccgcuaaguuuaauaaucacauugacaacaugcacaccugcuucccuaugaggacauuugcgagaaagauugacauacaauccacaaacuaaauuuaucuuucucucucuuuuuuuaaaugccaguccagaauuaguuauugcugacagcucaaacaagaaaauguuuuuaguacuuaauguucuccacuggguuuaauuucagcuacagaaaaugcuuuuauaacucuuaugacacagacauauuacuaaacagucaaagcccaaaucuaucaaagagucacuuucugaggucaagggaaaaaugaaaucuucaucaucauaaaaauacuucaagacaaaaaccagucaccucugauaugaaguacaggguuccccgaugucuguacagccgugcugagggcugcaguuggauagcuuuagugaggucauucacugcuucauuaauucgucccagaggggacagaaucuagaaaucccaaacauguaaucaggaagaauaccaaugaccaacccuaaaaucccaauguuuuugacucuucaauuccaccucaccauacuccacucaaaaauuacucucagcaggcugcaauccuugacccccuauauuaugcggugggguucaaagucaaccagcugaggugccacuaaucuuuguccagucaagcaggaggcugaugaacuaugacugcagcaacugccuugucacuauuucacauucuggguuguaucagauguugcuuuuccugcaaugugauuuuuuuucuugauuuuaucuuuuaaaucaaaauuuggcaucuauacacaaagaugucaaaauuaaccugaaagauaacuuugaaccauuaaaauagacaaauuaucggacacagauuagagucuuccauggucuuuagcucuguccucuaugguaagaagagcugaaugacaacuucuaagauuccagaugcucuuuaagcccuuuuguguaacaacuuuuaacucaugagucaugaucugcagaguaggaggaaaaauaucugcaagccuguuuggaaaagcucuuuugagccagcaaucaguuguauucaggcaacaugaaaauauagaagacaguucagaaugcaaaaguaaaccaaaaagacauaagaaaauccaaaauggguaucaguguucaugcaauuaagcccaagcacuuuauccugaaugaacguccuuaaauuaggguuuauuuuguuguuguuuuagagacagggucucacucugucacccaagcuggaauguaguggcacaaucauagcucacuguaaccucggacuccugggcucaugcaauccuccuaccucagccucuugaguaguuuaggcuacaggguugugccaucaugcccugcuaauuuauuuuuuaaaauuuuuugcagagguaggggucucacuacauugaccaggcuggucuugaacucuuggccuugagcaauccuccuguguuggccucccaaaauuuugggauuacaggcauaagccaccauguccagccuauuccauccuuauuagacagguuauuucuaccgaauuuuauaauuuccuacucuacagaaguuuaaaaccagcaagaaagaggauucaggcaggccuaucaccaguaguaagcaugauagcucagaaagaggaaagaaauugaauauaugucugagaauucaaaaagcacagugggcugggguuguauuugggaaggaaaaucaucccucccuaguuuaucaaccccuagguacauaacugaauuaucauaccccagcacaacaaucaauaugauaauaaugaguaacuuuaaaaaguuaauuuauguucaucaaauauagaauauuucagaaagcaugaaagugaaagauuacucauaaaaugaccucugacauauauaaaugguauguuauaauuuagccggaaaauucaguauguaguaacauuauugcccaaacaaugccagaaaaacagaauauuauuauacauuuuuaagacaauuaaaaauuauuuuucuaauuaccaaugccauuuuugauaaacaguaguuuuuuauuagauaugcaaauuguaaagaccuguuaaauaauucuuaccuaaauauacuuaacucaugauuuaccagauuuuaacauaaaccagaguaauauaggggaaaaaacaucaguccccccuaccagaagcagaugauuaccaaaucugucaccaaauuagccacuaaacaccaacuaaauaccagcaagucucaugcagugauaaacuauagucacuuaacccuuaggguuacaauucaaaauagagaagagguaagaaauuaaaucauucauugagaaagauuuuauucaaaaagccaaauccccaacaaaacaaaaauucacuuuaagagacugaacuguaagacacaauaaucuuaagaacaaaaauaccauaaauacaguuuuuaaauuccuauaccuuuagcacuuccuuuacuagcuuucucuuccaaaagagaaaauaaaaaguaauuuuuucuuuaguucaacuaugagaucauaucagaugauuaaaaguuguuuuauucagacuaaauacauuaacacauaugaagccuagauagcuuauuauuuuaagaaaguaaaacaaacacauuucacuuaaaaacauaaaacagaaugccuuuguacagacucucuucccugcgcugaacacucuccuccaucuuguccccaccacaccaugggacuggaucagcucuagccucgcuuccuccgacagccucagcaaacacucccaacauuccccuucuucucuucccaaagaagcgccuccucugucuacuugagccaguauuacauggcaucuucaccacauauuaucugucucuaugucaaguuccuuuaagauguggcugucaucauccucacuugaucuauguauccaugcaccuaggucuauaucauaagaauuacauuuaagugcuuacacacauacacaucagcagaaugaacgcuuccaagggcugugaauuccaguuugaccuaacagucauaucaagucuugcuaaaguaugucacauauacaguaaauauuauguguuauauuuuucaaugaauauuauguguuauauuuuucaaugaauauuauguguuuuucuuuuguguuauauuuuuuguguuuuuuuuuaaauuuuauuauuauuauacuuuaaguuuuaggguacaugugcacaaugugcagguuuguuacauaaagacuuggaaccaacccaaauguccaacaacaauagacuggauuaagaaaauguggcacauauuaccauggaauacuaugcagccauaaaaaaugaugaguucauguccuuuguagggacauggaugaaacuguguuucuuuuguguguuguauuuuucuguguuauauuuuucaaaauauaacacaaauauuauguguuauauuuuucaaugaauaucuauagaaguaguacacgucauauuuucauacuaaauauuuucaaccacauauuuucauacuaaauauuacucuucuauguuaguucaggaauaucacucaauccauaguuuucuauuaauuucaaccaugcuuaaaggcauuaaguaccgacauagaaaaacauaagaguuuuaagggagcauuaaaauuuacaaauaauaaaguaauaggaaaaaaauugagauucaacuaauccaauaaugacagagggaaaaagaaagccacacucacuucugcucgcugcucaaauaccucuggacgaucugguuccaagguaauuacucggcucaguucgaacagagcaagcucagcauucuuaauguccuugaaaaggcauuagcuuaguaugagacauacuguuacucaaaaccaggcugaaaaaauuuucugagaaaacuaauaauuuaguaaugauguaaccaauuguuuaaaaauaaauaugaacuucacuucuauguaagagaugugccaugucaaaucagucaugauauuauaauuauuuaacucacucaagucuaccuacuuacucaacaauaacauguuagacccggcuaccuaucacaaauuccacagauggcaggauauuaucuaaacuuaaucuacuuaaacauggaaucaacgaaucucaauggaugaguauguggauaccagcacaugaaaugaggcugaccuguggcaacaggggaacagaaaugggucaagacagugucuaucaaaaacauaagccuauaaaucuauaccuuaagaaguuuagguacauucucuuuaacauuugcacauuauuuuuacauuaaaaaugcaugugcaacuuuuuauuaaauauacaugcaaauuuaaucucaagauauauaauuuuaaaagaugagaauuaggaagaggcagcucugaacuuuacuacugcaacuucaaccuggucauucauugaugcucugaguaaaauaucauuuccuuccuaagcacuuccaucauucccaauucuaaauucauucucaguccucuaugucucaaaguauacaaauacacaaaguuucuccaauaggccagcacaagguuaguauaauauuaauuguaauauuuuauaaauuguaauaaaauaaaaauguuaaacauuuuuaauauuuuaauguaaaaguugcaaaaguggcauuucucucaaagcacaauuucacacaaauauuuuuaguauacaauaagacaauagaaaaaguuugcauauaauguccuagacuaaaaauuuggaaagcugaacuuacaccauuucgugauuuacuauauaauuucaggagucuucauuuuuauaccauaguaccuuuguuuguguaaaauaugauuauuauaguccuucuccagccuuccucagagaaauaaggggaauaauuugauuacagcuacaaagauauuacgccauaugcaaaaaguauaaaauauaacaaauaaagauaaauuuuacaugccuaaaaaaaccuuuuguucuuucaccaaccuuuaauaauugugaaaggaacucaaacucuaaguccuacugcacuauugaugcccagucuccacuuggaccauugaauaucucuuaggaaagcaagcagggucucaugcuuuucuuagucuauccaguucaucaaaguugacuucagaagaucuggguggaaauccccaguccaccacuuacuagcugccauuuucucaucugugaacuggaaugauagauaccacuccacaucccaucaagggucaaugaacaguagcaguucuagcaaaacccuggucugugucaggucauguaggcgcuauggcaaucguaacuauuacauacucacauguagucccuucuuuccauaggcuaucccucggccauaaauugcacuaaccagaucaggcuccuccuagucagaccaaaacaaaaacacgucaaaaaccauaaacaaaacaaaacaaaaaaucaguuucugcuuaaagcacguuaaugccgcaagugacagcucuacuucuuuaugcuacgaccacucguaagucaauacgcagucuccaaccugaaaagucuauguucuuaaagcucauuuguaugaaaugugauaaaaguuucauguugaaaaaaauaauagagagagaagggaaccaacauuacgcagaaacaugcugguuucuuucacagggucaucuuauuuaaaaugcaauccucucaacaacucuggcagcaucagcaaucaugucuuacagagaagaaggaggcucagagggguaaagagaugugagcaaaggauuagguaaugccuguaacuaauguguuuucuuucauauauccaugaaauuaccugaaaaggaaagaaccacucagugccaacacaaugacgaacuagaaaugaggcugcacugaaaucuguuggagauuaauucaacccuucauacuaauggguugaaauaaaaaaccagacucuuuuugcagccugcucccaugcuuucuccuguuauucugcaauccagaugggguggaggaaacaucuaucaggaccaaggacaaaacaucuguugaccccggccauugaguccuuacacacagguuaguuggugagugaaugaaaugccucucaucuacauuuagccucuacaauuuuuacuucucugaaugguucgcuauacaguuaagaaagaagaauaaacagcugccucuggcuauaagguccuggguggaagucuugcacugcuaagggauuuaauagaauggcacuggauucuccagaaagaaacucugcaaaaacuugauagauuaaucuacuguucaguuucaaaucugagcuaggguaucugccaguauuauagaaaaugaacacauucacuucaaugaugaguaaaugggaaaaaauaaaggagaagauaacacgcauuuaaauuuuccuaaaggcuacucaaauagaaugagaugcaucuauauccagugguaaacuggcauaucgcuggccacaacccagacagcagauuggacuacacgguguaugaaaaauugcaaaaauucaacuaaacaauuuuagguuucuagcuucucuuagaacaucaaaagauccaacaaacaugggcccacauuuuggcauucucacacagcaauaaauaagagacuagagcuaagcacuggcugucucuauagaugagagguacaaguccaucaguucaccacagggccuacccaucacagccacacugcaccaacuuucuuuacucauguuaccucccuggccccuacaaaguucuggauuuaugaauuauauguaacugguauagagguugcucaugcuauuuucuaagaggggcggggaacaguacauguuauagaccuacagaaagaugguagucauauuucauaaaucauacuuauacgugauugugugagccauuaggugcacagaaauaaacuccaaaaugcuaccaggaauuuccucuggggagugagauuacuagauauauucccacuguacuuaauauauuguuauauuccuguuaauuuuuuaaaacagacaugcucauuuauaaucagaaaaaaguauguuuuaaguaauacauguuucccuguaaaaauuuuagaaaaugaagaaaagcaccaagcagaaaguaaaggagcccuauaagccugcccccccagagauaagcacuuuaaacauuuaaguauucuuccuggcuuaaaggaaggcagaguaagugguuuggauggagaaaggauacaggugucagggggaaaaggggagcaggaaaaaagggaaccuaaugaggaauuaaaaguaagacuggcgucaugcuuuucuguagcaaaaaagccagaagacagaacagucaacagucgaaccgaacccuggccaggcuggggugggaggcgguaagcccagugagcucauccucuagagcagggguguccaaucuuuuggcuucccugggccacauugggaaaagaauugucuuaggccacacauaaaauaccguaacacuaaugauaacuaaugagcuaaaaaaaaaaaaauaucauaauguuuuaagaaacuuuacaaagcuguguugagccacauucaaagccauccugggcugcauguggcccauggguuggacaagcuugcuuuaggauaacauacaucuccaggaagaaccaaaccuaugcucagauuuguuaugguucaaaauauauuauccaagcugcuuuucuccuaacagaaaaaaguuuacuccagaugaccaagaggugaaucagaaaaagauguaaauaagcaguuauucuacaaauacaacuggcauccccgcacacccguggccggggcuggugcucuggcauccuccugcucuccaggucacacaccccucaccaaauccuggccaucucaccuccugaacagaucagcauccucccacccacuccaucagccacugcccuauucuaagccuuccucucucaccuaggauacugugaucaccuuaccuguucccauuucuuccuaucuauucuccagauauacaccaagaguuaucuuucuaacacuaaagucucaucauaucauuucccuaacugaaauuauucagugacuccccaacaccuaauacagugacauucaaacuuuuuaaacuccaaaucacugaaauacauuuuacauuacaauccaguacacacauacacaugugcacaauauauacacacauguaucagaaaacaguuucaguagguuauaccuaggacuuccuauacacaauggaaucugauauuuucuaguccagcauauuucacuuaaaaaaaaaagugcuaaucuugacuugccaauuaauuucaggacccacuaaaggguagcaacucacaauacaaaaaaaaaaaaaaaagguaacaucuaaauggcucugcagaaaauauuaaucauuuuccugcuuacuguucagccucaucuccuuccucuuuuuuuuuuuucuuuucauaaagacagggucucacucugucacccaugcuagaguacaguggugcaagccuagcucacuacagccucaaacuccugggcucaaacucccaccucagccuuucaaguaccugaggcuauaggagugcacgaucacaccaggcuaauuuuaaaauuuuuuuguugagaugggggucucacuuuauugcccaggcuggucucaagcuccuggguucaagcaauccuccugcuucaaccucccaaagugcugggguuacaggcgugagccaccacacccagcuucacuucauacccuagaaaucagaaucauuuaauaauucccuacauacaagaugcuuucccaaaugcagugcauuugcaaaugcuauccccucugucugaaacacucacccauugccucgguccccaagaaauuccuuugaucccuuaagucucaguucaaacaccaccuuuggauuccuuccagacgccccuggaaaauaaauaugcuccuucuccuuuauucccacuguucacuguauggaugucagccauucauuccacaauuauuuacucagggccuacuguuagcuaucucagguuccaugugcuaggaauaccaugcaaagucaugcuauucuugccacauacuaggaauagcaagcaaaaaccaacacagaagacaaagauuugccuaucagaucaaagucagcucugcuaagccuauucuucccaaagggaagcaagcaggacaacauggcuaauaauaguggggugcaggucaauggaaaacaagagcccgauccaggguaacaggaaggcaaagcucuaugacagaugugccacagugaaugacguaugguggcccuccagcucuugcagcuggaacauuuuuauaguaauaaaaauuuuaaauuaaaaaaaaaaaacagccauucaaaaauuugcaacagcugaaauauccgaacacugacaacuuccuaaagguagccaucaucaucuugacugcaggauuggaugugugccccacacagaggcccucgcacgggccuccccucaagucaccccauggucucaucauuacuacagcacugaauugauuacugugcuuaucuguaaaguauuuagguuuucucuauucaauuuauucuuuccuuuuuuuuuuauuuuuuauuuuugagacgaagucucgcugucgcccaggcuggacugcaguggcgcgaucuuggcucacugcaaguuccaccuccaggguucacgccauucucccgccucagccuccugaguagcugggacuacaggcgccagccaccaugcccagcuaauuuuguuuuuguauuuuuaguagagacgggguuucaccauguuagccaggauagucucaaucuccugaccucgugauccgcccgccuuggccucccaaagugcugggauuacaggccugagccaccacgcccggcccaauuuauucuuucuuuuuagaauuuuuuccuaacagucaagaaggacauauaauuauuguggcuguuauaucuacagucuaguauuaagccuuccuaaauuuaaauaacagauuuuauuacuuuuaaaaguugauacaacuuuauuuauuauuuuaucuaucauuagcuaaaagccaaaaacuuuucuuuauggaaugccauaguaaauuauuggguuuuuccaaauaaaaaccaacguuuauuccuaaaaacaaauuaggcucugaagagcaauuuuucaaaauauuuuuauaauauuuauacuuuauaaaguuuucagaaacuuuuuaaaaaguuucuuuaaaaaguuucuauacucuuaaaaagacugaaaugaaaaugaauacuucaaucuuccaauuuuacuuuaugcaacugcaaaaucaugguauaacaguugccuaaaugguguugugucuacuuagaugucucaauucgcaaaaaaaaaagagucuaauauauuauccucauuucauuacuuauauagugacuuuaaauuuuacaguauuuacuguauuuaccacuacaaggcuggcuuuuuuauuaaaacugggaagucacuggaucuaaaaacaaacaagucgaaacagucaguagauaagcaauguaaugaggauuagauuucaccuaagugacgaacacacauauuuacauaaaggauguuauuuaaaauucuaugcagaggaauguuuccaauuuuguaugcuaauguaaaauaggaaguaauauucuuuuacaaguucaguuccacuggaaucagaucaaaaucagaugagcucaaggucacauaauaaauagcaaaggccaaauuaucucauaaaauuguugaagcauuuauguuaaacccaucccugcaugaggaccaaagcagcacagaaaucaggaaaaaguucuacuuuucaacucaagaacacuauuacugaugcacugacacacauggaaaugacuucagggcauuggcauagaagcaacacuaacuuauaagcuuuaaaaaucaagaguuuccaaugcagaccaacaucuauuaaacccugucauugugcucaguuagaaaccuugauacuucuguaaaggaaaaucaaaccacagggaauaaacauuccaauaaacacuuugaaacaccgaggauuauggaaauauuucccagguuuguaaccugauggugaaaccaagacaacaggaaagguauaagagcuuuauaucaaaaagucauucuggaguuaaaauacccuuuauauguagauuugaaaaucauauuaaaugagcuuaucaaaacagugauucuaauaaaauccaagccccugaguccccauuuguugccugcuucuauaaacagaauaauauuccaugcucugcugcuucauacuggagcucaugagcugucuaaaaaaaaaaaaaagauugccaagaguuaaugaacucaagaaaaccaaaaauucuguacaugaauagcuaccacuuuguagauuugucaaaggacauuuacuggcuuaaaaauacugcauuuuugcauaucuagaagguccugcaaggaacagguaaaaacuuauuagcauauacagagaaaaaugguucucaagugauauuuagcucaggugcaacgugaagaaugaaaaguaguagagcaacaucuguguaggcuugaagaaaagcuucaucacuaugcugaaauacuggauaugaaaaaguauuauugagauaaaaauguauuucauacugcaagaaauuuuaucacuacacuugccaacaaaagaaaaaaacaaacaaaaaagaaaagaguaauuagauuuagagaauaaucaugugugugauacauaauuuaaagagaauaauuuaugcaaauuaugauuugugaugaaaaaaggauuuucagucaauuggagaagaagcaauaacuauucuuuggacauuugcuaucaccuacuuuuacagugucucgaugacacuggcuaucgagaauuugaugaaaucaacagaaaacucaaacagagacugcgugcaucaauuucaaacauaaacucuaauauagaaaaguuuuguccagaaaaguaggaucaaguuucuuauuagaacuuuugaaaacaauuuuagcauuuaacaucgaaucuucguauuuucuuucuuuuuuucagagacagguucuugcucucuagcuggaguauagaaucuucgaauuuucuauuccuuaucagucauaugauacaaagaaaaugugacagauuuucacaaagcuuuaucuggaugccuccaaauuauucuuguuuacccaugugccaugcagauauuauuuccacaucugccaugauguggaaagagcugggaagcacugagauaaaggguaaggagagagaaaucacugaggaaagcaccagcaggaaagccaagggcauucuugcugcuaauaaaaauauguuacaaaugaccacccaguucauucuucugcaucugaacuuuccacugccuucaucccugccccaucaauagucugaacugcgagcaaagcaguccaaucuuauaauccacacauucucaaagacagauuucccagcugaaagcaacccauuguaucagagauugaugaaaauacgauaucacauuucaauacauuaucuucuuugcacaaaaagaaaaaugcuaauauacuuucugaacacaauugcaagagaaaugucuuacaacuauaaauggacaaaacaaaggcauauuauagagccauuaaaaauaagauuguagaaaaauacugauaaacauuuacagcauagaauuaagugaaaaaguaauacaaaacaguacauauauucagauuauaaaacaaaugcauacuuugaaaaggcauaaauaaaaaauuuaaacaauguuaaaguggcagaauucggaaauuuuuuauuauuuaaaauauuuucuuuaagaguauuauauugucuucaaccacaaugguaauaacauuuucaaaaaguugaauaaaauaauacaucugcaaauuccuauuuucugcuggauucuacacuccagccugguugccuuaaauuaacugauauuugcuccuauaaacguaucaaaaccucccuuucaaaccagggucagguguuaacuguguaaaaguguuugcuuaccuuuuauaacauugccaauacuuaacagaaaggugguuuuuuaaacuauuuauaaucuacccuuuguacuuuaaauucuacugaagaauaguguuccacaugaccacccaaauauaccacuccuuggauccaaagaccucaaaguaauaacuaaaaauaucucaucaauuguuugagaaugaagauauuaucaguauaauuaaccuuauuuuuaaagagaaaacaaaagcagagcuaaaauuccaaaaugaaucauuuaaauuaagucugccugcuagacuggaaggcauuuguuggcacuugcuacgguuaacacagaugaauauaccagaaugguacuuugacuagccaaaauuuacuaagcacuuacuaugugccaggcacuggguacuaaguacuuuaauaggacauuucauuuaaaccaaaaaagaauuuuuuuggagguaguuauuauuaucuccauaacucaggaguuuaaauaacuugguagcaagaagcaaaguggauuagaauuaaggcaucucuagcucuaaaauccaugucuucuucacuggaaagacacaucaacaaucaauaaaugguuaggcaccaacagugcauacaguugaauaaugauacaagauacaaggccaaugaugcugggcagcuaccagccuucuuugcaacucuuauacaugcagugcuuaaaugcuuuaucuuaacuagacuuuagugcagccaccaaucaguaaagacccaauacuucacugaggagucucauaauuauacuuuaaggugagaaacauaccuaugaguagaaauuaaguuaaucaugaagaucaacuccugugugaaauuaagcuggaauuucaagaauuuccagugucuguaucucaugggagauauugugguagagaggaaagugaacugaagcuaauguuuuuuuaaagcuugcauuugaaucccaucucugcaauuugauggucgggagacuaugaguaaauugcuugaccugauuagauucccuuuucucauuuaaaaugaaguuuucuuuaaaaucuuucauuuaaaagauuaaaugaaagcaugucacaaggccuggcagcaagaaagugcucaguccauaccaauuucuuucacuuucuuguauaauuuaaaaacaugucguauuacagcacuucagcuguucauuaguccauauuuuugucaugaccauaaacucaaaauuacauaaauaagaagaaaauuuaccugaagcauuguugaaaaaugccguauugcuucaucauacagaccacugccaaucaagacauaagcaauagcuaugaaacaaaauacaaaaauauuaaaggaaagaauaaaguaguucuaacuagaaucaauaacuaaaugcuuugguaaaucuccaaaggcagcuccaagcacuggaagcaguuaaagaaaaccuagaaguuaauaaggugucacugaauucuucuacuuucaccacuccacacuugcuaaucagccuuccaguuccaucuagauuuaaauuguuaaagucaucuauaaaauaucugccuacaagagauacugaucuuuuucuaaggccaucauucauuuucaaaucccaaauaaucuuugugaugucuccuagcuaucacaaaagcuaguaauaagccuaaauaauguccacauaacauggcaaugugauuuuuuacugugaauguuaugagaaauacccaaauagcaucacaaaucucaauuccugggagugcugaauuuacugccaauuaccuaauaagaacaaaaacagggacucaaauguauuaacauaaugcuuaacuguggauaauacaaaccacuauaacgcaaugacagucuuuuuccuacuucuuccauucaaaauauagucaaaacgcuacucaaaauauacacuaaagaugaaccacuuuguaucacguuguuuaggaaagugguauuuugaaauuagagccaggacaaucucugaaaacacagcaauauucugacuaaauucucccacccauccaaaaaccaguguuugaauaugcuagauuacauugccaucuauaaaauuugcccugacugcuugacccuuagccccgccaaaaucccugaaaaacauuuuauuccucacucaacaucacuauuuugauaacauuuauuugcaaaaaagcucuucuguaaagcuuuacugcaauauccuuuaggaccuaacagguguucaagaagauaggcaaugaaaacuuuuacugucauuaagagcuuauacuuucugacaguuaaaagcaguaaaaauaggccaggcgugguggcuuacaccuguaaucccagcacuuugggaggcugaggcaggcagaucacaaggucaggagaucgagaccauccuggcuaacacggugaaaccccgucucuacuaaauauacaaaaaaaaaaaaaauuagcugggcgugguggcgggugccuguagucccagcuacucaggaggcugaggcaggagaauggcaugaacccaggaggcggagcuugcagugagccgagauggcgccacugcacuccagccugggcgacagagagagacuccaucucaaaaaaaaaaaaaaaggaguaaaaaauuaaagcagaaacagaaacgaaaugcaggaagaguuuaaaauacauucauaaaucaauaaaauaaaguucaaauugaacaccauaauaauauaagcacuucugggggcauucuucaaaauaaaaagagagcccuuuugcccuacuuucuuuggaaagauaaauuaagcccaaauucaugcucagaaugcugacaauagauaccguucaguuagcuaaccuccagguaacgagaggauaccuuuaguuuuggugggggugguggaggcaguaauauuaguaguaaaaacagcagcaagaaucacaguggcuacaggcauugcauucuuaauaugugccaggcacaguaauauccuuuaccaguauuaacucauuugcuccuccacugcaaugagguagguacaauuauuaaccccauuuugcagacaaggaaauaaaguagaaagugguuaaacuagcuguccaaggaccauaagcagugagugagaggaaggcagcaagcugccuggcuccagagccuaaccucccaggcagcccgguacgcugagaaaauucaagucaguucccaaaccacugugcacuggagggauggccaaggggcugaaauuccuuaauggucagaugaacauggauaaaaacauaaacuuguacuuuuuugaaugcaggaagaugacgauuugaucagaaagccaagaugugagcucggauucuggcucugccacucaccagccgugugaucguggggaccucagucacuucucauaacugucuggucuugcuuaauaagccuguagaaaauuuucuuaaaguuuccuuucaaaucuaaauuuuuauuuccuauuuauuaucccauaaucaguaaauaucuguugaaugaacaaaucaaucaaugagccauaaaaacaaauaugauuuuuagagauaaauuuuguacuuuaggaacauauuuagauggcuguccacaucuaagugauugaauuccacuuaaaaucaaaugcaguuuucaaaucccuccaccuaaagcucaacauuuugugaaaaaaacgcagaaguauccauucauaaaagaauaaucauaacccaaaucuugugcaaauacaaauauuaggaucuaaauuuuguuguaggagucuaaagacuuaaaggaaaagcugguauaacuggacuucucucagaaaucucuacucaccagcaaccccacaucuccgagcaauguauauguucacagaugucauuuuuuucaagaaaaaauacuggauacaaaagaucauaggccagcucagggccuacacuaccccagggucuacuaggauuauucuuggagaacaaaacagaccuggcauaucaggcucugaacucauuauucaauaaauaaauacuacucuaaguagaauccaaggacuucagaaaagaccagaucugaugccuuaaagggcaguccucaaagccuccucaaagaauaucaccauaaaguaauuagcauuuucaaaauagcacccugggaggccaaggcaggaggauuccuagagcccaagaguuugauaccagccugggcaacauggugaguacuggucucuacaaaacaauuuuaaaaaauuagccaggcacgguggugugcaccuguaauccuaccuacucaggaguccuagggaagaagaucauucgagccuaguuuaaggcuguagugagcuaugauugugccacugcacuccagccugggccacagagcaagacccugcacuaacaggaaagaagccaauauaaggagcacuuagucuuaauaucaaacguguaugaccaugguaaggauaaaauaauuaugcauaaauuagauagagaagaauuccugcaggugcuuuggugacugggccccaugcgaaaacaugugcuucaauaguuugcccaguugcacugcucagcccuguauucaauuuugucuccacuucuucaaauguaaacucacuagacagcgagggaaacacacccagugcauaucugacacugacaaaaccagccuguuuuaaaacaugcaaugaacacaccaaacuaugugacucgugcagguacgaaugaauucaauuuuucuacacccacauucuuaggcccaaaaauaacucacuagccucaugaguaaaauaacuuaaaguuuaaguuaaaauaacuuaaacauagcuauuucacuauacagaaaaguagguagucugcuuucacuucuucauugcucacaucugaugacagcacacaaauaaccuuuuacugaaucgaaacagcucauaagagcucauuaccauaauuauuaauuuccauagaaauggagagcuggaaaagauuauuccauccaaaccuuuuuuuuuucucuugacauauaauaaauggaaugucacaagggcugaaugcuccaugcaagaucaaacagcucaaauuggcaaagccagucucucuacuccuuaccauccugucuuccugcuaugcaucuaaccaaaacuuugaggcaaauauuacaggaauauuaccagauucaagucuuaccuaacucuucauuugugcugucauuaucaguggcaaacgggaaucucuucuguucugcaauagacuuggccuggcucugggaaaaaaaaaaaaaaaacccauacauuuuagcuaucacaaaugaaagaaaacuuguauuaaaaucuguauuuuaaaaaauuaaaauuaaggcuacauuugauuuaaguggaagcaagaaaaugccacuauugugggaauguuuuacacuuuauggcuuucaguagaaccuugaugacgagagggaaacucuuaucagcuccuucuaguuuugcuaugcagcugggagcuuccacaccuggaaccugguaaagcuucaagauguggcagauuuaacaaugcguaaggguguuacugaugauauacagcugggugugaccagaacaugagcccuuccucuuugucaaauguuuacagacaaguucacagaugcaaaagauuuuucuccuuaauaaauugcuuagauagacggggcaugguggcucacgccuuuaauuccagcacuuugggagaccaagguaggaagaucacuugagcuccggaauuucgagaucagccuaggcaacacagugagacuucaucucuacuaaaguucaaaaaaauuagcuggacauggugauguacacugauagccccagcuacuugguuggggcugaggcaggaggauggcuugagcccgggaggucgaggcugcagggagcccugauugugccacuguacccccagccugggcaaaacagugagacucugucucaaaaauaaauaaauaauugcuuagauggcuugauuguggcaaccauuucacaacauauauguauauaaaaucacauuguacauuguaaauauauaauuuuuauuugucaauuacaccucagugaagcugggaaaaaaagcaaguaaauugcuuagaggcaagaaaaagagucuguaaauauugcuuuauuucauauuugaggagagucuaccauuugccaagccuuucugcaaaaagauauagggacgaggacagaaaugaaauucuacaaaaagaagaaaucauuuacuaagcaaccucaagaguacacugaagaauauaucugauuuuaaguuguuuguauucacuagaaagugggcaggagaaguacaguacaaacaaaucaaauucuuuuuuuuuuuuugagacaaaguuucucucuuuuugcccaggcuugagugcaauggcacgaucucggcucaccacaaccuccgccgccuggguucaagcgauucuccugccucagccucccaaguagcugggauuacaggcaugcgccaccaccccugcuaauuuuguauuuuuuaguagagacgggguuucuccauguuggugaggcuggucuugaacuccugaccucaggugauccacccgccuuggccucccaaagugcugggauuacaggcgugagccacugcacccagccaaacaacaaaucaaauucuugaugaaaaagacccuuuccuauuucuaauacugcaucuauaguaucuccucuggacagaguugagaagcuaugcucaaguaaguuugaacacacagcucaacaucacuaguagacuaauuucaauccaacuuucucaucccugcuuacacuucaguuccugaaagcuguauugccugauaccccuaaauaaagggaguuuauguugacccuuugcuauuccuucauaugauguguacaaucacacuuuuauguuuauuugcauaaugauuugguugaugaguauaaaagucauggugcagagaccaacgcuaucuggcuugcugcuguauuccuaacacucaccuaguacaaugccugguacauaaugcagagaccaacacuaucuggcuuauugcuguauuccuaauaaucaccuagugcaaugccuggcauguaauaggugccaaauaaauaucuggagaauggaucaauaaaugaauagucuaagucccauauuucaaccuugggaagaggaaaggccaagacuaacgagcuuucucccauaggucacuagcuagcacuagcuuaaacuggaaaugcaacuaguagaacauauuuuaacuacucucaguaagaagacuuucauaacucuaagaaucuaacugccuauacaagaugggauuauccaacuucuacuuaaacacuuucagagaugaccaacucacugcuuuacaagacagccccuucugauuuugggcaagucuaauucgagaguuuuccauauaucaaguugauuacuaugcagcgaguuagguaaaagcagacgaucauucucuaguuugcaguuucaauccaucuucaguaguucucacaugaaaaggcaaggcuuuguuugaaaaaaaaaaaaaagaguaucuuaaaaggaaauuuuaaaccgaagaugcaaagaguaucuaugcagauguugaaggaaaaggccuggagaaaaaauacauuaaacuuggacacggaaagaacaaucagcuucauagaguuaagugugaacaaaaagaagacccaucccucuugaggcagccaggcuggaggaggagaugcacuaacauggauaggcagacgcaaacauuagcuacugucaaguauucaccccugaaauggagagguccacgguauaguuuaguugguacugauagaaaacauagauacaaaagauacccacauaugcaaagguuggaaaaauaagagucuacuauaccuacaaauacacaaggcugcuagaaauaagguuuaacuauaaugucccuuuauuucuugacacuugcaaauuaaaaguucuauguccagaauaaucaaccauccaauucauaagucauaauucaauguggcaaaauaccagacgaccuaucuuuauccuaugcauguagacucaacgaggcccaacuucuaguugacagaggcgacuuccacuuuuuggaacuaguaucacugggcuucagguuacaaaaacagaacacagagagaagaugcauaccagaaucuucucaguguugagggaaagcaaggagucacagggugaugaucccuuggguucgcagucugagucauggaaguucaaaaaggaugacucugaaaggcaagcauucuuuguuauucucuacaccuuaauuuaugcucuuaggugcuuaacuaugaauuagaauuuuuagacuccacagaaccaaaauaagaacaggugugaauaacacuaaaaguggcaaccagcugggcacagugccucacaccuguaaucccagcaacucaggaggcucgcuugaggcaaggaguucaagaccagccugggcaacagcaaaccaaccaggcugggucucaaacagugagacccugucucuagaaaacaaaaaauagaaguagcaaccuguauccuaccuuuauaauaggguaauguuuuacgguuugcaaguaucuugcacaaccauuagugauguuccucaccaccauucucaaaugagcaaagccagugagcuuccuggaugguuaaaugagguuuaaauagguuguaacuuaucuaaaggcaacaggguagaaagaguacuaguacaaugcuugucucaggacacauguggaacuaauauuguuguugagauccuucagucgaacaaucuauggggcagcauuuaccauagauuaaaaaaaaucacaaaaggagaauaagccaaaccagugagacuuaaauguuaaaagauacacccuaggccaggcgugguggcucacaccuguaaucccagcacuuugggaggucaaggugggcggaucaccuaaggucacgaguucgagaccagccuggccaacauggcaaaacccugugucuacuaaaauacaaaaauuagccaggcgugguggcaggugccuguaaucccagcuacuugggaggcugaggcaggagaaucgcuugaacccgggaggcagagguugccgugagccgagacugugccauugcacuccagccugggcaacaagagcaaaacucugacucaaaaaaaaaaaaaugauacacacuaugaguccaguaugcaaaauauauaaauagcucuuacaacccaacuaaaacaacacaauuuuaaaaacaggcaaaggaccuguauaggcauugagcacaugaaaaguugcucaacaucauuacuaauuacuacuuagggaaauguaaaucaaaccacaauaagguaccucuucacacacacacacuaggauggcuauaaccaaaaagcagaaaacaacaagcaguagcaagaauguagaaaaauuggaacccuugugcauugcuggugggaguguaaaaugguacaccaguuauggaaaauaguuccuuaaaaagcgaaucagaauuuccauaugaugcagcaauucuucuccuagguauauacccccaaaauugaaaagggacucaaacaaguauuguauauacauguucauaguagcgcuaaucacaguagccaaaagggagaaaugguccaaguguccaucaacagaugaaugaauaaacaaauuuugguguauacagaguagaauacuauucgaccauaaaaaaaugaacuacugauacacacugcaacguggaagaacuuccaaaacauuaugcuaaauggaagaagccagacacaaagggucacuuaucauaugacuccaucuauaugaaauguccagaauaggugaauccauagagacaaaaugcagauuggugauugccggggauaggggaaggagggacuagggagaaacugcuuaaugaguaagggguuuuauuuuggaguguugaaaacaacuuggggugguugcacauggugaaugccacugaacuguuugcucuaaaaugguuaauuuuauauuaaaacauuucaccuugauagauuauugcaaaaaaagauauguucuaauucagcagucauuaaagagcauuaaauuauguucaaggaaccaucugagggagagaauaaauuauaauaucaaaaucagucuguguccucaaagaacauauaauuuagcuaaauucucacguguuguauaucuuaacaauaagaaacaagacaugauauggugaagaagcccugggguggugaaccauuacugaagcugcaauguuaaauuucacaaggcauaagcaggguuuaaaagaauggauggaggcugggugcggugacucacaccugcaaucccaggacuuugggaggcugaggcaggccaaucccuugagcccaggaguuugagaccaaccugggcaucguggcaaaacaccaucucuacaaaagaaaaaauuagcugggugugguaguacaugccuguagucccagcuacccagaggcuaaggugggaagaucaccugaguccaggagguggaagcugcagugaaccaugaucauaccacugcacuccagucuggaugacagaguaagacccugucucaaaauaaauaaauaaauaaauaaauaaauaaauaaauaaaagaaaaaagaauggauggauuuagacuggggcagagaaagggaagggguauuccggauaggacgaugagugguacacgcaaagguacaaaggcaaggaaaugcaaagggcagcgaggagacuccuacucccuggcuagagcagggaguuuguguuggaaaagaaaaaguaugaguuuggaaggugaggagucagacugcagaaagucugaucugaaccccaacgaaaggcuuuagucccacaaaaaugaagauaguaaugguuccuggcagaugguuggagaauaaugacucaaugaaagauauuuuggaaacauacacauuuauaaccuguuucuccugccuuuucuaagcuaagauuugagaacuuacuauaugccaggcacugugcuaagcaauguguauaccuggccuuauucuaacaaucccucuccuuuguggaauccauuucaguuucaauaaauauacaccuacauaauuuuaaaaggcugcacuuaaccauacuuuuaucacuggauacuuaggaugucccuacuuuuuucuuaauacgaacaguauuucaguaaguauucuugaccuauauuuuugaaaauguacccacuuacaauagauuccaacaaauaaaauugccaagucaaagggugugcacaaguuuaauauuuuucauauauauugccccaauuuccuuccuagcauauaauaacaauuucauuccuacuagaaguuugagaagguccauuucccuccagaguacugacauucuuuuuaaucuuucccaaucugaacauaccacuaauaaaguuaaacuuuugguuuauuggccauuuguaucuccacuuuuguaaaucacuuauauccuuugcucauuuuuaagucaucuaaaccuauccuugcaaaagauauugaaaaaaauuccuaauuaucuauuuuccaaaugguuagccaguugucccagcaccacuuguuaaauuaucaauuugaaugccaccuuuauaauacauuauagacauuaggaucuguuucuauacuugcuuuuaaaggaaaucuuuaagauuauuuaaauccagcuauaguaaccaaaacagcaugguacuggcauaaaaacagacacacagacuaauggaacaaaauagagaacccagaaacaaaucuacacgccuacagugaacucauuuuugacaaaggugccaagaauacacacuggggaaggcagucuuuucaauaaauggugcugggaaaacugaauauccauaugcaaaagaaugaaacuagacuccuaucccucaccauauacaaaaugaaaucuaaauggauuaaagacuuaaauccaagaacucaaacuaugaaacuacuacaagaaaacguuggggaagcucuccaugauauucaucugggcaaagaucucuugaguaacacccacaaacacaggcaaccaaagcaaacaaggacaaaugggaucaugucaaguugaaaagcuuccccacagcaaaagauacaagcaacaaagugaagagacaacccacagaaucagauaaaauauuugcaaacuaccccucugacaagcgauuaguaaccagaauauauaaggagcacaaacaacuguauuggaaaaaaucuaauaauccaaccaaaaaauggggaaagauuugaauagacauuucuuaagacauacaaaaggccaacaggcauaugaaaagguggucaacaucauugaucaucaaaaagugcaaaucaaaacuacaaugagauaucaucucaccccaguuaaaaugguguauaugcaaaagacagauaauaacaaaugcuggugaggauauggagaaaggggaacacuuguacacugcagugggaauguaaauuagcagaaccacgauagagaacaguuuggagguuccucaaaaaacuaaaaauugagcuaccauaugauccagcaaucccacugcuggguacauacccaaaagacaggaaaucaguauauggaagagauaucugcaauccaauauuugcugcagcaguguuuacaauagcucacucugacacccagacuagagugcaguggcacgaucucggcuaacugcagcauugaccucagcaucccuaguagcugggaacacaggcaugcaccaccacaccuggcuaauuuuucauuuuuauuuuuuguggagacagggucccacuguguugcccagaauggucucgaacaccugggcucaagcaauccucucgccucaaccucccaaaguacugggauuacaggcaugaaucacugcaccugacuuaaauuuucuccuaauuacuuaaacuugguaggauuauauaucacuuuucauuuaauauuuuuaaaauaaauuuuuaguuuucuauaagaaacuuuuguuuccacacuuucuaaucccuuauaaugaucuguuuguuuugauuucaguaucacauuguuucaauuauuguagcuucacaauaaauaaauguuuuuugguuuuuauuauuuuaaauugauacagaauaauuguacauaugggguagagggugauauuuugauucacaauacauacauuuuaauauaaaacaaagccauuaucaauuuuauuccaaaacuuucuuggcuauuuguauaaacauucuuucuucagauaaacuucagucaguuuuuuaaguuccaaaacaaaaaaaucucucuaugauuuguguuaggauggcauuaaaauuguagauuaauaggagaagaaauacuucuuuauaaaauuugaucucuuuauuuaaauauuuuauuaaacuaugugaaacuucauaaauuuuauauaggauuuacaugugauuuuuuaaauuggguugauaaccauugauucaauacauauuuguugagcaucuacuauguucccaucacuguguuagccucuacugagcaaaaccagaaaugacccuucuucuacaaagacauuauaguucccugugggaaaacugauagcaaucaaaguacacaaagaaacauaaaccaacaacagugugagagcuacacaugacagcacagucagaagauauggccuggucaguuucccgaggacgugaauaacaccagcuaacacauaguuaccguguacaggcaaccuuagaauccccauuucaaagaugaggaaaaugagcccgaggaaccugcaguaaucauccugacgcuacccucuagcaaagcaguggagggaggaucugaaccuaggcagucugguucuggagucugugcucuuagccaugaauaagugaauggggaccugagggaaauuauggauuucaccaugggaggcuauggcaccgggagagcagucaggcagaaauaccagcacaugguaaauccuuuguccaacugccuagugcugaauauuuuaucugcccacauuacugaacucuuuacagcccuauuaaugucuccauuuagucagcugguaacuguauuaucugcacguaauuuuaucaaggucuuuuaaaauauuuauauuaauuuagcaccuuauuauacuagaugaaacuuccaaaaaguacucaauaacgccacugauuaacaggcaccccugcuuauuccugacauuaauacuucauuuaauaacugagauuucaucaacuuuugaugauaaaacuuuuucaccuaacauuuaucaacauccaguggaaagcugcucugugucagcuauggguugagacugauguacuucaccauauaaaagaaguauuuuccuauucuauuuuuuuuuuuaccagaaacuuuaaaucaggagagcuugcugaccuuuaucaagcacuuuugaaauuuauuuaagauguuucuaugauuuuucuccuuuggccuauuaacaaacuaauuuaauuuuuucaaguugaaccaucuguguacuucuaaaacaaacucugauugagguagaucauucuuuuaauugcuugcuaauauuuuacuuaaaauuuuuauaacuauguauguaucuucuaagguugcaauagaaaaauaguugcuagaguuauaacuauaguuguguggaacaggagguuaaauuuguucuucgaucuuaaaauauuuaacucacuauggcuuuaauuacuuuacuaucauaaaugauuauauuaaaggauaacuacuuaauauaauaaauaauuacagcccaaccagcuguacauaaauaguauaaauuuccuuggauaggaaaagcauuaguuuucuuccuugcuuacgucguacaaguaaaguuagugcugauuacuauagaaacugugugaaaacgcaucacagaauucuaucuuguucuucuacaucaucucuggacauuucuucacugcuucagaguuuaaugucuuagcagagauuucugcacaguugccucuuaaguucucauggccucuggagcucugcgcaugccucucauucacaacugacacuugcaccugcucccucuuucuguagucaccucaucaggcuuaucuauuuuauucuucuuuuuuuuaucacuuaagaauuuguuuuccuauggugguggggggggggccuuuuuguuuuauugugguuaaaaaaaaaacacacaucacauaaaagcaaucgccuuagccauuuuuaguuuguaugguucaguaguauuagguauaugcacacugaccuccagaacuucuuaaucauucuuuuuuuaaaaaaacaacccgggucuauuucucaauuccacugcugcuuuauuucuaauucauuuauaccagcuuugcuguauuaggccuucuaauuucccuuauuaccucuucucgcagcucaaguucagcaucuaguucauuuauucccuuucuucuuagcauuaaacuaagaaggcaggaugaguuuaagcaggaggcgacaucacuaacaggugucuaaggagagaaggggcaaguagagcagggggcaggugggaggccauggccaguuaaaaugagcaaagucugaauggaggcagcagccaucggguugaaauagagggucacggucuaaaggauacagcaaguaaaaaggagagggccuugaggaagaauuaggcacagaaagagggaaaagacacagguuuccaguuugugcaaugagggaagaaguggugccaucaacggaaacaaggaguuuaagaggaagagagguuuuagagggaagucaagagcuaacuuugggcuugagucaagugauuacgcuggaagcucucuagcauguaguuaagaaaguccagagaaagguaaauacuacagauauggaugugaugauuugauaaucauuaacuuaugguggaugauaagcugagacuguaaguacagucucuaagaaagcuuagggggcugggugcgguggcucacgccuguaaucccagcacuuugggaggcugaggugggcggaucacgaggucaggagaucgagaccacggugaaaccccgucucuacuaaaaauacaaaaaccuagccgggugcaguggcaggcgccuguagucccagcuauccgagaggcugaggcaggagaauggcgugaaccugggaggcgaagcuugcagugagccgagauugcgccacugcacuccagccugggugacaaagcgacacuccaucucaaaaaaagaaaagaaaagaaaagaaaaagaaagcuuaagaagcuuacguuuaauaagagaagaguugaccuggugaagaugaguauuuaagagauagugggagaaucaacuuagcaauuuaucuuuuguuaaaagaacuauccauuucuuugaaagguucuacaucugggccauaaagcuggauacaguuauuauaaugauuuucauauuuauuauacuugcuuauuccucaagccaaauacuuguuucugcucauuuuucuugauuaggcuugcuagauaacugucuaaucuuaagcaguauuuucaaagaacuaggucuuauauuuaauucuaguauuucucugacuucaaacuuaauuaauuaguuugaaggcaauguaacaguggcucagggcagggcuauggagucagacuaacccagauuagaugcuucccugacuguuugacuuagagcaaguccuuuaguacgucuuagccucagcuccuucaucugcaaaauagaaauaaccacccccagauaccuucacagggcuacugugaagaauaaaggguauaaagcccugugcacagaaaaggauuguuaaauguuaguauaggcuuauaggcuaaaaucgcaguguuuuuuuguuaaauuuuucuaucugcuuucuuuaagcuuaucuuggccuucacaguacuucccagcuuccaaauaccuucauaaaccucauuucuuuugauucuccauccuccaagguagauacaaggcacacugugcccacuguacacauggggaaauaaacucaauguuaaugaacauguuuaaggucacaaaacaaagacauagcacagccgggucuugccacagcaaugaagaacaugguacauuugucacaacuccuucugccaaugcuggguccuaguaaugaacaguuuagguauagcagugucuugaaacuucuuuccucuccuccuaaaccucacacacaacugaccuuaagaagagcaguuucagcacauugacgaggacaaaagcuaaccauagaagguccaagagagaguggagugguggaggcaguccauaugaacaucuccuuugaggaauucugcuguaaaaggaggcagagggauggggcaguggcuggagggguguguggucaucuuaguugcuuguauuuucaggaugguaguuuuauuaagaccaucuguaugcugacggaagacaagaggaaaugagagccagugaacagagagcugaacuaggcagaggcaccggccacucauccaccacaacaggacagaaggcaaaaucuaccaguccaucugcgggcaggccaguagcuggggugguggggagcaaggaaguuguuuucucacugcuucuuagucaaauaagaugacagucgucaccuccaaggaaggagagaagguggcauuggcaguagcauguauuucucacacauccaugugugugagaaaacugacugaaagcuuauaaguggcaaacccauggccaauuuauaaggaaaucaacagcugcuggguagcacuuaucacucgaccaccuaguuauaacagacagcacacugagcuacuugaaaauaaggaugacugggcuuuucccuuggaugagcuacaacuuaaaaguagagugccagauauuuauugacaauccuaaccccagguauaggguaaaccugcgaagagaagacagaauucuuguggcugaaagaacuaccugaaggccagguggcugugugguaucaacuuguagugccuuuugcuuuuaucaauuucugcacuuauaagacaaccacagguggccaggcgcgguggcucaugccuauaaugccagcacuuugggaggccgaggcaggcggaucacgaggucaggagaucgagaccauccuggcuaacaugguggaacccugucucuauuaaaaauacaaaaaaauuagccgggcgugguggcgggcgccuguagucccagcuacucgggaggcugaggcaggagaauggcauggacccaggaggcagagcuugcagugagccgagauugcaccacugcacuccagccugggcaacagagcaagacuccaucucaaaaaaaaaaaaaaaaaaaaagacaaccacaguugacaucauauacugcauugcucaauggccccgaaauauggucccaagugguaaauuccuuugagaguguaauaacaggaaaaaugcucugaagaauuuauaugcuucauuuaaugaaaugaaauauucaucgguaccugagauguauuaucguaaagcaaauugaaaauagacacugccugcugauuauuaaauuauaaaguaaacauauaauuaauccauaggaacuaaggauccacaaaagccaucuuaaagagacagaaguuuuuuguuuuuuaacaaagcuugaauguaauaggaucaaagguaucuuaacccacauacaaauauaaacauauguaaagaaucaaaagaaaaggaauucacugcacgggauggaaaaacaggcacaguagcaaauuacauggaacagaacagaagaaggaugccuuaaccaacaaaacaggccuuccccacaaaggccaguuacuuagcauaagguuauaaacuagauugaagaugcaucagaugcucaaagugacacauacuuuuaagagcuaaaagcuuucucauaagcccacacauacuggcagacaacaucaacuccacagggaaugcugaaacagagcuaggcacugacaugaaaagauuagugacaagggaacacagagucacugagaacauugcaaacaccagcagggaagaguugcaagagaagacaacuggucuucuugugcagaggugguccugagaugcaccaacugauuccuaagugagagucuauggaaagaaugccagcacaugugcaguguaaguccacugcauggugcuggacucuaaaucagacaaaacauuucccaaaugaaacuaggguuagcauggaaugagacuaucggcaaucuuaaaaacagacagcuauugauuucgguucuuucugauuacaucaguuguucagcuuaugaaaacguauugagcuaucuacacuuaggacauaugcacucuccuguauauauguuguauuuugauaaaaaaguaaaaccaaaacauaagaaaaggaauaugcuggaaagcauucacccaaaguauuaaaauucugccgcuuugauaaauuauuuauucuaucugcaagauaagaugagcccaaacaaaaugaccucuuuaaaacaacucauugugaaagggagaagguuuaaaagucagucaaguauauauugagugcagugaagcuaaacugucuguacauugaguggugcacauugaagagccuugacuuuccuacagucaugcuccagguagguucuaaaacccaagucacaccauuuuugccuccacccagagauuaaaaaauaauaauuaacccuuaucaccugaaguugaacagguuuagcaguauguagaucuuuuaaaagguagauguaauucuuaaugacaacagauauacgugaaaaagcgaaucauaggcugccaucgucauagggcuuaugcuauaaaaugcuacuucuaaaccagaggauuugcugaaagaugcuguucagugagcaaaagggaaacacccucuggcaaugccacaggggccaggauguggcaagaucacaaucucuucaucacucugugccucagucucugagcacagcgacuuugcacuggcaaauuuacucaggaaugccuugaaaaacaagauaugaagaggucugccaugaaacuauguaugaugacaaacacagaaaaucagggccaggagaugaaaggauugaccagauacacucacaguaaugguuaccacaauugcuaugacugagcacaaaaugugguucuuaacuuccucauagagcaaaaaaggaaauagcucucauaaguuuccuucuauugauucucuaccaccucuaggcauagcagugaucuaugugcugugagcaaaaagacugacuucauguauuuaaauggccaauuccuuaauuaagaaagcuaccauauacauggacaaucucaguguuaccaauuuugucaaaaacacagagcuagguucauagcuacuuccuuauuuuucuggcaguucacaauucucaaauuggacaaacagauucuaaaugccuuuucccauaaagaacugugggaaaauagaauaaaugcaauucugcuuucauugauuucaacaaacuaaugaaaauuaagacaucaaguacagggcugcaucacucaagagcagugaaaaaaggcugaaggcauuggaaaaaaagauucacacaaacucacuguucuuguuacuacuacauuuucaaggcgagaggagaaaacaaaaguauuuuuaaaacaacuucuagaaaugcauaugcuugaaccauaaaauauaccuuauacugucuguaaagaguauaaagauauaauuuaauacaugauuugaaagagaugcaguuuagcuuugguaagaagagcagaggggccgggcgugguggcucacgccuguaauuccagcacuuugggacgcugaggugggcagaucacgaggucaggaguucgagaccagccuggccaacauggugaaaccccaucucuacuaaaaauacaaaaaauuagucaggcuugguggcaggcgccuguaauuccagcuacuugggaggcugaggcaggagaaucacuugaaccugggaggcagagguugcagugagccgagaucacgccauugcacuccagccugggugacagggcgauacuccaucucaaaaaaaaaaaaaaagaagagcagagaaccugaauuuuuaaaucaaugaacaaguuacaaauuucacaagaccuuaauguagcagaucuacagaguguugaauuaagauauuucuaagaucucuccaaaucucacucuaucuaagucucagcucaaaugucuccuuaccagaagccaucccggggcaccucuuaaaguagcaccuacacacugcucuuuauccucucacacugcuuuauuuucaaggcauguauuacugggcccuacuauauagagucaugcgccacauaaugauucggccaaugauggaccacguaugugugagaauggucccaucagacgguaauaccacauuuucacuguacauuuucuguauuuagauacacaaacacuugucacuauguuacaacugccuacaguauugaguacaguaacaugcuacaggucuguagccuagaagcaauaggcuauaccauacaaccaagguguguaaugggcuauuccaucucggucuaaguacacucuuugauguuugcaccaugaugaaaucgccuaacgacacauuucucaaaacauacccuguuguuaaaugguauguaacuguacuuauuucuucccucaccaagacacaggauccacacuaggaacucagucagcugugcugcaucaccaggguccaaaauacuaaguagcaucuagcagguauacaaauaguuuuucaaugaaagaacagacccauucuaguccugcaguucaaaacacuagguucagugaagcauccuugaauuuguagucaaagacaaaauucuaauagugauuuaagaauauaacuuucaacaaagcuugaaguuauaggacuucaucauuaauauuaguaagaaauuauacuaauaugcaacaauuacugaagauaacacacaaauggucaggucagguucaaauccuggcucuacucuuuacuguauaaccuuaacuucucugucucaguuuguaaaauggggauuaaaaacagcauuggccaggcacggugucucacgucuguaaucccaacacuuugggaggcugagguggaaguacugcuugaguccaggaguuugaccagccugggcaacauagccagaccuugucucuacagaaaaaaaaaaaaaauagcugggcaugguggcacacgucugugguccuagcuacuugggaagcugaggcaggacgauggcuucaaaccaggaauuuaaggcugcagugagcuaugacagcaccaaugaacuaccuccugggcaacagagcaagacccugucucuaaaaaaauagaaaaaacaacagcaccuacuucaguaucaaaaggauuaaaaaagauugcagaguguuuaugacaauauaacuaaaaaagugaggaaagaauuggaaaaauacuucuguucaucauuuccuccgacaguuacaaauuaaagauagggcuuuggcaacaggaaauuuacuuuuauuuuuaaaauauguacaauacaguguucauuuuuuuaaaauaauauuuuuucucuacaaguaaacaaagagagaagacaaguuugugguuauaugcuuuucaaguaaaaagguaaaaauaaauaaaauaucaaaaagguaaaauguaaaaauguggaguagaaaauauuaagggcggaucaggaaacaugcaaagcucaagcugagacauauggcaccagagggacauccaugccugucacuucugcaguagaucuggguggggcucagcccacugagcauuaggcuguucccugggacauggaugccaugugacgguggugugcauagcugggccagccauugcuaguguguugucuuuggauuggugggcucccaccagccacuguccuuguauguacaaucacuggcgguucugucucaagggaauacauauacugcuuguaagaagguaugcagauuuaaauuuagacccaagcaggcaucagcucagccauuugaaccugaaagcugugggaaagauucugaaaagugguugugcugcuguguuuguccucaguauaugugcuggauugauaugaacagguuuguggcuggacaggcaagcaagagacgauggcaugaucaaugcuuaguaaagccaagucuguaugauucugaagaacugacuaguucuggauccugacauuugucuagacccuaauguugcucaaaugggucuccggauacagagcaucagcugccccucaggcuauggcacgguuaguuguaaaucccgaauucauccccacauccuaggacagagaagaaaugaaacagguuucauaggguccagcuucuacauaguuguccagggcgaagagggagaaaugagaaguauuucaguagccccuacaacaacagaguuggcuuuugucgcauacugcagccaggaaagcugagggaaacagcuggagcuccaaguaguugauucuggaaaugacuucuugggugaccacagcggcagcugccccacuuuagcaccuguugguagcuacucacacagccaggggaggugaucugaaagacucaggucguucauuugcaacaguaaauuuuaaauuccaagcuagaaaaaauaaguacuacaugggagagagaaaaagaagguagaaacaucuaaauaaauuauguuuacagcuucaugauacaguguucauccuccagggaaauaucguaauacaagucagagcuggcuugaacaggguucuuaaauacuggugguuagccugaugccaaagaaucaaauaagccaccaacaucaaugauaccaauagauaucauaguauuaaucgauacauaccuucuacugucuaaacgcuggggcuccuuuagccagugagcaccacaugagcaaaggagaaagggaaauuuacccaacaugcaccauaugcaaguaaauacuucagaugugguuugccuaccuacaaccacuuaaugguuaggacaaaggcuuugucuggagcccgacuucauggguuccuccuuuggcagcugugggaucucaagaagaugacaauuucacuauguuucaguuuguucaucugagaaaaugagccaccaucuaaugaggugguuauuguuuuucugauagacuaauauacuaggcucauagaccuaaagcacuuauaacagcaccuggcauacagcaagcacucaauauaugucggcuacuucucauuucccucacagcacccucgugaggaaaauaaaaccccacaauuaggugaacaguguuuuccacuuacagaggaggcauuuuacaaagacagguaauucacuugcucagagauacagaaagugacagagguaaguaaaugccauucuuucuccaccgugcaaggcuggccguguuacuuacgccguuaccagcuaaggccuaccgcaaaauaaaaaagucacaaaccucucagugagugacacuuccucaaggaagucagacuguacuaaaaggaaaucagauugugcuaaucuugacgucucaucucaacuaaaaaaaaaagguauuguuuucccagguacacaaugccgaagaaaaccacugccaagucuuaaaagcaaccaucucccaguggguucgguagaccccgguccuucccaaagcaagccauaagggaacucacauagagaagggggaaagagaaagggaggagauugauggguaaaaagacccacgacagaacuucaaaacaaaaaaauguacacacguauuuugucccagaggcaucugcuaugauuuauuaaacugaagccaauagcgcccauucuuaaugaaugagcuggcguagcuccaauacacacacggcacugacacacaggcucaaggccugcaggggccuuuuuucccucugggagacaccugacagaucgcagguugaucuuaaacaacuggaagcaagaugucaacgagcagauaagaugggcuugcucuuuuuuuccauuccagggauccaauuuuuaggaacuguuguauacgagacauuaacccgggaggucaggaagccugauuuccaggccuaagaugugccaggcgucucccuccgggggcgggcuccgcaagccgccgggcugguugcucguccgcccgccccucccucgccccuucggcauccucgggaggccggcggcgggaacagggcugccccgggccaccugccaucuccuccgccacccuuccaacaguugcuucagacucaggagagaggccgcccuggccccaggagcaugcugucagcucauuucucgacucgccgcccugcccaaaggcggcugcaggagggcgcgcggcggcguggguggcagcggcgggaagcugcccgccaggaccccuggccgagccggcucccgcggaucgcgcgccgcagccggaggcgugaggcccgggcgacccguaccccggcccgggaccccagccccgcugccccgccgccccggccgacucggacgcccgccgccgcccacucaccgccgcacucggcagaguacugguccccccaguccccggacugcgggcugcagccgccgccgcccgccggggccuccugcugcugccggugcugcagcuccugcuugagcagggagagcggcgaguagugcucgguggccagggcgccuggccgcagcccggcggacaggacccccagcagcagcagcagcaggacacgccgggcggcgcccgcggcggccacagcgccgccccagaagcagcagcagcagcagcagccggcaggugccaucuucccucaaggcgcaugcgcgacagcccuugcccggcucucaggccuccccgccucuaa

SEQ ID NO: 15860 - RNA, 72785 nt, Homo sapiens
uuagaggcggggaggccugagagccgggcaagggcugucgcgcaugcgccuugagggaagauggcaccugccggcugcugcugcugcugcugcuucuggggcggcgcuguggccgccgcgggcgccgcccggcguguccugcugcugcugcugcuggggguccuguccgccgggcugcggccaggcgcccuggccaccgagcacuacucgccgcucucccugcucaagcaggagcugcagcaccggcagcagcaggaggccccggcgggcggcggcggcugcagcccgcaguccggggacuggggggaccaguacucugccgagugcggcggugagugggcggcggcgggcguccgagucggccggggcggcggggcagcggggcuggggucccgggccgggguacgggucgcccgggccucacgccuccggcugcggcgcgcgauccgcgggagccggcucggccagggguccuggcgggcagcuucccgccgcugccacccacgccgccgcgcgcccuccugcagccgccuuugggcagggcggcgagucgagaaaugagcugacagcaugcuccuggggccagggcggccucucuccugagucugaagcaacuguuggaaggguggcggaggagauggcagguggcccggggcagcccuguucccgccgccggccucccgaggaugccgaaggggcgagggaggggcgggcggacgagcaaccagcccggcggcuugcggagcccgcccccggagggagacgccuggcacaucuuaggccuggaaaucaggcuuccugaccucccggguuaaugucucguauacaacaguuccuaaaaauuggaucccuggaauggaaaaaaagagcaagcccaucuuaucugcucguugacaucuugcuuccaguuguuuaagaucaaccugcgaucugucaggugucucccagagggaaaaaaggccccugcaggccuugagccugugugucagugccguguguguauuggagcuacgccagcucauucauuaagaaugggcgcuauuggcuucaguuuaauaaaucauagcagaugccucugggacaaaauacguguguacauuuuuuuguuuugaaguucugucgugggucuuuuuacccaucaaucuccucccuuucucuuucccccuucucuaugugaguucccuuauggcuugcuuugggaaggaccggggucuaccgaacccacugggagaugguugcuuuuaagacuuggcagugguuuucuucggcauuguguaccugggaaaacaauaccuuuuuuuuuuaguugagaugagacgucaagauuagcacaaucugauuuccuuuuaguacagucugacuuccuugaggaagugucacucacugagagguuugugacuuuuuuauuuugcgguaggccuuagcugguaacggcguaaguaacacggccagccuugcacgguggagaaagaauggcauuuacuuaccucugucacuuucuguaucucugagcaagugaauuaccugucuuuguaaaaugccuccucuguaaguggaaaacacuguucaccuaauugugggguuuuauuuuccucacgagggugcugugagggaaaugagaaguagccgacauauauugagugcuugcuguaugccaggugcuguuauaagugcuuuaggucuaugagccuaguauauuagucuaucagaaaaacaauaaccaccucauuagaugguggcucauuuucucagaugaacaaacugaaacauagugaaauugucaucuucuugagaucccacagcugccaaaggaggaacccaugaagucgggcuccagacaaagccuuuguccuaaccauuaagugguuguagguaggcaaaccacaucugaaguauuuacuugcauauggugcauguuggguaaauuucccuuucuccuuugcucauguggugcucacuggcuaaaggagccccagcguuuagacaguagaagguauguaucgauuaauacuaugauaucuauugguaucauugauguugguggcuuauuugauucuuuggcaucaggcuaaccaccaguauuuaagaacccuguucaagccagcucugacuuguauuacgauauuucccuggaggaugaacacuguaucaugaagcuguaaacauaauuuauuuagauguuucuaccuucuuuuucucucucccauguaguacuuauuuuuucuagcuuggaauuuaaaauuuacuguugcaaaugaacgaccugagucuuucagaucaccuccccuggcugugugaguagcuaccaacaggugcuaaaguggggcagcugccgcuguggucacccaagaagucauuuccagaaucaacuacuuggagcuccagcuguuucccucagcuuuccuggcugcaguaugcgacaaaagccaacucuguuguuguaggggcuacugaaauacuucucauuucucccucuucgcccuggacaacuauguagaagcuggacccuaugaaaccuguuucauuucuucucuguccuaggauguggggaugaauucgggauuuacaacuaaccgugccauagccugaggggcagcugaugcucuguauccggagacccauuugagcaacauuagggucuagacaaaugucaggauccagaacuagucaguucuucagaaucauacagacuuggcuuuacuaagcauugaucaugccaucgucucuugcuugccuguccagccacaaaccuguucauaucaauccagcacauauacugaggacaaacacagcagcacaaccacuuuucagaaucuuucccacagcuuucagguucaaauggcugagcugaugccugcuugggucuaaauuuaaaucugcauaccuucuuacaagcaguauauguauucccuugagacagaaccgccagugauuguacauacaaggacaguggcuggugggagcccaccaauccaaagacaacacacuagcaauggcuggcccagcuaugcacaccaccgucacauggcauccaugucccagggaacagccuaaugcucagugggcugagccccacccagaucuacugcagaagugacaggcauggaugucccucuggugccauaugucucagcuugagcuuugcauguuuccugauccgcccuuaauauuuucuacuccacauuuuuacauuuuaccuuuuugauauuuuauuuauuuuuaccuuuuuacuugaaaagcauauaaccacaaacuugucuucucucuuuguuuacuuguagagaaaaaauauuauuuuaaaaaaaugaacacuguauuguacauauuuuaaaaauaaaaguaaauuuccuguugccaaagcccuaucuuuaauuuguaacugucggaggaaaugaugaacagaaguauuuuuccaauucuuuccucacuuuuuuaguuauauugucauaaacacucugcaaucuuuuuuaauccuuuugauacugaaguaggugcuguuguuuuuucuauuuuuuuagagacagggucuugcucuguugcccaggagguaguucauuggugcugucauagcucacugcagccuuaaauuccugguuugaagccaucguccugccucagcuucccaaguagcuaggaccacagacgugugccaccaugcccagcuauuuuuuuuuuuuuucuguagagacaaggucuggcuauguugcccaggcuggucaaacuccuggacucaagcaguacuuccaccucagccucccaaaguguugggauuacagacgugagacaccgugccuggccaaugcuguuuuuaauccccauuuuacaaacugagacagagaaguuaagguuauacaguaaagaguagagccaggauuugaaccugaccugaccauuuguguguuaucuucaguaauuguugcauauuaguauaauuucuuacuaauauuaaugaugaaguccuauaacuucaagcuuuguugaaaguuauauucuuaaaucacuauuagaauuuugucuuugacuacaaauucaaggaugcuucacugaaccuaguguuuugaacugcaggacuagaaugggucuguucuuucauugaaaaacuauuuguauaccugcuagaugcuacuuaguauuuuggacccuggugaugcagcacagcugacugaguuccuaguguggauccugugucuuggugagggaagaaauaaguacaguuacauaccauuuaacaacaggguauguuuugagaaaugugucguuaggcgauuucaucauggugcaaacaucaaagaguguacuuagaccgagauggaauagcccauuacacaccuugguuguaugguauagccuauugcuucuaggcuacagaccuguagcauguuacuguacucaauacuguaggcaguuguaacauagugacaaguguuuguguaucuaaauacagaaaauguacagugaaaaugugguauuaccgucugaugggaccauucucacacauacgugguccaucauuggccgaaucauuauguggcgcaugacucuauauaguagggcccaguaauacaugccuugaaaauaaagcagugugagaggauaaagagcaguguguaggugcuacuuuaagaggugccccgggauggcuucugguaaggagacauuugagcugagacuuagauagagugagauuuggagagaucuuagaaauaucuuaauucaacacucuguagaucugcuacauuaaggucuugugaaauuuguaacuuguucauugauuuaaaaauucagguucucugcucuucuuuuuuuuuuuuuuugagauggaguaucgcccugucacccaggcuggagugcaauggcgugaucucggcucacugcaaccucugccucccagguucaagugauucuccugccucagccucccaaguagcuggaauuacaggcgccugccaccaagccugacuaauuuuuuguauuuuuaguagagaugggguuucaccauguuggccaggcuggucucgaacuccugaccucgugaucugcccaccucagcgucccaaagugcuggaauuacaggcgugagccaccacgcccggccccucugcucuucuuaccaaagcuaaacugcaucucuuucaaaucauguauuaaauuauaucuuuauacucuuuacagacaguauaagguauauuuuaugguucaagcauaugcauuucuagaaguuguuuuaaaaauacuuuuguuuucuccucucgccuugaaaauguaguaguaacaagaacagugaguuugugugaaucuuuuuuuccaaugccuucagccuuuuuucacugcucuugagugaugcagcccuguacuugaugucuuaauuuucauuaguuuguugaaaucaaugaaagcagaauugcauuuauucuauuuucccacaguucuuuaugggaaaaggcauuuagaaucuguuuguccaauuugagaauugugaacugccagaaaaauaaggaaguagcuaugaaccuagcucuguguuuuugacaaaauugguaacacugagauuguccauguauaugguagcuuucuuaauuaaggaauuggccauuuaaauacaugaagucagucuuuuugcucacagcacauagaucacugcuaugccuagaggugguagagaaucaauagaaggaaacuuaugagagcuauuuccuuuuuugcucuaugaggaaguuaagaaccacauuuugugcucagucauagcaauugugguaaccauuacugugaguguaucuggucaauccuuucaucuccuggcccugauuuucuguguuugucaucauacauaguuucauggcagaccucuucauaucuuguuuuucaaggcauuccugaguaaauuugccagugcaaagucgcugugcucagagacugaggcacagagugaugaagagauugugaucuugccacauccuggccccuguggcauugccagaggguguuucccuuuugcucacugaacagcaucuuucagcaaauccucugguuuagaaguagcauuuuauagcauaagcccuaugacgauggcagccuaugauucgcuuuuucacguauaucuguugucauuaagaauuacaucuaccuuuuaaaagaucuacauacugcuaaaccuguucaacuucaggugauaaggguuaauuauuauuuuuuaaucucuggguggaggcaaaaauggugugacuuggguuuuagaaccuaccuggagcaugacuguaggaaagucaaggcucuucaaugugcaccacucaauguacagacaguuuagcuucacugcacucaauauauacuugacugacuuuuaaaccuucucccuuucacaaugaguuguuuuaaagaggucauuuuguuugggcucaucuuaucuugcagauagaauaaauaauuuaucaaagcggcagaauuuuaauacuuugggugaaugcuuuccagcauauuccuuuucuuauguuuugguuuuacuuuuuuaucaaaauacaacauauauacaggagagugcauauguccuaaguguagauagcucaauacguuuucauaagcugaacaacugauguaaucagaaagaaccgaaaucaauagcugucuguuuuuaagauugccgauagucucauuccaugcuaacccuaguuucauuugggaaauguuuugucugauuuagaguccagcaccaugcaguggacuuacacugcacaugugcuggcauucuuuccauagacucucacuuaggaaucaguuggugcaucucaggaccaccucugcacaagaagaccaguugucuucucuugcaacucuucccugcugguguuugcaauguucucagugacucuguguucccuugucacuaaucuuuucaugucagugccuagcucuguuucagcauucccuguggaguugauguugucugccaguaugugugggcuuaugagaaagcuuuuagcucuuaaaaguaugugucacuuugagcaucugaugcaucuucaaucuaguuuauaaccuuaugcuaaguaacuggccuuuguggggaaggccuguuuuguugguuaaggcauccuucuucuguucuguuccauguaauuugcuacugugccuguuuuuccaucccgugcagugaauuccuuuucuuuugauucuuuacauauguuuauauuuguauguggguuaagauaccuuugauccuauuacauucaagcuuuguuaaaaaacaaaaaacuucugucucuuuaagauggcuuuuguggauccuuaguuccuauggauuaauuauauguuuacuuuauaauuuaauaaucagcaggcagugucuauuuucaauuugcuuuacgauaauacaucucagguaccgaugaauauuucauuucauuaaaugaagcauauaaauucuucagagcauuuuuccuguuauuacacucucaaaggaauuuaccacuugggaccauauuucggggccauugagcaaugcaguauaugaugucaacugugguugucuuuuuuuuuuuuuuuuuuuuugagauggagucuugcucuguugcccaggcuggagugcaguggugcaaucucggcucacugcaagcucugccuccuggguccaugccauucuccugccucagccucccgaguagcugggacuacaggcgcccgccaccacgcccggcuaauuuuuuuguauuuuuaauagagacaggguuccaccauguuagccaggauggucucgaucuccugaccucgugauccgccugccucggccucccaaagugcuggcauuauaggcaugagccaccgcgccuggccaccugugguugucuuauaagugcagaaauugauaaaagcaaaaggcacuacaaguugauaccacacagccaccuggccuucagguaguucuuucagccacaagaauucugucuucucuucgcagguuuacccuauaccugggguuaggauugucaauaaauaucuggcacucuacuuuuaaguuguagcucauccaagggaaaagcccagucauccuuauuuucaaguagcucagugugcugucuguuauaacuagguggucgagugauaagugcuacccagcagcuguugauuuccuuauaaauuggccauggguuugccacuuauaagcuuucagucaguuuucucacacacauggaugugugagaaauacaugcuacugccaaugccaccuucucuccuuccuuggaggugacgacugucaucuuauuugacuaagaagcagugagaaaacaacuuccuugcuccccaccaccccagcuacuggccugcccgcagauggacugguagauuuugccuucuguccuguugugguggaugaguggccggugccucugccuaguucagcucucuguucacuggcucucauuuccucuugucuuccgucagcauacagauggucuuaauaaaacuaccauccugaaaauacaagcaacuaagaugaccacacaccccuccagccacugccccaucccucugccuccuuuuacagcagaauuccucaaaggagauguucauauggacugccuccaccacuccacucucucuuggaccuucuaugguuagcuuuuguccucgucaaugugcugaaacugcucuucuuaaggucaguugugugugagguuuaggaggagaggaaagaaguuucaagacacugcuauaccuaaacuguucauuacuaggacccagcauuggcagaaggaguugugacaaauguaccauguucuucauugcuguggcaagacccggcugugcuaugucuuuguuuugugaccuuaaacauguucauuaacauugaguuuauuuccccauguguacagugggcacagugugccuuguaucuaccuuggaggauggagaaucaaaagaaaugagguuuaugaagguauuuggaagcugggaaguacugugaaggccaagauaagcuuaaagaaagcagauagaaaaauuuaacaaaaaaacacugcgauuuuagccuauaagccuauacuaacauuuaacaauccuuuucugugcacagggcuuuauacccuuuauucuucacaguagcccugugaagguaucugggggugguuauuucuauuuugcagaugaaggagcugaggcuaagacguacuaaaggacuugcucuaagucaaacagucagggaagcaucuaaucuggguuagucugacuccauagcccugcccugagccacuguuacauugccuucaaacuaauuaauuaaguuugaagucagagaaauacuagaauuaaauauaagaccuaguucuuugaaaauacugcuuaagauuagacaguuaucuagcaagccuaaucaagaaaaaugagcagaaacaaguauuuggcuugaggaauaagcaaguauaauaaauaugaaaaucauuauaauaacuguauccagcuuuauggcccagauguagaaccuuucaaagaaauggauaguucuuuuaacaaaagauaaauugcuaaguugauucucccacuaucucuuaaauacucaucuucaccaggucaacucuucucuuauuaaacguaagcuucuuaagcuuucuuuuucuuuucuuuucuuuucuuuuuuugagauggagugucgcuuugucacccaggcuggagugcaguggcgcaaucucggcucacugcaagcuucgccucccagguucacgccauucuccugccucagccucucggauagcugggacuacaggcgccugccacugcacccggcuagguuuuuguauuuuuaguagagacgggguuucaccguggucucgaucuccugaccucgugauccgcccaccucagccucccaaagugcugggauuacaggcgugagccaccgcacccagcccccuaagcuuucuuagagacuguacuuacagucucagcuuaucauccaccauaaguuaaugauuaucaaaucaucacauccauaucuguaguauuuaccuuucucuggacuuucuuaacuacaugcuagagagcuuccagcguaaucacuugacucaagcccaaaguuagcucuugacuucccucuaaaaccucucuuccucuuaaacuccuuguuuccguugauggcaccacuucuucccucauugcacaaacuggaaaccugugucuuuucccucuuucugugccuaauucuuccucaaggcccucuccuuuuuacuugcuguauccuuuagaccgugacccucuauuucaacccgauggcugcugccuccauucagacuuugcucauuuuaacuggccauggccucccaccugcccccugcucuacuugccccuucucuccuuagacaccuguuagugaugucgccuccugcuuaaacucauccugccuucuuaguuuaaugcuaagaagaaagggaauaaaugaacuagaugcugaacuugagcugcgagaagagguaauaagggaaauuagaaggccuaauacagcaaagcugguauaaaugaauuagaaauaaagcagcaguggaauugagaaauagacccggguuguuuuuuuaaaaaaagaaugauuaagaaguucuggaggucagugugcauauaccuaauacuacugaaccauacaaacuaaaaauggcuaaggcgauugcuuuuaugugauguguguuuuuuuuuuaaccacaauaaaacaaaaaggccccccccccaccaccauaggaaaacaaauucuuaagugauaaaaaaaagaagaauaaaauagauaagccugaugaggugacuacagaaagagggagcaggugcaagugucaguugugaaugagaggcaugcgcagagcuccagaggccaugagaacuuaagaggcaacugugcagaaaucucugcuaagacauuaaacucugaagcagugaagaaauguccagagaugauguagaagaacaagauagaauucugugaugcguuuucacacaguuucuauaguaaucagcacuaacuuuacuuguacgacguaagcaaggaagaaaacuaaugcuuuuccuauccaaggaaauuuauacuauuuauguacagcugguugggcuguaauuauuuauuauauuaaguaguuauccuuuaauauaaucauuuaugauaguaaaguaauuaaagccauagugaguuaaauauuuuaagaucgaagaacaaauuuaaccuccuguuccacacaacuauaguuauaacucuagcaacuauuuuucuauugcaaccuuagaagauacauacauaguuauaaaaauuuuaaguaaaauauuagcaagcaauuaaaagaaugaucuaccucaaucagaguuuguuuuagaaguacacagaugguucaacuugaaaaaauuaaauuaguuuguuaauaggccaaaggagaaaaaucauagaaacaucuuaaauaaauuucaaaagugcuugauaaaggucagcaagcucuccugauuuaaaguuucugguaaaaaaaaaaauagaauaggaaaauacuucuuuuauauggugaaguacaucagucucaacccauagcugacacagagcagcuuuccacuggauguugauaaauguuaggugaaaaaguuuuaucaucaaaaguugaugaaaucucaguuauuaaaugaaguauuaaugucaggaauaagcaggggugccuguuaaucaguggcguuauugaguacuuuuuggaaguuucaucuaguauaauaaggugcuaaauuaauauaaauauuuuaaaagaccuugauaaaauuacgugcagauaauacaguuaccagcugacuaaauggagacauuaauagggcuguaaagaguucaguaaugugggcagauaaaauauucagcacuaggcaguuggacaaaggauuuaccaugugcugguauuucugccugacugcucucccggugccauagccucccauggugaaauccauaauuucccucagguccccauucacuuauucauggcuaagagcacagacuccagaaccagacugccuagguucagauccucccuccacugcuuugcuagaggguagcgucaggaugauuacugcagguuccucgggcucauuuuccucaucuuugaaauggggauucuaagguugccuguacacgguaacuauguguuagcugguguuauucacguccucgggaaacugaccaggccauaucuucugacugugcugucauguguagcucucacacuguuguugguuuauguuucuuuguguacuuugauugcuaucaguuuucccacagggaacuauaaugucuuuguagaagaagggucauuucugguuuugcucaguagaggcuaacacagugaugggaacauaguagaugcucaacaaauauguauugaaucaaugguuaucaacccaauuuaaaaaaucacauguaaauccuauauaaaauuuaugaaguuucacauaguuuaauaaaauauuuaaauaaagagaucaaauuuuauaaagaaguauuucuucuccuauuaaucuacaauuuuaaugccauccuaacacaaaucauagagagauuuuuuuguuuuggaacuuaaaaaacugacugaaguuuaucugaagaaagaauguuuauacaaauagccaagaaaguuuuggaauaaaauugauaauggcuuuguuuuauauuaaaauguauguauugugaaucaaaauaucacccucuaccccauauguacaauuauucuguaucaauuuaaaauaauaaaaaccaaaaaacauuuauuuauugugaagcuacaauaauugaaacaaugugauacugaaaucaaaacaaacagaucauuauaagggauuagaaaguguggaaacaaaaguuucuuauagaaaacuaaaaauuuauuuuaaaaauauuaaaugaaaagugauauauaauccuaccaaguuuaaguaauuaggagaaaauuuaagucaggugcagugauucaugccuguaaucccaguacuuugggagguugaggcgagaggauugcuugagcccagguguucgagaccauucugggcaacacagugggacccugucuccacaaaaaauaaaaaugaaaaauuagccaggugugguggugcaugccuguguucccagcuacuagggaugcugaggucaaugcugcaguuagccgagaucgugccacugcacucuagucugggugucagagugagcuauuguaaacacugcugcagcaaauauuggauugcagauaucucuuccauauacugauuuccugucuuuuggguauguacccagcagugggauugcuggaucauaugguagcucaauuuuuaguuuuuugaggaaccuccaaacuguucucuaucgugguucugcuaauuuacauucccacugcaguguacaaguguuccccuuucuccauauccucaccagcauuuguuauuaucugucuuuugcauauacaccauuuuaacuggggugagaugauaucucauuguaguuuugauuugcacuuuuugaugaucaaugauguugaccaccuuuucauaugccuguuggccuuuuguaugucuuaagaaaugucuauucaaaucuuuccccauuuuuugguuggauuauuagauuuuuuccaauacaguuguuugugcuccuuauauauucugguuacuaaucgcuugucagagggguaguuugcaaauauuuuaucugauucuguggguugucucuucacuuuguugcuuguaucuuuugcuguggggaagcuuuucaacuugacaugaucccauuuguccuuguuugcuuugguugccuguguuuguggguguuacucaagagaucuuugcccagaugaauaucauggagagcuuccccaacguuuucuuguaguaguuucauaguuugaguucuuggauuuaagucuuuaauccauuuagauuucauuuuguauauggugagggauaggagucuaguuucauucuuuugcauauggauauucaguuuucccagcaccauuuauugaaaagacugccuuccccaguguguauucuuggcaccuuugucaaaaaugaguucacuguaggcguguagauuuguuucuggguucucuauuuuguuccauuagucugugugucuguuuuuaugccaguaccaugcuguuuugguuacuauagcuggauuuaaauaaucuuaaagauuuccuuuaaaagcaaguauagaaacagauccuaaugucuauaauguauuauaaagguggcauucaaauugauaauuuaacaaguggugcugggacaacuggcuaaccauuuggaaaauagauaauuaggaauuuuuuucaauaucuuuugcaaggauagguuuagaugacuuaaaaaugagcaaaggauauaagugauuuacaaaaguggagauacaaauggccaauaaaccaaaaguuuaacuuuauuagugguauguucagauugggaaagauuaaaaagaaugucaguacucuggagggaaauggaccuucucaaacuucuaguaggaaugaaauuguuauuauaugcuaggaaggaaauuggggcaauauauaugaaaaauauuaaacuugugcacacccuuugacuuggcaauuuuauuuguuggaaucuauuguaaguggguacauuuucaaaaauauaggucaagaauacuuacugaaauacuguucguauuaagaaaaaaguagggacauccuaaguauccagugauaaaaguaugguuaagugcagccuuuuaaaauuauguagguguauauuuauugaaacugaaauggauuccacaaaggagagggauuguuagaauaaggccagguauacacauugcuuagcacagugccuggcauauaguaaguucucaaaucuuagcuuagaaaaggcaggagaaacagguuauaaauguguauguuuccaaaauaucuuucauugagucauuauucuccaaccaucugccaggaaccauuacuaucuucauuuuugugggacuaaagccuuucguugggguucagaucagacuuucugcagucugacuccucaccuuccaaacucauacuuuuucuuuuccaacacaaacucccugcucuagccagggaguaggagucuccucgcugcccuuugcauuuccuugccuuuguaccuuugcguguaccacucaucguccuauccggaauaccccuucccuuucucugccccagucuaaauccauccauucuuuuuucuuuuauuuauuuauuuauuuauuuauuuauuuauuuauuuugagacagggucuuacucugucauccagacuggagugcagugguaugaucaugguucacugcagcuuccaccuccuggacucaggugaucuucccaccuuagccucuggguagcugggacuacaggcauguacuaccacacccagcuaauuuuuucuuuuguagagaugguguuuugccacgaugcccagguuggucucaaacuccugggcucaagggauuggccugccucagccucccaaaguccugggauugcaggugugagucaccgcacccagccuccauccauucuuuuaaacccugcuuaugccuugugaaauuuaacauugcagcuucaguaaugguucaccaccccagggcuucuucaccauaucaugucuuguuucuuauuguuaagauauacaacacgugagaauuuagcuaaauuauauguucuuugaggacacagacugauuuugauauuauaauuuauucucucccucagaugguuccuugaacauaauuuaaugcucuuuaaugacugcugaauuagaacauaucuuuuuuugcaauaaucuaucaaggugaaauguuuuaauauaaaauuaaccauuuuagagcaaacaguucaguggcauucaccaugugcaaccaccccaaguuguuuucaacacuccaaaauaaaaccccuuacucauuaagcaguuucucccuagucccuccuuccccuauccccggcaaucaccaaucugcauuuugucucuauggauucaccuauucuggacauuucauauagauggagucauaugauaagugacccuuugugucuggcuucuuccauuuagcauaauguuuuggaaguucuuccacguugcaguguguaucaguaguucauuuuuuuauggucgaauaguauucuacucuguauacaccaaaauuuguuuauucauucaucuguugauggacacuuggaccauuucucccuuuuggcuacugugauuagcgcuacuaugaacauguauauacaauacuuguuugagucccuuuucaauuuuggggguauauaccuaggagaagaauugcugcaucauauggaaauucugauucgcuuuuuaaggaacuauuuuccauaacugguguaccauuuuacacucccaccagcaaugcacaaggguuccaauuuuucuacauucuugcuacugcuuguuguuuucugcuuuuugguuauagccauccuagugugugugugugaagagguaccuuauugugguuugauuuacauuucccuaaguaguaauuaguaaugauguugagcaacuuuucaugugcucaaugccuauacagguccuuugccuguuuuuaaaauuguguuguuuuaguuggguuguaagagcuauuuauauauuuugcauacuggacucauaguguguaucauuuuuuuuuuuuugagucagaguuuugcucuuguugcccaggcuggagugcaauggcacagucucggcucacggcaaccucugccucccggguucaagcgauucuccugccucagccucccaaguagcugggauuacaggcaccugccaccacgccuggcuaauuuuuguauuuuaguagacacaggguuuugccauguuggccaggcuggucucgaacucgugaccuuaggugauccgcccaccuugaccucccaaagugcugggauuacaggugugagccaccacgccuggccuaggguguaucuuuuaacauuuaagucucacugguuuggcuuauucuccuuuugugauuuuuuuuaaucuaugguaaaugcugccccauagauuguucgacugaaggaucucaacaacaauauuaguuccacauguguccugagacaagcauuguacuaguacucuuucuacccuguugccuuuagauaaguuacaaccuauuuaaaccucauuuaaccauccaggaagcucacuggcuuugcucauuugagaaugguggugaggaacaucacuaaugguugugcaagauacuugcaaaccguaaaacauuacccuauuauaaagguaggauacagguugcuacuucuauuuuuuguuuucuagagacagggucucacuguuugagacccagccugguugguuugcuguugcccaggcuggucuugaacuccuugccucaagcgagccuccugaguugcugggauuacaggugugaggcacugugcccagcugguugccacuuuuaguguuauucacaccuguucuuauuuugguucuguggagucuaaaaauucuaauucauaguuaagcaccuaagagcauaaauuaagguguagagaauaacaaagaaugcuugccuuucagagucauccuuuuugaacuuccaugacucagacugcgaacccaagggaucaucacccugugacuccuugcuuucccucaacacugagaagauucugguaugcaucuucucucuguguucuguuuuuguaaccugaagcccagugauacuaguuccaaaaaguggaagucgccucugucaacuagaaguugggccucguugagucuacaugcauaggauaaagauaggucgucugguauuuugccacauugaauuaugacuuaugaauuggaugguugauuauucuggacauagaacuuuuaauuugcaagugucaagaaauaaagggacauuauaguuaaaccuuauuucuagcagccuuguguauuuguagguauaguagacucuuauuuuuccaaccuuugcauauguggguaucuuuuguaucuauguuuucuaucaguaccaacuaaacuauaccguggaccucuccauuucaggggugaauacuugacaguagcuaauguuugcgucugccuauccauguuagugcaucuccuccuccagccuggcugccucaagagggaugggucuucuuuuuguucacacuuaacucuaugaagcugauuguucuuuccguguccaaguuuaauguauuuuuucuccaggccuuuuccuucaacaucugcauagauacucuuugcaucuucgguuuaaaauuuccuuuuaagauacucuuuuuuuuuuuuuucaaacaaagccuugccuuuucaugugagaacuacugaagauggauugaaacugcaaacuagagaaugaucgucugcuuuuaccuaacucgcugcauaguaaucaacuugauauauggaaaacucucgaauuagacuugcccaaaaucagaaggggcugucuuguaaagcagugaguuggucaucucugaaaguguuuaaguagaaguuggauaaucccaucuuguauaggcaguuagauucuuagaguuaugaaagucuucuuacugagaguaguuaaaauauguucuacuaguugcauuuccaguuuaagcuagugcuagcuagugaccuaugggagaaagcucguuagucuuggccuuuccucuucccaagguugaaauaugggacuuagacuauucauuuauugauccauucuccagauauuuauuuggcaccuauuacaugccaggcauugcacuaggugauuauuaggaauacagcaauaagccagauaguguuggucucugcauuauguaccaggcauuguacuaggugaguguuaggaauacagcagcaagccagauagcguuggucucugcaccaugacuuuuauacucaucaaccaaaucauuaugcaaauaaacauaaaagugugauuguacacaucauaugaaggaauagcaaagggucaacauaaacucccuuuauuuagggguaucaggcaauacagcuuucaggaacugaaguguaagcagggaugagaaaguuggauugaaauuagucuacuagugauguugagcuguguguucaaacuuacuugagcauagcuucucaacucuguccagaggagauacuauagaugcaguauuagaaauaggaaagggucuuuuucaucaagaauuugauuuguuguuuggcugggugcaguggcucacgccuguaaucccagcacuuugggaggccaaggcggguggaucaccugaggucaggaguucaagaccagccucaccaacauggagaaaccccgucucuacuaaaaaauacaaaauuagcaggggugguggcgcaugccuguaaucccagcuacuugggaggcugaggcaggagaaucgcuugaacccaggcggcggagguuguggugagccgagaucgugccauugcacucaagccugggcaaaaagagagaaacuuugucucaaaaaaaaaaaaagaauuugauuuguuuguacuguacuucuccugcccacuuucuagugaauacaaacaacuuaaaaucagauauauucuucaguguacucuugagguugcuuaguaaaugauuucuucuuuuuguagaauuucauuucuguccucgucccuauaucuuuuugcagaaaggcuuggcaaaugguagacucuccucaaauaugaaauaaagcaauauuuacagacucuuuuucuugccucuaagcaauuuacuugcuuuuuuucccagcuucacugagguguaauugacaaauaaaaauuauauauuuacaauguacaaugugauuuuauauacauauauguugugaaaugguugccacaaucaagccaucuaagcaauuauuuauuuauuuuugagacagagucucacuguuuugcccaggcuggggguacaguggcacaaucagggcucccugcagccucgaccucccgggcucaagccauccuccugccucagccccaaccaaguagcuggggcuaucaguguacaucaccauguccagcuaauuuuuuugaacuuuaguagagaugaagucucacuguguugccuaggcugaucucgaaauuccggagcucaagugaucuuccuaccuuggucucccaaagugcuggaauuaaaggcgugagccaccaugccccgucuaucuaagcaauuuauuaaggagaaaaaucuuuugcaucugugaacuugucuguaaacauuugacaaagaggaagggcucauguucuggucacacccagcuguauaucaucaguaacacccuuacgcauuguuaaaucugccacaucuugaagcuuuaccagguuccagguguggaagcucccagcugcauagcaaaacuagaaggagcugauaagaguuucccucucgucaucaagguucuacugaaagccauaaaguguaaaacauucccacaauaguggcauuuucuugcuuccacuuaaaucaaauguagccuuaauuuuaauuuuuuaaaauacagauuuuaauacaaguuuucuuucauuugugauagcuaaaauguauggguuuuuuuuuuuuuuuucccagagccaggccaagucuauugcagaacagaagagauucccguuugccacugauaaugacagcacaaaugaagaguuagguaagacuugaaucugguaauauuccuguaauauuugccucaaaguuuugguuagaugcauagcaggaagacaggaugguaaggaguagagagacuggcuuugccaauuugagcuguuugaucuugcauggagcauucagcccuugugacauuccauuuauuauaugucaagagaaaaaaaaaagguuuggauggaauaaucuuuuccagcucuccauuucuauggaaauuaauaauuaugguaaugagcucuuaugagcuguuucgauucaguaaaagguuauuugugugcugucaucagaugugagcaaugaagaagugaaagcagacuaccuacuuuucuguauagugaaauagcuauguuuaaguuauuuuaacuuaaacuuuaaguuauuuuacucaugaggcuagugaguuauuuuugggccuaagaauguggguguagaaaaauugaauucauucguaccugcacgagucacauaguuugguguguucauugcauguuuuaaaacaggcugguuuugucagugucagauaugcacuggguguguuucccucgcugucuagugaguuuacauuugaagaaguggagacaaaauugaauacagggcugagcagugcaacugggcaaacuauugaagcacauguuuucgcauggggcccagucaccaaagcaccugcaggaauucuucucuaucuaauuuaugcauaauuauuuuauccuuaccauggucauacacguuugauauuaagacuaagugcuccuuauauuggcuucuuuccuguuagugcagggucuugcucuguggcccaggcuggagugcaguggcacaaucauagcucacuacagccuuaaacuaggcucgaaugaucuucuucccuaggacuccugaguagguaggauuacaggugcacaccaccgugccuggcuaauuuuuuaaaauuguuuuguagagaccaguacucaccauguugcccaggcugguaucaaacucuugggcucuaggaauccuccugccuuggccucccagggugcuauuuugaaaaugcuaauuacuuuauggugauauucuuugaggaggcuuugaggacugcccuuuaaggcaucagaucuggucuuuucugaaguccuuggauucuacuuagaguaguauuuauuuauugaauaaugaguucagagccugauaugccaggucuguuuuguucuccaagaauaauccuaguagacccugggguaguguaggcccugagcuggccuaugaucuuuuguauccaguauuuuuucuugaaaaaaaugacaucugugaacauauacauugcucggagaugugggguugcuggugaguagagauuucugagagaaguccaguuauaccagcuuuuccuuuaagucuuuagacuccuacaacaaaauuuagauccuaauauuuguauuugcacaagauuuggguuaugauuauucuuuuaugaauggauacuucugcguuuuuuucacaaaauguugagcuuuagguggagggauuugaaaacugcauuugauuuuaaguggaauucaaucacuuagauguggacagccaucuaaauauguuccuaaaguacaaaauuuaucucuaaaaaucauauuuguuuuuauggcucauugauugauuuguucauucaacagauauuuacugauuaugggauaauaaauaggaaauaaaaauuuagauuugaaaggaaacuuuaagaaaauuuucuacaggcuuauuaagcaagaccagacaguuaugagaagugacugagguccccacgaucacacggcuggugaguggcagagccagaauccgagcucacaucuuggcuuucugaucaaaucgucaucuuccugcauucaaaaaaguacaaguuuauguuuuuauccauguucaucugaccauuaaggaauuucagccccuuggccaucccuccagugcacagugguuugggaacugacuugaauuuucucagcguaccgggcugccugggagguuaggcucuggagccaggcagcuugcugccuuccucucacucacugcuuaugguccuuggacagcuaguuuaaccacuuucuacuuuauuuccuugucugcaaaaugggguuaauaauuguaccuaccucauugcaguggaggagcaaaugaguuaauacugguaaaggauauuacugugccuggcacauauuaagaaugcaaugccuguagccacugugauucuugcugcuguuuuuacuacuaauauuacugccuccaccacccccaccaaaacuaaagguauccucucguuaccuggagguuagcuaacugaacgguaucuauugucagcauucugagcaugaauuugggcuuaauuuaucuuuccaaagaaaguagggcaaaagggcucucuuuuuauuuugaagaaugcccccagaagugcuuauauuauuaugguguucaauuugaacuuuauuuuauugauuuaugaauguauuuuaaacucuuccugcauuucguuucuguuucugcuuuaauuuuuuacuccuuuuuuuuuuuuuuugagauggagucucucucugucgcccaggcuggagugcaguggcgccaucucggcucacugcaagcuccgccuccuggguucaugccauucuccugccucagccuccugaguagcugggacuacaggcacccgccaccacgcccagcuaauuuuuuuuuuuuuuguauauuuaguagagacgggguuucaccguguuagccaggauggucucgaucuccugaccuugugaucugccugccucagccucccaaagugcugggauuacagguguaagccaccacgccuggccuauuuuuacugcuuuuaacugucagaaaguauaagcucuuaaugacaguaaaaguuuucauugccuaucuucuugaacaccuguuagguccuaaaggauauugcaguaaagcuuuacagaagagcuuuuuugcaaauaaauguuaucaaaauagugauguugagugaggaauaaaauguuuuucagggauuuuggcggggcuaagggucaagcagucagggcaaauuuuauagauggcaauguaaucuagcauauucaaacacugguuuuuggaugggugggagaauuuagucagaauauugcuguguuuucagagauuguccuggcucuaauuucaaaauaccacuuuccuaaacaacgugauacaaagugguucaucuuuaguguauauuuugaguagcguuuugacuauauuuugaauggaagaaguaggaaaaagacugucauugcguuauagugguuuguauuauccacaguuaagcauuauguuaauacauuugagucccuguuuuuguucuuauuagguaauuggcaguaaauucagcacucccaggaauugagauuugugaugcuauuuggguauuucucauaacauucacaguaaaaaaucacauugccauguuauguggacauuauuuaggcuuauuacuagcuuuugugauagcuaggagacaucacaaagauuauuugggauuugaaaaugaaugauggccuuagaaaaagaucaguaucucuuguaggcagauauuuuauagaugacuuuaacaauuuaaaucuagauggaacuggaaggcugauuagcaaguguggaguggugaaaguagaagaauucagugacaccuuauuaacuucuagguuuucuuuaacugcuuccagugcuuggagcugccuuuggagauuuaccaaagcauuuaguuauugauucuaguuagaacuacuuuauucuuuccuuuaauauuuuuguauuuuguuucauagcuauugcuuaugucuugauuggcaguggucuguaugaugaagcaauacggcauuuuucaacaaugcuucagguaaauuuucuucuuauuuauguaauuuugaguuuauggucaugacaaaaauauggacuaaugaacagcugaagugcuguaauacgacauguuuuuaaauuauacaagaaagugaaagaaauugguauggacugagcacuuucuugcugccaggccuugugacaugcuuucauuuaaucuuuuaaaugaaagauuuuaaagaaaacuucauuuuaaaugagaaaagggaaucuaaucaggucaagcaauuuacucauagucucccgaccaucaaauugcagagaugggauucaaaugcaagcuuuaaaaaaacauuagcuucaguucacuuuccucucuaccacaauaucucccaugagauacagacacuggaaauucuugaaauuccagcuuaauuucacacaggaguugaucuucaugauuaacuuaauuucuacucauagguauguuucucaccuuaaaguauaauuaugagacuccucagugaaguauugggucuuuacugauugguggcugcacuaaagucuaguuaagauaaagcauuuaagcacugcauguauaagaguugcaaagaaggcugguagcugcccagcaucauuggccuuguaucuuguaucauuauucaacuguaugcacuguuggugccuaaccauuuauugauuguugaugugucuuuccagugaagaagacauggauuuuagagcuagagaugccuuaauucuaauccacuuugcuucuugcuaccaaguuauuuaaacuccugaguuauggagauaauaauaacuaccuccaaaaaaauucuuuuuugguuuaaaugaaauguccuauuaaaguacuuaguacccagugccuggcacauaguaagugcuuaguaaauuuuggcuagucaaaguaccauucugguauauucaucuguguuaaccguagcaagugccaacaaaugccuuccagucuagcaggcagacuuaauuuaaaugauucauuuuggaauuuuagcucugcuuuuguuuucucuuuaaaaauaagguuaauuauacugauaauaucuucauucucaaacaauugaugagauauuuuuaguuauuacuuugaggucuuuggauccaaggagugguauauuuggguggucauguggaacacuauucuucaguagaauuuaaaguacaaaggguagauuauaaauaguuuaaaaaaccaccuuucuguuaaguauuggcaauguuauaaaagguaagcaaacacuuuuacacaguuaacaccugacccugguuugaaagggagguuuugauacguuuauaggagcaaauaucaguuaauuuaaggcaaccaggcuggaguguagaauccagcagaaaauaggaauuugcagauguauuauuuuauucaacuuuuugaaaauguuauuaccauugugguugaagacaauauaauacucuuaaagaaaauauuuuaaauaauaaaaaauuuccgaauucugccacuuuaacauuguuuaaauuuuuuauuuaugccuuuucaaaguaugcauuuguuuuauaaucugaauauauguacuguuuuguauuacuuuuucacuuaauucuaugcuguaaauguuuaucaguauuuuucuacaaucuuauuuuuaauggcucuauaauaugccuuuguuuuguccauuuauaguuguaagacauuucucuugcaauuguguucagaaaguauauuagcauuuuucuuuuugugcaaagaagauaauguauugaaaugugauaucguauuuucaucaaucucugauacaauggguugcuuucagcugggaaaucugucuuugagaauguguggauuauaagauuggacugcuuugcucgcaguucagacuauugauggggcagggaugaaggcaguggaaaguucagaugcagaagaaugaacuggguggucauuuguaacauauuuuuauuagcagcaagaaugcccuuggcuuuccugcuggugcuuuccucagugauuucucucuccuuacccuuuaucucagugcuucccagcucuuuccacaucauggcagauguggaaauaauaucugcauggcacauggguaaacaagaauaauuuggaggcauccagauaaagcuuugugaaaaucugucacauuuucuuuguaucauaugacugauaaggaauagaaaauucgaagauucuauacuccagcuagagagcaagaaccugucucugaaaaaaagaaagaaaauacgaagauucgauguuaaaugcuaaaauuguuuucaaaaguucuaauaagaaacuugauccuacuuuucuggacaaaacuuuucuauauuagaguuuauguuugaaauugaugcacgcagucucuguuugaguuuucuguugauuucaucaaauucucgauagccagugucaucgagacacuguaaaaguaggugauagcaaauguccaaagaauaguuauugcuucuucuccaauugacugaaaauccuuuuuucaucacaaaucauaauuugcauaaauuauucucuuuaaauuauguaucacacacaugauuauucucuaaaucuaauuacucuuuucuuuuuuguuuguuuuuuucuuuuguuggcaaguguagugauaaaauuucuugcaguaugaaauacauuuuuaucucaauaauacuuuuucauauccaguauuucagcauagugaugaagcuuuucuucaagccuacacagauguugcucuacuacuuuucauucuucacguugcaccugagcuaaauaucacuugagaaccauuuuucucuguauaugcuaauaaguuuuuaccuguuccuugcaggaccuucuagauaugcaaaaaugcaguauuuuuaagccaguaaauguccuuugacaaaucuacaaagugguagcuauucauguacagaauuuuugguuuucuugaguucauuaacucuuggcaaucuuuuuuuuuuuuuuagacagcucaugagcuccaguaugaagcagcagagcauggaauauuauucuguuuauagaagcaggcaacaaauggggacucaggggcuuggauuuuauuagaaucacuguuuugauaagcucauuuaauaugauuuucaaaucuacauauaaaggguauuuuaacuccagaaugacuuuuugauauaaagcucuuauaccuuuccuguugucuugguuucaccaucagguuacaaaccugggaaauauuuccauaauccucgguguuucaaaguguuuauuggaauguuuauucccugugguuugauuuuccuuuacagaaguaucaagguuucuaacugagcacaaugacaggguuuaauagauguuggucugcauuggaaacucuugauuuuuaaagcuuauaaguuaguguugcuucuaugccaaugcccugaagucauuuccaugugugucagugcaucaguaauaguguucuugaguugaaaaguagaacuuuuuccugauuucugugcugcuuugguccucaugcagggauggguuuaacauaaaugcuucaacaauuuuaugagauaauuuggccuuugcuauuuauuaugugaccuugagcucaucugauuuugaucugauuccaguggaacugaacuuguaaaagaauauuacuuccuauuuuacauuagcauacaaaauuggaaacauuccucugcauagaauuuuaaauaacauccuuuauguaaauauguguguucgucacuuaggugaaaucuaauccucauuacauugcuuaucuacugacuguuucgacuuguuuguuuuuagauccagugacuucccaguuuuaauaaaaaagccagccuuguagugguaaauacaguaaauacuguaaaauuuaaagucacuauauaaguaaugaaaugaggauaauauauuagacucuuuuuuuuuugcgaauugagacaucuaaguagacacaacaccauuuaggcaacuguuauaccaugauuuugcaguugcauaaaguaaaauuggaagauugaaguauucauuuucauuucagucuuuuuaagaguauagaaacuuuuuaaagaaacuuuuuaaaaaguuucugaaaacuuuauaaaguauaaauauuauaaaaauauuuugaaaaauugcucuucagagccuaauuuguuuuuaggaauaaacguugguuuuuauuuggaaaaacccaauaauuuacuauggcauuccauaaagaaaaguuuuuggcuuuuagcuaaugauagauaaaauaauaaauaaaguuguaucaacuuuuaaaaguaauaaaaucuguuauuuaaauuuaggaaggcuuaauacuagacuguagauauaacagccacaauaauuauauguccuucuugacuguuaggaaaaaauucuaaaaagaaagaauaaauugggccgggcgugguggcucaggccuguaaucccagcacuuugggaggccaaggcgggcggaucacgaggucaggagauugagacuauccuggcuaacauggugaaaccccgucucuacuaaaaauacaaaaacaaaauuagcugggcaugguggcuggcgccuguagucccagcuacucaggaggcugaggcgggagaauggcgugaacccuggagguggaacuugcagugagccaagaucgcgccacugcaguccagccugggcgacagcgagacuucgucucaaaaauaaaaaauaaaaaaaaaaggaaagaauaaauugaauagagaaaaccuaaauacuuuacagauaagcacaguaaucaauucagugcuguaguaaugaugagaccauggggugacuugaggggaggcccgugcgagggccucuguguggggcacacauccaauccugcagucaagaugaugauggcuaccuuuaggaaguugucaguguucggauauuucagcuguugcaaauuuuugaauggcuguuuuuuuuuuuuaauuuaaaauuuuuauuacuauaaaaauguuccagcugcaagagcuggagggccaccauacgucauucacuguggcacaucugucauagagcuuugccuuccuguuacccuggaucgggcucuuguuuuccauugaccugcaccccacuauuauuagccauguuguccugcuugcuucccuuugggaagaauaggcuuagcagagcugacuuugaucugauaggcaaaucuuugucuucuguguugguuuuugcuugcuauuccuaguauguggcaagaauagcaugacuuugcaugguauuccuagcacauggaaccugagauagcuaacaguaggcccugaguaaauaauuguggaaugaauggcugacauccauacagugaacagugggaauaaaggagaaggagcauauuuauuuuccaggggcgucuggaaggaauccaaaggugguguuugaacugagacuuaagggaucaaaggaauuucuuggggaccgaggcaaugggugaguguuucagacagaggggauagcauuugcaaaugcacugcauuugggaaagcaucuuguauguagggaauuauuaaaugauucugauuucuaggguaugaagugaagcugggugugguggcucacgccuguaaccccagcacuuugggagguugaagcaggaggauugcuugaacccaggagcuugagaccagccugggcaauaaagugagacccccaucucaacaaaaaaauuuuaaaauuagccuggugugaucgugcacuccuauagccucagguacuugaaaggcugaggugggaguuugagcccaggaguuugaggcuguagugagcuaggcuugcaccacuguacucuagcaugggugacagagugagacccugucuuuaugaaaagaaaaaaaaaaaagaggaaggagaugaggcugaacaguaagcaggaaaaugauuaauauuuucugcagagccauuuagauguuaccuuuuuuuuuuuuuuuuguauugugaguugcuacccuuuaguggguccugaaauuaauuggcaagucaagauuagcacuuuuuuuuuuaagugaaauaugcuggacuagaaaauaucagauuccauuguguauaggaaguccuagguauaaccuacugaaacuguuuucugauacauguguguauauauugugcacauguguauguguguacuggauuguaauguaaaauguauuucagugauuuggaguuuaaaaaguuugaaugucacuguauuagguguuggggagucacugaauaauuucaguuagggaaaugauaugaugagacuuuaguguuagaaagauaacucuugguguauaucuggagaauagauaggaagaaaugggaacagguaaggugaucacaguauccuaggugagagaggaaggcuuagaauagggcaguggcugauggagugggugggaggaugcugaucuguucaggaggugagauggccaggauuuggugaggggugugugaccuggagagcaggaggaugccagagcaccagccccggccacgggugugcggggaugccaguuguauuuguagaauaacugcuuauuuacaucuuuuucugauucaccucuuggucaucuggaguaaacuuuuuucuguuaggagaaaagcagcuuggauaauauauuuugaaccauaacaaaucugagcauagguuugguucuuccuggagauguauguuauccuaaagcaagcuuguccaacccaugggccacaugcagcccaggauggcuuugaauguggcucaacacagcuuuguaaaguuucuuaaaacauuaugauauuuuuuuuuuuuuagcucauuaguuaucauuaguguuacgguauuuuauguguggccuaagacaauucuuuucccaauguggcccagggaagccaaaagauuggacaccccugcucuagaggaugagcucacugggcuuaccgccucccaccccagccuggccaggguucgguucgacuguugacuguucugucuucuggcuuuuuugcuacagaaaagcaugacgccagucuuacuuuuaauuccucauuagguucccuuuuuuccugcuccccuuuucccccugacaccuguauccuuucuccauccaaaccacuuacucugccuuccuuuaagccaggaagaauacuuaaauguuuaaagugcuuaucucugggggggcaggcuuauagggcuccuuuacuuucugcuuggugcuuuucuucauuuucuaaaauuuuuacagggaaacauguauuacuuaaaacauacuuuuuucugauuauaaaugagcaugucuguuuuaaaaaauuaacaggaauauaacaauauauuaaguacagugggaauauaucuaguaaucucacuccccagaggaaauuccugguagcauuuuggaguuuauuucugugcaccuaauggcucacacaaucacguauaaguaugauuuaugaaauaugacuaccaucuuucuguaggucuauaacauguacuguuccccgccccucuuagaaaauagcaugagcaaccucuauaccaguuacauauaauucauaaauccagaacuuuguaggggccagggagguaacaugaguaaagaaaguuggugcaguguggcugugauggguaggcccuguggugaacugauggacuuguaccucucaucuauagagacagccagugcuuagcucuagucucuuauuuauugcugugugagaaugccaaaaugugggcccauguuuguuggaucuuuugauguucuaagagaagcuagaaaccuaaaauuguuuaguugaauuuuugcaauuuuucauacaccguguaguccaaucugcugucuggguuguggccagcgauaugccaguuuaccacuggauauagaugcaucucauucuauuugaguagccuuuaggaaaauuuaaaugcguguuaucuucuccuuuauuuuuucccauuuacucaucauugaagugaauguguucauuuucuauaauacuggcagauacccuagcucagauuugaaacugaacaguagauuaaucuaucaaguuuuugcagaguuucuuucuggagaauccagugccauucuauuaaaucccuuagcagugcaagacuuccacccaggaccuuauagccagaggcagcuguuuauucuucuuucuuaacuguauagcgaaccauucagagaaguaaaaauuguagaggcuaaauguagaugagaggcauuucauucacucaccaacuaaccuguguguaaggacucaauggccggggucaacagauguuuuguccuugguccugauagauguuuccuccaccccaucuggauugcagaauaacaggagaaagcaugggagcaggcugcaaaaagagucugguuuuuuauuucaacccauuaguaugaaggguugaauuaaucuccaacagauuucagugcagccucauuucuaguucgucauuguguuggcacugagugguucuuuccuuuucagguaauuucauggauauaugaaagaaaacacauuaguuacaggcauuaccuaauccuuugcucacaucucuuuaccccucugagccuccuucuucucuguaagacaugauugcugaugcugccagaguuguugagaggauugcauuuuaaauaagaugacccugugaaagaaaccagcauguuucugcguaauguugguucccuucucucucuauuauuuuuuucaacaugaaacuuuuaucacauuucauacaaaugagcuuuaagaacauagacuuuucagguuggagacugcguauugacuuacgaguggucguagcauaaagaaguagagcugucacuugcggcauuaacgugcuuuaagcagaaacugauuuuuuguuuuguuuuguuuaugguuuuugacguguuuuuguuuuggucugacuaggaggagccugaucugguuagugcaauuuauggccgagggauagccuauggaaagaagggacuacaugugaguauguaauaguuacgauugccauagcgccuacaugaccugacacagaccaggguuuugcuagaacugcuacuguucauugacccuugaugggauguggagugguaucuaucauuccaguucacagaugagaaaauggcagcuaguaagugguggacuggggauuuccacccagaucuucugaagucaacuuugaugaacuggauagacuaagaaaagcaugagacccugcuugcuuuccuaagagauauucaaugguccaaguggagacugggcaucaauagugcaguaggacuuagaguuugaguuccuuucacaauuauuaaagguuggugaaagaacaaaagguuuuuuuaggcauguaaaauuuaucuuuauuuguuauauuuuauacuuuuugcauauggcguaauaucuuuguagcuguaaucaaauuauuccccuuauuucucugaggaaggcuggagaaggacuauaauaaucauauuuuacacaaacaaagguacuaugguauaaaaaugaagacuccugaaauuauauaguaaaucacgaaaugguguaaguucagcuuuccaaauuuuuagucuaggacauuauaugcaaacuuuuucuauugucuuauuguauacuaaaaauauuugugugaaauugugcuuugagagaaaugccacuuuugcaacuuuuacauuaaaauauuaaaaauguuuaacauuuuuauuuuauuacaauuuauaaaauauuacaauuaauauuauacuaaccuugugcuggccuauuggagaaacuuuguguauuuguauacuuugagacauagaggacugagaaugaauuuagaauugggaaugauggaagugcuuaggaaggaaaugauauuuuacucagagcaucaaugaaugaccagguugaaguugcaguaguaaaguucagagcugccucuuccuaauucucaucuuuuaaaauuauauaucuugagauuaaauuugcauguauauuuaauaaaaaguugcacaugcauuuuuaauguaaaaauaaugugcaaauguuaaagagaauguaccuaaacuucuuaagguauagauuuauaggcuuauguuuuugauagacacugucuugacccauuucuguuccccuguugccacaggucagccucauuucaugugcugguauccacauacucauccauugagauucguugauuccauguuuaaguagauuaaguuuagauaauauccugccaucuguggaauuugugauagguagccgggucuaacauguuauuguugaguaaguagguagacuugagugaguuaaauaauuauaauaucaugacugauuugacauggcacaucucuuacauagaagugaaguucauauuuauuuuuaaacaauugguuacaucauuacuaaauuauuaguuuucucagaaaauuuuuucagccugguuuugaguaacaguaugucucauacuaagcuaaugccuuuucaaggacauuaagaaugcugagcuugcucuguucgaacugagccgaguaauuaccuuggaaccagaucguccagagguauuugagcagcgagcagaagugaguguggcuuucuuuuucccucugucauuauuggauuaguugaaucucaauuuuuuuccuauuacuuuauuauuuguaaauuuuaaugcucccuuaaaacucuuauguuuuucuaugucgguacuuaaugccuuuaagcaugguugaaauuaauagaaaacuauggauugagugauauuccugaacuaacauagaagaguaauauuuaguaugaaaauaugugguugaaaauauuuaguaugaaaauaugacguguacuacuucuauagauauucauugaaaaauauaacacauaauauuuguguuauauuuugaaaaauauaacacagaaaaauacaacacacaaaagaaacacaguuucauccaugucccuacaaaggacaugaacucaucauuuuuuauggcugcauaguauuccaugguaauaugugccacauuuucuuaauccagucuauuguuguuggacauuuggguugguuccaagucuuuauguaacaaaccugcacauugugcacauguacccuaaaacuuaaaguauaauaauaauaaaauuuaaaaaaaaacacaaaaaauauaacacaaaagaaaaacacauaauauucauugaaaaauauaacacauaauauucauugaaaaauauaacacauaauauuuacuguauaugugacauacuuuagcaagacuugauaugacuguuaggucaaacuggaauucacagcccuuggaagcguucauucugcugauguguauguguguaagcacuuaaauguaauucuuaugauauagaccuaggugcauggauacauagaucaagugaggaugaugacagccacaucuuaaaggaacuugacauagagacagauaauauguggugaagaugccauguaauacuggcucaaguagacagaggaggcgcuucuuugggaagagaagaaggggaauguugggaguguuugcugaggcugucggaggaagcgaggcuagagcugauccagucccauggugugguggggacaagauggaggagaguguucagcgcagggaagagagucuguacaaaggcauucuguuuuauguuuuuaagugaaauguguuuguuuuacuuucuuaaaauaauaagcuaucuaggcuucauauguguuaauguauuuagucugaauaaaacaacuuuuaaucaucugauaugaucucauaguugaacuaaagaaaaaauuacuuuuuauuuucucuuuuggaagagaaagcuaguaaaggaagugcuaaagguauaggaauuuaaaaacuguauuuaugguauuuuuguucuuaagauuauugugucuuacaguucagucucuuaaagugaauuuuuguuuuguuggggauuuggcuuuuugaauaaaaucuuucucaaugaaugauuuaauuucuuaccucuucucuauuuugaauuguaacccuaaggguuaagugacuauaguuuaucacugcaugagacuugcugguauuuaguugguguuuaguggcuaauuuggugacagauuugguaaucaucugcuucugguaggggggacugauguuuuuuccccuauauuacucugguuuauguuaaaaucugguaaaucaugaguuaaguauauuuagguaagaauuauuuaacaggucuuuacaauuugcauaucuaauaaaaaacuacuguuuaucaaaaauggcauugguaauuagaaaaauaauuuuuaauugucuuaaaaauguauaauaauauucuguuuuucuggcauuguuugggcaauaauguuacuacauacugaauuuuccggcuaaauuauaacauaccauuuauauaugucagaggucauuuuaugaguaaucuuucacuuucaugcuuucugaaauauucuauauuugaugaacauaaauuaacuuuuuaaaguuacucauuauuaucauauugauuguugugcugggguaugauaauucaguuauguaccuagggguugauaaacuagggagggaugauuuuccuucccaaauacaaccccagcccacugugcuuuuugaauucucagacauauauucaauuucuuuccucuuucugagcuaucaugcuuacuacuggugauaggccugccugaauccucuuucuugcugguuuuaaacuucuguagaguaggaaauuauaaaauucgguagaaauaaccugucuaauaaggauggaauaggcuggacaugguggcuuaugccuguaaucccaaaauuuugggaggccaacacaggaggauugcucaaggccaagaguucaagaccagccuggucaauguagugagaccccuaccucugcaaaaaauuuuaaaaaauaaauuagcagggcaugauggcacaacccuguagccuaaacuacucaagaggcugagguaggaggauugcaugagcccaggaguccgagguuacagugagcuaugauugugccacuacauuccagcuugggugacagagugagacccugucucuaaaacaacaacaaaauaaacccuaauuuaaggacguucauucaggauaaagugcuugggcuuaauugcaugaacacugauacccauuuuggauuuucuuaugucuuuuugguuuacuuuugcauucugaacugucuucuauauuuucauguugccugaauacaacugauugcuggcucaaaagagcuuuuccaaacaggcuugcagauauuuuuccuccuacucugcagaucaugacucaugaguuaaaaguuguuacacaaaagggcuuaaagagcaucuggaaucuuagaaguugucauucagcucuucuuaccauagaggacagagcuaaagaccauggaagacucuaaucuguguccgauaauuugucuauuuuaaugguucaaaguuaucuuucagguuaauuuugacaucuuuguguauagaugccaaauuuugauuuaaaagauaaaaucaagaaaaaaaaucacauugcaggaaaagcaacaucugauacaacccagaaugugaaauagugacaaggcaguugcugcagucauaguucaucagccuccugcuugacuggacaaagauuaguggcaccucagcugguugacuuugaaccccaccgcauaauauagggggucaaggauugcagccugcugagaguaauuuuugaguggaguauggugagguggaauugaagagucaaaaacauugggauuuuaggguuggucauugguauucuuccugauuacauguuugggauuucuagauucuguccccucugggacgaauuaaugaagcagugaaugaccucacuaaagcuauccaacugcagcccucagcacggcuguacagacaucggggaacccuguacuucauaucagaggugacugguuuuugucuugaaguauuuuuaugaugaugaagauuucauuuuucccuugaccucagaaagugacucuuugauagauuugggcuuugacuguuuaguaauaugucugugucauaagaguuauaaaagcauuuucuguagcugaaauuaaacccaguggagaacauuaaguacuaaaaacauuuucuuguuugagcugucagcaauaacuaauucuggacuggcauuuaaaaaaagagagagaaagauaaauuuaguuuguggauuguaugucaaucuuucucgcaaauguccucauagggaagcaggugugcauguugucaaugugauuauuaaacuuagcgguacaauuugaauuucuuuggguuucacagcccaagaaacacacccugaacuagcauggcuuuccagacuguagcuucucuauguaagugacccaagccugacaagguugucuuuuaucaucagaguggcauuuaugauugccacaauuauuucuguggcuuauaguacuuuaaauaacaauuuucugugccaaagaaaauauauuaaaagagucucagcauaacacauuuuaauguuaaucuguggcauaauuauucugggaauauccaguaugauaaaaugcuaguaccagaaauuucucuaacagauuauuaccauaauacuauuugagauaaauuuuuuuguaguugagacagagugcuuaaauuaaaccuuuguuuuucucacaaucgcuuuucuuaaaaaacucccaacuguuugaaugaguaguauaagcacuuaaccaauauauagugucaugaaauguuuccuuuaaagccaaaaagggcagaggaugaauugagauuuuuuuucucuaccagccaaaaauuaggaaauguucacauaucuaaugaauacuauuuuauuuuuccccccacucuccuuuuuguaggacuaugcaacagcccaugaagacuuucagcaguccuuagaacugaacaaaaaccagccuauagcuaugcuauacaaagguuuaacuuucuuucacagaggacuucugaaggugaaaguguugugcauauguguaccauaugaugacucugcuucucuuuugugggugggaggaauuucguuugauugauggcugguauuuauuauuuauugagcuccuacucuuugauggguucuuggagggagauacagaaagggaaaggaucaaagguuaauaaguggaagaaaugauacuuuaccuuuauagaggauacaguuugcaaagcuuuuuccacauauaauuuaucauaugguaaacauacucaagaauguaauauaaacaaagugcuuugaaaauguagauaagaaagauucauuggaacugcagaguuagagaaaguuccaaagaacagguggacuuuguccuggagcuggaagacugaguaggauuaggggguggaggugggagaagaaaagcccuucaggcagagaggagagcgugggugaugacuuggggagauggaaauaugggcaguucacagagugggaaguaguuggguaugguuuaagggagaugaagcuggaaggucgguggagggcagguccuuauccuggaguacugugcuaagcauuuugacuuaaauuugcagaccagaggaucuauaaauucuagguugccaaaaugcauagauuccagcacugagaccaaaucuguaauuuaggaaguagauucugacagugugguggcugaggagaugagggacagaaggacugacuaggugacauugguugggucuaggucagugggcaugaaacuugacccagcuccuugagagaccacaggaacagguugggagacccuucuuugauugacuguauuaguauugcuugagaacugccugacugcugggcagaggagguagagggaaacaggaaagcuaucugaacugacugaaaguaugggcagaaacguggccuccagccuggcccuuccuccugccugggcacucgauuccauguuccgagucugugcggggaacccacugugagaaggcuugugacaggagccgggggccuggaaccugacggggagcugccucucucaccugggccuccuuagugccgcucaaggccuggcacacaguaggugcucucacacaggacauauccaagcuaccugauggaagacagacgggccugagaacgaaacagaggcagccugcacagccaaaaagcaauucauucugacaggagccccagaaggugguacuuaacaagaacuuugaaggcugugaagaaauuuaguaauguguggcagggauauguauucugcagaaagaacagacauuuuauuauugaaagagguuugaggaucugacauacauauauuuggguuguggggagaguguuuaccugugaaaaggcugcacauugcaaauccucaguguuaagggcagugccugucacaaaguaggugcucaauacguauuagugcaauaaugaauuucaaggacagagcauugaaguugauguugaauggucuugguuugagcucucgcuccaagcuccaugggcaaucaguuucuccuuccaugucuauaaaguggaaacaauucuacuuucugccucuuggagugaucgugaggauucaauaaaauacucuaugugaaaaguacuuuguaagcuuuaaacaggaaucaaauauuaauuauuauagauuauuuuaucugugaaaauuuaaaguuuuacagauucuaaaagaaaacucccaucccacuaaaaaccaaaccaaaaggaauuuugcagauucuauuucauaaaccucacauuccuuuuggaaguauguggaggauacuccuaauaaagaccucucucuccccucaggauucagacuggcagccgcaggcuuugagaacaauuucuuaaaacaugcuuugagcagcugccagauagacuuguccaguuuauuuuguaucugcccucuguuccucucaucuucucugacagucaccuuaaauuuuaaaaacucagaacuucgguacucuacucaaauuauaucccuuggauaucucauggaggagaaaaagauuacaaauacaaaaaauaccaaccuauuuguauuaagagguugaaaauauuuuuaaaaguaaacaaaugcaaacgguuucacuuuuaacauuguuacuguaaagccagguuuaggaacauggauggggcucuuugggguauuugaaaaugagaauuuuucagaaaagagaaacuaacuacaaauugcacaagaacugaaauucaguuugauuugcuuuagaucugcaugauaagaaccuagaaacagugcuuucauuuugagcauuaaaagccccucagcaaacuaguccuaccaaguuauuugguacucuguccuuuucaccaugcucauaagcacagcaucagcaaguauaauagaugggaacucuugcuuugcauuuuuauagauccacugucugaggagguuagaguaguuacuuacugacuccuucaucccaacggcaucuccaugagguauagaaggaguggagggugucccuguuacacagauuggaaaacugagucgguagugaaacggcugaauuaauaaaugaacuuugucuagguuuuucuguuucucuuguuaaccgcagagacaaguauuaaauggaccagugaguuugagcuaucuuuauauccuaaagguggucucucuuggccaacagcaauuuagaaauuaauugagugggugauugcuuauuuacuauaugauguaauacguuagaaguauauuaggcaauauuacauuacaaauuuuacaacuaucuaauccagggguuauaucaggcauuuuggaucuucccagggaaacaacaaaaacuuuucuauugaauuccauuguuuuaucuauguuguaaggauauuucacaaaccaugcgucccaagcaccaucagucuucacuuugagaguuuucugagaguguucucuuaguuacaaggaacagcccuaggguggugguugccugucaacuaguaagaaagauggggacugaaaauggugggauggcauuugccaagcaaauuaauucagagccaguucauaugcuuagagauugauucauucaaacguaguuucuuuguucccaacgccuuaaaaucuugauucuacuauguccccucuuuggcagaaugagguagagagcugugcagugauuagacaggaaccccgaaaccaaagacucuuaaaagcugaagagaaaucagacuuugaagaacuguggcguccaagcaugcuguaaguggagugggcagcccccugggcgucuccaccuagcuguccacaagcacuccagacuuaacacgccccgaugggcucguuauucccuccugccccaccccauccccaccugcagcugcccuuucuccuguacuuccuuacuugguuaauguucuugccacccacccaagcucuucagcuuaaaagcuuccuacccuuucuucucccucaucucccauacccaggcagccaccaaacucuguuguaguuugccuuucaaaaugucuccugagguugacccuucuuuucucuccucagagacacuuuauuaguuugagcuuucauuaucucuugcuccaacuacugcagcaacucccuaauuggcucccugucuccauucccuucugucucuagucugucuuuguugcugcuaguaguaaucaucucuaaaaaguacauuuccugaggucaugcaccugugugaagccccccaguccucacugccuacacugcuuggcccaggaggcccuuccuuuccuggcccagcuucccacguuagccuggucucccaucuuuucccucuccacugcacccacccaugcacccugcacuccuguaccauuucugagugaucugugccacuguacaguacuauuuccccucuccaaaaugcccucuuucuuuaccaaauuucuuuucauucuccaaggcccaacucaauugucacuuccucccugaagccuguucucuuaccccaggcucaguuagugauuucuuucucuucauucucagagacuuacuuauaucucuauuccagcucuuaauuuguauuccgauaaccuggugacacaacuggcuuucuaacuagacuccauucuuagaggacagagauaaugacuggcucauccuugccuucccugcaccucacacugucucuggcacauaguaggcgcucaauauauguuuacugaauuaagaauauagugguaaagucuuaaaagaucaagguuacaccauggcaagaagccuaacuaaaagugaucuuuaacauuucuuaaauguuaaaguuuauccauucucaucucucuacccaaccguagauauucagcaggaguccuuaauuaguagauugucaucccaucguugccuuugaagaguuugcacaccagccugucuuguccugcugucucccuuccagagaaaaucaaggugcagggaaugaaugccuuuuugaaaagaauuagaauuuuacugcuuuugcaaaacaauuuugugugccuuaccaaaucauuaaauauuuauugagugccuaccauguacaagguaugugacaucuucaguaguuuucuucuaugaauuaucuaaucagguguaaaauuaucuaaagucaugucuuuugcauuaaagcgauuagagaucaugaugcuuuauagcagguaacuuuaguaagauaugucuuuuccuuaggaaaaguguuaguaagcuauauagucguaauuuuuuuuauugcaguguauaagucacagugaaaaguacauuuaauguugguuuaagccuagguuguuucuacuuaaauagaaugguacacuugauuaauaguuuucauagauggagagggaguuaggcaguagccaaguacaccaugcauuuccaaggauagcuucccaaaggauagugccugcuuagcaguucucacuuucuuagccacagacuugguguuaggccgauggaagcuaaccccaaacaccuccaacuuaagguuuuuguuuuguuuuguuuuacuuuuucuuuuuccucguagaucaugggaauccuucagauggugaaucuaggagccuuuuugcuuguuuuaggaacaguuucacauugggcuuucuuuuuugucucuugguucaauuuuaaauguugccaguuaugaucauuuuaaauuauuucacacagcuguuaggcuugcuuuugguccuagggccuuucuuaauuaaggauaugauauuaauaauaugaaggugaaaugauuaguauucaaaguuuuaaugaaguagcuaguaaugaaguagauaaaauggaaagcugaugucccauuguaaaggggagaaauuuaaggcucauauuuuucauaguaaugcauuuguuuacugaaauuaaauccuucugacuuauaguuuauugcauuuucugccucucuuuuuuaaaaguccuccuaaaagaaaaucugucagagacuaggauauauauuuaaauccuuuuaugauuuaagugaaucucaauuuuaacaauuaugcaaaugaaauaauuuucucuacacuuuuuauaggaagcuauugaauccuucaaagaagcuuugaagcagaaaguugacuuuauugaugcauauaaaagucuagggcaggcauauaggugaguaaaauaauaacaguugggguaggagggaggcugaagaguggggagacaagauagcuucacauaauauuuaaaagaaauaguauuucuuaaccaaaggagauggguauuuugaauugugcaaguauguauagacuuguugauauuuucucugaaaugcagaaaaauaaauuguaccagaggaugucaugaugcacaguauucucucuuaacuucagcguguguauuggucuagaaaacguucauccuucaaggguuguuuugaauaguggcauuguaagcuauugggguguagacgcugcugcuacuuucuuagacaguaacuaagguaaauuuccuaugaucucuuugaagaguccuagaaugaagggauggaaaaguugugauuauaauguacaucugcugagaaugagaaguuguaacuagaacuuggcuuccugacgccaugcauugcccugaugauuagagccauugugacuuuuggcuuaaaaaaaaaaaaaguaagccgggagcgguggcucaucccuguaaucccagcacuuugggaggcuaaggcaggcagaucacuugaggucagggguuagagaccagccuggccaacauggugaaacccugugucuacuaaaaauacaaaaguuagcuaggcauggugguggguuccuguaaucccaacuacuugggaggcugaggcuggagaaucgcuugaacccgggagucagagguugcggugagccaagauugcaccacugcacuccagcuugggcgacagagcgagacucuaucucaaaacaggaaaaaaaaaguauauuguguuaugaaaaggagguaggauggcaugagugaaggagcucaugacuuaguucugccuuggucguucugcagguaugagugcuuaacuucccugagcuucuggcuucucacuuguaaaggugcuacaaaagcuagaaaagaaagacagcgacggaaagucccuuuauuagguaccuuauucaggaaggauuacauucaagagcuuauuuaucugauaguuugaggagcucuuauacuaacuuggaagaaguguguuuggauuuguuugggguuuaagggaugauauuugugcuuccugucucacagaauuauugaauauaaauugaaaacagauuugaaagcaccuuguaaagugcuguaugaauguaagcaggaauuauauuuuuaaaaaauguucacuauuuauagagaauugggucccgcuuuucaggaggucaagugggagcaucgccugagcccaggaggcugauuucagccugagcaaugcagugagacccgguuucuaaaccuauuugaaaagcaaauaaaaagcagauugauccauaacaaccauuuccauccuggaaugguuacaauucuaaaauacacuucuuuuuucagaauucuaaauuauauaaugauuuacuagauuuuaagcaaagcaacuuuggugaccaaaaaaaaaaaaaaugcauuuuuaaggcuaugaauuugauugagaaugaugaacuguuuaugauuauaauugguauauuuuuuuccaaaugggaaaaguguguuucuauccauauauuaacauuuacacaguuuuuaggguuugggacucauugugaauaaucaaggagagggguuugaauaagcgucugccuuuggaaaucagcagaugaauuuuccccacagaauuucaagagcucugugguuauccuaugagcuggugagauuuagaaguaagugaaauguaaugugucagaggcuauaaaaaagcaacaaagggaacacucccaucaagguaucuuguuuacauauugguccauaauucugaggauagcuuauucuguauguuucccguaauaucuauacuguauucauaacuauuauuaaauaccuagagaacugggcaauuuugaagcagccacugagagcuuucaaaaggcacuguugcucaaccaaaaucaugugcaaacccuccagcuccggggaaugaugcucuaccaccacggcagcuuacaggaagcccuuaagaacuuuaaggugagcauccauaaauaagaacacuguaauuggaauuacuggauuauucuucauugaaguuuagugaaaugaauagagaagggggacugagaauaguguuucuacuccaacaaaaagaaagagaagaaaucauugcucuuguccuguagacuaguuuacaggucugguuuaaccuggagggaaaacuaauuccagaguaaagaauaaagcauuucaaaguuuuccuaaacuguguugauacuaaugcagcauuuuguccucagcggugucugcagcuagagccauauaaugaagugugccaguauaugaaagggcucagccauguugccaugggacaguuuuaugaagggauaaaagcacaaacaaaaguuaugcugaaugauccucucccaggccagaaggcuagcccugaguaucuuaaaguaaaguaucuccgagguaagucagaaaaucacagaauuguuggauuuucaugcucaaagcuguagaaaucauauugcuugacucuuuuauguuucguaugaaacaguggagucugaaagaggccaggugacucauccacagccacaccuugucagugcuagugucgagacuagauguuucuaucuucaaaagaucagucaaaugcauuuucuaccacuuuuaacauuuuuacuuucuaaaguuaaaacauuuuuuacuuaaguugaaaagccauauuuugaacuaaaugugacaagcaucuggaauauuugugucucaucacaucucauccaagaauacaggaagggcaggaaacugacauucugugagguucuuacuguuuuuuuguuuuguuuugagauggagucuugcucugucaccaggcuggaguacaguggugcaaucucagcucacugcaaccuccgccuccuggguucaucccauucuccugccucagccucccgaguagcugggacuacaagggcgcgccaucaugcccagcugauuuuuguauucuuaguagagacaggguuucaccauguuggccaggauggucucgaucucuugaccucgugauccaccugccucggccucccaaagugcugggauuacaggcgugagccaccacgcccagcugguucuuacuguuaaaugugaacuugguaucuuugacuugucauuccuucauaucaaaauucucauauauuuuggagaaauaugaggugaggaagaaagcaaaucuugcaguuacccuuuuauuaguuguaguuuuacucaccuuuuaucuccugucucugaagacaguuuuuuuaauuaaagccuacauucuuuuuuguuauugugagcccuuuauaccaugacuguccaaaauaaaaaaaaggggaaagcuguguguguaauuuuaaauuugugguagccacauuaaaaaagugaaaaucaaagaaguggaauuaauuuuaauaauguauaauuuuaaauucaguauacccaaaauauccauucaauauauaacauaauuaauaugaagcugcuauucauuagauacuuuacauuauuuguuguacuaagucuuugaaaucugauguauaguuuaugcuauaguacaucucaauuuggauguuaaauuuucauuggaaauacuugaucugaauuuagaauuuauaauauuuauaguuaagaaaguagguucauauguguaaguuguuccacaugcacugaaguuuucugaugauugaaucaaguaucaguuuguaaguuuaaauuaauucaaauuaaauaaaguuuaaaauucaguuucaaucacccuagccucauuaaguauccaauagccagguggcuaggggcuaccuauuagagaacaucuuucuucuaccugaauuacaauucccuuuuuucugguucaguggagcuugcgcuugugaauuauaggcagaaggggcagguauucuguacuuuggguuuuuuccuacacugcuuucauagagauaagcagcaguccauuagucgguuggugaaauuauauacccaaucaaucuauauaccaguugacagaguaccaggcucuaucugagacugaacuuggauucuuaagcucuggaauugaaaacaaugagauuuuuagugguuuuccuggaaaggugauuaaaauuuagccaaacuaggccaggcgcgguggcucaugccuguaaucccagcacuuugggaggcugaggcaggcggaucacaaggucaggagaucgagaccauccuggcuaacacggugaaacccugucucuacuaaaaauacaaaaaauaagcugggcaugguggcgggugccuguagucccagcuacucgggaggccgaggcaggagaauggcuugaacccaggaggcagagcuugcagugagccaagauugcaccaccgcacuccagccugggcuggagcaagacuccgucucaaaaaaaaaaaauguagccaaaguagacccagacugacugacuuauauuugaccuuguuaucucaagucaguggcagguuaccucuaucauauacuaauagugacuuacuaaaauuuagaaacucuuuagaauucuuauaauugaagaacagcuuguuacaaaguauuuguauggcagcuagccauaagaaaguuucuuuagcaguauuuggaugugucagaucucauuuccuuucugcagaguauucucgauaucuucaugcacaccuugauaccccccuuacggaauauaacauugauguggaucugccuggaagcuuuaaggaccacugggcuaaaaauuugccuuuccucauagaagacuacgaagagcagccaggguugcaaccccacauaaaguaagugcuuuaaaugaagaugauuuuuuuuuccuuucucaaaacugagcuauaagcugggcaugguggcacgcuacucccugcuacuugggagggugagguagaauugccuggggccaggaguucaaucaagcauacuauccuugugccugugaauauccauccaucgcacuacagcaacacagcaaagaccccaucucuaaaaacaaaacaaaacaaaaaacaccuauagcaaacaucauuuuaacuuaugaaaugguagauacauuaacauuaccauugggagucaaagcaaaaagcccagaaucagugcuucucuguaauacugaacuacaaguccuagacagugcacagagagaagaaaaagaaaucagugauauggauuagaaaggaaaauagaaagcugucauuguuugcagaucacauaguuuucuacaaaggaaaccuagaagaucuacaaauuauaggaaaugaugagaguuuagcaagcucauuguuuauaaucaauauacaauaaucaguuacauuucuauauauaagcaacaaaaauaucauuuauaguaguaacaaauacuuagaaguaaaucuuacaagaucuguauaaaaucuguauggagaucacaaaacuuaauugaaaguuacuaagauaaaacaaauaaauggugagaaauacuauguucauggauuggaaguucaguaacauuaguaggccauuuaucugcaaauuaauuauauauuuaauaaaaugccauucaaaaucccaaguuuuuuugaggcacuuguuaagcaaauguauugaagaacaaaggaccaagaguaaucaagauacucccaaagaagaggaugcucaggcuugaaggggaagcuucucaucuuaccagguagcaaaacuuaauauaauaaugaacagaaugguauugcugcagggauagacaaguggacuaaggaagagaauagauaacuuagauaaaugggaaagguguguuagagaucagagugggacugguuaagaugugggagugggccaauuaaguuauuuuauggauaaaauaaaauugauauuugugauggcauaguaaucuaauuccaaauggaugaaaaucugaaguaugaauggcaaaauauuuuaaacuuuaggaggaaauauaaaugaagauguuuaugacuuugggguagacaaggauuucauaagaagcacaaagcauagaucugaaacaaaaagguugauaaauuggacuaccuugaaccuaagaacuuccguucaacaaaugacaccauaaggaaagaaaaauaagcccaaauuggauaaagauacuuggaaauuuaauaacugaccaagaauuacuguccaaauuuaugaaguaucacuacaaauuaaaaaauaagagacaaccaauagaaaagugugcaaaagacaugaacaaguaauuuuaccacagggaaaacaugaaugacaaacaugaagagauacuuuaguucauaaauuaaggccucaugagauuuuuuucagccacuagaugagcaaauguuacgaagucugauaauaguaauauuggucauaagggagauuauggagaacuuuuauacuccugguuagaguauaaguugcuacaaccacuuuggaaagcaguuuuucauuaucuaguaaagcugaauauucucauacuugauauaagauucuguuccugugucuauucagagaacuuuguacuugugcacaugucuaccaggagagauuuauacaggucugccagcagaauuuguucacagcuaacacuggaaaucaacccaaaugccaucaacagaagaauggauaaaugugauacagucacacaaugggauauuauacagcaguauaaacaaaugaccgaggcaacaauguggauuaauuguaaaauguaauguugaauaaaagcagcaagucaguaagcugugcucucacauauuuuuuucucccaaagcucauaagccaaacuguagaguauauuguauauauacauguauguaacaaaccuaguuuuuaaaaagguacgugagucaggagcacacauuucaagagaugggaggaugggauaggaaagcagcauacaaguagauacaacugcaugaauugcucuaguucuuaaacuggguaauuugacuucguguuuucuaugugucucaacuauuaaaugagcaaaaauaauaaaaagaaaauugauugcucauggagauuaugcauguucucgaacuacuccuuuuuugagaaauauuucgaugcacaaaagaguuaacauaguagcaggucuaugacugcuguccuuagaaaggacugcuugcaagagugacccuugguugguaucugggaacuuggauuucgaggggauuccuaccacucccaaaacuaauaggagagguucccugugccuaaacuguguguucaaacagugugauuucuauucaacacuugcuuuccuucuggguaucuggaauuugggaacuugccaggcauaaguugucuguaacccuggccacugagucuuuaaugagcuuuccugguuggcagcauuuuacacguguucgcaacuaaucgcugggagaauuuaaugugucauauaugacuuccuugggagaggacccuuggaagcuugugacugguuuccuccagacuucucccaaugugccucuucccucugccgguuuuguuuuguaaaggacacaaaauaaaaaaugauacucacuauugugaguaucauuaugugcuaaguccacugagcccuuucagccaauuucugagccugaguaaggauggucuuggagauccccagaacaaccuguaauuuagaguuucagucuuuguuauaaaagcaucaagcagguuggcagcuaaacaguaguauuucaauguaucauuccaaguauacuuguucuaauacaacuugggcaggguugaggaguggacaaagggcagagguuugguugcuuguugaaaaaggcaguccauucaggaauguauucuggagaaguuuacaaagcaaauaauggaaagaggugucuucugaauugcauacuaguuaucauaguuuucacuguuacuaaccagcaugugauggcaauuaugcacaugccaucauagagauucccuuuuaagcugagguaugguugggugcaaaggacugaaguaaggauuauguggucguagacugcuucauuaguuuucccguggaggaagugacugcuucucagguggaauuggauuaccaaaugucuguuguaaaaguccuuaucauguacaugauguuucuuccagagauguguuacaucagaauuuugagaguuauaagccugaaguacaggagcugauuuguguggcugaucguuugggaucccugaugcaauaugaaacaccugguuuccugccaaacaagagaauacacagagguauucuggaaacuaccugaaaaugaaaauauuccuggcauaagaggaagggugguuaagccauguugugcauuuuaauaaauuaguauuuauugugcuuauucaaauucuccaugugaucagaauagaaauguguagaaucauucaaacugaauucugaaagaagacugcuuccauccuuggcuuuuuugcuauugcuguaguauaaacuagaauauaggucuuaaguccuuacucaaaaucagacagcugauccagggagcuauuuccuuacuauaggagugaggaagaaugcaaaccuccacuuguuucaguaggaggcagaguugggagcagacaacuugaguugucuucaguuaacucugauggguuuuaauuuuaguaggaccaucaugacugaaacgugccuugggucuuguuauaucaccaauacuucugacccuuuauguguuaacucuugaguuaucacugagacucuguaaaguagguggaacucagucccucuaaaguguacuaacucuucucgauauuccuuucucguagcuauggguuuggccgcauuggaggucaugcaagccgugcagcguacauggaccaacucgaaaguucgaaugaaugggaagacacgguugaugcaguggagagacauguuugacauugcaguuaaauggagaagguaacuaacaucucagugaaaauaaacuauaagucuuaucauugucaaauaacgucagucuguuuuagcuaacaggcuaugaacccuguuuugcuugcuaacaccaggccuuccaaguuagguuuuccucucuaaaguuuguuagaaauugcuggcaucuuuauuauuugacauacacuuaacuaauauuuucaaaauaggaauugauuggcugggcgcaguggcucacgccuguaaucccagcacuuugggaggccgaggcgggcggaucaccaagucaggagaucgagaccauucuggcuaacacggugaaaccccgucucugcuaaaaauacaaaaaauuagcugggcgugguggugcgcgccuguagucgcagcuacuccggaggcugaggcaggagaauggcgugaacccaggaggcggagcuugcagugagccgagaucgcgccacugcacuccagccugggcgacacagcgagacuccaucucaaaaaacaaaaaaaacgaauugauuguugucacauuuucaaucaccuauuuacaugaagcauuuuagaaacagucucuuugaaagaacagauccauuaccugugguaccucugaaugaacuucgcuggaccagucccuuuacagauaauggugugccuggcaacuagcuaguuuagaguaaccuuugauauucauuugcgugacaaaaacuguccucugcuccuaaaccuuuaccuuuaccuggcuuuucgccugguccagcuggaacaucuguuuggaauuuguagguauggacaucacguuuuuagauaugauggacuagcuguugcuuuauccccaccuuugcaaacacuucuacauguuuuauuuggaaugcuucugaacacuucugguuuuauaaaggucucuguuuuauaggauugcugacccagaccagcccgugcugugguuagaucaaaugccagcacgaagucuuagcagagguuuuaacaaccacauuaauuuaaucagguacgaaccuuuugugcaucuuucuucuuuuccuaggaguuuauucucaagacacaggccauggagaccaggagugacccauugcuccuuuccuggugacuuuuugaccagggaacauacugauugacucugcaccuguggaguccugccugcauuccuuuccucuagcccagcugcagaaagaaacauagcgcaugccauacuccuuccccaggcccuucugucugguguagagcacaaccgaaggguagauugcagauguuuuccuagggcgucagucuuuaaggagucuuaaaauauagaaaauuauuagauggagaacauuacaguaaccauaauauucuuuugauaguacauggcucaaauaaauuauuugacaagucucucgugguggagucucucacggugggcggcuccccauuccaccccaacacacaaagggcuuagauaaauaacacuaucugguaacuaagcugccaucuggggagggcaagucagguuggcuggaaaacuucuguuuuguccagaggcucugcuaguuggggacaugggugaaaugcucacuucuucacucuuucuuuaugugccuagcugccuucuaaauaaauggugaacaaauauuaaaggauaucaguuucuuggggaccuauauuaucagcccaucuuuuagugaauuuaauuuuagauaaaauguauagauaugguaguugugucaccucuaaaaugcuucuaguuccaggaagcugaauuaagaaaauauuuuucuauacaccuuuaaguuuggguuuuaauggaaauauaauuuguauguauauuuauuuuuuuaauuucuagaaaacaaauuucuuuucaccuugugacuuguauauuccuauuucucauggaauaauuuguggcauagauagguagacucaagcaacuaacuuuaaucgaaggcuaccguagaucagccagugugcugugcugugcuguguguuggggauacagaagggagauacagccccaccugcugaaagcucacagcagacagaccagcagacaacuacuaugcaguguguuaagagugagcugaucacaugcacaggaugccaugggaaccuggagaaggggugccugauaaagccuucuggugcuacagggcuauuuggaaaaauggaaaacagagagagguggggugauuaacuuggacccauggaugaguuagguauggucaggaaacugugacuaacucauuacgccugguggugaguuugcaauuaagggaguaucaggaauuaaggcuagaaagauaggcagaagucagaacauaaaucauuuuauaguccaagcuaaggaauuuuuuccccugaagacaauggugagccauucagggauuauaagcagagaaguaacaggaacagauuugcacauugggagaagauggcaaaauagauuggagaggaggcaggaaccucggagguaagggaggagguuggaaaauuguguaguuguucagguggacaagugcaaaggccucaaaagcugugugguagugaguuggagaggaagagcuagacucuuagaagauagaaucaggagcacuggcagugggcugcagugggaagggcauggagcuagaggaaggccaccuucccucagguacgugguugucccauuaggccagagagcaccagaacgaaaaguagguggacauguuuaguggggaggcugggagaaguguggguugcaggagggaauucuuacuugacaguaaccuuugagguuugagaugccuggugggaacccagggagcgauguccugggagcagucggcugugucaugugacucagcauguuggcugaacauggaguucugggagugaguuuaaaaggaaaagaucagaagggauagaaaugugaggaaaagaguauuccgaguggguagaggaaaggagacugcuagugagcuagagagcaagacaggguauuggauaaugcuguugggagaacugagggaggggagacggcacacugcccacaagugaugggauccgucagaggacgcugauaugaaagucuggaccucacuuuagugcugggggauuugucuucccauuguggcugaucuggcacugaguuugaugccagaauaggcccugugagcuggcaggcagucuugcuaagacggugcuuugcuucaccacucauugacuaugaacaagcgaauuucccagacuuuuuuuuucuacauuauucucauaguuucuuauuuuuuuaaauuaacuuugaaauuagauguuggcuugagcauauucuucuauaaaaauauucuuaauuuuauuauuuuugccuuauaggggucaggugaucaacaugagauaccuagaauauuuugagaaaauacuucauuuuauuaaagacagaauucuuguuuaucauggguaagccuuuaauuuucuccuucuuaguaaugaguugauuucauguguuuuauauuuguuauauuuuugaaacuugagaacuaagccuguugacgggcuaaacaaggucuaucaaauuuuuacacaguguuuagaaucguaaaggcuuucauaaucacuuucuuuuuaauacaaaauccacagaccucaacugaaguguuuuuaacuuuaugugcacuauugugacuuuucuagucucuuucuucuauaaagcaggauguuucuuuggauuuaucuuuuagggauuucagcuuuaauacuuacucuccuucacuugaaaggcaggaugggauagacaaaacaaugagcagaacacuaggagaaaaaaaaucugaaugcuuaaauaucaccaaguaaauauaaaaucgguggaaaaaccuagcagaauacuuucauuugagcagcuuuagaaaggaaaaaaacaacacaaaacauccacauauaauuuuagagcuggaauaggaaaaucagaguuuaagaaccaaacucauaaccauacauguucacacaaacacuggcuuuugauccauucugcuuuuuccuguuuugccuucuagauguuuccuuaauucucaucugcugcuguuuccuuaauuuucaucugcaguccaaaacucauuagaauugaacuaucccguuauuuggaagguuuauuuguggccuaccauuuugaauguuuagcuacucaaaauugaggucaauuuauuuaaauuaaagauaauugcaugauuaauuauuacaauucugcauuaaucucaguugccaucucucucugucucucuuuaagagcuaauaauccuaaaggauugcuggaaguucgggaagcccuggaaaagguacacaaaguagaagaccuucuuccgauuaugaagguaacuuuagcaucagaauggcaguccauguuuuuagaggaaaagaaaaccaacagcacuuuuuuaaaaagaacucagaauuauuaaaugcuauuugaaaucacucguaugaacacauucugaauaauaaccaaaauaaaagaaccuacaggcaucagacucaaacagaaaaaacaacuugugaggaagcaguuaauauagaaaaaagaaaacuuaaaaauacauauaauugaauucugcuucuggccacagcugaguaacugguacucagcugcccuucuacaugauugcaguuauaaaacuggacaaaaguuaguuauuuucaggcacuggcuaauuacaauaaugugaaucccacugucaccccagcuuucuacugugguauuuauuagaccacugcacgguaauguggagcccaagcagaguacaguggucuugcuaagcuaaggagguagagaguggaguuugguucugccaaaguggcuggaauuugcagagcagaguauaggagagaaggaggccauguaggcuggggagugcucagggguuaaugugagcacuccuuuucauccuugacuaagaccuuggucaugaacaugcaauaaaagaccaugagaggcucagcagagaguggcuacugugggaacgaaagcugagcagagguaucagagguguaugugcugagagacauuggaguuucggccuugccaauguggauggauccugugaacaccuugggcguuuaguuaagaccccagaaaggacacaguuuaaaaguaagaccauacuuuacaguaaggcccacaaccuaggacuaagaacaauuucuaaauagacugcccuaacaaagaauaaaacuaagucuaaaggauuaaguggaucugcuagugauuugacuaccugucaaaacucauuacccuuuaaagaaaggcaaaauaaccuauacucuuuaauuacuagagaaguaaaugccaucguuugaauguguuccccucaaaaugaauguguuggaaauggaauccucagugcacauauguugggagguggagccuaacaggaaguguuuaauggcagagcccucaugaauggauucaugccguuauaaaaagggcuuuggggaguggccucucuugcccuuccagcuuccgucaugugaggcagcagucagaaggcucacaucagacgcuggcaccuugaucucagacuucccagccuccaaaauaaauuucuguucuuuuuuuuuuuuugagacagggucuugcucucuugccuacacugggugaugagugagaccccaucuccuaaaaacaaacaaacaaacaaacaaaaagcuagauacaaaaguaugauaguaugauccagguauaccaggcaaaugcuaaugagaagaaaaguauguguggcaauaucaauaauggaaacauuugaauucaaugggaaggacacuaaaagggacagaaauuauuugauuaaaguauaauccauuaagaauuauaacugugugaaccuuuccuccaucuaggaguaaaacugccccaaaacaugccaacagcaguuagaauugcuuuuccaauuagugguuuaaacacuaaugugcaacuucaguaaauguuuuccuugcagcuauaguagaugagauugauucauguaaaauuuaggaaauuuguaugaauaagcaaaguguaucuauuucuaaggaauagcaaggaaguagcaugucaugaacagagcugagcaucugacccaggccccacaucugccuggguggguguggaugagccuauuuuacaguuauuccagguuuuuggucugcugaagaccaaauauuguggccagaccuaccucguggaguuuauugugagggucugaugcacuaacacagugccccucaaccuucucaaacccacugcguugacucaguaaacauguucagaugcccccuuuacugacuccuuuauugcacuaagaugaacuucacagagaauaugucucaccuccuaaaaaauguccacgcaaagucaucucaguaucucaguccacacaguguccacacaguguaucucaguaugcagaaauuggggcaggccuucucuagaagccggaaagcaguagccagugcuucacaccugcauguaaaaucauggugaaugugacaguuauaaguguagccccauaucuguguguuauuuggugagcuacauugucauuggcgaugugguuuucugaaaugguaaaccaagcuuaguaaagcuccaagcuauauauaguagacuccuuacucaauguguaugcuauuugcauuccuggcaaauucaguauguaugaaaacuauauaauaaauaguuagcguuuaagugcaaaacagagucugguuccaggcccacauauugauuaaaugauaaacauguucuucaucuacaugaaaauccagugggacauuagaaaaucauacauuaugugugacaauccccuguacugugggacauauaguaaucuuggcucccaacuguccaaucccuguaauaaucagucucccauaaauuuccccagcgccccccagggggcagaauggcuucaccacaggcccugagauguaccauauagaaaggaaacuggugugugagggcucuucagcugccuuccuguggguauucuaguuaggcauuuagauguccugugguauuaggcagaauacaacgucaguuuagggagauuuuaauauuuuauaugucuuugucuaagaagaaaaacagagugggcuacaagacuguagucacuuagcaugcagccugagacgcggcaucgccagccucagugugccucucggugugaaaucaccaacuguugucugaaagauguaagauguuuguucucugcggugggaugacauuccauuucagcauuauacaucuagccuuuacccaggauuacggauauauugguacuuugcaaggcacacacagcagaauauacaacaagauauuugaguguuuaaagugcuuaguggaauguaccaggucaacuuccacugaaaggcacaaugguacuguugaugaaaaaccaaguuaacguguaugucagcgcccccuagaggcgguuuauuagcaaguaacgcggacuggaauucaccaagaccuugggcccacauucccacucugcggcuucccugcuggcugggacucagccagacuuugccucaccuaguucguuucucaucuguaagauugagaccauaccuagugcuaucaguauguugugaggauuagaugagaauuggcacauaguguguuaacgcauuucuucuccugaaagucguuuuuuuuggcgugaaagaugcuugccugcucagugccugcugugggccuuaugaccugugccacucauccucuggcuucugggcugcuggugacaccuggugcaucuuucuguuucuagacaagcucuccccucaugaagcagcagccucuuguacuuuacuguugcuucucuuaacuuccaguccaucaauuaaaaaaaaaaauuggcaauauuaaguuaacuaaauuugggggucauuuucugaaaccuauuuauugccauugcagguuugucccaaauguuuuaaacagaaagcuaacgucugaaacuguguucauacauuuaucacuccgaaagccauucuuaacuccgaguaauucuuuuaacuuaaccgacuuaucuguggcucacagaguugggugggugugggugugggugugaaugaaguucuccaguuaguggauauaauccuggguacucuucagaaaaaucagucucugcuuugagcacuaguaugagcauaaguugcauuuuugaguuacgggauguuagguacaacuauucugccaugauucaagguugcugccuacuaagauggacaugagaaaacauucaaagggagcucuuagaagugagcagugccccuuguugacgaagagaaccugugagcuuuuggugcugagguucucugcuggccucugguaggagcuguggggagcguaaccugggcucuguuggggccugaagacaggcagagauguccuuggccaccaggccaccaucucuuguaucagaugaccuccuuggcccuuuuuaaaaacauguaagguagagccagcacuacagaguugcaguugggguuuacagugaaugaaacacuaguaacgugaauuuucuuuuucccugaaagcaguuuaauacuaaaacgaaggauggguucaccgugaacacaaaaguucccagccuuaaagaccaagggaaggaauaugauggauucacaaucacgauuacaggagacaaguaugugcgcuucuuaauguggguguaaacuagagacgaggcaggaagggugccugugcuuauugucacuauagaguuuugugguguugaacuuuugcuccauccugaaaugaaaaguaucaagguccagugagcaguuauaaccaguuauuuaaaaaaaugugacaucuaaaguauuacaccagcagauacauuuucugacugucuaaaucuaaggacuuucuagauacuauguaugauguaguuugugggagacauucuucuggguucuugaaguuccuugggggggcgagggaggcuuuuacuaauaaaaugaaaaaagaugagcaguuggcggauugaaguccauuguagauuuaaauauauauguauaaaagccaaucuauauauauauagagagagagagagagagagaaaacagcuuuaauaauuaaugaguaguauaaucuuauuguagaaaauuuagaauauacagauaagcaaaauuaacaaaauaaaaaucaaguuauuuucuuuaaaaacugagguuagacuguucuacuauuuacccuuaccauuacauuaucacaaucauuuccccagucauauucuuaaaaguauuuuuaguaacugcauaauauuccauuguauagauguagaauuucucugacugaucuuuuuguuauugaccacuuaggguauuucucauuguuuugcuuuauaaauagcacugcaguaaacauuuuuauuaacucuaguuuuauuuacaucugaaauccaagcuuugucugucagccuccauauuccuugaauuguggguggaauugccuugagcugugcacacacacacacacacauacacacacaccccauauucaggugcauagccuugggaagugccaugcccucccccugguuuccaccugcucagcagugagacuaugacucacauucuccagccccucugccucuugggcucuggcuuucucacauacuuuuccucuaaacuacaaggagccaccucuucaaguuccaugucaaaacuuaaacaggccuucaugaguaaacaccaguucagcaacuuccagauuucagggcuuuucuauaucuuugaagucuugaucucuaccucaagcuucuuaucaaaguacguucccaauaaagaucauucuccccugauugcagguugugcuauuuaacauaaaaaguguucuccuaccuuuucacacauccacgauguguauccucagaucagauuccuaagcagaaaugaaauuacuauauaaguacaguugaucuuugaauaacucagggguuagguggauugaccuucccaccccagcaggcaaaaauuugcauauaaccuuugacuaccccaaaacuuaauagccuacuguugaccagaagccuuaccaaaaacauaaacagcugauuaacauauauuuuauauguuauauauauuauauuuuguauucuuacaguaaaguaggcuagggaaaagaaaauguuauuaagaaagucggccgggcgcaguggcucacgccuguaauccuagcacuuugggagcccaaggcgggcggaucacuaggucaggaguucgagaccagccugaccaauauggugaaaucccaucucuacuaaaaauacaaaaauuagccaggccugguggcgcgcaccuguaauuccagcuacucuggaggcugaggcaggagaaucgcuugaacccaugacggggagguugcagugagccgagaucaugccacugcacuccagccuggugacagagugaacuccaucucaaaaagagaaaaaaaaagaaaauaauaaggaaaauauacuuaacuauguauuaaguggaaguggauccucauaaaggucuuuauccuuacuaucuucacguugaguaggcugaggaggaggauacggagggguuggucuugcugucucagggguggcagagguggaagaaaauccucguauaaguggauccaugcaguucgaacccauguuguucaagggucaacuguacaugaaauuucuccccuugaaacgugacaucuuuccucaauuuccugcuucaccucacuuguugccucccuugcucugggccuccugaccccucgagucgacucugccuggcaucccaucuucugucuccugcuucaccagcacuucaccaauguugcuagagcuccaccucacuggacguuccccuagcuccacaaaucucuccccucuccauacccagccauugccuguggcuacccaaaccagcuucccugccaggcauucacagccucucacaaaguggccucagacauuuccugcuugaccuggaccaucucccuguuggaaccuggccugcuaguccgacuggaaugcuuguuccccaguucaccccugcuuuccaaugucugggucucucacucccaucccgacccauguucaggccacuucucccaugagaccuuuccugcuuuucucuauguuguccaaauuagauuccuuuuuugaaccucugaugagcuacauuaugaccugagucaugguuucauaauaauuuguggcccuuggccagaagugguggcucauaccagcauauugggaggccaagaugggaagauugaggccaggaguuugagaccaggcugggcaacauggugagacccugccucugcaacagauuuuuaaaaauaacuacaggugcauaccaguagucccagcuacucaagaggcugaggcgggaagaucacuugagcccaaaaguuugaggcugcagugagcuaugaucaugccaaugcucuccagccugggugguagagcaagaucccauuucuuauaauaauaauuuguggccccguuucuuccuuccuuccucaaucaaggcagcagcugagcuuuucuuuguaggcuccgaggacuaaaugcaacacuuugcuaguggcguuauacaaaaaaugccuguuguaucaaacuuauauccuccacagaaccucaguggagcuucagcuccacuuuuuuuuuguuuugauaaaaaacagaaccaugguguagucccugaacuuucuuccuacacacaguucuugcuucugaccuuuaauccuaaugggguggcuuagaaaauauuuacugguuauuuaaaugcauucuuuacuaugugucauuguuuucccauauauuagcuuaaguuuguguaauaaguacauguaguuagacuuaacugugagcaaaugaguuacuggucacuuaaaggugaggcaacuaucacauuuuaugaagaaagaaugcauucucaugaaaccuaccuugcuugucuauaguuagaaagguaagguacauucuuguauauguuuagugcuacgucaguaugcuauuugcuuuuuaaaaaaaacuuucuguguuuggcuguuugaacuuauaauacaugccuuucacacuuauuuuuguauuuucagaguuggcaauauauuauuuucuguggaaacucaaaccacggaagaaaggacacaauuauaucaugcugaaauagaugcacuuuauaaagauuugacagcaaaaggaaaaguauugauucuuucaucagaauuugggguagguuucucuuuguuuccauuuuucugcucuuccuaugauucuuuuguaaauuuuuugaaccucugcccuuucacugagauuguacaucuuaugcuugaaauuggguugaauugaccuaaaaauauuucuuauuucuuauaggcaaaaauucuuguauuuaguaacuacaguaauggggaggauaauaaauuaauaauuuaguacugcacuaugacauuaucauaaguuugggcuuugacaagauauaaaaaagcugguccauaaugaaaaugaccugggcuucaccuuuuucuuccauuuucuucccuucguugcgguuguugcuuauaaccguauauuuacaaggagcuuuugaauguaaacuggaugaugcauucugaugaguuaauggcaaggaaaguauaaugaaguuguguauacuuugcacuuggcggcccuuuccuggucuguggccuucuucuuugguugucugcuuggacucgagguggagucguuacaggcagcaggguaugguggacauucucuccccaccacgccccuucucuguguucugcaguggacgggugccccuuacccuugaaaagucaccuuauuucuccaacauuuaaucacugcauccauauaauuaaacaucuaaguuuauacacauaauugagcaucauccaaaucucaaugcggaguaggggaaggggcuuacccagaucuuuugggguaagguacauguuguuugagagaacauauuugguguuaauaaaugccuuuuaaaauuuuagucacaauauauauuuugacauuucaaauaacguuaaaggagacugagauuuuuauguuuauccaagaguugcaguuuaagaaacagcugggaaaacauugcucuaaauugaacuaaauuggaaaaaaaugauacaaaaggguauagaauauucaagaauuugaaaaguagauucuuaugggggaggaagaaaacaauccucuucuugauguagauuauucuuguguguucugucaccuaaugaaaaauuaguuuguaaucuuuauaguauuuaugagucuguaucuuuuuuuucuaggaggcugaugcugucugcaacuuaaucuuauccuuaguuuauuacuuuuauaauuuaaugccacucucucgaggauccagguaaguaauauccugucauuaaaauuauuuuaaauugagaaauguguucuuuuuugcuuauccuuccuguuauggauauagguacagaguacacaaagaaaugguaaggagcucccuauuuuuuuccaaaaucugcacaaaaaaauauuuccuuagucuaucacaucagcaaaagaauuauagaagacaguucuaauauagugugcuuacguuuaauaggauagggauucauccauucaacacaaguucauggaaaguuuacuguguaucaugugccgugcucaguguguuuuaauuuuuuguaucugccagccucuuacugaaccucuuccuccuccucuuccuuuuccauuuugggcugucaggugacccauaauccucauguuuuauacuuuugggccaacagucacucuguacuauuuuuauuauuuuggauaaauucuugcuacuuguauaucaggaguuuuuuagguaucauuaaaacaagagcuaugacuguagaguuuucauuucauucuccuuuucccagcacugugugcaguaaauuauguaaauggccuuuugccauuacuggcacauaguugaacuuaagauguuuuggcuaaaaauaauacacuugaaugucuuuaucuuugauuaauggcuuagaaaguaaaacuccccuaagugugguaguaaauuugguuauagaauuuaagacucauugaaacaaaauagaaacauaaauguugucuuaucagcauaauauugcuaguuguguccacugaauaagggaugugaggccugugcacaucaccgcuugugggccccacuguacucaacagccagcauccguccuuuguccucacagcagcucugcuggcucacgugugacauugaaggacgugcagcucugauuguccucaacucugccucaucccuacaucucuucaauccuaaauagucuguugauucugccucccacacuucuguuucucucuucccuguacccgccacagcuagcuuugcuccugcuccucucugugcccugcggcucuccagcaccuucugaaaaccauggguuuaagccgagcuuggcagcauacacagugcgcagugcuagcccugcccugcccugguuugccuuggcugcagcaccgcucucuuccguggcucuuuugcuuccccuuggcuuuccacgugggcucucugccacaucucccugccuucucugccccuuucaucuucagcccugggacccuggagguugcagagcacaugucuuuagccucugaagucuucccugcuggagaaccccaugaaucaccuugacucacuuuucuugguguccacccauggcacuuguuagcuuucucaggugcucgugccauccuuuccaccugcuaggaugcauuaucucaugggugagagcugucuuuauuuugagccgauuuguuuugggaaaagcacaacacugugguuacaauagugggucccauggccuuuugccagccccuuccacccaaaaccagucagcucccucucuucccucaccaagagcagaagcacaacgucuuacaaaugccuccuaccccagaccugcacacucgcagcucuacacucguucuggagugacagggcagcagaccuugccccacgagccuccgagccagcaggcaaagguaccccacaauccccuggccucuaacagccaccuuggagcccuggcaguucacacacaugcccaaaucuccaaaccaucuguccguuaguacauugugagaauguauucugcauuucuucuuugaaggccagcauuucuaaugcuuaaaaaguaagacuaacauauguauuuguauuuaugaacuuuauuguauacaugcauugcuggagugcgguggagcgaucucggcucacugcaaccucugccucccggguucaagcaauuuuucugccucagucucccaaguagcugggacuacaggcacaugccaccacuccuggauaauuuuuuguauuuuuguuacagaugggguuuugccauguuggucaggcuggucucgaacuccugaccucaagugauccacccaccucggccucccaaagugcugggauuacaggugugagccaccaugccuggccuaauuuuuguguuuuuaguagagacaggguuucgccauguugcugucaaacuccugaccucaagcgauccgcccaccuuggccucccaaagugcugggauuacaggugugagccaccucaccuggccaguaaauauauucuaauaguaaauuaguaacuauucuuaaacaaauaggcauauuuucauguuaaaugaaacauucgguguuuuauuugaaagaauuuuugaauaaauuuuaucuuucaugaugggaaguccauggugaaauuuaacaugguaacuguagaccguccaggauggauugaccuuuguucuuuauuuaaauaguguaauugcuuacucggucaucgugggagcacugauggcaaguggaaaagaaguagcaggaaaaauucccaaagggaagguauguuggagcgggaagggagaaaugcuugguuauguauuaagucccaauuuauggauuuuuauuuuaagguacacgaguuacauagaucuccagccgagccuguguccuccauguuuaguaacauuccuaaaugucuuucuuuuucaguuagucgacuuugaagcuaugacagccccugguucagaggccuuuagcaaagucgccaaaagcuggaugaacuugaaaagguaacuacuugagggggguccacacaaggguaucauaacuggaggaggaaaaggaguuuccuguuacuuuggagcgcuaugaaaacuggaacuguuauacucauuuuuauaaguuaauauguaauacaaugaauuuaauucacuuuuucaagguuaaaauguuuugcuguuguauaagauaaccuuuuaagggugaauguauggauaaaaauggacuaugaaggccaggcacaguagcucauaccuguaaucccagcacuuugggaggcugagguggaaggaucauuugaggccaggaguucgagaccagccugggcaacauagugaaacugcuccccucuacaaaaaaauuuaaaauuagcugggcaugguggugugugccuguagucccaaguacuugggaggcugaagcgagaggaucucuugagccuaggaguuugaggcugcagugagcuaugguugcaccacugcacuccagcuugggugacagagugagacccugacucuuaaagaaccaugaauaaaaaauuuaaaaaguaguuggugaaagaaaauuaccaaagucuuauuuauaugaucagguauucacuucucuuggccuguuuacucuuaggcucaguauucaggaguguuugaacuuguagacagagcccauuuuacauuacucugagugguagcacuuagccuacuugguugcauuuuauugcagccaggaauuaucccugacggacacugugugugaggagucuagcagaccaugaucguuccuggcucuuguuuccagaagcacuggagaggacugugugaauuugaagugugugaaauuaaacucauagaugccucaguaguuaaugaagaauaaguaagccucacuguucaacuuuaguuauuuuugccccuucuccugguuuuuuacaucccaaccacccccaguuuugccuuucacgucuauuugacauagcaaccacucuauugcuggguaauuuauguucuguuuaaaacagaaauauuugugccuguagucuaccauugcucaauuuguaauuuagcuuugcaaugaaagcuucuaacaguuacaccuuguccugguacauuguuguuucaggcuuauuaguuugcacauguuuuaguaauacaaccaccaggccgaaggucuugcuucuauucuuacauaauuguacagugugaaucuuuugacaauucuuuaaggaaagaauaacaaugcuaccuuacauccugcaguuaacgcuuuacagcguaccuugaaauaccuuaucucauucagagcucaugguaacuuugcgaguuaagaacacugucccugugacagaucagggaagugcagccuagagaaguaaagaaagcuaauaaggagugaagcuggaccugaaaccugugucuuuugauuccaagcccagcaugcaccacagcuggacauguaaaucagaguuuaauuuucuuuuucaaagcucuggcuuaacuuccaagcgacuuguaacguguuggcugaugccgcaggccguuguugugagaggagccauucuguucacagcuccucccugccuuucuaacacuguuugauauuacaacaugaauauaauaaauauaaugauaggaauaaauauaagcucugcccuuuuuuugcaaauuuuguuaauuuucaugccgcuacuuuguguuuuucuuuuucaguauuucaccuucuuauaagacucuuccaucaguaucagaaacguuuccaacguuaagaucgaugauugaggugcuaaacacagacucuucuccacguugucuuaagaaacucuaguucugcugcuguauuuauacaaguaaagggccggaccucuugcuucuuaaguuauuuuuuaaaacauggaauuauaaagaaauuagguccucuauuacuuuugauaccaauuuuuauaggaauugaauacuugaaaucauuuucuuuacuuuucugaaccauaaugaaaaucaugaaagaggcuuucggggggaaaaagcuacuugacuuggagggaaagcguauguauuagccggcagccuguugguucccacuuauaaagucauauaacuccuuccuuacaguaaaaaaaauuuuccucaacaacuaaaauauaauacugaagaugaacaaaaacaaaaccaaauaggaguguuuguauuccuuuagagaucuggauauuuuucaaagacuugcuuuuuacgcacauugugauagagcaucuuuuguugacucacguaaccuccauguguggguccuuuguuuuauuagaaccauggaagaagguuccugggccaucaguauguguugcagagcucacagccaggaacacuuauuuugaacaaugcagacaguacuugccagagucccaaaugcugaauuauugaaccauguuuuuuuuuccuuuguugaaaaaaauaaaccagggugauuucuauaaaucaccaguuuuuggcauuggauuauguauguguuuauuuugugaaccaguuucacuuucagguauaagaacauucagaaagucucucuuguuuuuuuucccagacaggguaaaugacagugaguaaaaugaguuaauuaaaacuguugcuguuuccaa

SEQ ID NO: 15861 - RNA, 15646 nt, Homo sapiens
ugcggaagugaggggagggagaggccgagagaaauuucgguacugcgcaugaaccgagcgugacguugagguuugaaauaaccggcaaagaguaaaggcugaaacuagcuuccugaaagcuucguagggcccgagcccugugagcccagguucugcgcccacuaggaggugucaugcugacugcuuuuuuuaaagcccuagaaucuuggcuucggcguuugggguaagcuccguucucguucucaagcgcguuuccgcgaacucucgcgggauugacgggccgucucgagagccggcaucuccuaggagcuaguccugguccucggcuaggcggcuuggggucgcggcguaacuggggagccagccugacgccggcggaccccgccugugauccuggcaacgauggaugaugacuugauguuggcacugcggcuucaggaggaguggaacuugcaggaggcggagcgcgaucaugcccaggagucccugucgcuaguggacgcgucgugggaguugguggaccccacaccggacuugcaggcacuguuuguucaguuuaacgaccaauucuucuggggccagcuggaggccgucgaggugaaguggagcgugcgaaugacccugugaguuccgagccccgcuggggaaagaggcgggacuggcagcuuuccugcagcccccggcccugguuuucucuccuuucucuaguccgacggucccagggggcguuaaaugaggggagucugguuuuggaccuggcaauuccugccucggcguguuucugucuuccuuaccuuuucucccacucgaacaauaagaaagcuguguagaccacaccgccacgguuggacucagggccguaacaaaaaagagauuuuuauuugaaucucacuucacuugaaaauaacaaguuccugauuugccuuaugauagugcuguaggacccagaagggagaagcaaccaaaucugcaccuaagaaagugcugaggacgcagaguaacugccaaaggauguguguucuccuccucuauucccguuaggaaacccacuuuaguuagcucguguguugcauuggggaucuucagugaugcuuuuaaaacgauucuuuuucuacacgcuaaauuucagaaaucccuauuugaaauaauaaucuacuccugcacgugaacaggguuaaguuuaagauacaguuguaucccagcaugcuuguuuuugaguugauagaaaacaaccuacugucaaacaaauuaagauaugauauuaaauuguguuuaaaguaccaauuuccuuuauacaggcgucuguuaugauuuuggagauaugcuacuggagauaucugcuuguuaauaacaccgaacuguaacuugucggaaggagacugggaguagcagaauaggauugccuuugagcuguugcagccuagcuagggcaaggggagcugcaguugggccaugugguccgcaucguauuccacuagguccccguuguacaccagguacgguccuggcgucucuagcaggugccugcagccuuccaccuucucaagcaggguggugagagcacgcugcuuuccuuccuugcccggcggggaucggagccaucgcgggaggcgcccgcggggguuguaacuaauuaauuaggugaaaugcaaguaucugcuaaccaagggggguauacuuucaugaaagccaucugccaacugaguuagugugaacugcccaagaauguguaaggacuugggcauauuuggccaauguaacacauuuuuauggugauuguuuucuaggugugcugggauaugcagcuaugaagggaaggguggaauguguuccauccgucucagcgaaccccuuuugaaguugaggccaagaaaggaucuuguagagguauuuuucguguaaacuugcuuccuagcgcaguaauuuacaaauacuugucaaugauuuagacugcugugaauucgccuguauguaucguuaaaaaaagucacuuugcccucagugaaagcuugaauuauggggcaaacaauaaugaacaccuuauguuuuuuauagugcuucauaguaaaaaaaaaaaaaacaaaaaaaaggcuucuaggggccgggcacgcuggcucacgccuguaaucccgacacuuugggaggccgaggcgggcggaucacgaggucagaagaucaaaaacauccuagccaacacggugaaaccccgucucuacaaaaaaaaaaauacagaaaauuagccgggcgugguggccggcgccuguagucccagcuacucgggaggcugaggcaggagaauggcaugaacugaggaggcggagcuugcaaugagccgagaucgcgccacugcacuccagccugggugacagagcaagacucugucucaaaaaaauaaaagccuucuagguauauuaucuguuuugauuuuacaacagcccuguuuauguucauguguugcuguuuucauuuuuaugaguaaagaaauuaagguucagagagguuaaguaacuggcuuaaguuacuuauuuagaaacagagaaaacaggauccacauguuccuguugagaaacacaaauuuugauucuccucaguugggcugcaacacugcugugcucucaggacaccuagcugagcuggcagcacaaaccagugugagggcacgcuucacauuuagagcugguacuuacuucugcuagcagaauggagcagugggagcugaggcaggaggaucucuugaacccgggaggcggagguugcagugagccgagaccguaccauugcauuccagccugggcaacaagagcgaaacucugucucaaaaaaaaaaagaaagaauuaucuguacaaaagagcacagugguaguuucugagcauggggugggaagcauguuaaaacaugcuuggagaugagagaugcuguuuuuaaggauaauaaaaggcaauggauuacauaacagugugaauauacucaacacugaacuguacacauaaaaauggguaaguuggggaauuuuguuaauuuuuuuuaccacaguuuguuuaaaaaguagcuacuaaauguaaagugguacaguagaaauacuugauuaaugaaaaagaacagagcucagaugauaaagagaaagguagguguaaacaaaauaucaguuaaauguaaguggacuaaacacuccauuaaauacauggaauggcaugcuagauuaaaagagacaugcuuacaguaaagacacacuuauuuuaaguuuaaaaggaugaggaaaaguaaucauccaaacacuuaaaagcagaaaacuauuguggcuauaagguugaguacucauuauccaaagugggaccagaaguguuucagauuuuuuuuuuuuuuacuuuggaauauuugcauuauacuuacugguugagcuucccuaauccaaaagucccaaaucugaaauggcuuuagugagcauuuccuuagaacuuaaccuuuaaucaucuuguaagugcucaaaaaguuuuagauuuuggagcauuucagauuuuggauugucaaauuagggauguucaaccaguauuaguaucagacuaaagacuucaagggaagaaguuuuacuagaggaaaagugggauauuuuauaauaauaaaauaaucuauuaagcaacaauacauaaucucuccaaaaguaauaacauaacuuuaaauuuuaugaggcauaaauuagcagaagcaaaaagaauauacaaucaggcugggugcgguggcucacgcccauaaucccagcacuuugggaagcugagacaggcggaucacuugaggccaggaguuugagaccagccugaccaacauggugaaaccccgucucuacuaaaaauacaaaaauuagcugcguguggugacacagccuguaguaccagcuacucaggaggcugacgcacaagaaucgcaugaacucgggagguggagguuacagugagccgagaucacaccacagcacuacagccuggggugacagagcaagacccugucucacuacagccucaaccucccaggcccaagcaauccucccgccucagccucccaaagugcugggauuacaggugucagccaagacacccagacucauacuugaagaauguuaacacaaccuucuuaguaacccaaugaauaagcggaaaaaaauaauacacauuuuaaaaaguugaacagcaugauuaaccaaaucagccuuagaaggagcccuaacuggaagaguugcuuaaugaauauguauuggguaaaugauuacauaaacacaugagaaaaaaauguuuuuaaguagugggugagaagagaauggggaauguauaauaguaucaagugagcauuuccuguuggcagaaaguuacaaaaugacauuuucgucaaugacaggccccauauauaacaguggucccauaagauuauaagaccauauuuuuauuuauuuauuuauuuuuauuuuuuguuuuuugagauggaguuuugcucuuguugcccaggcuggagugcaaugauaugaucucggcucacugcagccuccgccucccugguucaagggauccuccuaccucagccucccaaguagcugcgauuaaaggugugcgccaccacgccuggcugauuuuuguauuuuuaguagaggcgggguuucaccauguuggcuggucucaaacuccugaccccaggugauccuucugccucagccucccaaagugaaugggauuacagguaugagccaccaugcccggccaggacuauauuuauuuauuuuuuuuuugagauggagucucgcucuguugcccaggcuggaguacaguggcgcaucuccacucacugcaagcuccgccucccggguucaggccauucuccugcgucagccucccacauagcugggacuacaggcacccgccaccaugccaggccaauuuuuuguauuuuuuuuacuagagacgggguuucaucauguuagccaggauggucucaaucuccugaccucgugauccgcccgacucagccucccaaagugcugggauuacaggcgugagccaccacaccuggccaagacuauauuuuuauuguaccuuuuuucuucuuuauauuuaguugcacaaauacuuaccauuauguugcacuugccuacagcauucaguacaguaacauccugugcagguucguugccuaggagcggcaggcuauacucuauagccuagguauauauacucuauagccuagguauauacacucuauagccuagguauauauacucuauagccuagguauauauacccuauagccuagguauauauacucuauagccuagguauauauacucuauagccuagguguguguauauauauauauauauuacauaggcuauaccauuuagguuuguguaaguacacucuuaagauguuugcacaaugacaaaauugccuaacaauggauuuuucagaacauaucccugccaagugaggcacaacuguaguuaccuaaaucauagagaaggggguucagaaaaggaacagacuuuaucugguugaggaggucaagaaaagcuuuauaacuguacauuuuguuacuaccaucaccacuccugcugcucacuauugagcaccuauugugugucagacuuuggacuaaacgucgucuuuaccacagccaugcaaaaugaggauaucccauuuuagggaugaggagccacuuggagccugucccaggucucaugcugugauuguggguuuagguuccaguuucccugacucuaaggcucuuguucuguccccuuuaccauucaacucaucacuccugcgauuaaaacauggagaggugagcauuaaaggacgaauuguacuuuugacaagcagagauaggacaggaggcuacucuuggcagaaagcaugggaauaaugugaacaaaagugaguucagacaacugggggcauauuuaggacuagagguaguucauuuuaacccgauagaacagucauggaaaacagagguauuuugggacuguguuguguauagauccuugaauuaagacuaaauauggaaaaugauagauauuuaaaaaguucaguaccauuuucaagauguuuuuuaauguuuaauuaaauugaaccaaaaaucaggaaccuaaauuuguuucuccuuuaugagaauagaucuuuaucauugcucuaauuuagaacauugagaaacuuuugcaguaccuuucuugaauuugagucuucuucguugagcggcauuuacuugaaaaauaaaguucuggcuggguacaguggcucaugcacguaaucagauagauggauugcuugagcccaggaguugaccugucuggguaagauggugagaccuugucucuacaaaaaauugaaaaaaaauuagccagguguggugacaugcgccuguaaucccagcugcucaggaggaugagauagagggaucccuugaugccaggaauuugaggcugcagugaaauauaaucaugccacugcacuccagucugggugaaaaagugagaccccaucucugagaaauaauaagauaaauaaauaaaguuccuuuuaagagauacaguugauaauuuuuagagggauauaugaaugaccaaguuaaaauguuugauucucucauuuuucuguucagcauaauuuuauaagacuaaaauucauuaaugacagucuaguucuucugauggaaauuguuuuuuaaaaaaauuauggaggaucaugaaaaagguaugucuuugaagaucuuucugauuuuugcuuaaaaaaauuauuuauauuuuuuagagcaaaaaccccagcaaucuuaaaugcuuuuguuaauuuugcacagaaacuugugcaucuuugguguggaaugagcaguagguuuuaguguuuguuucaaguuuucaugauuucugaaucaaaacccaaaagcuguagaaagcuauacacaaagaugucuuguucaguguccuccucuaucuugaacuccuuacuugcuguaggagcuguuaguuucuuuucauuuuucuguuuugcaaauauuucuauucauuuuuauuccuccuccccaccauacaaaauuuuucuuacacaaaauacuauguacauucuucuguacuuugucuuuuucuuuuucuuuucuuuucuuuucuuucuuucuuucuuuguuucuuucuuuuuuuuuuguugcccaggcuggagugcaauggcaugaucucggcucacugcaaccucugccucccagguucaggugauucuccugccucugccucagccucccgaguagcugggauuacaggcgcccgccaccaugccuggcuaauuuuuguguguuuaguagagacgggguuuuaccaugugggccaggcuggucuugaacuccugaccucaggugauccaccugccucggccucccaaagugcggggauuacaggcaugagccacugugcccagcccccugucuuuuucauuaauacgcucuauagcuuucuccaaaccauuucauguagauccuucucauucuuuuuuguggcugcauagaauuccauuauauggauguauaaaacacuggaguuauuucuaaucuuuugcuguuauaagcagugucacagugaauacaccuugugcauaugaccuugcaugcuagucuagguauugcucucucagaagacaaaugcauuuguaauuuuguuagaugcuaccaaauuuuccauaggagaauugcacucccaccagcaguauauaggaauguuuauuuucccuuagcuuuacuaauggugucaaacuuuaggaguuuuaccaaucuugauaagcaauaaauaacauccuaguguaguguuggguuuuuguggggguuuuuuguuuuuugagacagggucuugcuggguuguccaggcuggagguaaucauagcucacugcaaccuugaauucauggccucaagugauccucccaucuccgccuccugaguagcuaggacuacagaugcacaagcuaauuguuuuauuuuuauuuuuauuuuuuuguagagacaaggucucacuauguugaccaggcugguuuugaacuccuggccucgagcaauccucccaccucagccucccaaagugcugggauuacagacaugagccaccacgccugaccauccuaguguaguauuaauucgcauuucucuuuuuauaaauaaaguugggcauuuuuucuuuucuuuucuuuuuuuuuuuuuuuuuuuuuuuugagauggagucuuggucugucaucaggcuggagugcaguggugcauucucggcucacugcaaccucugccucccagguucaagcaauuccccugccucagccuccugaguauacugcucggacuacaggcgggcgcaacuaugcccagccaaaauuuuuuuuuuuuuuuuuuguauuuuaguagagacaggguuucaccauguugagcaggauggucucaauguccugaccucgugauccggaaguugggcguuuuuucauuuguuugugggucauuuauacuucuucugugaacuccauggucuuugcccauuuugaaauuggguugucauucccuguugacauuaggagcuccuuguauauuaggaauagccugugauaagaguuauacauauauuuuucugaguuugucuuuuuacuugguguuuuuuuccuauagaauuuuaaaguuuugucugggugcaguggcugacgccuauaaucccagcacuuugggaggcugaggcgggcagauugcuugaggucaggaguuuaagaccauccuugccaauauggccaaaccccaucucuacuaaaauacaaaaauuagccaggcaugguggugcacaccuguagugccagcuacucaggaggcugaggcacgagaaucacuuggaccgaggaggcagagcuugcagugaggagagauugagccacugcacuccagccugggcaacagaguaagacccugucucaaaaaaaaaagaauuuuaaaguuuuuauguaguugaauucauugauuuuucuggauuuugauauauagucaaaaaggucuuccuagaacagggaguucuuaaccugugauuuucagagcuuuagauguuacacaaauuugaguaccccuucucugaaaugccugggacuagaagugucuuggauuucagauuuauuuggauuuuggaauauuuguguuauucuuacagguggagcaucccaaaucugaaaauccgcaaugcuccaaugagcauuuccuuuugagugucaugucauugcucaagaguuucugauuuuggagcauuuuggauuuucagaguugggaugcucaacucauaugcaauauuuugugaaugagugcuuauauaauuuuuauagaaugagguggguuuuuuguuguuguuguuuuguuuuugugagacagugucucauucugucccccaggcuggagugcaguggcacaaucacagcucacugcagcgucaaccuccccaggcucagaggauccucccaccucagccuccugaguguagcugggauuacaggcaugcaccaccacaccuggcuaauuuuuguauuuuuuuguagagacaggguuucgccauguugcccagguuggucuccaaccccugggcucaagugacccucccaccuuugccucccaaaguguugggauuacaggugugagccacugcacccggccuagaaugaguuuuaucaguucugaaggaagccugugauacagaaaagguuagacaccagauagaauaagaaaauuuauauuuuccaaagugucauacagacucuaaaacuaauuugaauauuuuauguuccagacccuccugcaugaaaugauacaugccuauuuauuugucacuaauaacgacaaagaccgagaagggcaugguccagaauuuuguaaacauaugcaucgcaucaacagccugacuggagccaauauaacgguauagaaagccauaucuauuuaugauguuuaguaguuguuuauucaauaacuccugagauuuaauuaaaaguagagaacuagguagaaacaaguaucuuugaggauuuuccacagcgaacgagaggccuagagaagcaaauuggcuugucugggacuacaugguggaauggcagcagagccagugauaucccugaggccucugaccucuucugagucaacauuuuacacacagguaauucaggccugcaguacgucacuucuggaaucaucaugaucucuuaacuuuguuuccuuauuauugucuuuuuuaguccauccuguauccugcuaccauugcagaugucauucccucaucagaauucuucuuugauucauaucucuguauagcauuguaggagauagcaaagccucagguucaaaaagcuggaggcgucaggcugcuuggauucaaauccuggcuccaccaauuauuaacuuuccuaugccucauuuuauacccauggcaaaugagaguaguaacaauaccuaucuguuggauccuugugaggagaaaggauuaaaggagaaagcacaucaaaacauuuuagcccaaucugacacuaauuaaauauuaguuuuauuguauucauuuuauuaaauaaccuuguuccuuuuuuacugccuccaacucugcugccuguguccugucucuuuaacugcacuuuugaccucccugccuuuccucagguguagcuucccugaggcgugccacugcucuguuuuguguccgaaugcuuuucaucguuccaguggcaucucauuucucccucuuuugaauccucagcagauauuuaagcuauuacaauuuuuuaugcuacuuucauacuuuugaacgcaggguaggucuugcccaucuuuauaguacaucuguauaagguguauaauguacugaauugaauauuaauaggauagauuaaauucuuucuuauguuuggguauuuccuuccuuuaaaaggcaacaaaauccacugugauagaaaaugaacagugcucaaccgccauguuuuguuuauuuauuuauuuaagauagggucuugcucuguugcccaggcuggaugcaguggugcauucauagcccacugcagauucaaccuccugggcuuaagugauccucccaccucagccuccugaguagcuggggcuacagaugugugccaccaugucaagcuaauuuaaaaaaaaauuuuuuuuuuuagagacagggucucaccauguugcccaggcuggucuugaacucauggguucaagugauccucccaucucagccucccaaaguggugggauuauagacaugagcuaccaugccuggccucuccauguauuacuauuuucuagcuaucaguuuuaauuuucuaaagacuucauuucauuauuagacacaguuacuucaacauuaggaaagugucuugcaguuuuuaaaaaaaucagacauaaaauccggguuagcaagagaauuauagacuugcuuguauaaaauacauuaaguuucuuaaccagaacuuauacuuuaagcaaagcccuuguauacgucccauuguucagcuggaagaguaucuguucuuuuaucuuagauaucuguguguuuuuauuuaggagagguuguaaggagugaacacuccuugcuuuuacagguuacauccuguuauaaggaacucugcaggguaucuacauuguagaguaauuuuauuuuagugacuacauuguuaaaagucacauucccaagcguuaggaguuacaggaauuggaagcagaacagauccaggcugggugugguggcucacgccuguaaucccagcacuuugggaggccgaagugggaggguaacuugagcccagguguuugagaucagccugggcaauuuagugagaccuuguuuccacaaaaaaaauucaaaaauuagcuaaucgugguagcucacgccuguauucgcggcuacucgagaggcagagguggaaggaucacuugagccugggaggcggagguugcagugagccagguucaugccaccucacuccagccugggcaaacagagcaaguccaugucacagaacaaacaaacaaaacagauccauuugucucucuuuuuggguaaugaauuaagaguucugaacauaauagagugcgugguuucccgugcuucuuugccuuaaaaccuauguccuucagucccuucugcauuuaauauaaugugcauucuuugcaugcuuaccaaguagaaauuuuuugcuuaggauggagcgauagugaguuuaaaacuaucuauagaguuauagaaagcuuagcauucuuucccacaaggggaauuuauuagaaagcuaaaugucuuugguaaaacaccaaaaucuuacauacagaugcuucucacucuuacacagagaguuccacugagaaggcagaagaauaaggugcccauagucauuuaggagucauuucaaauggugcucuauagucuucagugccaccaugcugggagggcugacccucuuuucagucaggucuuuucccuuaccuguuuucugcuuggguuccaaauaggauuuuugucuagagggugaaaaagaaggcauccuacuuaaggccugaaaagcacacuucagagaauuuuauuugacucaaugaaugaugcuuuucugacugagcaccuucuuggugccaaaagcacuauauuagccacuagggacacaaaaaauuaaaacauucagauccuggagaacuuuucagucugguaauagaaauauuuauaaacagauaaaaugguaccucauaaggcuuauuacagagacauaagcacagaacuuggagaauguggagagugagcuuagcagaagcuucacuggguaagauacuuguguuguuagcgucagucaggcauuuauagggaguaauguaguccuuuagaacccuuugcuauuuuuacuuauagggaaaacuucaauuuagcagugggaaugauucuuauuuuaguaugguauuacauaaaaucuuaucuuuauccuaauuuuugaucauuuacaaauuugauuucugaaacuuuuaguguucaugaagauuuucugugguuuuguuuuuaaaagauuuuuuuguccucuaaucccaugugcaucuaucuuuacacaguuuaugaaguauuaacugcugcuguuucccauuaaaaucaacuuuugaacagaaacuaaauauaguugcuuucucuccuaaaauagaacuuuucagaaagcucugggaaaguuucaaaaauuaaaaaaaaaaaaaaaaaaaaaaaagacugcuuauguaaauuguuuucuugcaguuguuaacuugcuuauugaauacuaaaaauucugucuccacucagguauaccauacuuuucacgaugagguggaugaguaucggcgacacugguggcgcugcaaugggccgugccagcacaggccaccguauuacggcuaugucaaacgagcuacuaacagggaacccucugcucaugacuauuggugggcugagcaccagaaaaccuguggaggcacuuacauaaaaaucaaggaaccagagaauuacucaaaaaaaggcaaaggaaaggcaaaacuaggaaaggaaccaguauuggccgcagagaauaaagguaccuucguguauauucuucugauuuuuaugugaccauagcuaugauguaaagacaauacuguccuucagagaacugguauuaagauaaacuuaaggaucguuucugguguagaagucuucaaguguagacuuaaggaaaaaaucccacuguccaugaaaugaugguaggaaaacagacuuugcucuguacagaaguaaguaaaaguaggaauaguuuccauggauauuuuuauuuuuauuaacuuuuuucaguuucuuuuuauucaaagaaacaaaauucaaucucugauaauauuugagguaaaguuccuuucccuaucuugacucacugaguuauuaggaaacagaaggcaaaaagauugucaaaauaaaaacaauaauucaaguaacaaugcccggaauauacguccuaacuacaccccuuccuaucagcuggauucuauccaagugacucuauugauguauguauguucauucaaagaaugggaaaaggauaugacauauauuugccaguacuucaucuucaagauuuacccuuuuccugugaaguucagaguuacugaagaugcuucuucccuugggaaguuguugacccaagaacauagguuauauuucccaaaucuuuaauuauugagugaaagagcuauagaugaauugauauggaaagaccguaucuucauuuucgugaguagaaggaaagauaagaaugaggcagcagauuuucccuccuggaauuacacauaaaggacacuaagcaauuuucaagguaaauguugccuuguuguuggucuuuggcaugauaagauucuuuauuuaaauaugagagaauuuuuuuuuauccuuuauauucucucaauaucagaacuccugaauucugaagauugcccuccucccauuaauaggauuguauggauguaagauggaauaaaauacuaguucuucauuuugagaaaacuguacauuaguuuaauguuuguuacuguauuucuuuugaguugaggcacuuacauaacaaucuucuuugcuuuuuuggcagauaaacccaacagaggugaggcccagcuaguaaucccuuuuagugggaaaggauauguucuaggagaaacaagcaauuuaccuucaccugggaaacugaucacuucacaugccauuaauaaaacccaagaucuuuuaaaucaaaaccauucagcaaaugcuguaagaccuaauucuaaaaucaaggugaaauuugaacagaaugguucaaguaaaaauucucaucuggucuccccugcuguuaguaacagucaccaaaauguucuaagcaacuacuuuccuagaguaucauuugccaaccaaaaggcuuucagaggugugaauggaucuccaaggauaaguguaacaguuggcaacaucccuaaaaacucagucucuucuaguucucagagaaggguuucaucuucuaagauaucccuaagaaauucuucaaaaguaacggaaucagcaucugugaugccaucccaggaugugagugggucugaagauacauucccaaauaaacgaccuaggcuagaagauaagacuguuuuugacaauuuuuuuaucaagaaagagcaaauaaaaagcagugguaaugauccaaaguauaguacaaccacagcucagaauuccagcaguucauccagucagagcaaaaugguuaauugcccaguuugucagaaugaaguucuggagucucagauuaaugagcacuuggacuggugccuugaaggugacagcaucaaagucaaaagcgaagaaagucuuugaaaaagguuucaaagucucaaguaccaccuguauuaucucacuaaugugcuaugucagccagucaggaaguucugguuaauacuaagauuuguagguuauaaucuaguucacauaaccaauagaaaguguccuauuuuauauauacgcauauaagauuguaauuuuaagauguuuugugucucagggugcuacauucacucuugccuuagguauacuguaacccagguucugccugucguguauaaguuuuagauacuuuuguucuu

SEQ ID NO: 15862 - RNA, 526 nt, Homo sapiens
gccugucuccgggaucucaggaccucagaaaguuugcuuucacucugacucauuucuggaagaaacaagaggggaagugcaggaagccuccaggaugggguacaggagggcgccuuccagacgcaugauuuaagaagugaccacacagugauggagaagauggagggaugugaggggcucauuuauacaaagugggggcgggggggaggaguggggauaacugaugacccuggaaagagaugagugggagcagauguuuagaaaugagauaggauuccaacuucuagcaucuuccagcagcuccgggcugguuccaggacacagaaguccaugcaagcuccuaggcaacugacuccccccuucaccccuucucuuugguucauucaaggaagcuacuggagcacccccuagguagcaccugcuauaggacaauggguacaaggaagggcuacacaugagcucuuugcccuuaagcagcucaccuccaggcuagaaggagagcacgugcauagaaaacgaaaucaca

SEQ ID NO: 15863 - RNA, 2839 nt, Homo sapiens
auuguacagggaaggaugagacagaggagaagggauaacaugaagcggcguccaaccaaccaagaggggacuagaaucaagagcucugcuuuauuccuaugaaggacaaaaaaagagauuucaucauuugguccuuuuggaaauguuuauuuuuacagaaauauauaguagaaaagcaaugaguguuaacgaacaauacuacuuaaaagggaggccacuggccaucagcuuuauauaaagcagaucaggcuuccuuuggcuuuuuuuuuuuuuuuaaauagcuuuaaagcuaaguuucacuaaaaguguuagucaaaguuauaccacacuuuuucacugucuuuucccuaaguggaaaggcagaggucaccaugucaaugaaagugauauuauuauuaacuaccuguccuuaguaacuuaaaucaaaaaaaucuaaccagaucaacaaggggaaaaaauaaaaugaaaauuauuuuuuaccuaugucuugcugagaccagucaccugguuuuaguuuacuaaguugaguuugagaaagguaccacugaaaucccgcagcuaaaggaacaucagugaaucugguaaauuuaucaauggugauccauucaucuucaauaaggccugaaaggcguggaaggauguaaaauauggucugaaaagagaauuauaaaaucuaaauuucuucccuuaagaauaacaaagaaauauauaacauuuaaaauacaacuuaauuauuaaugauauauucuccaaacuauuacaucugaucaaacuauauacuuucauuuauaucuuauagcaacugucuauauauauuucucaucuucucagaaauuaggggauuaauuuaggaaaccccugagaggaggcagaacuuguacucugguacuucuaacuguguguaauaaaccaguaugugccuaauaaaaacaguguuucagaaguaaucaguucuaaugauggacaguauuuggauaagugcaauuuacugacaacuaaauaccuccaaaggcaaucaaguucaagcucuuuucaugacaagucuuuuacucucguacccauuagauaaauuuagaaucugaauucugguuugacuaauauaauuaguuaugugacguuaggcaagugauucagccuuucuuggcuucaacuuccucauuuguaagacgaggauaaaaucagauuacaacaacauauuaaaguguucgugaacacggcauagucugacaccacuguaaacagucaucgcauaagcaauccuccuuugcuuuucuuaccuacuaaaagaacugcaccauaaaaaugaccaacagugaaacaaguacauaggaagcagagguccaaguaacaggcaacuuaaaaacgaaacaauacucuuagcagcaaugcacaugucuucaugaaagguuuuagaaugaauaugguuuucuucacacuagcuauaucugugcaaacuuaaacuggcacaaugaucacgacuacauguugauuaagggggaaccaaguagggggcaccaaguacagcuccaaauacaugaagacuaaacuaguucaaccauuguggaagucaguguggcgauuccucagggaucuagaacuagaaauaccauuugacccagccaucccauuacuggguauauacacaaggacuauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugaggccauaaaaaaugaugaguucauguccuuuguagggacauggaugaaauuggaaaucaucauucucaguaaacuaucgcaagaacgaaaaaccaaacaccgcauauucucacucauagguggaaacugaacaaugagaacacacggacacaggaaggggaacauuacacucuggggacuguugugggguggggggagggggggagggauagcuuuaggagauauaccuaaugcuagaugacgaguuggugggugcagcacacgaccauggcacauuuauacauauguaacuaaccugcacauugugcacauguaaccuaaaacuuaaaguauaauaauaauaaaauaaaaacaaaaaaaaaacaaauacaugaagagauacaguuccuaugaacaauuaagccccauuauuuuauuuacacauacaccuuuaauucauuucaugacuggagaauaaaucauaaaacauaugagagugagguggucaaagguaaggaugagggagggcaggagggaggcaaaggacuuacuccuguuggaagacugaauagaaaaagguugacuuaacacuagagugacuagaggaguccugcagaaagaugccggacaaagcauucugggcgcuaaagaacacagagcagagcauauuaaaaucuuugaaaaauccuaaaugauauuugcagugaagcagcagaaaauacacauuaguguucuaggaugcauaucuugcaauauauagaucuauacuuuuuuacagaucaguuuaucaauaaucuuaguaauccaccaaaaaaauugcuuaugcacagcagcuuaaguuaccaauaacuuauaaguucuucagaggaaaagcccuaggucagugauuuaaauucaagggcagcacauuauaauuacaguugaaaaagggagaagguaucauaauuuaugcaaugucuaaugauuuacauauugaauuaauuuacauguuaaucauaauaagcauguuuaugguucuuaaaauuauauaagcacauuuuguuacagucagugaggugaug

SEQ ID NO: 15864 - RNA, 14468 nt, Homo sapiens
agccacagcgcccuacacaagcacggucugaauuauuacucauggaaauccccucuguuucauggaaucagguagcuuucaaacucccaacaauuaauggcccuuuuggucaaaggagaauagcaaaaaaauaaaacaacccccgccccaacccaccccccagaaaaacccaacccagacugccaggcugagggcuucuaaacaguccguuugguuucuaguaaauuagagagagugggugguugagguacaaguaaugcuauccuguagaguguggucuucuuugacgucagcaaaauguuucucucgcguuucugcuucuuucccucucucccuccuuuucccucuccacccuccuccuucccucuuuaugucaaagagacagaugacauaggguaacuguggaaaugugcucauaguuuugcaacauagcucacaggcucagaaaaauucccacauuuuaaaaaaugaagaguauugugggagguggguaaauuggcaacacaaaaauacaugcuacccaggaaaggaagggggaaaggcugcugggaagugcagucaccaccacuggcgguauggucuucccuccauccugcccgguuagcagcucugucugagggaacauucuuccuguggcgaagaacacauucuugcuccagcuggccugaaaucggauccuggagagcaugcgcccugcucccuggcuacuguauuugugggacccaucccggacugcugagccaggauuucuguuggcucugcucccccucaccccccuucagcuagaguuguuuuucucuacucaucaaaggcagcaacagcugcccccauggguuagcauagaacuuucuagaauaaggauuccaagucuaggcaaacauuuguaaccugacccugcaguacuuuuguuuccccuucaaauugcuuuugucagccccacuguuucaacaggggcagccguggacacccuaggggucuggcccgacagucacagggugaggauugguggagugggccacucccuuuguggcugugaauugccauuuggucucuagaguaaugugacucucacauucuuugcccaggcagcucuuuaaaagcaggaaucuauccugaccucgcggguucugacgugcugacugcaagugugguuucaggcaggcagagaaaggagcggggcccagaguacacauaggccugguuuucuccaugugggguguacuggcuucccccucaucccuucccugaucuagacagcaagggcaucagagaaccuuagaacagggaguacuuuguaaaccaaagccucuaaaugcugcagacaccagguucauaugaaaagcauaucugccauggaaaaaauacaugcacgagaaaauggagcaaggucacaugaaucuacucagaaaugagaccuggaaccugaaaaagaaccucugugucugugugugcuuguguguguguguguauugggggagggauaggugcauagcagcaucauaagcagauaacauaagagcacagcacacaguagauauuuauuagguugugcaaaaguaauugcgguuuuugccacuaaagguaauggugagaaccgcgauuacuuucacaccaguguaauaaggauugggcggaugaacaaaugagcaagugaaugaauuacaggaaugaauugguuuagaaaacaaagcaaaaaggagcugaaacuuucucagggguggauggggguagagcugcuggaucaguuuggaagagaacagacuucuaaaguguaaacuuuagagcacuuuguaaaccaaagcuucuaaaugcuguaaaugcugcagacaccagguucaugugaaaagcguaucugccauggaaaaaaauacacgcacgagaaaauggagcaaggucacaugaaucuacucagaaaugagaccuggaaccugaaaaagaaaguguguguguguguguguguguguguguauugggggagggaugggugcauagcagcaucauaagcacauaagagcguagcacacaguagauauuuauuagguugugcaaaaguaauugggguuuuugccacuaaagguaauggugaaaaccgugauuacuuucacaccaauguaauaaggauugggcggaugaacaaaugagcaagugaaugaauuacaggaaugaauugguuuagaaaacaaagcaaaaaggagcugaaacuuucucggggguggaugggguuggugcuggaucaguuuggaagagaacagacuucuaaaguguaaacccaaaccaggagucugacaugaugacugaugauaaugacacucgguaacgagcuugaacacuugccacgugcuggacacggugagugucugacacacaucaucucggcugguucucauagcaaccccaggaaguaggaacuagguuaaggguaugucgacucuuuggggcaccagagaagaaaauccuggaccugaaggguuuaggaagauuugaagcagauguauccaaccaagagcaacccauguguaacuccaagcuggcaaaguggguucuuuaguggcccugccugccuaagucugaccuccacuguaguuucugcccgccucggucacuguugagaggagacaauugcucuccugcugacuuaccgugcagagacccugagggggccgaggguggaauggcucugaucccaggcagcaaaagcuggccuagccaccuccuucccauugcuccuuccuucccgcagaaacugcgggagggaagggaagaauuggcaucccuaggcuucgagggcgguucuuuugugcuuccggccccagccuuacugggcaaccgcugggcucuugaggaagcagacuccaguuuuccaggacauuaagggacugagguagccagagugaugccaacgggccuguccuugguggccuccacggaccuucucucaccuuuaugagaagagcaggaaacuuugguuugacccaacugaagcgcuggugccucgcagcagcucugguuuauuaaggcugagcaggcucuguuuucaacaucgucacagggaucauuuuccuccaccucacguuuccucuccuggaaaugcaccuuagucauuuuuuggucacuucaggggaauucucccuccuucauggucuacaccauugcucuacugaauuauucuuucuuccaaacaugcuauuacagcccugacaccacagguguacauuuaauaaaaauaauccuccaggggcaucauuugaaauaucccccucucauguaagauguuucccugagagguggaguggggugaggugggagggaccuuggaggaggagcuucugcuugaacacagcucguugcccucugauuaccaggacagaguggaguuggcugucaacuugagcuucuugccuacuccucacggacccuggacccccaugcccauacaucccaacagacuggauuccuauuacccacccaugggcaugccauuaaaaauauggaauaugaauaagcuccagaacgcacuggacucugcaacucagcaggugugugaucaaccugaacaaaagacagagcccuuagccacugccaggugguuuagcaagggcguugagaagcuguuuggcuaacagcacacagaccagucugugcucccgugaugggggcaaagaugaagcagaugcccucguggccaccugacacagcaaguugcuagccucccuaaacacacacacgcagucaugaccuccagugucccuggaagguggcacggguaacagccagugcaugcucucuaguccuggccagcuggaguccaagccuuggauaauaauaccuccuugaugggcuaauacaguguuuauagcacuucuggcuucugguaggccgcuuuuuauuguuggcagaaacaauguuuacaguggcuuggugcugaagaucacugcaauuuauugagccauuuuuaugagccauguguguuaaauacauuaccucuacucacauuagccgucaagguagguaucauuauuccuguuuuacaaauaagaaaccugagcuuaaagcaguuaaguaauuugcccaaagucacauagauaguggcaaagagauggcucccauuaagguaauccaugccuccuucacggcgcugugcuggccugcauggagagacagguccacacaagcagagccccuacuucagggcaacacagaguaaauccaagugauuaugcaaaagggcgauggucgugugugugugugugugugugugugugugugugugcgcgcgcgcgcucacccucagcucaggacagcgcuuuucagcugcacacagucugccaaaggcccauguucaaaacccaccuauugaaaagcuugauucugacccucagcccacagcaaauguaggaaacaaacaaagggcauucauaaagacuaggguucaaugcaaaguuccugcacauaguaaagcucaauaaaccaagcagucaaaaccacuggaaagcaucaguagacauucagguaaugauacauuuauuuuaagcagucagaaaggaagagcaaaagguaaaaucagcuucugcauggguagagguuuauccuugccccuucuucgagauagagcuaacaagcccaaagugacuugaacaaggagaaggagccucuugcaggucacuggcauccauagauaaacuguaauggaaguguggcuauggggauaaguggguuuuaacacaucggcuuugacuggugacaaacacucuuuugcucuauaucccuccauacccccuuuaguuccuugaugauaaagacucccccuuuagcuuuuccaggccacucuuguugagaagccaguauucuagaaguugaaguggccuuggaggucauucuuuguugcagcaaacuuuccuugcugaaucagaccccauaaaauaccaacuaugagucacacacaaguaaaugagccgcuauugggaagagagauaauggggugauauuuaucaguggcugaaucuuagcaaacaaugagcauugccuaaucaguggucauguucguguagauuaccuuccaguucacugcaugguagcucuugggaugguuucuaacugucaauauuuacaggaaccaggcacuuaacacagaccaagugggcuggaugucuccacggaugacucaugccaaaugaagccuuuuaucuaagggucacugcucugaauccucauuggcuagagcagauuggaagugaucaggucacugaaaagcuuguacauggcugugggcucaguuccguucucuggauguaccaacauuuaugaaaugaaagcguagaagagagcaaggguuugaacgcguguagaccuguaguauuuguuuguuuuuauuggcuaacuaguaaauauagcucuggggcuaggggaagguggcagugagauggcaccaugagcccacaucagucuccauuugcagcaagauucauacccuugagugauaggagccugcaucaccccagaccuaccugagaaggcgucugcgcaucagccaaacaugcagacagacacacaccgaggaaggggugcagcuuagaacccagcagaucaccuugccugguuauguaaguaagcagaguagaccugucugcccaaccaguccagguagaaaaccuuggcuccguucaagcauugggagauaauuucuuuggauuuugaaagcuuaggauauucaggaggcacucaucuaaaacgcagcuaaccucaggaguagggcacacccuaggucccaucaaauaagaggauucugcuugggaguaagcagggagcaagaggaagaaggcagggccgaggggcagaaauggaggccaggaaaggaaggcacugcaggaggaaguggggcaggagaagcugagcauacccaggcuuugggacacucuugcugggcuggcccucagaacaucacuggaauagacauagaaaagaaagggaagcuuguuuuaacaucaacguuaaaugaagaaaugccacgagacuucagaaacaccacuauggauaugagggaaaagugaaugugaugugcaaauuucacuccccagcaugcacaaagaagcugauugcagccacauuggcagucacaucuuggccaaaguccucuggggacccaguacuaugcaacacgggacccguuggucaacacugagcucuuggaaucccaguucccuuuaaaaucagcgaacuaagccaggauugcaaaacgaccaaugggacaggauuauuauuguguugaguggugaaaaaugucuuugauccaaaaugguagauacuguagaagaacgaggaauauugagucuuccauacugagccuguuuuaaaugggcuuggcuuguuaauaggcgcagcagguuugaagacugggggguguuuccagagaucccaagaugauuucagaaugaaaugagcuggugauuccugcagauaaagagaucagagcacacagccauccuccagggccauaaaucaaaggacaguccuguagcaauuguguggaaacacaacauugccaucauuuuugcacacaaaggacaaaaagugacauaauucgugccccagagaaucauuuuauugcagccuuuuccagccaccaugccccauaaagcugggacuggcaaacacuggcaaacacacugccagccacacagucacagcguguccacaacagcuggggucccuguucccagucuuucugagaugcacacaugcggcugcuucgucaggccauguguguguucuggccgugaguguguauacacgugagcuaaaaacaaacuuggagagugggggacagccaaaagaaaaugaugcuucugauucuauacugaagggucuccauucuauuccagagcuuccguagggcggcaucugcuggagagcacucuguuucauuucccccuaaguuucugcuuucugcugaggguagagguaaggagaggcugaguagggaggguuugggaggagaaaaugaagaagaaaagaugagcucguucccguuccucuuuuccuguacuucucuacuuucaucuguagaucaucuagaauaacuugcagauggcuauaugcucagugaacguguugagaggcuguauucauuuucccgggcugucauaacaaaguaccacagacuggcuuaaacaacagaacuuuacuucuucacggucuggaggcuggaagugugagguguaggugccggcgggguugguuucuucugaggccucucuuuggcuuggaaauggccaucuucaccccauguccucagaugggcuucccucugugugugucuauguccucaucuccucuucuuagaagaacaccagucauauuggauuagggcccaucuucgugaccucauuuguacuuaaucaccucuuuaaagacccucacacuuggccaggcacaguggcccacaccuauaauuccagcaguuugggaucacugaagugaucaccugaggucaggaguucgagaccagacugaccaacaugaugaaacucagucucuacuaaaaauacaaaaauuagcccggcguggugguauguaccuguaaucccagcuacuugggaggcugagguaggagaaucacuugaacgcuugaacccgggaggcagagguugcaguaagcugagaucacgccacugcacuccagccuggauaacagagcgaggcucuguaucaaaaauuaaguaaauaaauaaauaaagaccuuaucaccaaauaaggucacauucugagguccuggggguuagauauucaaccacaacaaaagcagagcaggaagagauguaaacaaaugugcagagcccuggcagaagcuuggcacugugccaggcaggagagagaaaaagugggagagacauuaucucaacgugauugaaugaugaaaugauagcccuggugagugagugaauagguggauggaucaaucaugaaugaauugaaugaacaucaaaacugcuccccgaauccagaggacucaacaaacuccaggcauaccaaguccagaagccgaguccagagcugacagccuauucccaucucuaucucccacggagcugcagagaucauuagggaacuaacguggccacugcuucaugcccacagaggcccaccagcucuuuccuagagcagaaccaccgugcagagaggugaggcacucccagaugaaauccaggccuuccccaucugugagcccuuucccaaagugggcucacagcagcccacagucacaaagcagaacugaaacccccuacaggcagcaucucaggucagcugugcggacagcgcuaccugccacaggccacaccagcugcagugcggugacgggugguguucuaugccugggauagugucacccugccaaaugagagugaaagucuccacauccuccacgccauccccucaaaacacucccggugcccgaaacuguaccccuaaguaaggaagccaaauuagaggaacagagagggaacaugccccugagcuuucucaucagugcauucuuccacgcacugcagauaauucagcuacgucacucaauuaugauugucugugcugugaguguuuacuuaaucaaucuucaaagagcuuuccagauggguguuuuggugacuaaaucaaggucagaguuccuccugcaaucaagcagaggcagcagggggcaggcccagcugacagucaucugaucuccgcagcugugcacaaacuuugaaccaguccagugucucuuucaggcuccccaugaaccccaguccuuaguccacuccugaauugcaacaacacacaacacaaaugcacacagcgaugccucccuuucuuggaugacucuuuuauaucauguuccugcacauucucccuccaguccaaacauaagcaaguugcacagcguauccaugaaucuuuccuuuauuacagaaucugcacuccaaaagcacuggcuugguauuuccucugccccgguagggauuuuuaugggguuuuuauuugguuucauuuuugccaugcuucugagaaugguucuuuuguucuuccuucacucaccgcuuagauccuccaaggcauuccacucagaaaaucacacggcugcugcccccacuccaaaaaaagggagcugagaaaaacccccauuuuccuauggauuuucaagccaaaaaacaaugggcucuguggacagaugucaccccucccccaggccaugccccucacugccaggcaggggaagcagaggcgaaggaggagggcccacugcgcccuaggacuugggaauagcucucagcaccacgguggugggcuccauuguaugucuuccaggacaggggccccuucuucuggaaaguacccccucccuagcacaaaucagaguccagaugugagcaggcaucaguucagcucuucccaagccgcaguguuugagccaaugauggucaccuggccccagugaaggccgugaaggccccucucugucccuuucuggcagugaagucaugagguacaauaagcaaaagcugccaucgugcacauuaccugccauagagaggaagcuuagcaaagagauuuagaucaguauucagaggaaguugaggcgugagaaaagagagagcacguggcaguguuggcucccaguugcagguguccagggucacacaaagcccccuuuuaaaagcccaggcugguuugacuugcauuucucucucuagaagcucucaaguccuuguugaauauggcagugacuggaugcuggccauccuaccugaacuagaccagccgagccucugcucuggccaagcaaaugggaggagauggagggagaaaagaggaaaugggagagacugggccggaagaagaaccccuguccaaggugauggagggcgucggaacacagaacaccuguagcaguuuugcagagggcuuccaauucuuuaucaagccugcacccgacucuuagguuauacagucuuaggcacaagcaauuaucugaauaauuggaguguuucuuagaagagguuuuaggugucagcagcgaugucuguucagacggcacacuagugacagauccuuggaaaacuccaugcucuagaagaaaaagccaauccugacuuuucacuucggaaugucucagcuccccaccugacccucuccuaucguaucauuggcuaaauagacaaagggaccacaagaaaacuaccuccuccuucaacugccuccuccaucagucuagcgccugccuagguggagccccugagaacuaugcugcucccccaaaugcaacucccacaaaggagggagcucuugaggcaggcacagauccaggauuugccucggcucucuaugucacuagccucucucagcugaaaccacaggaaggccucaggucagaaggcuuacccaaugugaagcaaggucauaggguccagcugagcccccucacucauccaaaggggucaagggagggccagcggcuacaaggggucagagccucagguuugacuccaaguucaaagaaucuagcuaaagccacacugugcccccuggcaccacccucagaaacagauccaauccugagucagagaggaagcagacacucacugaaucacgcauccacuuccuccuacccacagccgcucagccaagaccagcagccgcuuccaagggacaaauuagugacugacacucggaaaaguugaugcuguaaaggagagcaagcagggcgccacgcacgcggugugaaccaccaggaccgaguuuacuguggcuccccacccccugcauuuuucagaguaaaacugcacauuuuguaacagccccuauccuguccugcacugaccuuggcuguguuauuuuucacuucccuguucagaacacagccacacuuuccaaaugccaugaaucaucaccaccgagcaacggccauuuagcaaggcaggaaaccacugcgcaccaggccuggaaggaguagcucccugcagugggccucucccacccuggcuguucgucguggcaagaguccaccacggaggcuggcagggcagaguugccaccccauguucucaguuucuccaccaucgucccugggggcuuccaguucccccuugcacuaggucacaggcagcguuagccaucuucugacuuucccgaagccucucuugguugcauuggcugaaaugaagcugucaccuuccaaucucggaagggagagaaauucuuggugacauuggcugaagugaagcugucaucuuccuaucccagaaaggaaagaaauggggagacccauucgagaccaagggaggccaggcgccauggcucacgccuguaaucccagcacuuacggaggccgaggcaggcagaucgcuugaguccaggaguucgagaccagccugggcaacauggugaaaccccgucucuacuaaaaauacaaaaauuacccaggcuuggugguacaugccuuuagucccauuuacuuguggggccgaagcaagaagaucccuugagccagggaggucagguagauuagaucagguggaucuugcacagacaucaacaagacaugggacgugcauucugccugcaaguggccuugcaguuauaggcaaaugucauccugucauccuuuaugaccagagccaugcaggcuucuagaugccauucaaccaguuccugaaaguagucaccggugaguccauaaaucaaucaaucaacaaaauauuauuacccucaaaugguuaucaaacuguucugugcuaggcaccuggcaccauggcucucugaauaacauaugucugccuucaugccagccuuaguuccucauguaguaaugauauccucauaugaagucauuauuuuugccucuauuuaaccauaaacaguaccauucaaaaguaaaaugaucuaggaaaggcaaaucaauacaacaauaaaacaucaguuuuaaccuaucagauuggccaaaacuuuaaauauugucaauggcuaguguuggccagagaguguggaaaugggaacucuccuuauuauugguagauguuuaguguuauacauuuucugggagaaauuugacccuguacauuaaaauuauucaugaguacucuuugucuucuuaauuuuaaaacuaggaauuuauucucaguugagccaccagaaaaaaauugcacagauagucaucacaguguggcaaauaaaucuaaaaaauaaauaaagcugaaacaaccuagaagugauugagucagugacuuauaguauguuuaaucauaugcuaugcaaccauuaaacauaauguuggaaaucuacauccaaagccauaggaagauauucacauggaucauucugauagauaaaaaguaggagcugauacaacauuugcagcccauuuauguaaaaauguuguugugagggcguauucauaaaagagacaccuggaggcuuaucaaaucguugacaguggucaccucugcagagugggauuuggggaugauuuuuacuuuccucacauuuucuguaugucuuaaaauugccuacaauacauaugaagcauacuuacagucagaaaauauacacacauuggccuggcgugguggcucacgccuguaaucucagcacuuugggaggccgagguggguggaucaccugaggucaggaguucgaaaccagccugaccaauaugguaaaaacccgucuuuacuaaaaauacaaaaauuagcccagcgcaguggcaugcaccuguaaucccagcuacucgggaggcugaggcaggaaaaucgcuugaacuagggaggcggagguugcagugggccgagaucaugccacugcacuccagccugggcaacagagcaagacucugucucaaaaaaaaaaaaaaaauuuaaaaagagagaaaauauacacacauuucuuuucauuuuaaaaccaaaugcaacacaaaucuaaaagcuguuugccuaacagaucauaucugugcaagauaaguuuuacauguucucuuucugauggaagauguuucugcggacauuccaccagaaggucguggguccuaagcuguuuuuccagagcucugauaggcugaacugaauuauguucacacucucuuacgcagccccuguguggcaaccugauggaucaggauggcugaccagggguggagggguagagacagggacauggcagaguuuucuccaacaggugccaaguauccagugugguaaucaaaucccagcuuggaauuaacuaaauuaacuaccacagaccucucuggguggccaagcaaauucagacguuuugaaaauauauaacucacaaccucucucucuccucagcuccagaaauaaauuccagacccuuggagaucacaaaaaccuaaagccagaaagauccguaggcagucauguauuuuggacuccucguuugacguuugagggaaccaaggcucagagaagugaagugacuuacucaaggucacacagcauaaggguggcagacacaagagagcuugugucucuucaucuguaauccaagguugcuuuugcuauaaugcaucuagcaccaguacagugggcagggguggguguuaguguggaagauguccuucauaccaucauaaacgguuccugugagggguccagaauauacuaugauggccucuggcccuguagaagagucuaguuagaguuacaugugagcauucuuaaccagaaagucauguauuuuucugaaaggggauagagagagagcuuucacuauauuucaaaggggucccaucacacaaggaaaacuaaaaauggaugaacuaaagcauggguuagcagauguuuucuaucaagcuccaucgaguaaauauuuugggcuuugcaggccgcauggucucucucccagcuacucaacucugcccuuguacugugaaagcagccauugaucaaaugugaacaaacgggcaugguuguguuccaauaaagcuuuauuuacaaaaacaagcugugggccagauuucgcccagguuugccaaccccaaaaccuaaggauccgaucaacuuccuuucuauuacauuagaugcugcuugccccugcucucgggugaacugaaugacauccauauuccuggcaauggauccagcacuuagccagggaccaccaaggaaguggagaggcacauaaaaggcauucguuucacuuuuucauuaaacaacaacuucuuugaauuccuaauuggaaacuuucacacaagaaucgagguugcugcaacucauuuccugcugcccugcuugcaguguauuuucagcaaaauaauuguugaguguggaggcugacauuugaccucugguggcugccagcaacauacuuugcugacucauuugcauauaugguguucgaaacacacuggcacauucuucccuuuucgcaugaagcccagacguccuugauuaacuggagacuaaaauaagaucucaaggugg

SEQ ID NO: 15865 - RNA, 1047 nt, Homo sapiens
gcaguacauugagcuccauagagacagcgccggggcaagugagagccggacgggcacugggcgacucugugccucgcugaggaaaaauaacuaaacaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaggcggacaaggcccguuaugaaagagaaaugaaaaccuauaucccucccaaaggggagacaaaaaagaaguucaaggaucccaaugcacccaagaggcuuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaagaagaugaugaugaugaauaaguugguuguagcgcaguuuuuuuucuugucuauaaagcauuuaaccccccuguacacaauucacucuuuuuaaagaaaaaaauugaaauguaaggcgguguaagauuuguuuuuaaacuguacagugucuuuuuuuguauaguuaacacacuaccgaaugugucuuuagauagcccuguccuggugguauuuucaauagccacuaacuuugccugguacaguauggggguuguaaauuggcauggaaauuuaaagcagguucuuguuggugcacagcacaaauuaguuauauauggggaugguaguuuu

SEQ ID NO: 15866 - RNA, 7384 nt, Homo sapiens
uuuuauuugcuuucuuguuugucaccuggacaaagaacagcucuguuuugugauuauacacccugggagguuuccuuggagugaguucugaauuuguaaauccuaaggacuuaauguaugcuucuauuaauuugaauugaaacagagguucccauuuuuaacacaggaaaauaaauguccaacugaccugcuagcaaagacaaguucuaagguagcugauaucauauucuucaaguauucuucuuuuccugguuagcaguuuuaaauagagaaccucugacauccacagcgcccaggcugaaugcagaggaagcugaggaggcacaaagcaugacggcugggccucucucagaccuuuucugacauucuuuaauguuucuuuuccauagaccuguggcaugaauauagaaugcaggugucaaggaugacaccuacuugauagucucucuaaagcaaaccuuuucgcaaaagaaauucuugacaguucugagaugcuaagucaauuucaauuccaggcuguguggaaaauggaaucuuuuuucugcaauugaugugaaaauugaaggcuacugacuauucacuuucuaauaacacaggguaaauaaauacuaucgcaccauugaaaaaugcacuuagaagacaagcucagcuaaugauauucaccacaacauauguuggaaauauuccuugugaaugcuuuuacuuguuaccauuaagguuccauauuguuuacauuaaauauaauagaucaaguacauguuacuccuaaauguacuuguaucaagccacaaauuaguauauaaagguaauuguuuuguccugacaaucuuuuaaagaauucacugggggaucucuuuccuaauugagcguugaaugguuuucuucugaccuauguuuaauaauagccaauuuagaagcaaaagacuaaaaucagauuaaauuuuggaucauagugaaauaaccaggucuccuauuaaccucucugcuugcaguuuuuuuuuuuuuuuuuuggaugguugauccuuuuccccacuugcaucucaugcuuuaagccaagagccaaaccauucugguccucucuugccuccugcaagcaauucauaauucuuucugcaucauccaugacuacucuuuucuucuugggggggcgggggggugggggagaugguugaaccucugcccccaccuccaucccaugcuguaagccaaggccaagcucccaaaaaaccauucugguccucucuucccucuugcaggacauugccccaacaauguuuaauuauuucuucucucuucuaaauccaucugauccaucugugucugccuuuuuuuuuuuuuuuuuuuuuuuuuuuuuuuuuggagacagggucuugcucagcaggaguacaguggugcaaucaugccucacugcaccuugaacugcugggcucaagugaugcucccaccucagccuucccaguagcugggacuacaggcgugcaccacugugccuacuacuuuuuaaauuuuauauagaggugggaucucacuuuguugaccagguuggucucaaacuucuggccucaagcaauccucuggccucugccucccagcaugcugagaugaggcaugagccacugccccuggcauugcucuucucucuacaggaucauucacauuguuuugcaccaugcuguuaccuccuccaucuuagagaaaauucucucuuagcccuacuuacucuccaacuacgaucucauguccucuugcccaccacagcagacccuuugauauauuugcugucucuuuuuuccgauucucucuugaacuugcuucaaugaauccuucaccccuuccacucagcaaauccuguucucguccaggucaccaguuccucuuccuugggaagucgggguccauuuucaucccucaucgugguccacuggcaguacccagcauguuaaucauggcucuccuuugagaccaacuuugccagcuuucccuccuccucccuggccuacccugucuugucuccuuugcuaauucugugccauacucuguccuccaggucuugugccccaggugcucaguccgaaguccuuuuguuuucucuuuuugguaacacagaauuuugauauucucaggaaacagccuuugugauccaaauacagccuauaggcagaugacucucaaauucaccucuccugccuggacauuuucuuggaacucuucauuuguaguuuaaccaucuucuugacacauucacuuggagaucaaccagacacuugaaacuucacacgcucccaacucacugcuggauucccccuccccgcaaacugcucccgcgagccuucccuuucucagauaauggcaguucugucuucucaguugguuagauccaaagcuuuggagugauccuugacaccugauuuucccuuaugccccacaagcaguuuaagaauguauaaaagcaaaaguccauuagcucuguuuuugguacacaucugcaauccuacuuuucagcccccagugccgcuguuacugugccccagugguccaagcucugugugcccucuuccuggcuuaggcaguagcccucucacugugcucccugccucaaccccugcuuccugcaguuuauucucaccaccacauccagaagucacuuuucccuccucuguucaacccccaguagccuucggcaccacucagagcaaaaaccaaauccuuagggcccuacagaacuuggucccccaccccagccucuuugaccuugucccuaccgcucuuuccuucaguaacuuuacucuucccugaaccuaccggguccacuagagccuuuucccuugauccugccucuaccuggaauagccuuuucucagguauuccuagguucacucuuguaccuuuaacaucuuuauucaagagucagcuuuuuagagggucuagccaaaauugcaaacucugcucccucucacccugacacuuuucuaacccacuuuuuggcaucauuuuucacauuugcacuccuaccugagcuaugauagaucccacucauuugauguaaauauacauugacauugacagagaauguuaacccauuuuuccccugcuguaucccuggcagacugcaugaugcguccaucaucagugcccaguaaguguaacagaugcccauugccaaaccccuucaguggccauucucugccucugugucugaggccucucugaagucuuggaaggcagcucuguguuuccaucugugccugcuggaugugcccaggaauaacaccuuggagcagccuucaacgccaguguaaauguaccccagucuccauggcccuuggguuuauagcacuaagucauaaggucugcacucuucacccucagaccaggagcuuguuggaaauguggaaucccaggcccugcccacaucugcugacauuagaaugugcagcuuaacaacccuggggauuccugugugcauuucaggucgagaggcagcagccccuacccugcucccagaguuugccugugggguuguguuccccauacccacaguuucacaggcucgguaacaucccuuugugacagccuuuccuccccacuguggcaucuccacuucucucccaaguguuucuucccuuaaaccacuguccugaauccuugucccagggucugcuugugauuaaauccagacuaaaacaguguugagugaaugaauaaauaaaacuuuugagccgggugcgguggcucacgccuguaaucccagcacuuugggaggccgaggugggcggaucacgaguucaggagaucgagaccauccuggcuaacauggugaaaccccgucucuacuaaagauacaaaaaaaaaauuagccgggcgugguggcgggugccuguagucccagcuacuugggaggcugaggcaggagaauggugugaacccaggaggcggagcuugcagugagccaagauggcgucacugcacuccagugugggggacagaacgagacuccgucucaaaaaaaaaaaauacuuuuggaaucagcggugaauaguguaugcuggaaacuucuguuggggguaauuuugcaauuuaugacaagucuucauaccaggacaaugcuggcguucccaucuuuggaaggcaaugucacugccgucucugccuuuguauacguacauaccugugacugcacacacaguccccaaagagcagccuuucaugcuccauggaucuacgucaugguauuugaauuauuguuauuauuauuuugagauggaguuuugcucuuguugcccaggcuggagugcgacggcacgauuucagcucacugcaaccuccgccucccagguucaagcgauucuccugccucagccucccgaguagcugggauuacaggcaugcaccaccacaccuggcuaauuuuguaauuuuaguagagaugggguuucaccauguuggucaggcuggucucaaacuccugaccuugugaucccccugccuuggccucccaaagugcuaggauuacaggcgugagcugccacgccuggcccgguuuauuauugaaguucuuuuauucugcuaaaaauagccauagaugauuuuuguaaauuaaaaaacauuaauuuugauuuuuuuuuuuugagacauucuugcucugucgcccaggcuggagugcacuggcgcgaucucagcccacugcaaccucugccuccuggguucagucaguuuucccucagccucccaaguagcugcgauuacaggcaugagccaccacacccaccuaauuucguagagaugggguuucacuauguaugccaugcuggucuccaacucuggaccucaaaugauccgcccaccugugccucucaaagugcugggauuacaggcgugagcuaccgugcccagcuuaauuuugaauuuuuuuaauaaaaaaauuuuuuuagagacaggaucuugcucugucacccaggcuggauggagugcaguaacaugauccuugcaaccuugaacuccugggugauucuccugccucagucuccugaguagcugggacuauaggugcaugucaccaugcccagcuauuuuuuuaaauuuuuuacuuuuuguaaagacacggucucacuuuauugcccaggguauuuucaaacucuuggccucaagugauccuccugccuggccucccagucuacuaggauugcaggcgugcaccacugugcccagccaugauuuaaguauucucuacauaagacugucagaaaagauaauuaugauuaccagauuaaacauuccauguugggaaauucccuguuuucaggcugaggauuguauaguugaguggugauagauuuaagcaaagaguucguguuaaaauugcccuuucaugucugccuacgccugaaaacgucagagucuaggaguuguguaagauucuguuucuaaagaagucaaaacugguuuuacuccuuacaagcuuugugggcagcugcugcagagcaaaugagcagguggaaggccucccuucugaaggccccagccaugggccacuuacagacaaccucugccucgcccacuggaggcgcucugggguuucccuuucacuaccgcugcuagguauccacacauuucucaagaggcaccagggcccagcccauaccuggggccuggaaucugagguaugccuugacaggcugaugacaaccucaccuucuuaguuucuucucccaugacauuuauaauauuuauauugugccuuccauuucuuuuauaaugacaauauuaucuaacaauguuagucuuuuuuuaaaaaaaggaaaugaagaacuuuacagucucugcucauacaaaggaacagauacuuugaaaugaacugaacagauacuuuaaagugauggaaaccaacuacaaaauuuuucuaacuugcuauauuaagguuucucaauuuccacucuccuggcuaauuuagaggaugaucuauuaucaguuuuuauuccauuucugauuuugucaggugguauguuggucauucugacuuuuuaaggcaaacaauaagcuauuucucauguagccaauacuguggcuagcagucagcauucauucauugcauguugauacugguggacacugcagagaacauuguuuucaauaaccccuuuacaccucauaauaacccuauaagguacuaauuuuagcccuguuuuaugaaugaagaaacuaaaacauaaagguguggagaagaacuuaccaaggucacaagguaauuggugguagagucacaccgaauuugaacaauggucaaccucaaaggccguguuccuaacacucuccugcaccaucugagccgucuuacccuuccggguagguuuugccaccccuaaaaccuaugugggagccaagauugcuaugcgacauggcauugcuauugugagugcuauggaaaaaagcacucacauguuacuagcuuggaaaugcagaaguuaguauuuuuugaaccugacuuucacguuuuauuccuacuugauuucuauagcuuucucugucuauggucucuucucuucccaaaauaauucuuuuuuuuuuuuuuaauuuuguagagauggggacucacuuuguugcccuggcuggucucaaacuccuggcuucgagugauucucccaccucggccucccaaagugcugggauuacaggcauggaacacaaugccuggcaccaaaauaauucuuaaggauuuuuacugcuaaugaaaaacuuaccagcugucucauuccucucccucuucacagacucucagaccugucuguguaggugcgauggcagccaucccugcuccagaacacaaacgaggacgauuuuaaaacaaugcccucuuuccuccggcucucuuccuucuagguggcucugugcugcgcauucccugccucuuccuguucccacccucauuuuccccuuuccuuacugcaugccaccuuguaccucuaucuugcuccaccauugcugccucugauuuuucccuaucaaaacaauuaugaggucuuuuccgcagacuguguuagcaguuuuugcauccucugcucauuccucugucuccuugucuuccucuccaccucagcccaugcccugucagugccgcccagcucacaauugccugauccuugguggguacacuggcucaccucucagggcuuugcuccuugggaggcuauucaagcucagcaucaccugucucacaucugucugggauccucaaaccugaccuuuguaaauuuccacuaacugaagauuguagaggaaaaaaaaaaacaucuuaucgaauuccugcucuuauagcugauuuuagcuauuaggaaaacaucccaaguugagcuuuucuauuccuagaauuucagauuucuuuccuuuu

SEQ ID NO: 15867 - RNA, 2162 nt, Homo sapiens
aaaaugauacuagacacaggccgggcucucaggcucgcggaccgggucugagcacaagcuggccauggccaugcguccuggucccggggugcccggcagggaccggcgacucuugacguuuauaaacacggggaaguggacugcacugccgccaccgcacccccgguccccagcggcuccacuaagccaacuucuacccggcucccgccgcccccgcccgcggcgcuggccccagggccgccuccuggcagccggaggagaccaguccccgucgcgggcgccgacggcuggcucgacgcugcuccaaggacagcagcucgcgagggagcgagagacaaaggcaccggacccguccaggggagcgccgagucccaaacgccgagccccggguggccucgcuggcucccaccugcgcuugcccagcccggcgggagaccgcaggugucaggggccguucgggcccggucccccgcagcuccggcagccccgacgugacagcgcccaggccggcgacccucacguucggaacgcggcugggcuggcucugcgcccgggggcugccagcgccggggacccgaggcggguggcggcgugcggacuuccuccuggacuagccuggaauccugccccagcccccaaccgcuggcggccgcccccgcccccgcccccgcccccacccccacgcccggcacaaaggucccggcgcggcccggccggcggcuuuaagugcugccgcgcacaggagaccggaggccgcggcccgcgcucccacacccgaggcccgccggccccuaccuuuuccgcgcggcguccggggcccggcgcggugggcucgggccugcuguuccgcgacucccgcugggccucucccgcgggcuggcggggccucccgggugucgggcgcggcggguggcggcggcuccuccuccucaggggcgggaggaggggacucggcggcccagagccgccccccggcaggaaaccagccgcggccccgccuccucugcgcgucugaucccgcucccgaggccgccgccgcccucucccuccggaaacgcauuccucucccgccgcgucagcccggcccggggcuaggaggaggcggaggauggggcaggaagugcgaccgggacaaaggaaccggcugcgcgggagcgcgccugagggaggccgcggggggcagggccgggacugcguugagacagucgccgugccucaguuuccuccucugcgaagggcgggaggagucggacgcgcccuagagccccgcgcguuccugguguagccugcugggcccguguucuuuaaguuccucuuccucggagccgcgcguucgacccucgcucccguuuguccacugaugucccguuucgagcccgggagauccugcaucucggaagcccccugagucccgaggcaaaucgggaccgugagccccccuacccugcagggcuccauggggccaaaaaccacgugguccuucuggaagggaacuggcuaagccaggacugcuuuucuggagugauaaugugcuugccugugucuaagagaaaggugaagaauugggaaacccaugggugucacgaaggguggugagacuggggaacguuuuagaaaaccuggugaguugcguccugcuuuugauagauuuaucuggagguaccuuuauggggaacagggaugagaaggaaaaguuucuuccuaaggaguacaguuucuguuucaccucuuaaaaaaaaaaaauuuggagauuggggcuggaaacaacguuugaaagagaaggaaacauucauuaugagaauggcugaacgcaugucgauucgaugauugaagucuguaccagccaaaaucauacugaaacccaguaauuuaguauaugcuacuggcaagcugcuauccugguagcagaaaaugcuguggguuccgcuuggugagcugcagcacccuguugggaaaagagcucaaaaauuaccagauuuaugaaauagaaguguuucucuugcaggagauuagggacuggaaugcccauuuggcugcugccaaucaauauaagagaaaaugaagcgaucacaucuaagaaaauuugcucauuacuuaccagcaaaaucaaaacuugauuagccaaucugaagaccucuaggaaaugagcacuauuuuuccca

SEQ ID NO: 15868 - RNA, 58476 nt, Homo sapiens
cguuuccggagggagagggcggcggcggccucgggagcgggaucagacgcgcagaggaggcggggccgcggcugguuuccugccggggggcggcucugggccgccgaguccccuccucccgccccugaggaggaggagccgccgccacccgccgcgcccgacacccgggaggccccgccagcccgcgggagaggcccagcgggagucgcggaacagcaggcccgagcccaccgcgccgggccccggacgccgcgcggaaaagguaggggccggcgggccucgggugugggagcgcgggccgcggccuccggucuccugugcgcggcagcacuuaaagccgccggccgggccgcgccgggaccuuugugccgggcgugggggugggggcgggggcgggggcgggggcggccgccagcgguugggggcuggggcaggauuccaggcuaguccaggaggaaguccgcacgccgccacccgccucggguccccggcgcuggcagcccccgggcgcagagccagcccagccgcguuccgaacgugagggucgccggccugggcgcugucacgucggggcugccggagcugcgggggaccgggcccgaacggccccugacaccugcggucucccgccgggcugggcaagcgcaggugggagccagcgaggccacccggggcucggcguuugggacucggcgcuccccuggacggguccggugccuuugucucucgcucccucgcgagcugcuguccuuggagcagcgucgagccagccgucggcgcccgcgacggggacuggucuccuccggcugccaggaggcggcccuggggccagcgccgcgggcgggggcggcgggagccggguagaaguuggcuuaguggagccgcuggggaccgggggugcgguggcggcagugcaguccacuuccccguguuuauaaacgucaagagucgccggucccugccgggcaccccgggaccaggacgcauggccauggccagcuugugcucagacccgguccgcgagccugagagcccggccugugucuaguaucauuuuaccgcgugucauuucuuaggcuucauaaauuggauuuaugagacuccuacucucuaaguaacuuuuauuuaaucaaauucgugcuuuugaguccaaaacuuugcacucauugguaugaucauuaguaaguugcauucucuaagcuuccguuuccucaucugugaaauaggaacaguaauaucuacauuaauaauucauuuuuauaauaaugacagugagggccaaguuuagcucuaggcauuuuacauguauuauuuaauucuggaaccgcucuaaugagauugguacuguuucgauucccauuuuccgagugaagaaacugaggcacagggagcaaaaguaaguugccuguggucaucaggagcuccuggagaaggcauggggucuaguuccagaguccgcguuuaaaccacaaguaaccuuccuaacuauaguucugaaaaucaaaugcaaaauguaaaaaacuuagcuugagaguagaugcucaaugaguauugacuccuuuucagcccuucuuuuauaguaaaaagauguuaaaaauaucucggaagauaauugguaacaucauugguaagguuucuuugggccaacaugccacaugguuaacuuagguggguagaauuacuagguuauuucguuuuguuuugagacagggucucuguugcccaggcuggagugcagaagagccaucacagcucacugcagccucaaccuccgaggcuuaaguuacuuuuccaccucagccucuugaguagcugggacuacaggcgccugccaccgugcccggcuaauuuuuuuauuuuuuguagagacaggauuucacuaugcugcccaggcuggccucaaacuccugggcucaagcuguccucucucaccgagcucccaaagugcugggauuacaggcgugagccccugaaccuggcccuuagguuuuuuuauuuuuuuuuuuuuaauuguaguuuuaaugcuacaaaaauaacaugcuagaggaauuuagauuagacaccuuucuuaaaccacauacguccuuuacgauagguuauacaguagaccaauuuuagaaaugauuaaggaacuucaguuggcaguuaccuguucauuuguggacaucaaggcccagagggguuaggacuuagagucucacuauaauucucauauuuuuaaauaauguugacucauugaucaauauuauauaagugacugaagauggugaaguguuaaauaaaaaacauugguauuuucauuacaggcauuuggggagaaagucauuuuacuuaucccaaaauugaguaugaagguggaagauguuauuagaaugcuaguuaaaaggacaaagaaugugguuaauacuuuaauucuguaaacaggaagcaaauagauuguuuaacucgucuguguugacuucagaccuaaaccuacaauuuuaaguguuugugauuuucuuaauguaaaguucuauauuaaaguuauuuuuuaauacccucaacauucugcacaugagaagcauggaaucagcaauucugaaagucacuggauuuaguaauuuuaacaauuaggcagcuuucuggucaguauaauuuaauuuaaaucagccccgaauuaccaucacgaaugaaaauguagcucuacauugguguucuuccuaacucugggagugacacuggggacaucuggucauauuauaauaaugaaaaguggucaaacaacuuaacauggugccaguuuuccuaagcgugcuugccacugauuguaaugcuuuuauuguuuggcuucuugauaaguaaguuauggcuuacagcggugaguaguauaguguucugucugaaaacauauucauuaauauucuguagcugcucugguuugcccuuaacuaugcugcuagugugauaagcugaaacaucuuguaacugguaaaaguuucagagaacuuaacuuucugaauauguaacaagcugcauguaucugaaaggguucauuuagacuucuguuagauauuagcagauuuucucacucugccagagaguuaggaucuguuagguuguggguggaauccuggagauuaugccggguaaauauguaaguaccuguauuguauuagcaguguuuacucugacuugguuuuagguucugagaguuuggcugguuauuuuuucagaggugggagguauggaguagagacguuaagauacagaaagguacauucgucuucugaauccugaaguguuaugcuagagguaucuauagcuguggaaaacugaaaagauauuaugguauguacccagcuuaaaggggguacaguccguaaaagucagaauauuagcagccuuccaauaugucugucgguaggugaaaaaaaaaguuucucucuuucaggagcuguguacaaaaggauccaaacuauacuuuguacauuuguuauuguuuuaaaaguggcugugaguuuuuagaggucagcuaacuuuaaacuugccguuugguuugugacuuuagaagguagaguuaacuauauuuagcaauaugcuuaagcgugugcauaucaccucaugaaacgugugugugcaugagaaaagcugccuccaguacacauacauauguauauacacacauacacacaagcacauauauguauguauuucuuauaggaccaaucucauuguacauaauuucaaagcacagguuccuaucuccagggaugcauaaaaagacucacugaaguauagggagaaaauuuuaggucuacuauuauguuuguugaucucaucacuuuaaaauuuaaaauuuugauuaugauugauaaucuuacuauauugcuguagaaguacauguaucugaauuuauaaauugcauuuauuuuggguacagguaugccuagaauuuuuuugcugauaaaggugaguggucagaaagcuuugcagaucccuauauggaggaugauuugagugggguucaagaacuacuguauuugggagggagaacugauaagacuugauaagagaaauaaaagaaacccagugugacacugguuucuggcuaggaggugcuguucacugaggugagagggugaccacaagcugggggugcugguuggcuggagcagaggggaaaugaugaccuuaugaggccaaguuuuuuuuuuuaaggugaccaugggacauagguggagaugucuaaauugcaguugaauacacagauugagagcuuaaaaaaagaaaaaacucugagagauuucaauuugacaauucuuagucuauugcugguugaagcuauaggcugugcaugcaaacaccaaaggaggguguggagugaaaaacgggcugaaggaggaccugggaacacuuuuaauagucaaggggggguggaggaagaggaaucuagaaaagcauuuaccuuccccaguuucuucucugaacuucuaauuccuuugaguggcauuuuugugagugacauagguauuucuggguuuuuccagugauuggcauguuugaguuaaagacagaaagacuucauuggucacauuucuuugugguaauuuauuuucagauaccugaucagagaagcaguuugauguacuaaaggcuucucgauugggagacaggaaaccugggugucagugccgggucugccacugaauuucugugugaccuuugucagaguacuguacuuccagagcguugguuuccacaucuacccuauaaagcagccugcauguuucucucauucucucguucgaggaguuggaggauagcugcugccugauguaaguagagugcaguucucucuccaugagcaacuuuuuuuuuuuuuguaucaccagagaguguaggcacugugccacuuacucuguuaaggauaccugccagcgcugaccagcaacaucugucccugucagcucugcaucaggauguagcuuggcuguacauuacauuuuauucuaucaguacauugaguaccaguuaccugaaaaaugcuuuacucaguggacaugaaucaagaaguuggcaugcucuuugauguugagucuguugucuaauuggaacaaguuguguucaguucaggaaaacauaaauaccaaagaguguuuuauacaauguacuguaccauaaaauacuguaccauguaauauucccuaacaauguuagaaaaaucucagcauuggcuugugugguuuuggaacacguuguguaggagaugaggccugagcuuggaaugguaugagcgaagguuggaugacagaugguugucacauucaaggacagcaugggaagaauccaaucuaauuucacagauaguaccuggccacuuuguuaccuauuaggaguuauguauaauaucauauauaucagaaggauaugugaaggcuauauaaaaugaaggccuggguucuugcccuccaauacuagccugaugagagacacagacaugaauacaauuaguuacaauagaaguuugaauagaaauaacacuauauuauuaagcaucacugaagauuugucauucacucugcugggcacuaucaaagcuguuuuggaaccacagagaaggaguaguuaauuaaguugauugugguuggugaggagaugaagaggcaauaaagacagaaaggaagaagaaaaaucagcauucuauuuuguguagggaguauaguuucaguggagugaugaggaaaauauuuacauacgaaauuagguauguaccauuuggaguauggaagucacauuuuucuguauaaauguuuauugaaugaauauguaaauaacuuaagcuuucguaaucuaugaaauuagcaauagauuauucuucuccauguacaauauuuuaugguuuauguaugauuuucuucauauuaugauuucagugcuucuuuuaaaggggugguacagggucauguuuauuggaggaggaaauuggaguuugaaaaagcacauuugguaguauaauguuauguuagaaaaauguuacaaaaaaguacaauagggaguaagauuuaugcuuauuaaagaagcauggauuaaaaagauugagaaacauuuauuaaagagucacugagguucuuguuuuagaaggccaugauuaaugaguuggagaacaagaagcaaauuugguaaucauguaaauuaugagcugcugaccaccuagaaauauauuugcugauaagagcuuucauauaaugaucauauuuuaucuuuccaacaauuagauacuguuuacagcuuacugauguguaaaaugagaaacuuuuuuuccuauguuuaucaugguuuuaaaacauuuaucauguauuuaaaauacuguaugcacuccaccacagacaggauggagaggaagaugugacaaaagauguggucaaaauuaguuuuaaucaaggaagcauuuuggaaugaucugcuuaaaaaguggauauaauuacgcaguuugagaagauaauucuccuuaauugaaauuacggggaauaagucuugcucucaggugcuuauugauaccguugaucaugcugguucuuuugcuggcuccacucacaauuaucuuugacaacuugccccaaaguaaacuuucucaaccaaaaccguucccaacuucuuuccuccucacagggaaaggcaaaaaaguccgcaggcauagagaguggaaagaaggaacagcauacuaggcugguuugaaaaacaaucaauugcuagguaauaaugucuuaccuuuugaguggaaggaggagcugggaagaauuaaguucgggcagguuuuuugcucauuuuggaucagcccuucauauuauggcuuaauagcuuuguuuauaguguauuuuucugcuuuuacguucauccucugaagucuugaguuaauuuugugccccuuuacccccauuugaauuaaaugcuucauuuuuuucccguuucucacauaaagcuauuuuuuuuucaggacagggaggggcuggugguggugguggugcuguaccaguugucuguuuaugagaucaccauuagacaacguuucucauuggcuugaauuauuugaauuuugugugauuuuccuguuauguugauucuguucuuggugucuaugaguucuguagaggauuccagccuaaauuuucuuccuuaguucuguuuacuuuuccucgacuuuugugguuuugcucuuugaucacugucaagaucuauuugagauuuucugacuuucuugaagagcagaaugagaucuagauuuucucuuauuuuuaaagaagauucuucacugacuuccuuucacuuuuuguucuguggaagucuuuccuagguguuaaguuuccaggcuuuaccucccccuacccccaacguauuaucuuuaggcauuuuguuugccaaugcguacuauauccauuauuuaucuuucccuugcacuuguagauuggguggugauaaaaaucuuccauauuucauuuuccuggagaaggcggguagagucacuagugaugaauuuuaucuucaaucuguuguauaauuuucuuaaaguaucucgccguguugugagcuguucucagauuucaaauuguuuugugaaccuauagcuuuggagcagccaaaccuuuguuguuagagcuucuuagcccaggcuaucauuaucauugugugagaagggguuagugcucuuuaaaaagccauuuuucuucugggugggaguggugaauuuuagaugguuuucuaauucagacuacuuuucuguuugucaaggagaggagaagaggacuucaaaugugguguuacaucuuugggaucccuuagccucuucucuuucaugucuccuuuuuuuucuucucuauucuuucugcgaaguuuuguuaaucauuaaugcuagcuuauuaauauuugggccauaaacaccucuguagugaccaacacaccucuuccugccagauggaaggaaaaaaaguguugaguuuuaauuguucuuccuguaaggggaaagguucccuuuccaugggaggaacucaucuccacaugucacccucucagaugguacagaauucagaaagauuucucaguuucuuccauucauguuuuucucguuuuuauuacucucuaugugggauaagugggaggaaccucaugucuuucaauuuggcucuguguucuucuucuggaauauauugauuuuuaaauacuaaaaucuguuauuggccuauuucuuccccuuuuaaaagcagauacagaaaauaaugaugguagaacagacuugggaugaauccaaguuuauuauaauuuuuaggagacauuuaugauauaccucuauagguaucagaaucuuuucuacuauuaaggugaaaagauuugagauuuugugaaaucuuuuguguauucuuuuuauuugaguuggcuuuuagguggcuuauuuuucaacucugaaaugaacauaacauguuacauauguuacauauguuacaauuuuuuucuaaaguguaguuguuuaauuucuacaaagauaguccauauaaaguuucuaaagauuguaaauuuaaaaggaaaugccaaaugaauuauuuguaaaauuguuuaaaaaaauuaauaaauaaugaguguguauuuaaaaguuugaacaugauauaaaaccauacuuuuauggauaaagauuaguuuacagugaagauuaaaacaauuaugcacuauuuuugacaguggaaacaauugcacauauuuggguuaaccacuaaaaugagauuauuugugggugguguuuaagauuguuuauuguucagggaaugaauuaugaccccuuagauaaaauuucauaugguaaaaaaugaccuuaaggugaaaugcuuuuauaggaacaagacacaaaaccuuugucuguacuuaugaaauauggcaauuaaaauaacuuuucuuggccucuauuaaguucaaaugcccaagaaauaaacucauagaacauuauaagcccuuuccauuucugugcccugagucaguucuaacacuagaaggauguucuuuguuuuaaaauagugauuaaguaggcuuugaaaaaauuacaguuuaaugaagucaggucauagcuucuggauacagauggucagguuucaauuccaccugugcaacuuuugauuccaccauugcaaguuguuuagucucucugguuuuguuuccucaucuguaaaacaaagacacuauuauucuucaccucauugaguuaccuggaggagauagaugcuauuauuuuaucauuauuauuaucauauccauuugaaggugcugaaauaaaauucuaauuuuuuaaaguucuaaaugaaauaacuuuuuguuacaaauuacuuuaaaucaucaaaacuuaguguauuauacucuucuucuugccugugccuagucuggcccucucaauugagaagucagucuuuuuuuuuuuuucaguaauccacagugagcagcagucccugaacgaaaucauauugcuaguuggguuugauuaauaaaacacagaauugguauucuaguccuuucagggggguuugcuuccuugugauguaagaaccuugucuuagucuuugugcugcuauaacagaaugccacagacuggguaauuuaugucaggguucugggggcugggaaguccauuaucaagggguuggcaucuaaugucuuucuguugcaucaucccaugguagaagguggaagggcaagagagugagagaagagaaggaggccaaacuccgucuuuuaucuggaacccauucuccacuccugugguaauagcauuaauccauucaugugggcagagcccucaugaccuuaucaccucuuaaaagucccaccucucaucacuguugcuuuggggauuaaguuuccaacacgugaaccuuggggacacguucaaagcauagcaaaccucaaagcuuccuccuuauuucuguuuguauuagguauguuauucccuccccucaaucuuuuuuuaaggguuucugugauaucaguguucagagcauuuguauuuugucuacuauguuuuuaugauauuaguguucagagcauuuguauuuugucuaacauuuacuaccuuaaauauuuugucaguauaaaauauuuaagguuuugcugcuuuuauuacuuuaugaacacauuugucaggaaucugauuguuagaaagcacauuaaauagaauucuacuuggauguggaaucuauaaagaguauaauaagguuuugauauugaggaugucaguguaugaacagcuauaacaauccacauuaaucuauuuucuguaguuguguuacuucuaacuuucagacuuuauccuuucuuucauaucuugugucuucccuaaaguggauccagucaguuuucugguuauaauuacaauugaaaaaaaaaaaaaauucaaccauaguuacuucuuuauucaauuacguuguuauugagcgcuuccuguaacauuugguaaugaucauaacaaguaacacccagguacuuacaauuggccagacauuguuuuaaauguuuuauguguaucaacuuauuuaaacuucacaaaaccccuacaagguaaauacugcuguccccauuuuaaagaugaggaaacugagacagauuaauuugccaguguaacucugcacuacacaauguuguacaacgguagaugccacaaauaucugcugucaugaagcucaguguuuuauuuuuugauaccucagaguaucuccaguuguuuuuaucguuaguuucuucauuuauucaauauaaagacauugcgcuagauacagaaaacauggagaaacuucuagaagaugacaauuuauaaggcaagucaaccauguacaucauuaguagauguauaagagcuacauaugccccaaacaggaaaccuuuuaaaugaagauuauuauauauguuuuaacauacuguguguauguacguacacacacacacacacacacacacacacacacacacggcuauaugugaaucaccuggcuuuagucuuucuuuccuccccaguucuugccauaauucgagggcuucaagaguucaugcagaugauacuucucacaccuuggucuagcaguuuucuuucuuucuuuuuuuuuuauuuaaugaaauuucaguuuauucagauaaagacuaauguaugccucauaaccuagugauaaucuauaaguuugggaguucacaacauuuuuacaaagcacauaauauuaacauucaagugaggcauuauagaaaguuuuauaaagaaugaaguaggccagguauggugccucaugacuguaaucccaccacuuugggaggcagagguggguggauugcuggaggucaggaguuugagaccagccuggccaacauagcaaaacccugucucuacuaaaauacaaaaauuagccagccgugguggcacaugccuguaaucccagcuacucagaggcugaggcaggagaauugcuugaacccaggaggcggagguugcagugagccaagaucaugccacugcacuccagccugggugaucaagugaaacugucuaaaaaaaaaaaagaagucuuuacuauaauucuuuuaaaaaaccuugguucaucuugaaagacugaugaauuuuugaaauaccugcagaaaaggaaaauaaucccccccccccccccagaaauacauacaaaccacuuauuggcacuuguguuuuaaguaccuggagaaaaacaggacagauuuuuaaaggcaauuaauaacagcuuauacaaggccuuguuucauuugcuuuagcaccaaguaaaguaagaguaaauaugcuguggaagauggucagguuuuuccuccuucucucauaugccccacuucuccuaccaggucacaguacaucagcagccauccuuguugccccacugaggaaucacuuuagauuccaguauuuaaauggcugcucagaugaaaccaguagaauucuuuccccuuaagauaagguggcagugaaugcuagcagguaucaauuucuuugaucaggaacaaagaacuccuucagaaaacucacuuuuuuggucuuuguuaaccuauccugugaauucuuuuuauuggcacaccuuguuuacgaaucaugauugauugcuauuuaugccaagggaacauuccgcaggcaugccugaucuauuuacuaaugacaaaguaugcuuacuuuacauaauuccauagguuuucucuuuuauuuuugggaggagggguauaauaacuuguuauuuaucagggcagaucauauauuuggaucaaaaagagaaacuggcaaguagauccuaaaacacauuucuuaacccgaguaacaucugaaaacauagauuucaauuauauuuuguugaaaauucauucaacuuuggugcuuauccaagaacuuauaaugucaauuucugacaaaaauuauaacccucaauacauauguauuuucaaaagaagagucaucuuaaaguaauauuuuucuguauguuaauugauacauuuuuauagcaaauugaaaauucugaguaaauugaaaguauguuuaacaacaaaauaaauacagcauauaugguuagcuuauauauuuauuaguguaaaggcagcagugaauuuguaucuuacaacaaaucugugaauccaguugcuuuuuuuucuggaauuuuauguaguaucaccaugcuccacaaugcuagaaauguggcauuaaucugcaaaaauuucugaugagauacuuuccccaaaugacauguaacuuuuuaaaacuuuuccaaaaaauauggacauuuuaucaaucacuuaaucuuuuuuuuuugagacagagucucggucugucgcccaggcuggagugcaguggcgugaucucagcucacugcaagcuccaccucccagguucacgccauucuccugccucagccucccgaguagcugggacuacaggcgccugccaccacgcccggcuaauuuuuuuguguuuuuaguagagacgggguuucaccauguuagccaggauggucucgaucuccugaccucgugaugcaccaucucggccucccaaagugcugggauuacaggcaugagccacugcacccagccuaucaaccacuuaaugaacaaaaaguuagauuacuaccaauuguucauuuaauuuugcucuaacguguuuuaaaaguuaagacaucucugaugguuuugcaggugacuggauaaaacacacuagaugauuucaaaagauuaaucuuaguaucugacucguuuggcacauccucaguauccagaauaaaaucaguagaaauaaaaguaauauaacuuucaaagaauucauacaugcuggaggucuuaggaaaagcaguuuuuaaauucaaggaauaggagguuugcucaucuuacuaguuacacacauuucuccucauggaguaauggcagcuuucuggcuucuuuguggaacuuuaguuuguagaaaagcuugguaauauuccaggacuggcuuuguuugggcuucauaagccuuuagucuuuugauaaccgucucugguuuaucauccucaugcugaaugagaggauccccagucagaucaucagugcccacaguuuugggaggguugaauucaauguuguagacucagccacuggcaggaugaaucuagcgagcaguaaggcauuguuuaaugaccucaaagggcacauucgggcuaaucacuuugucugucuaagaagcuuagucuagggcuucugccuguggaaguguccauggaaaaccacccaacagcuagcuauacuaagugagauuuuucagcucauauagggccagcugagucaugacaucaucucggaugaguuuccuuuggucaaugaaagcguuagcuaacacauuaauuucugugccccgcagcauguugauccuggagcaggucuccgcuagagaggugcuucacaguguuuggugacgcgcgacaacuagugcuguugccuagcccagggcccccaugaucacggcugcugccgcguagacgccccuuuacagaccaaggcccacgccgcacccgaacaagggcuuuggcccagccugugaacuuaccuucucugccgcccaggcccagccagcuggcagcgcugcuagugggcggggacuguggcucccaggccuucccugaacucuggucuagcaguuuucuugucucucaacuuuaguggccauuggucacuguacuggaaaccucgugugucuuucucacauccucuuggccucugauuccagcuggugcugcugggaacagucgguggcucacuccuggcugacugcaugcugccucaggugccucucuuuugcuuuuuccccugcggcuccucuaaccaacuuucuugucuguucccucuugucugucccugggcacgugcacuguaguucuuagaaguguuaguggaguuaaugcccuuugaggcgacuuuuuaccuaugcaacuggaguugauccauuuccccguugacuuucacuggacagacuuucuacguacuucucaaaaguuuuccacaagaucaagcccccagguacucaguaugguaaagauaguaucuuuguauuggcuuuuucucuuuuucuugguucacugucuucaaagugucucucucuuuuccuggggucaccuuccaauaaacugccugcacaccaguucuguucccaggcucugcuuuggacagaacccuagcuaaaacaaugaccugguacuguauuuuuaauacaggccuuuucccccaagacugccugucucugaaauuguaaauucuuaacugucguagguuccagcucuuuucacuuccuuguuuccgugguccccucuccucucaccucccuguugugaugucuggucuuuugacuuuuuccucuuguuaacuuuuugguagcacugcaccuucuuugccccccacccccaccuuuccucuugcaccugcccugcacaccagggaauagauuuagugauuccaaauuggagucugagggaccaugggagguauucucagagauuugggcauuucuacaaaauuuaaaaaaaaaucaugcuuucauguuaauaauaaacauuuaguuuaucugguugaccaucuuauaacccaguaauauaacuucagaaucuauguuuguacuuggaaguuaauuuugguuucauaauguuuaagagcuaugagcaugagacauuuuauaucuaucuauaaguuggcuuauauacuuaaaguaauugaaaauuuaaguugucacuuggaugucuauaguaacacuuuucuguuuagagaaguucugcacauuaaguaauucugagacauucuucugaguaaugucagagaaaaaugucauacaauucaauaugguucagugaaaauauuuuuaauuuuuuaacuuuuugaggcagggucucacuccauugcccagccuggaaugcaguggugugaucauagcuuacugcagcuuccaacuccuggacucauggccccuuccccuggcccccacuuccaccaaguuuugcuauguugcccaggcuaauuuauuuucuuguagagccaggaucucuaggugggcaugauggcucauaccuguagucccaguuacuugggaggcugagaugggaggauugccugagcccaggagguugaggcugcagugagaugugaucacaccacugcauuccagccuaggcgacagagcaagacccugucuccccccaaaaaaaaaaaaaagagagagagagagacagggucgaggcuagucuugaacucuuugccucaggcaguccucuuaccucagccccucaaagugcuaagauugcaggcaugagccuaacagcaaagaguuuugagcauggacuuugugccaaguauuucuaggugcaauagcuauaaauaagauacacccaggcccuauuuucuuggagccuagaauccaucagggaagacauguuaacaaauaguuagaagugaaaugaguguuacaaauaugccuguauaaauuaggguguccaauaccuggugggcucucaccauugcaggcucucacuguaaucccauugcaucuuccuaauuuucugcaaccccuaagccguaccucuuuuccuaggaguucuuccuauuucagaaaaaaacagucaugcaugaaugaacucucuuugcuuucucaccuccugcucugccuuagaagaaaggcaccaugucucuguuuagggugauccacccccuugggcugcacaugccaucccucuuugcuccaaggaggccuggcuucaucacuuuccuuuucucuuuuccugugucuucaccucuucaaguuugcccccaguucuccuuucuuccuaaguauucuuuucaucccaaucacauccauuuucauaaguucgguuagcaccuagauuaugacaacucucaugucugugucucuaacucuugacuuaucuccugagauccauacucauguccuagcuucccaauaggcaucuucccuagauuuugcaauaaaacaaaccucauuuuuuccccuaaccccauucucccucguacaucuucuuuauuuuaaagugaugauuauucuaaauuccuuucuuucucccauccuuccuucuccaaguaagcagcagaucccucauagcuaccuucuaaucauuguuuguucgucuucuuguuuguugcuguuaucugaauuuagacauuugucaccucucacuugaaccuuugcaguaaauucuguauuugucuuccagcuccugucuugcccccuguccuuuucuccacugaguuucugccauguauauguagagguauuacuagccugcccaaauuuuuucaguucccuuccuauuuauagaauggaauccaaacucuuuuagcauggaugguauuuggcucucuguaacguagcucuuccugcuugcuuggucuucguuccuguuauuuccaacucauaauuuaagucucagaaauacuucaagauuccuuuuggccuuucugauauuuuaagauuuuaagauaauauaacuuauacuuacaauagaaaauuauaaggauaaaauaaucacucauuccaccaacaagauauaguuacaaaaacauacauuuuucuagucuuuuuuucuauaaagagagaaaaagugagacaguuccaauuuuggguugcagggagcugcccaaaugcauaugcuuagaaauaagauuaggaaggaguuauuauaauucgccucgggacuucauggcuuuguauaugcaggccuuuugcuuggaauaucuucucuccacuuuucuccacacccaucuccuaugugccuucaggucuaacugaaacacugccaugugccugaugccucugaacuuguccaggcagauuucaguguccucagugcacuguguccuuguuuauuacugaaaccaucauaucauaauaauuuguauuuuuguccuugaacugaaaguucccugaagcagugacccuuguauuuccugauauggcucaaaaccugacagaguugucugaagaggaaccuccagaaaggcagggggaaaccaguagaguucaagggaguagaguguguuaaagaauggugaauagucuuacauguugcuuuguguaaauucuuugguaguaaaccgauguacuucuucaagugcauauuguagugagucaaaaaauuugugaaugaaugagugaugaacgaaugaaugcagagaguaagguaaggccuagaaaggguucuuuugcaagaguaauuucacauauaugguugggcauggacaucaguuacacaguuaugugccacauaaugacuuuucggucagugauggaccacauacacgacaguggucccauaagauuauaacggagcugaaaaacaccuguugccuaguaauguagugucauagugcaacacauuacucacauguuuguggugaugcugguguaaacaaaucgaccaugcugccagucuuauaaacgcauagcaucuaaauuacagugcauaauacuugauaauaaacaacuauguuacugcuuuauauauuuacugcacuauauuguuaauuuuuuuuuuuuuuuuugagauggagucuagcucugucgccaggcuggagugcaguggcgcaauuuuggcgcacuguaaccuccaucuccuggguucaagugauucuccugccucagccuccagaguagcugggacuacagaugcgcaccaccacgccaagcuaauuuuuguauuuuuuuguagagacgggguuucaccauguuggccaggauggucuccauuacuugaccuugugaucugcccaucuuggccucccaaagcgcugggauuacaggcgugagccaccgcccccagccuguuguuauuugagagaguaucucuccuuacagaaaaaguaaaacagccucaggcagguccagguccuucaggaaguggucccgaagaaggagaucuuuuaggagaugacagcuccaugugucauuggagacaggauaugcaggcgcaagacagugacauugaugauccugacccagggcagcugugcaggcuuuaggcuaauguaguguguauuuguguccacaguacuguguauaguaaugucaguaauguccuguucaguguguguucugugcaguguacucacuugccccucucacucacucacucacucacucacucacucacucacucacucacuuacccacccagccauccagagcagcuuccaguccugcaagcuauauucaugguaauagaggugcaucaauuuuaaaaucuuuuguaccauacuuuuacuguguaguuuuucugugucuaacugugcguagauacacacaugcuuacugcagcauuccaguugccugcaguauucaggacagucuugugcuggacagguguguagccuaggggcaauaggcuguaccguagagccuggauguguaggaggccacaccaucucgguuuguguaagugcacugugaugguugcacaaagaugagauugccuucgcauuucucagagcucuuucuuuguuaaaugacacaugaagguacuggguugaggagagggaagguagguaggaaauggagaccaguguagacaacuguuucuaggucuuugaccgugaagaggagacaagcguuagaauuaggacagcaacugaaaggcaucuuucccuguuauccccucauacucuguuuuauauggaaugccauugggaggaaaccccuucagguccuuuucucagcauaagaaucaccuggaguccaggccccaugcucagggauuguggauuuuaagccuagggcauccagguaaacccaaugcaguuguucucuaggcccacuuagagaagugcuguccugggagcuuuguggcguaggacuugggcaccuguuccuuccccuuccaugcgcaugugcagggggcacccaguaccgguagaagggaaggccagcagcauugaaagcgaggcucccuggcccucugccucuccuuuccuguccgggucucuguggcuugcuucccucaggccacuucuaacuguggucuccucuccgcccccugguccuguagcucuucuguguucuuaauuggagucauccucuagccuuucccuuucccugagagaaagccucgccuuuuacagauaucacuagccaauggcagugccucucuguuucuugccagugccccgccagucgccagucgcaggaucguugacaucugucauuaaacuguuuccagcugcuggccuuguucucucagcuguucuucaacacugaagccuuguuucgccugcuuccggguuuggagcucuuccggaggcacaaggguuucagaagguugacuuuuugccuugucaagguuuauagaaggaaaggacagugacauuuaaaguaguguggcuccgaauguuaggaaucauuuucuguuaccuaauaacuucaucuuaguggugauugucuaaauuguaugauauguugacagauuucucaaagcagucucuagugaucauuaaacagccugaguuguauccugaagaaacauguaucuguccauauauggaacaaauauuuguuccauucccuuuguguggaaacugccugcaugcuucauucaucacaguaaugcauuuccucaggaacuuuuaauguuucaggugucuguugucauagcuuuggaaucgugauaacauuauuugacuugcuuagaauuauagucuaauggauuuacuacacacuaaaccuuuuagacaggccuugaaaggugaauuugguaggcauuucacacuucugugacacucagauuuugcuggucucuuggauacagucacaagugauauguaagcaaaacugcaagcucaggcauaacagccugcugggcugagcacgauugcagaagugaaugacuuuucacguuacgcuuaacucuuuucucucgggugcucagagcacaacuuaaagcauucucucugagccaggggaauagcauccuggaauguaagcccuugaagauggaggucuguaaaagaaauauucaguguuaacuuggaauucagugaacuuuuuucauauuaaaggaaauuugucaagaaaaauaauugcacaguuaaauugugcuacaguuguuuucauuaagaaaguagaaagaagacccuaacaguuuaaaaaacaaauggcccucauugucuuuauauugugcauauaacucuuuguuaucuucagauuauaugaaacuauuaguauuauuuuuauauucuucucaucuuuuuuucuuuugccuugagaaagucacguucuucucauuguguacuuuacauccaaaauuauuuuguaacucuuuuuuuuuuuuuuuuuuuuuuuugagacggagucucgcucuuucgccaggcuagaguacaguggcgcgaucuuggcucacugcaaccuccgccucccggguucaagcgauucuccugccucagccuccugagaagcugggauuacaggaguaugccaccacacccagcuaauuuuugcauuuuuaguagagacgggguuucacuauguuguccaggauggucucgaucuccugaccucgugauccacccgccuuggucucccaaagugcuggauuacaggcgugagccacugcacuuggcccucuauaacucuaaauguugcugcauuuuauuauugcaaugacuaauaagucccuaaacuugaugcaguuagauuucccuguuauuggauauaggauauuuacauuuuugcucuugugaauauacuagaguacuauacugaauguguguguauaugugugucaccuuuuauauauuuaaguauuuccuuaggguaaauucccaguagcuggauuauuagaggguagaaauuuuuuuaugguuuuugauauaaauugucaaauuauuucccaaaaaguuguaucaguucacagagcuaccaguugguuucucgcagccaucugcuauaguuuuguuggguuaaaaaacuuucuauuuuugcuaguucaucuuauguugcuuuaauuuacauuuuccaauaacgauuaaaccuaaacuuuuuuuguauaaauuugcuuuuuugaguauuucuucuuguggagggacagauacuuauauauaauuauuagauuggcugcuaguccaagagcaguaaguaguuaagggaucaagucagcaaccaguggccguagccaucuuugaccaaucaaagauauagauucauaucaucgugaaagcuuugauucagagaaaauaguuauauauguaccuaaugguaggaaauugggguaguuguauuuaguauauagaauauuaccuaauuuuuugguuagagguucuagaagacaagacuuuuucaguuugucuuaugcccucuuuuuuuuuguugggggagagguggggggucuggacacucuaggaaauuaaaacugaguauuuuacuuauugcaugcauagaaguugauuuucuuuucuuuucuuucuuuuuuuuugagauggaguccugcucuguugcccaggcuggagugcaguggcauaaucuuggcucagugaaaccuuugccucccagguucaagcaguucuccugccucagccuccggaguagcugggacuacaggcacccacgacgaugccuggcuaauuuuuaguagagcugggguuucuccauguuggcuggguuggucucaaacuccugaccucaggugaucugccugccucagccucccaaagugcugagauuccaggcgugagccagcgcuccuggcagaaguugauuuucuuaaaaaagagagauaauaggaaaacaagcucaaaaaucuauuuggggccuuaugcaggauguuggccuuagccugaagaaauaaaaacugaugaagcgcauuguuagcagagggaugacuugaucagguuuuugaaaacgaauguucagcauugagguaacugaggcaucuggauaugcuggucugggccccugggagccgcaggagauaauggagauagagauucuaugggcugagaccauugguagguuuuaugguguugaggaauacuuaacacugauuuuuuuuuugagcgcuguuaauuaaauguuaaaauauaaucgguuugcuuuagagaaaggcacgaauggauucuggggcucugguauggaaguuauuuucgcaguguaggugcaaggugagggaaccagauagggaggggagaugggcgagggucuguggagaggggcuggagugaaaugguuugagagccaucauguuuauaaaagcaauagaagguacggugggguaauacuuucuauuuaaugcauuuuucauuuuauuucuuuauaacuaauauaaggcacauuuuacauuucagaugaauuuacaaccaauuuucuggauuggacugaucaguucaguuugcuguguguuugcucaaacagguaaaaacaaaaaauuuucuuaguugucuuuucauuuccguaucuuguauugcgcuuugaccaguuagguucauaugagaaccuaagucauaaucaugcugcuccuucuggaagcccugcaauuguuccucuuacucagagaaaggucaaguuccuucauggucaggcuccccucaccccugccaccugggaugaugggaggcaaguuggcuggugaaguacuaaaaugcuagggauugaacacacugcaagaagaucuuuugagaacaugagaguguguaagugaacagaaggcaaaagcaaguauauuuagaagcaaaugaaauaaauguguagaauggaggauuaugaacuguccauuauuaucugcaaagacuuucuagaagacauucucacucuuugauaaaaaagucucacaaaauguuggcaucaucuaggaaagcagugaaaauaaagcugaaaauguauuuaacccuucuauaaagauguggcuccacaucuggaauaauggauacgcaguucuguccucugaaucuugaaaaacuacacugcauagagcaguucgauaucaggauuggaaggacuuacuacaaguaguaaaaaugaagcaggagaccguaaaagaaaguauugauaaguuaguuacauaaaaucaguaauaacaaaaacauucugugucagaacaccguaaacaagaugagaaacuaaacaaagguuccacuucauuaauguguauagaaauccaauaaaaacugaggaacauaacaaaaaaauuugcaaaagacauaacaaaauuauaaaagaaaugguuaguaaaaauaugaaacaauguaaaaccugaaauugauaggcuucaccaaugaauugauauucuaauuuacacuuaugaaaugagcaacaguuuuuuaacauuaaagcacuucgguuggaaaugugguaaaaugguauuuguacacugccguuuugugggagcuuauauuaguaguguugcccuaugguauccauggggaauugguuccaggaccuccuucagauaccaaaauccacaaauacucaagucccugauauaaaauggcaugauauuugcauauaaccuacacauauccuccuguauacuuuaaaucuucucuagauuaccuguaauacuuaauacaauguaaaugcuagguaaauagcuuuuacacuguauuguuuagggaauaaugacaggaagaaaaguauguacauguucaguacagacacuuuuuucccccauuuuugauccgugguugcuugaauccacugauuuggaaaccacagacacagagggucaacuguauauuacuuuuggauagaaauuaguguguauagagaauuuuagaaauguuaauaugcucuucaacuuaguaguuaauuauucuuuuagguuuuauuauaaggaaauaaucagauguguacuaagguuuauauauaagaucaucagcauguguaugugcauguaguacaguauguguauauguguacuugggguguuuauaugugcaugugagcaagcaugugugaacugugcacacauacauuuggaaacaaucuaaauuuguccagcauuaaauagaguacacuuauauugaaauacauaaucauuaaaagcuuuuuaauucuuuuuaaaaagaauuugugaugauaagaauaaaacacuuaggauaagguauaaaaaacaguauacaaaacuguacaacuguauauauaaagugcauccucaguuucauguaaauaauacauguauuaauauauauaugcuugcuuccccuugcuauuuaucugcauaggaaaaagacuggaaagaaauaggcaaaaauguuagcaacaguccucucucaguuaacagauucagugaguugguucuuuaugcucuuguguguuuuccagauuuucuauaagaagcauaugcugguuuuauaaucucagaaaagauacguuggagacagucuguauuagcgcuuaccauguagaaggcauacucuuccuuagguagaugcaaagaaaccuaaaacauacuuugaacauagagccugagaaauucugggauuauggauuagaugaauauggacuuuucaguuauuuaacauacugaaagcaaagggaaagccuugaagauucuugugaguaugguaggaguuaaaugacaagaaauaauacuuugcccaguuuuaagagaacucaugacauuuaugacagucaagaaugauaaauucugaauuaugucuugucuuugauacagaagacaaggaagauaacuuaugucucucuguggcuuucagugucaaggugauccaaaaucacggucccaaauuuugcauuguucucaccgguuugugggagcuaaaaauuaaaacaauugaacucaugaagauaguagaaggaugguuaccagaggcugggaaggguagugagaagguggggaggaagucgggaguguuaauggguacaaaaaaauagaaagaauaaguaugaccuaguauuugguagcacaacagggugacuguagucaauaauaauauaguugcauauuuuaaaauaacuaaaagaguauaauuggauucuuuguaacacaaaggauaaaggccugaggggaugaauaccccauuuaccauuauaugacuguuaugcauuguaugccuguaucaaaauaucucauguaccccauacauguauacaccuauuuacccacaaaaauuaaaaauuaaauuaaaaaauccugcucucuuuggggaaggucuaguuuagaugguaacuaggucauaguauuaauauuuaacauauguauugcauugucauugugauucugauuuuucauuauuuucucucugacacuucacauaaaauguucuguucuuucuucuuucugacagaugaaaauagauguuuaaaagcaaaugccaaaucauguggagaauguauacaagcagggccaaauuguggguggugcacaaauucaguaaguaagguugcucaaguccuuuccauuuguucucuggucauuuaguguggcucagugcuguauccuucagaagcacauauuaauuuuuauguaaaucauaaaaugaauaaccuaaugguuuggagcuaugugguucaacacaguagccacuaggcagauguggcuauugagcacuuuuguacaaauuagaauugcucuaaguuucaaagauauacaagauuucaaagacuuaguauuaaauaaauaauaauggugaaaugauaauuuuuguauauuuaaaaauaauguuauaacaguguuaaaauuuucucuuuuucuuuuuuuaguguggcuacuaaacaauuuuaaaauacauauauuuguagcucaucuuuguggcacauauuagauuuuuaugggagaaccuucaaaaaaauccuagucauuuaguuugacuguuucagauuuccccuuuuuugauggggagguauaaauuaaccuucuuaauuauauuugaguuaaacuacuggaauugauuugcaucccaauauaagcuuauugagguuaauuaggguuuggauuuuauucacuuuugucaucucuauacuuuugcuaauaugguaccuuccacaaagccuacuaaauguucagugagucaaugaaugaaugaaugaauauaucaaaagagaagguaaggagaagucauuuugagguuguauaguuuauucacagaaugaauaacuaauaucagaagaucaagggguuacugauuuuguuuucaugcaggcauuugggcccaaguuucaagugccuauuuuuguaugccuaaguggucaagugucagauaugucguaugguuugaccacaugaaagaaaaaaugagagguuuuguuguuuuucaaaaauuuucuaaugguguuuucuaaaagugguguguugggauuacauuggcaacaguggaggaaauauggaguguugugaguuugucucaggcaaggcuuauguaacugaagcucuugguuuucauaucugaaaaugaggaugauaauauccgcuuuaucuauuguuacaauaauuagaauugaugaacuuaaagcaguuucacuuaaaaacuucuaaauaagugguagcugcuauuauuguuaacauauccauuuuauggggacuacaguuuaucuguaguuaaggauuaucuuagccuuugagcuuuggagcauaauccuuaaaauuuuaaaggcuuucugaauauauucagugaaauuguauuugggugucaugauuguaaauuucguggauugauuaguauuuagaaauguguaauucacuaggaucuugugcuuugguagguaguaguuuagguuuaauaaauagugcagcuuugaauuaucugauucuugguauucccuuccaguuguugauuacauaaauacucucauuaguaugauguuucucuuaaaaaaucuuauguaaaaacuauuguguauucuuuaaauuuaaauaucuucacuuacuguuacuuuauacagcaccguuaaauugauauuugauaaauaaauaccauauauaaugucacuguuucccccacauuuucacauuucuugaaacaccuuuauucacagucuuuauauagaucuuuaacagcaguguuuuugaauucacuaaggcacuuuucaguuauaugauuaaauuuuuauuucuaaguuguuugauguauaccacauuuaaaaucucugucauuacuagaaauuuuacuacugcaaauauccauucaccugccauuaagaacuuuuuuuccuuuuuugaaauuuaccugccauuaggaccuuuuacccuugucauauacuuacuccuuuuacccuugucauauacuuacuauuuugcuuuuuaaaaguuuuuuaaaaacuuauuuacaauaauagcuaauacuuaaaguuuuuucaaaccugugggaauacuuauuuaaucggugcuaaauuucguguuguccuuuuaaaaaaugcaauaauuaauugagauguuuuuaagcucgucuguuuucccuaaacaucggguuguucagcauauugcgauggggagagugccacauaauaugagacgcuuuguaaggacuuuucaaagggaaauuuuggagaaaugaucugauauuuggguguauguauacauuauuaguagccauuaaccaugcucaauuagugauuucacuaaagaaauugcuuuugauuagauacucugaauuacaagauagagcauuuacuguguacacuugggucaguucugggaaagguauuacuuucuuggaaaugauuguuuuuuaacaagaacacuuaccacaguuuggaugaagggagcauuuuguuuaaaagccagaauugggguacauuagaugugauuugauguuuugcaauuuaauugcuuauuugcaauuauuauguaaaaagguuugaccauuacaauuuucauuuauaccuauauuuuauaugucauuuagacauuuuuacaggaaggaaugccuacuucugcacgaugugaugauuuagaagccuuaaaaaagaaggguugcccuccagaugacauagaaaaucccagaggcuccaaagauauaaagaaaaauaaaaauguaaccaaccguagcaaaggaacagcagagaagcucaagccagaggauauuacucagauccaaccacagcaguugguuuugcgauuaagaucagguauggaagcccaacucugugaauaccugcguguuuacuugaggcauucgacaccagcuuuaugcaaacucugaccaguuucuguugaaggcucguuuuuacauguggacuggcacucaaaaauguggaauuguuuaaauuuuagaaaauuuuugcagauauaacaauuguaagacauauuuacuuggaauaauauuaaauguugccuaauauucaaaguaaauuuuguuaaagauucagaaaguauuaauuagcuuuagugaguuuuaaaaaugaaaguguucauccucuggucuaauuacauaauauauuauaaaagcaacauuuuaaccuguucuuuuccuuuguauuuguuuaguauuauuaaacuguuaagguuuuuguaauuaugucuguuagucccacaucuaaacaugaaggaaaaaacaagcccucauccucgcuuuucugguuuccgaccuuucuugucaggagaaugguagaguggcccuguccccugacuucccucccggccccuccucaaccaggucagcccucuccuccucauccugcucuagcaaagcuccaccaucgccuucagcccgcagacccaggggacccuugucaggauuuuuuuuaacucuucuguaccaaguaacacuuuguacuuuuugaaaugcucuguccuugaucaaugauaccacuccucgguuuuucuuugugucucuuaccauugccuuccaggccucuuuuugugucuuuuuucuuccucccuuuuugcaguccaccuaaaugucaguuuuccucucguggcuuuaaaacccaauuguaugcugcagcaacacagacuuuucuugagcuccaaacccauuucuccaauugccuauuagaaaucuauauagagaaaacuacaaguuaaaauuuuaauuacauuuucauccaaaccucucuccuguauuuccuaaguaaauuacauuaacgucucuuguaucucucucuucuccuccuucaucaucucucucuggguuucuuuuguagauuagcuagucucuuugccucauaaugauaauaaaaauaaaauaauaaauaauaaauaauaauaaauaaauaauuauuuuuaaagcugucugccaggcuuucuaaaguaaagaucggaucauguuauucacuugcagggaguggcaucccacuacacacagaacagaguucacaacuucagugucuaaaaagucaguuguacccuaucacguguucugccuugcccucuccagacuaauuuaugguguucuauuuguuuucuucucuuauaaacugacuuuuugucuguuuuguccacuguggauugggaauaucuuuuuuaucuuugcauccugaaggccugguguuuaaaguauuuguugaaugaaacugaauacauacccauugaguuacuuauggaauucccagguuuuuguaaaaauuaugacaacauguuuuauuuuauuguguuuaccguguaaaccacauuuauuugguuuuucucguuugcguuugauugccaacaggcaaguuucauuuucuaaucucuugucuaauuaggggagccacagacauuuacauuaaaauucaagagagcugaagacuaucccauugaccucuacuaccuuauggaccugucuuacucaaugaaagacgauuuggagaauguaaaaagucuuggaacagaucugaugaaugaaaugaggaggauuacuucggacuucagaauugguaggaauguugggaacauugaccauuuucauuauaaagucuuggcaauucucaaauguuguuuuauauuuuauuccuuuguuacucacaacauacuugugagauaaacaagccaguuuuuuagccuuuucugaguggaaguugauauuccagucacacguuuaauaaucuuuucugccaccuuguuccucugucacuggaugcuacuguuugacacagauuguaccucauagauaaugacuugcaugcuuauuuucauacuaacuugaucauuuaucuuaugacuuacuuuauuuuauuuuuaagaguuucacucuugucgcccagacuggagugcaguggugugaucucggcucacugcaaccuccgcuucccggguucaagugauuuuccugccacagccucccgaguagcugggauuacaggcaucugccaccacccccaacuaauuuuuuguauuuuuaguagagauggggguuucaccauguuggccaggcuggucucgaacuccugaccucagguaauccagcugccuuggccucccagaguauugggacuacaggcgugagccaccaugccuggcccuuaugacuuauuuuauaaacauguguugaauacccagauuuuaucuaauugcuaauuaguaugucugcaccugcccguacagccugaucucaucuuagaccuggauuuuucauaugaugaugaucugcuuuccaaaccuuauuuuucccauuucaugcauccccagcuuaaccucuuuuuugccugcuucucuccacuccuguugcucuagagguuuagcaacagaauauuagaaagauuugacaguuaugaggccuaagagcugccuuucaaaaauuagcccuauuuuaguggaaacauuuaaaaauagcacuugcuuaaaauguucuuuuauucuguaagcauaauucaaggaccauggcauuagggagcuccuaucaaauuaguguuuuuuaaaauggccagaauucuagaauauuuguuuauucauuuguucagcaugucauuauugagagcuggugugccaagaaaaugaaugugaguuauuuuuaaaguagggaggcaaaauaaaaagauugucuuaggucuuaguccauuugugcugcuuuaagaaaauacuauaaacuggguggcuuaugaacaacagaaauuuauuucucacagcucuggaggugagaaguccaagauccaggcagauugagcaucuggugaggucccucuucuggguucauagaugauaccuucuugcgauguacucacauagcagcagggagacagcagcucucuggggcuucuuugaugaggucacuguaggagucuauucuuacguugcuauaaagacauaucugacacuggguaauuuaugaagaaaagagguuuaauugguuuacgguccugcaagcucuacaggaagcauggcgcuagcaucagcaaggccucuggggaggccucaggaagcuuccaaucguggcagaaggcaaaguggggagcaggcuucucacauggugggagcaggagcaagaguuggggagagaugccacacaauuuuaaauaacagaucucaugagaacucacucacuguggucagaauagcaccaagccaugagggauugaucugcccccaugaucgaaauaccuuccaccaggccguaccuucaacauuggggaucacauuuuaacaugagacuugggcggggacagauacccaaacuguaucaguuacuaaucccauucaugagggcucugcccucaugaucuaaucaccuuccaaaggaaccacuuccuaauaccaucauguugggaauuagguuuucaauguaggaauuuugggguaacacagacauucaguccauaguaaccuacauuugguaacauagaugaauuuuuuaaacaaugcaaaucucugucuuuccaucuauccauccauucauucauuuauguaccauuuuuuucuuggcaggauuuggcucauuuguggaaaagacugugaugccuuacauuagcacaacaccagcuaagcucaggaacccuugcacaagugaacagaacugcaccagcccauuuagcuacaaaaaugugcucagucuuacuaauaaaggagaaguauuuaaugaacuuguuggaaaacagcgcauaucuggaaauuuggauucuccagaaggugguuucgaugccaucaugcaaguugcaguuuguggaguaagcgcauucauuuccuaucaggggauauuguuucuauuaugugugugaauuuuaagugugauuuuacuaugauaauagaaaaauugaccuuaauuuucauagauuugauuaucuuagagaaguaauuuuaaguaaacccuuaaauugccuguauacauaaagugccuuuauaaaagcauauuuaaucuuuaugcaaaccacacaguuaguuuauucaugcgggcuuuuaaaagacagaaugcuaaccauuugaaacagcggggcaaccucucuguacuguagcugguggucuggauuuuagaaaagcccauguguccuaacuuucuggcuuuguacuagagauagaauugauguuauuaucugaggcaucaccaggaaccuugaaauugcucaaagggagagugucuuguaucauuuuccuuuggucaguuuucuucucacugucuuugaaagacacaucuuucuccugugucuuaguaauucaaaaagagagaacuuuuuaagcucuaguuuuuaaccuauaugaauagauguauuuugagaagugauacaauauuuguaauuuuaauuguaagauuuucaguagcaagcccaucccuauugguucaauaauuuguauuuuaugauccauguagcagcuauguauuuugagaugacacuuuaaugauguggcugaggcugaaacuagaagacauugucaugucaaguuuguccugcguaccuacucuugucucauuuuuguucccuccagugcccccauucucuagaugaccuucuuugauuuuagaggccucuuagugguuauuuuucagucaauuuuugcuaaggugcuaauugaugcccaaaauaauaagugaaggaauauggauaguaauuaagaauuuuucuaucaccacugaugcugggcaauuuacucagccucuccagggcuguuuucuucucuuuaagaagggaucaugauaguaucuaccucauagggcucuugugaaguuaaaaugcaucaaucucuauaaaguaccaaugagcauucagcaaauacuaauuccuauauuguuauuacuuucgacuuuucacuagaguguuugcaauuuaagguuagucccugcuguuauagccgaagcaaguagcauuccagguaguaccuagccuuacaccucuuuucuuacuagccauugaugugugagccuguuagcagcucguuguggggagggcauucucugggcugccucuaacuaggccuuaaccugugguauuaaacaagccauaacacccuugauuguggcuguuuuucuguguuggucaugcugauccacuccucuagaugcaaaagaaucagacauuccacuuuugaaagauugccaguauuaauaaaugugauucccaccuuaaaguauuuuacugucuuaugaagaucuaaacagacguauuaaauaaauuaacgaaagcagguaaauuccuauaguccuaugauuuuauaauuauaaauuaccauagugacaagaagauuuuacaguuacuuuagauucuuuauuggaaagggcaaggauaaaguaaaugagugcauaaacaguacugauugaggaguuagaaugggugaaauuauccuuaaacaagauacuuauuucuguuauaaaaaaaggaagccucauauggugggcugauaaagaaggugcauggcauagaacauagagcagagauggguggauggggacaagacagcagcagugggguaaaguaaggauaggcucagacacuuucauuuauucagcaaaugcucaucaagggcuuacugcuugccaagcagugugcuggcuugcuagcugcuggagauaugaugauaagcagaacuaaaccaaaccaaacaaaacaaaaaaacaguuuuuaaaaagaacugagagauugagagauacggauggucaggcaagauaucguuguacaugggauggaagagcuucauucagugggcuuuguguguuucucagcaagauaauuaccauuguauaaagagaagacacagaaaauacagaauuagguuaaaaauacaaugguggccuauaugaaaauuaaaggauuuuuguugaauuacugugaauaguguuuuaaaauugaaauccuuuucuuuucaagucacugauuggcuggaggaauguuacacggcugcugguguuuuccacagaugccggguuucacuuugcuggagaugggaaacuugguggcauuguuuuaccaaaugauggacaaugucaccuggaaaauaauauguacacaaugagccauuauuauguaagugccugguuccuuacauagugaauguguuuauguuggauuuuaauguuuaauacuaagagcuugugggugacuggcuugggguuucucaggguuugagguuuugcuguuuugguaaguagggguccugauugaaagugcaggaaagcuaguguugcuguuugugaagaugcagcuuuguauuugcuuccuucugcucagacaagggccucacuggggugggaaagggaugcccagaugccacuuucacucuuugccucaacuccccgcccacagcauuugguagcacagucaguacucuuucuaaauaaauaauuuaucuagucucauacucuuuguuuuauacgauuuuuaaaagcagucacucugccuuuauugaaaauaaauauuggcaaagcauucaaguucuagaagaaauccaaaugguaaaucuuggucuuuuucuuaaguuguagauaauagaauauuuaauuacugacuauucuuuaauuucauuguccuuauauuuaauauacauagauaaacuuacuauuuaaaaccuuuugaauauggaauuuuuuauucauacaugaaaguaaagagaagaggauuagcaauucauguauacacacgacucacuucagcaguuuauauuugauacuguuauuugaaagcagucuuguaaucuaguuauauguaugcaacuagauguaaucuagcuauauauggauuauauauguaaucuaguuaucuaaagcagucuuguaaucgaguuauguguaaucuugcauguauaacuagauugaaaaauuagaagagauuauaaggguguauuuaaauacuaaauuauauuacuugauuucuuaggauuauccuucuauugcucaccuuguccagaaacugagugaaaauaauauucagacaauuuuugcaguuacugaagaauuucagccuguuuacaagguaaaugugugagauaaaaagaacaagauucuaaacauuuuugauuguuagaggcaaaucaugucugaauugaaaugugggaaaaugccaccagauaggcaaaccgaauuuuacaaaagugguuuauauuaauuuuuaaucacauauuauaaaacugguuucuagguuugacuccuaaaguuaguuaggaggaaacaugggaacuggcauuuaaagauaaaaguugcucaguggauccuaauugguugaaugaauagcaguuguauuuuacguguuuuaucuuuuaauugcaggagcugaaaaacuugaucccuaagucagcaguaggaacauuaucugcaaauucuagcaauguaauucaguugaucauugaugcauacaaugugaguacaucuuaaauaagaucaguuuuggacaauacccuguugagaauacuuuguacaaagaaaguaaaacuuccuucauacacacuuuagcgagcccaaaguacuacagaaaaacuuaaauucuguauguaucuagaggaaaaacuuuauacauauugucuuacaaaagcaagauucauggccuaaacaaagugaaaaugugauaaaggcauguggggaguauuuccaaauaacuguuuguuuaucauuaaggaauagaucuccuuguuagaaagcaauuguaaaacauaacuuacauuuaaacuuacaggauuucuccaaucuuuuuccuccccaaaauauccuuuauagagucaucuauucugaugaauugugcuagaaaaguuuuuuuuuuugccaauucuucucuucccauauauucagaggauauggguuucuauuucaggagguacacacucauauauacguauaccauaaaauauauaaaaauguaaauauacaugugauuugccuauuucaaaaagauuuauaguguuguuuuccccucacagaugggaggaaguugaauugaaauuaaagaggaauuggcuuauccuuuuugagcauaauucaguguacuuuaaucacaccgaguuagccuucauuaauaaucauuuaaauaaucugaaggcgguuguaauuugguagguaacccuugugugucucgugcaccacuuucagcccccaucccccuaacccuuuggcagcuugaauuuuagacauuuuuacuucaugucauggggguaccauaacgcuuuggaaaggccagccuaccauaugaggcuucccuuuuuuaugggguaccauaaugguuuggaaaggccugacuuggagggguuuuuauaaagguuuuuaauauuuuacuuguuccacagcuuuucccauucuccccugucuuagauaauuuuccuaacucuuguucuuucaggggugugaacaagagauagcuugccauuguacccuucuccauuuguccugaauagucucauauguuaaacaagcccuggcuugaauccuuccuucuugggggauuuuguuuuuuuuuuuuuuuggcugggcuacaaugguuccuuaagcaaauuuguuccuagacugcauaguugauuguuuacccuaguccauaguuagcuggagagguaggacuacagaaaugccauuuugccgauggggaagacagcauuuauuucguuuuuuuuugggggguuucuguuuuuguuuuuguuuuuguuuuuuagauggagucgcacucuguugcucaggcuggagugcaguggugugaucuuggcucacugcaaccccugccucccggguucaggcgauucuucugucucagccucccgaguagcugggauuacaggugcacacugccaugcuuggauaaauuuuuuuuuuuuuuuguauuuuagcggagaugggguuucacuguguuggccaggcuggucuccaacuccugagcucaggcaguccaccuaccuuggccucccaaagugcugggauuacaggugugagcuaccacacccggccuauuccacauuuuuaagacuccuccuaauuaguaacagcccucugcacugugugauccugaguauuuuaacucagugauuaaaacaggaauacucuuuucaauuguguauuuuauuuuaaagauuugauccuuauuaauuaaaaccuguuucucuggccucuguguuuucuaguuacucaauuggauuuggcuuguagauacuuuauugaaauauauuuuuuucugagcaguuuauccauugguuuuaugcauucaaguagcauuuuguuugacuuuuccuguguauaauuaggcauucuuuuagucccuuuccucagaagucauuuuggaaaacggcaaauugucagaaggcguaacaauaaguuacaaaucuuacugcaagaacggggugaauggaacaggggaaaauggaagaaaauguuccaauauuuccauuggagaugagguauguuguauaaagcauuuucuguagaaaacauugguuauuuauaagcaaauuuaguuuauaguuugagaaacauuaaaauaagugagcaacuuuuugaaauauuuuuuaguagauuuaaauuguuuaguugguuguuaaucuuuuuuuucccuucaagguucaauuugaaauuagcauaacuucaaauaaguguccaaaaaaggauucugacagcuuuaaaauuaggccucugggcuuuacggaggaaguagagguuauucuucaguacaucugugaaugugaaugccaaagcgaaggcaucccugaaagucccaagugucaugaaggaaaugggacauuugaguguggcgcgugcagguaagcuggguguugucagacagugacagagcuacauugguuuagagaguauaggcaggucauauuuugggacauccagagaauaucucucuauuuggagcaaauuauuuuuuccaaccacgguugcucaccacaagaucaguuugaugaucuugugugugauauuuauagaaaguuccuuccugccuuuuuuucuuaaagugauuacucuuuaaaauaaaagauuuuauagccaugaaagaaguauauucaacaaauuguuaagguagcguuucucucaugugagagcaaucaauuuucuagaacaaaauaagcuuguguaaaauaacguuuauaggaaaauguuuuggaaaaacaucaaaccgaugauggcgauuucgucugggaaauggaauuaugaagcaguagaagauguuugucuuguacuacauguacuucugcauuguuggaauaauuuuuaaaaaauaaauauguguuguaaaauacaaaagagaaaaugguauuuucaguauguagaaucuaguacuaagaaaacuaacaaaauuacuucagauuuuauuuucacacugugguuacuuuuuguaauugaaaaugaaaaacugaguauacauugaauaccgcuuucucuguaaaagaauaggaagagggaagaguguuuaauccagugucagccccaaaagacuaggcuuagaaggcuauugacuaugaaagaaauauauggcuuuagcucacuaucaauuuuuaauugucugugcuaaguaacaauuuaaauguuagaguuucuuuaucuuccauguuguacauauccuguuuuaaucaugcagguccauuuuuaguaaaaugucauuuaaccaaaaagauuaucuugaaaauacuuugccuuucuuuccuuuauauuuuuaccagauacagaaucagugcagucaguguccaugagcauuauguguucuaaaaauacacagggaaccugaaaagucugcacauguaggauauauuuauuuuuaaauaguauacuaguuauauuuuaagugguauacacaguauguuuuuuuucaacuuccauacacuuuuuugcauguguuuauuguauuuuuuuagguuaacagaccauugcuuuaaauuuagacaguucaccuggaauaguaaauguaauagcauaccauuugaaaauguaacuaacgugcucuuuaaaauuaaguuuauucugccuuuccacaugugucauucacuauucauugcuagauuacauuuuugucuugaccaaaaugguuacuuuccugaagaaauuuuuuuccuagacucuugcauauauuccauaugaacuugaguggcuggaauguacaugugcgccuguguauguuugucccugcuugcacauguguguacacuuuacuacacgacugugacuuguggcauggacacucccaccuaacagauuaggagcuugaagagauuuuuuauaguuuuauuuucuuucccaguuuuucccuuuuaaauuauuauuauuauuauucccuccaagaugauucuucuucuuuuuuauuauacuuuaauuucuaggguacaugugcaaaacgugcagguuuguuccauauguauacaugugacauguuggugugcugcacccauuaacucgucauuuacauuagguauaucuccuaaugcuaucccugcccccuacccccaccuuaugacaggccccagugugugauguuccccacccuguguccaaguguucucauuguucaguucccaccuaugagugagaaggugcaguguuugguuuucuguccuugcgauaguuuucucagaaugaugguuuccagcuucauccaugucccuacaaaggacgugaacucaucauuuuuuauggcugcauaguauuccauguuguauaugugccacauuuucuuaauccagucuaucauugauggacauuuggguugguuccaagucuuugcuauugugaauagugccgcaguaaacauacgugugcacgugucuuuauagcagcaugauuuauaauucuuuggguauauacccaguaaugggauggcugggucaaaugguauuucuaguccuagauccuugaggaaucgcuacacugucuuccacaaugguugaacuaguuuacagucccaccagcaguguaaaaguguaccuauuucuccacauccucuccagcaccuguuguuuuccugacuuuuuaaugaucgccauucuaacuggugugagaugguaucucauugugguuuugauuugcauuucucugauggccagugaugaugagcauuuuuucaugugucuguuggcugcauaaaugucuccuuuugagaagugucuguucauauccuucucccacuuuuuggugggguuguuugauuuuuucuuguaaauuuguuggaguucuuuguagauucuggauauuagcccuuugucagauggguagauuguaaaaauugugucccauucuguagguugccuguucacucugauggcaguuucuuuugcugugcagaagcucuuuaguuuaauuagaucccauuugucaauuuuggcuuuuguugccauugcuuuugguguuuuagucaugaaguccuugccuaugccuauguccugaaugguauugccuagauuuucuucugagguuuuuaugguuuuaggucugacaucuaagucuuuaauccaucuugaauuaauuuuuguauaagguguaaggaagggauccaguuucagcuuucuccauauggcuagccaguuuucccagcaccauuuauuaaauagggaauccuuuccccauuucuuguuuuugucagguuugucaaagaucagaugguuguagaugugugguauuauuucugagggcucuguucuguuccauaggucuauaucucuguuuugguaccaguaccaugcuguuuugguuacuguagccuuguaguauaguuugaagucagguagcgugaugccuccagcuuuguucuuuuggcuuaggauugucuuggcaaugcaggcucuuuuuugguuccauaugaacuuuaaaguaguuuuuuccaauucuaugaagaaagucauugguagcuugauggggauggcauugaaucucuaaauuaccuugggcaguauggccauuuucacgauauugauucuuccuauccaugagcauggaauguucuuccauuuguuugaguccucuuuuauuucguugagcagugguuuguaguucuucuugaagagguccuucacaucccuuguagguuguauuccuagguauuuuauucucuuugaagcaguuaugaaugggaguucacccauaauuuggcucucuguuugucuguuauugguguacaggaaugccugugauuuuugcacauugauuuuuguauccugagacuuugcugaaguugcuuaucagcuuaaggagauuuugggcugagacgaugggguuuucuaaauauacaaucaugucaucugcaaacagggacaauuugauuuccucuuuuccuaauuaacugaugggcuucccuuugugggaauauuguuauguguuauuucuuucuccugccugauugcccuggccagaacuuccaacacuguguugaauaggaguggugagagagggcaucccugucuugugccaguuuucaaagggaaugcuuccaguuuuugcccauucaguaugauauuggcuguggguugaucauaaauagcucuuauuauuuugagacacaucccaucaauaccuaguuuauugagaguuuuuagcaugaagggcuguugaauuuugucgaacaccuuuucugcauuuauugagauaaucauguguuuuuugucuuagguucuguuuauaugauggauuacguuuauugauugccuguguugaaccagucuugcccagggaugaagccaacuugauugugguggauaagcuuuuugaugugcugcuggauuugguuugccaguauuuuacugaggauuuuugcaucgauguucaucagggauauuggucuaaaauucucuuucuuuguugugucucugccaggcuuugguaucaggaugaugcuggccucauaacgugaguuagggaggauucccucuuuuucuauugauuggaauaguuucagaaggaaugguaccagcuucuguuuguaccucugguagaauucggcugugaauccgucuggucuuggacuuuuuuugguugguaggcuauuaauuauugccuccauuugagagccuguuauuggucuauucagugauucaacuucuuccugguuuagucuugggaggguguauuuguccaggaauuuauccauuucuucuagauuuuccaguuaauuugcauagugguguuuauaguauucucugaugguaguuuguauuucuguuggaucgguggugauauccccuuuaucauuuuuuauugcaucuauuugauucuucucuuuucuucuuuauuagucuugcuagcggucugucaauuuuguugaucauuucaaaaaaccagcuccuggauucauugauuuuuugaagggcuuuuuaugucucuaucuccuucaguucugcucugaucuuaguuauuucuugccuucugcuagcuuuugaauguguuugcucuugcuucucuaguucuuuuaauugugauguuaggguguccauuuuagaucuuuccugcuuucucuugugggcauuuagugcuauaaauuucccucuacacacugcuuuaaaugugucccagagauucugguauguugugucuuuguucucacugguuucaaagaacaucuuuauuucugccuucauuuuguuauguauccaguagucauucaggagcaggucauuuaguuuccaugcaguugagcaguuuugagugaguuucuuaaucuugaguucuagcuugauugcacuguggucugagagacaguuuguuauaauuucuguuauuuuacauuugcugaggagugcuuugcuuccaauuauguagucaguuuugcaauaagugcgguguggggcugagaagaauguauauucuguuguuuugggauggagaguucuguagaugucuauuagguccacuuggugcagagcugaguucaguuccuggauauccuuguuaacuuucugucucguuggucugucuaauguugacaaugugguguuaaagucucccauuauuauugugugggagucuaagucucuuucuaggucucucaggaccugcuuuaugaaucugggugcuccugcauugggugcauauauauuuaggauagucagcucuuccuguugaauugaucccuuuaccauuauguaauggcguucuuugucccuuuugaucuuuguugguuuaaagucuguuuuuucagagacuagguuugcaaccacugccuuuuuuuguuuuccauuugcuugguagaucuuccuucaucccuuuauuuugagccuguguuugucucugcacgugagaugggucuccugaauacagcacacugaugggucuugacucuuuauccaauuugccagucugugucuuuuaauuggagcauuuugcccauuuacauuuaagguuaauauuguuaugugugaauuugauccugucauuaugauguuagcugguuauuuugcucauuagcugaugcaguuucuuccuagcaucgauggucuuuacaauuuggcauguuuuugcaguggcugguaccaguuguuccuuuccauguuuagugcuuccuucaggagcucuuguaaggcaggccugguggugacacaaucucucagcauuugcuugucuguaaaggauuuuauuucucuuucacuuaaagcuuaguuuggcuuaauaugaaauucuggguugaaaauucuuuucuuuaagaauguuaaauauuggcccccacucucuucuggcuuguagaguuucugccgagagaucugcugcuagucugaugggcuucccuuuguggguaacccaaccuuucucucuggcugcccuuaacauuuuuuccuucauuucaacuuuggugaaucugacaaucaugugucuuggaguugcucuucucaaggaguaucuuuguggcuuucucuguauuuccugaauuugaauguuggccugccuugcuagguuggggaaguucuccuggauaauauccugaaaaauguuuuccaacuugguuccauucucccugucacuuucugguacaccaaucagacaucgauuuggucuuuucacauagucccauauuucuuggaggcuuuguucguuucuuuuuacucuuuuuuuucucuaaacuucucacuucauuucauucauuugaucuucaaucacugauauccuuucuuccacuggaucgaaucggcuacugaagcuugugcaugcaucacaugguucucaugccaugguuuuccgcuccaucaggucauuuaaggucuucucuacgcucuuuauucuaauuagccauucgucuagucuuuuuucaagguuuuuagcuucuuugcgauggguuugaauauccuccuuuagcucggacaaguuuguuauuaccgauuaucugaagccuucuucucucaacuugucaaagucauucuccguccggcuuuguuccguugcuggugaggaggugcauuucuuuggaggagaagaggugcucaaauuuuagaauuuucagcuuuucugcucugguuucuccccaucuuugugguuuuaucuaccuuuggucuuccaugauggugauguacagaugggguuuugguguggauguccuuucuguuuguuaguuuuccuucuaacagucaggacccucagcugcaggucuguugggaguuugcuggagguccacuccagacccuguuugccugaguaucaccagcggaggcugcagaacagcaaauauugcagaauggcaaauguugcugccugauccuuccucuggaagcuucgucucagaggggcaccgggcuguaugaggugucagucagccccuacuaggaggugucucccaguuaggcuacucgggcucagggacccacuugaggaggcagucuguccauucucagaugucagacuccgugcugggagaaccacuacucucuucaaagcugucagacacggauguuuaagucugcagaaguuucugcuggauuuuguucagcuaugcccugcccccagagguguugucuacagaggcaggcaggccuccuugagcugcaaugggcuucacccaguuuuagcuuuuuuuugcuuuguuuaccuacucaagccucagcaaugggggauaccccucccucggccucccugcugccuugcaguucaaucucagacugcugugcuagcagugagcgaggcuccaugggugugggacccucugagcugggcaugggacccucugagccaggcgcgggauauaaucuucugguguuccguuuucuaagagcauuggaaaagcgcaguauuagugugggaguguccugauuuuccagguaccgucugucacagcuucccuuggcuaggaaagggaauuccuugaccccuugugcuucccgggugaggcgaugccccgcccugcuucggcucacacuccaugggcugcaccuacuguccagcaagccccagugagaugaacccaguaccucaguuggaaaugcagaaaccaccugucuucugugucgcucacgcugggagcuguagacuagagcuguuccuguuuggccaucuuggaaccucuuaaauuauuuuuguuuugugugauugcaauuuuggcauguuucuucaggugcaaugaagggcguguugguagacauugugaaugcagcacagaugaaguuaacagugaagacauggaugcuuacugcaggaaagaaaacaguucagaaaucugcaguaacaauggagagugcgucugcggacaguguguuuguaggaagagggauaauacaaaugaaauuuauucuggcaaauucugcgagugugauaauuucaacugugauagauccaauggcuuaauuuguggagguaaguaaagggccugaagugguuguaagaugugaucccaucuaaugccacgaaaaaucuugaguuuaguuggugcauaaguagaaaagggguagcuugagggucagucucgccccuagguauacuuucucacauguuguugcuuauuuuacuuuucagucaauacugugauuguauauuuuuaccauuuugagaaaugauaugcuuaauugcaggaaaugguguuugcaagugucgugugugugagugcaaccccaacuacacuggcagugcaugugacuguucuuuggauacuaguacuugugaagccagcaacggacagaucugcaauggccggggcaucugcgaguguggugucuguaaguguacagauccgaaguuucaagggcaaacgugugagaugugucagaccugccuuggugucugugcugagcauaaguaaguauuuccuaauugcuugaaauaguugauacuuccucuuggcucuccuaagccuguauuguuucuagaaccagaacagugccaauauuaaaauauacuguaaauaaaaugccugccauguggaagccuacucuuuaauucuuaaaaguucuuucucaacagcuaguauauauuacaugguaugaagugugucaugugagaguuguacuauuauuuugaucugaaugugcuagauaauugaauuuacaugguaaccuuuauuuuggcaauuaagauuuaauuuaauuuaauuugucauuaccaauuucuuaauuacugucuuuugacaaaacuaagccaaauuaaagauuuuuccucuugaaggauuauuauacuaguaacauauuauuuaaauuauuaugauuuuggccgagcacaguggcucacaccuguaaucccagcacuuuggaaggccgagacagguggaucacuuaaggucaggaguuugagaccagucuggccaauguggugaaaccccaucucuacuaaaaauacaaaaauuagccagauaugguggugugugccuguaaucucaacuacuugggagguugaggcuugcuugaacccgagaggcagagguuacagugagccaaggucacaccacugcacugccuggaugacagaacaagacuccaucgcaaaaaaaaaauuauuaugauuuuauguuacauauuuaauaugugauagggcuaauuuauuuuacuaucuuuuauuucuuaauaggguuuuaauuugaacuguaauaaaucuuuaauuuuauuauggaaauuagcaucuuuuuacauaauuuuucuauccacaaauguaauguuccucuucauuuauugaaaucuuccuucauagcuguuuguucaauuuggucacaagaguuuagcaugggaaauauguuuaagcaaauauuuacugaaauaauaaaauguaaauaucauaauuuguguuuuuuguaacagagaauguguucagugcagagccuucaauaaaggagaaaagaaagacacaugcacacaggaauguuccuauuuuaacauuaccaagguagaaagucgggacaaauuaccccagccgguccaaccugauccugugucccauuguaaggagaaggauguugacgacuguugguucuauuuuacguauucagugaaugggaacaacgaggucaugguucauguuguggagaauccagguagaaaugcgaugauugcagacauucuuuucauaucuuguaugucuuguuucugcuuauuuaggccuaacauccagaaacagccuccagcuggaauauuuuaggucaaguugggaaauuuuucaucucucaaagcuuaaaauauuaucuaauuaacuguauaagaaauaaggaaaagagaguuccacuuuuaaguuuucugaguggagaguuugaagauuaaauacagugauuuauauaagacgcuuagugauuuauauaagacacuuagaacgaugccugacaccaagugcauauuaagaguuuuuugaugauugaugauuuuaaaauuagagcuugauuuaagcuugaauacugggaaagauaauuuguuaaaggauauuaauauaaaguguugaauuuguucaacuucuccggaggugaaacuuuuuuuuuuuaaucuuaguuuuccuaguagccuuuuuguagauucuuuggaauuuucuaccauaguguacauguuuuugugugaacauaagcuuucauuucucuuggguaaauacuaaaaauggcauuuuggagcauaugguaagcauauguuuaacuuuguuaagaagcugccagacucuuagacucccauacuguuuugaauuaucagcuagguguuuugcaaauauugucucccagccugugucuccuuaucauuucauuuuuuuaagugucuucugaacaccacagguuuuaauuuugauuaaguacaguuuaccaaguuuuucuucuguggcucuugcuuuuacauugucuuuaagaacucugccuaacccaagauuauaaggauuuuucuccucuguuuuuugguagaaguuuuauaguuucugggguuucacauuuagaucuguaacucauuuugaguuagugugugacaaaaggcucaguuuuuuucaugucaguguccacuuguucuaggggcauuuguugaaaaaagacugucuuuucuccaccuuuguugaacaucaggugaccuuacauguguaggccuguuucugacucuguauucuguuccauguaucugaguguuagcuauaccacauggucuuguagcuuucuuuauagcuaggccugaaagcagggucuuccaacuuuauucuuuuacaaaaguguuuuugagacacuuccuuaguucccugccuuccauguaaauuuuagaaguggcuuacugauugcuacagaaguucugccaggaguuugagugggauaccauugaguuuauagaucaaauugggaagaauugacgucuuaacgguauuagguuuuguaacuccugcacauggaauaucucuccauuuauucagucugaaagauuucuuuuuaucaguauuuaguaauucuuaacaugcaaaucuugcauauauuuuguuagacuuauauguaaguuuuucaugcuuuuucauucuguaguaaauauuacuguuuaaaaacuuauauuuucaauauguagaaauaaauuauauauauagaaaaauacaugauuuuuguucauugaucauguauccugcaaccuuguaaacucacuuguuaguucuaagagcuauuuuauagauucuuugggauagugugcguucacucucuuggguguuuauuccuguauguuuuuuauaagacacugcacagcucuuuguggugcucauuauuaccuucuuauuuuccagagugucccacugguccagacaucauuccaauuguagcuggugugguugcuggaauuguucuuauuggccuugcauuacugcugauauggaagcuuuuaaugauaauucaugacagaagggaguuugcuaaauuugaaaaggagaaaaugaaugccaaaugggacacgguaaguuacaaaacauccaaaaagcaaaguggcuuauaaaguaaauguaauacuccuaagacuuauguauuagcugucaggcugauuauuaaaguccuuucuaaguauuuuauucccccaaaaguuucuuacucaaggaauuugcauuuagugaaaaacagaaagcauccuaaauauaucccauugaaacaaaacauugauuauaagcauguauauucugguuacuguggccaguauuuuuauuucuuuaauaguuuugauccuaaaucugccuuuucaucuaaugugaaguagaauccuaaauaauguuaucuguguagcaagcuauucaauggaaagcugcuucuuucuuuaaaacaaacaaacaaaaaaaaccuucagugaaagccagauucaaaagguuauauaccaagcuuguccaacucgcagcucgucggccaggacaugcagcccagaauagcuuugaauguggccccaacacaaauuuguaaacuuucuuagaaauuguaauuauuauuauuauuuuuuuuugguaacuuuuuuuuaaagcucaucagcuaucguuaguguauuuuauguguggcccaagacaauucuucuucuuccaguguggcccagggaagccaaaagauuggacaccccugcuauauacuauaugauuccauuuagaggacauucuggaaaagcaaaacuguaggggcaaaaaucagugguugcuaggggcuggaaugggggaaaguguugaccacagaggggcguaagggaucuuccuugggaugaucuugauuguggguggauuuauguauuugaaaacucacagaacuauguacuuuaaaaagauguauguuccucuaugaaaauuauaucucaguaaacuuuggcuuauaaaaaucuuaaaagcccuaagugaccgaaagguuauguuagcauugagugcuuugaaauauggagucagagggugggguaaccaaauguuggccuuuguguauucaucuuuugauacaagaaagcaaugccaaucuucaguauuuuuaaauuguaaaugaauuuuguaguuaguugcacuuuacuacaauuugcuuggguuuuuaaaaauuaucaauuuuuuaaauuacaaauuucagaaggguagaaauaaaaaaaaagacauuuauaguguucaaacacuauaaagggauuuuuuuuuucugaugaaaucauuagaaacuauuucuuuuacuuuagcaagaaaauccgauuuacaagaguccuauuaauaauuucaagaauccaaacuacggacguaaagcuggucucuaaauugccguucguauuuuguuucacuuucugccuuugcaugugaacuucuaucuuuuuuacugcacuguguguccuuuaucacuauugcuguucuuuuuuuaagucuggcuuuaaauaucgcuauuguggcuuuucuuuuuguauguuaacuucgcguuuagaaagaccguaaaauaaguaaugugauauagaaacagcagccauguuguagugaaaagagaaugugcuuugcaaucaguuagaccucaggucaaaucccaccucuuccacuuaguaaguagaacagcauugagucacuucacuucucucaacugucacagggagucaguacucuguuuuguauggggugguuguauuuggcaaaugcacuccaguauaugaaaucagccugucagcucuaauccucauaacaguccugugccuagaaugauauuauccuauuaucuuuuguucuuuuucuguuuauuuauuuauuuauuuugagacagucucucucugucgcccagccuggagugcaguggugugauaucagcucacugcaaccucugacuuccagauuccagcaauucuccugccucagccucccgaguaccugggauuacaggugccugccaccaugcuaggcuaauuuuuuuguuuuuaguagagaugggguuucaccacauuggcugggcuggccuugaacuccugaccuccagugcucugcccaccucggucucccaaagugcugggauuacaggcgugagccacugugccccaccaguauuauccuuaaauaacaaauuuguuaugaguaaauuuuaggguuggauagugaaaauugaucacgaaauccaaauugcaaaauagaaaaauauaaccuacuaugauauuuguaugguaugcaacuacaauaucauuauugguucucaaaagauuugagaucaauuucuugaauauaacuugaaauuucauuaaaagccagaagaccauauauauguauguauauuauauauauaugugugugugucuguguguguaugugagaaugauucuaauuuucaaauguaaguuuguaacuguucauaucugaauuuucaugaaaugcuuccagcauauucuaauaaaaucaugcaagccccuaaaacucugauaacaaagguuaauugugauuagaacuaaauucuccugacuggugguugagaacucuucuucucuuucccaacugacugacuguaauagggccuggaagauuucugcuuuucucacugccuaccuuauugugcagauaaagaugguauugggaacacuuacauaaaaaucacugugucucaggcaugauucugaccacuuaaucuguguuuaaucuucauagugaaaguuguaggaauguuuuacauaugagaaaacugagacacauaaggguuauguaacuugaccgaguucccacggcugguuagucagagagcugagauuugaacccaggcaguugggcuccagaguccauguucuugucuaugacauuguacuugguagcaguuauguaucuucagaagucccguuaccugguuaggaagagguagaucacucuuuauagagauuuacagcccuuuuacaauuuguuguuacucugucagaguuaacacugcugcuguuggcaaacaucauguuagggaaaucacuuuaauacauggaacccagugcuguuguuguguuuuuugacuauugagagugugcuuacaaacugaucaugaauaagagccuacaguacaggaauguuuaauaguuacaagugauauaggaagugcugauaacauuagaaaucauuaacuugucagauuuuuauuucuaaguagaccguaagauuuuuaaaguuaaauuugauggcagaaaauuauauucaaauucacauaugggcagguugguacauauuuguauuagucugagacaauauauuuuucucguucucacuuaguacuuuacagaaagucauuuuuagaggaaaacugauuagccaaugacauugccaggcuuuuuuuuuuuuuuaauacauauuuuuuucuuuaguuguaggucaaaaauagucaaauguugacaauuucaugugguuauuucucacaagagaaaaaauuucuguccuacugaggugaaauuuucacccuugcuguaccuuucauuguauuuugaaggaaauuaucaguaaauguuauuuaaacuuaauguuuauaauguauauauggcuaaaauguugcuaaaauaagcauuuuauguaauucaggaagcagaaguuugguaaaaauuucucuaugcauuauugaaguccaggcaauuugauggcuacagauuauuuuaagagauguuuuucucaagaaaaaguagaaauuaacaauugaaauaaaugaaugagcaucaagaaauuacaucauggauuguaagaaacuuuucugauauggaccaagguuugccagucaauuaugucauugaaauuuuugaaauaaugggcaggcgcuaauuacuuuggcagaagacuaccauguaggaacauuaagaagaacaugucacauuaucagcuucuaacuguuggaguggguuaaaaaaauggucuguccucaucugcugcuaugcggguuuaaauguggcucccaaaucucccacacuucugcauuauguauuuaauacauuguagagaugguucugcagcuaccacugucagccauuccagagugagcacaaagaugacauuuuacugagcuugagggcuuccuuucauaauauaacccuguucucuugcugcggguuuuuuugggguggggugguguugcacucugaaugauggaaacuaauuugaauuauuuuaguuuaccuucauuuaaaaugaugccuaauacagauagugagcuuaauuuuaccucuaaccuugcauguuaaacuuuuguuugaguggacuuugaaauaauaaauacaaauguuuguguauacgacaagacagauuuuucuccaaagguaaguucuuccauauaaauuacacuuuggacucaucuauauagggcuuuuuuucuuuauuuuuuguuuucuuuuuuuuuuuuguccuucccuuauaauucuugaguauuaaauacuagauuuagcaaauauauuguauuaaagaaauuuaauuagaugcuaauuuauuuucccaacauauuugaaggaauguguagcacuuagccucaaaucagauaggauauaaauguggaguguaauuuauuugcacucuggcuuuuuaagauaguaguugccaaaauccaguuuccugacccccauuuugaaaugucugcucucacagcuguauaauguauuagcuucaguugggacuagagcugagaguuugauguacacaguuuugucauccacauuauaugcuguuugucucugagggauccugaguuuguccauguuucugaaacaaccagucaagguguauuuugaggagaggggagugagggcugagguauguugucugguucugauugguaucacaugagcugcugagcugaaaucacagugguuuauuuggugucuugcaggacccagccuuuauauguuaauguuuuucccucauugguaugggauaccuacaggaugaaguuucagacuucauagcaaggccucuaggacuguucuuccuuugucuccucaccuccaaucauaugcccccuuaauucuuuuuuuuccucuuuuuuuuuuuuuuuuuuuuuugagauggagucuugcucuuucgcccagucuggagugcaguggugcgaucucagcucacuacaaucuccgcuucccggguucaagugauuccccuaucccagcuucaugaguagcugggauuacaggcacccgccaccacacccagcuaauuuuuguauuuuuaguagagacgggguuuuaccguguuggccaggcugaucucaaacuccucaccaaaagugauccacccaccucggccucucaaaguucugggauuacaggcaugagccaccgcgccugcccuccccuaacucuagaaacuucugaacuguauguauuucuacuuaaaugucccauucuuuucccuacaccuugacuuugcauagauugcuauuuaccaaccaauaauuuuucuagucaauuucacaaugaaaaucuccuuaaucuucuuaaaguuaauaacuuuuuucuuauacuauucccagauuauguucauaacucuauuguaaacuucaucagagugccuuauuuucaugucucucacccaccaaacuauaccuuccuugagggcagaaauugugccaccaaaaggcagauccaaauacagucugcaaugaagugugaauaaaauuuaaaaacaaaaauuacuuuuagaucaaaaaauguuuuagaugcuuucuauaaauauuuuuuuaaaaaucaccugcaguugguucuauagugagauauaaaacugaacaacauuccaaaaucuuaauuuuuucuuaaaaaaaauuucccugguaguuaacaaguauuuuuuauuuguacucacuguaauuuucucugauuaaguguuauuuggucacacuucucacuuggcuuucaagccugcuuucaauuuauaagaacaggagaaaaaagaaugcuauagcaaguauuuaaauguagcaguuauaguauaagagaauuuuuaaggaaaagggugauacagugauauguuuuuuucugcuuaaaacaucacugucaguauauuuuuggaucuugaaagaucucuuguguuuauggcuuggggccugcuugcuaggcuugacuucaguacuguuuacuaaauuauagcacugcaauaagacauuucaccaauaugauauugaagcauaacaaguuauuucauaaggaaugguaauuaucuaacauucuaagcaaauuuggcagugugacuugguggggcgcagugcugucccugacacaaugacagccuuacucucuaaauuaguaacuuccguaggagaccccagaagcacaccucccucccagcagugaaagccgaggauucccguuuugauuagcaggcgccuucuguucacgauaaagggauaagaaucaggcagugauggcagcggaguucaugcuucauuaaggcaggcauugcaaacuaguucagaggagagaauccacgaugacagcacauucugugccauggagaacauucuuaaaucaagccuccaguggaggaaggacucaagaaugaaauagcaccagauaacggggcaucauuagacuuguaaagcaaagcuuccauuuucuauuuuuauauaaaccauuauuaaugccuuuaaaacaacugugauaucuggacaaauaaaauagaaaugacuucuuaagaugauugcaacuuuuagucuugauuuauaaaaauuauucuacauaauuuuaguaggguaacugauaauuuuucucacuuuuuuuuuguuguagggugaaaauccuauuuauaagagugccguaacaacuguggucaauccgaaguaugagggaaaaugaguacugcccgugcaaaucccacaacacugaaugcaaaguagcaauuuccauagucacaguuagguagcuuuagggcaauauugccaugguuuuacucaugugcagguuuugaaaauguacaauauguauaauuuuuaaaauguuuuauuauuuugaaaauaauguuguaauucaugccagggacugacaaaagacuugagacaggaugguuacucuugucagcuaaggucacauugugccuuuuugaccuuuucuuccuggacuauugaaaucaagcuuauuggauuaagugauauuucuauagcgauugaaagggcaauaguuaaaguaaugagcaugaugagaguuucuguuaaucauguauuaaaacugauuuuuagcuuuacaaauaugucaguuugcaguuaugcagaauccaaaguaaauguccugcuagcuaguuaaggauuguuuuaaaucuguuauuuugcuauuugccuguuagacaugacugaugacauaucugaaagacaaguauguugagaguugcugguguaaaauacguuugaaauaguugaucuacaaaggccaugggaaaaauucagagaguuaggaaggaaaaaccaauagcuuuaaaaccugugugccauuuuaagaguuacuuaauguuugguaacuuuuaugccuucacuuuacaaauucaagccuuagauaaaagaaccgagcaauuuucugcuaaaaaguccuugauuuagcacuauuuacauacaggccauacuuuacaaaguauuugcugaauggggaccuuuugaguugaauuuauuuuauuauuuuuauuuuguuuaaugucuggugcuuucugucaccucuucuaaucuuuuaauguauuuguuugcaauuuugggguaagacuuuuuuuaugaguacuuuuucuuugaaguuuuagcggucaauuugccuuuuuaaugaacaugugaaguuauacuguggcuaugcaacagcucucaccuacgcgagucuuacuuugaguuagugccauaacagaccacuguauguuuacuucucaccauuugaguugcccaucuuguuucacacuagucacauucuuguuuuaagugccuuuaguuuuaacaguucacuuuuuacagugcuauuuacugaaguuauuuauuaaauaugccuaaaauacuuaaaucggaugucuugacucugauguauuuuaucagguugugugcaugaaauuuuuauagauuaaagaaguugaggaaaagcauuucugguugguggguaguucacuuaugaagcuaaaacauaauucuuuaaaaaaauguacuagggacauaaggagagugguauggugaaauacagacuugaagacuguccuugggcucucugaaucaugguggauagauccuuacuuauccugcuacgcugggagagagguuucaucccaauauuaagcagaauuaacuuuaugaacaucuuagagccauuaguaggugcuggaaauuguaucauuuuauuuaagauauagauaggggauuguuaacuuuucugauaagaaaaauuaggaaaaauuuuacuuuuauuuggcuuugguuucuguuugaaaggauauauccauaaguacuacuuguguaaagcuuauuagaagaaauau

SEQ ID NO: 15869 - RNA, 58476 nt, Homo sapiens
auauuucuucuaauaagcuuuacacaaguaguacuuauggauauauccuuucaaacagaaaccaaagccaaauaaaaguaaaauuuuuccuaauuuuucuuaucagaaaaguuaacaauccccuaucuauaucuuaaauaaaaugauacaauuuccagcaccuacuaauggcucuaagauguucauaaaguuaauucugcuuaauauugggaugaaaccucucucccagcguagcaggauaaguaaggaucuauccaccaugauucagagagcccaaggacagucuucaagucuguauuucaccauaccacucuccuuaugucccuaguacauuuuuuuaaagaauuauguuuuagcuucauaagugaacuacccaccaaccagaaaugcuuuuccucaacuucuuuaaucuauaaaaauuucaugcacacaaccugauaaaauacaucagagucaagacauccgauuuaaguauuuuaggcauauuuaauaaauaacuucaguaaauagcacuguaaaaagugaacuguuaaaacuaaaggcacuuaaaacaagaaugugacuagugugaaacaagaugggcaacucaaauggugagaaguaaacauacaguggucuguuauggcacuaacucaaaguaagacucgcguaggugagagcuguugcauagccacaguauaacuucacauguucauuaaaaaggcaaauugaccgcuaaaacuucaaagaaaaaguacucauaaaaaaagucuuaccccaaaauugcaaacaaauacauuaaaagauuagaagaggugacagaaagcaccagacauuaaacaaaauaaaaauaauaaaauaaauucaacucaaaagguccccauucagcaaauacuuuguaaaguauggccuguauguaaauagugcuaaaucaaggacuuuuuagcagaaaauugcucgguucuuuuaucuaaggcuugaauuuguaaagugaaggcauaaaaguuaccaaacauuaaguaacucuuaaaauggcacacagguuuuaaagcuauugguuuuuccuuccuaacucucugaauuuuucccauggccuuuguagaucaacuauuucaaacguauuuuacaccagcaacucucaacauacuugucuuucagauaugucaucagucaugucuaacaggcaaauagcaaaauaacagauuuaaaacaauccuuaacuagcuagcaggacauuuacuuuggauucugcauaacugcaaacugacauauuuguaaagcuaaaaaucaguuuuaauacaugauuaacagaaacucucaucaugcucauuacuuuaacuauugcccuuucaaucgcuauagaaauaucacuuaauccaauaagcuugauuucaauaguccaggaagaaaaggucaaaaaggcacaaugugaccuuagcugacaagaguaaccauccugucucaagucuuuugucagucccuggcaugaauuacaacauuauuuucaaaauaauaaaacauuuuaaaaauuauacauauuguacauuuucaaaaccugcacaugaguaaaaccauggcaauauugcccuaaagcuaccuaacugugacuauggaaauugcuacuuugcauucaguguugugggauuugcacgggcaguacucauuuucccucauacuucggauugaccacaguuguuacggcacucuuauaaauaggauuuucacccuacaacaaaaaaaaagugagaaaaauuaucaguuacccuacuaaaauuauguagaauaauuuuuauaaaucaagacuaaaaguugcaaucaucuuaagaagucauuucuauuuuauuuguccagauaucacaguuguuuuaaaggcauuaauaaugguuuauauaaaaauagaaaauggaagcuuugcuuuacaagucuaaugaugccccguuaucuggugcuauuucauucuugaguccuuccuccacuggaggcuugauuuaagaauguucuccauggcacagaaugugcugucaucguggauucucuccucugaacuaguuugcaaugccugccuuaaugaagcaugaacuccgcugccaucacugccugauucuuaucccuuuaucgugaacagaaggcgccugcuaaucaaaacgggaauccucggcuuucacugcugggagggaggugugcuucuggggucuccuacggaaguuacuaauuuagagaguaaggcugucauugugucagggacagcacugcgccccaccaagucacacugccaaauuugcuuagaauguuagauaauuaccauuccuuaugaaauaacuuguuaugcuucaauaucauauuggugaaaugucuuauugcagugcuauaauuuaguaaacaguacugaagucaagccuagcaagcaggccccaagccauaaacacaagagaucuuucaagauccaaaaauauacugacagugauguuuuaagcagaaaaaaacauaucacuguaucacccuuuuccuuaaaaauucucuuauacuauaacugcuacauuuaaauacuugcuauagcauucuuuuuucuccuguucuuauaaauugaaagcaggcuugaaagccaagugagaagugugaccaaauaacacuuaaucagagaaaauuacagugaguacaaauaaaaaauacuuguuaacuaccagggaaauuuuuuuuaagaaaaaauuaagauuuuggaauguuguucaguuuuauaucucacuauagaaccaacugcaggugauuuuuaaaaaaauauuuauagaaagcaucuaaaacauuuuuugaucuaaaaguaauuuuuguuuuuaaauuuuauucacacuucauugcagacuguauuuggaucugccuuuugguggcacaauuucugcccucaaggaagguauaguuuggugggugagagacaugaaaauaaggcacucugaugaaguuuacaauagaguuaugaacauaaucugggaauaguauaagaaaaaaguuauuaacuuuaagaagauuaaggagauuuucauugugaaauugacuagaaaaauuauugguugguaaauagcaaucuaugcaaagucaagguguagggaaaagaaugggacauuuaaguagaaauacauacaguucagaaguuucuagaguuaggggagggcaggcgcgguggcucaugccuguaaucccagaacuuugagaggccgagguggguggaucacuuuuggugaggaguuugagaucagccuggccaacacgguaaaaccccgucucuacuaaaaauacaaaaauuagcugggugugguggcgggugccuguaaucccagcuacucaugaagcugggauaggggaaucacuugaacccgggaagcggagauuguagugagcugagaucgcaccacugcacuccagacugggcgaaagagcaagacuccaucucaaaaaaaaaaaaaaaaaaaaaagaggaaaaaaaagaauuaagggggcauaugauuggaggugaggagacaaaggaagaacaguccuagaggccuugcuaugaagucugaaacuucauccuguagguaucccauaccaaugagggaaaaacauuaacauauaaaggcuggguccugcaagacaccaaauaaaccacugugauuucagcucagcagcucaugugauaccaaucagaaccagacaacauaccucagcccucacuccccucuccucaaaauacaccuugacugguuguuucagaaacauggacaaacucaggaucccucagagacaaacagcauauaauguggaugacaaaacuguguacaucaaacucucagcucuagucccaacugaagcuaauacauuauacagcugugagagcagacauuucaaaaugggggucaggaaacuggauuuuggcaacuacuaucuuaaaaagccagagugcaaauaaauuacacuccacauuuauauccuaucugauuugaggcuaagugcuacacauuccuucaaauauguugggaaaauaaauuagcaucuaauuaaauuucuuuaauacaauauauuugcuaaaucuaguauuuaauacucaagaauuauaagggaaggacaaaaaaaaaaaagaaaacaaaaaauaaagaaaaaaagcccuauauagaugaguccaaaguguaauuuauauggaagaacuuaccuuuggagaaaaaucugucuugucguauacacaaacauuuguauuuauuauuucaaaguccacucaaacaaaaguuuaacaugcaagguuagagguaaaauuaagcucacuaucuguauuaggcaucauuuuaaaugaagguaaacuaaaauaauucaaauuaguuuccaucauucagagugcaacaccaccccaccccaaaaaaacccgcagcaagagaacaggguuauauuaugaaaggaagcccucaagcucaguaaaaugucaucuuugugcucacucuggaauggcugacagugguagcugcagaaccaucucuacaauguauuaaauacauaaugcagaagugugggagauuugggagccacauuuaaacccgcauagcagcagaugaggacagaccauuuuuuuaacccacuccaacaguuagaagcugauaaugugacauguucuucuuaauguuccuacaugguagucuucugccaaaguaauuagcgccugcccauuauuucaaaaauuucaaugacauaauugacuggcaaaccuugguccauaucagaaaaguuucuuacaauccaugauguaauuucuugaugcucauucauuuauuucaauuguuaauuucuacuuuuucuugagaaaaacaucucuuaaaauaaucuguagccaucaaauugccuggacuucaauaaugcauagagaaauuuuuaccaaacuucugcuuccugaauuacauaaaaugcuuauuuuagcaacauuuuagccauauauacauuauaaacauuaaguuuaaauaacauuuacugauaauuuccuucaaaauacaaugaaagguacagcaagggugaaaauuucaccucaguaggacagaaauuuuuucucuugugagaaauaaccacaugaaauugucaacauuugacuauuuuugaccuacaacuaaagaaaaaaauauguauuaaaaaaaaaaaaaagccuggcaaugucauuggcuaaucaguuuuccucuaaaaaugacuuucuguaaaguacuaagugagaacgagaaaaauauauugucucagacuaauacaaauauguaccaaccugcccauaugugaauuugaauauaauuuucugccaucaaauuuaacuuuaaaaaucuuacggucuacuuagaaauaaaaaucugacaaguuaaugauuucuaauguuaucagcacuuccuauaucacuuguaacuauuaaacauuccuguacuguaggcucuuauucaugaucaguuuguaagcacacucucaauagucaaaaaacacaacaacagcacuggguuccauguauuaaagugauuucccuaacaugauguuugccaacagcagcaguguuaacucugacagaguaacaacaaauuguaaaagggcuguaaaucucuauaaagagugaucuaccucuuccuaaccagguaacgggacuucugaagauacauaacugcuaccaaguacaaugucauagacaagaacauggacucuggagcccaacugccuggguucaaaucucagcucucugacuaaccagccgugggaacucggucaaguuacauaacccuuaugugucucaguuuucucauauguaaaacauuccuacaacuuucacuaugaagauuaaacacagauuaaguggucagaaucaugccugagacacagugauuuuuauguaaguguucccaauaccaucuuuaucugcacaauaagguaggcagugagaaaagcagaaaucuuccaggcccuauuacagucagucaguugggaaagagaagaagaguucucaaccaccagucaggagaauuuaguucuaaucacaauuaaccuuuguuaucagaguuuuaggggcuugcaugauuuuauuagaauaugcuggaagcauuucaugaaaauucagauaugaacaguuacaaacuuacauuugaaaauuagaaucauucucacauacacacacagacacacacacauauauauauaauauacauacauauauauggucuucuggcuuuuaaugaaauuucaaguuauauucaagaaauugaucucaaaucuuuugagaaccaauaaugauauuguaguugcauaccauacaaauaucauaguagguuauauuuuucuauuuugcaauuuggauuucgugaucaauuuucacuauccaacccuaaaauuuacucauaacaaauuuguuauuuaaggauaauacugguggggcacaguggcucacgccuguaaucccagcacuuugggagaccgaggugggcagagcacuggaggucaggaguucaaggccagcccagccaauguggugaaaccccaucucuacuaaaaacaaaaaaauuagccuagcaugguggcaggcaccuguaaucccagguacucgggaggcugaggcaggagaauugcuggaaucuggaagucagagguugcagugagcugauaucacaccacugcacuccaggcugggcgacagagagagacugucucaaaauaaauaaauaaauaaacagaaaaagaacaaaagauaauaggauaauaucauucuaggcacaggacuguuaugaggauuagagcugacaggcugauuucauauacuggagugcauuugccaaauacaaccaccccauacaaaacagaguacugacucccugugacaguugagagaagugaagugacucaaugcuguucuacuuacuaaguggaagaggugggauuugaccugaggucuaacugauugcaaagcacauucucuuuucacuacaacauggcugcuguuucuauaucacauuacuuauuuuacggucuuucuaaacgcgaaguuaacauacaaaaagaaaagccacaauagcgauauuuaaagccagacuuaaaaaaagaacagcaauagugauaaaggacacacagugcaguaaaaaagauagaaguucacaugcaaaggcagaaagugaaacaaaauacgaacggcaauuuagagaccagcuuuacguccguaguuuggauucuugaaauuauuaauaggacucuuguaaaucggauuuucuugcuaaaguaaaagaaauaguuucuaaugauuucaucagaaaaaaaaaaucccuuuauaguguuugaacacuauaaaugucuuuuuuuuuauuucuacccuucugaaauuuguaauuuaaaaaauugauaauuuuuaaaaacccaagcaaauuguaguaaagugcaacuaacuacaaaauucauuuacaauuuaaaaauacugaagauuggcauugcuuucuuguaucaaaagaugaauacacaaaggccaacauuugguuaccccacccucugacuccauauuucaaagcacucaaugcuaacauaaccuuucggucacuuagggcuuuuaagauuuuuauaagccaaaguuuacugagauauaauuuucauagaggaacauacaucuuuuuaaaguacauaguucugugaguuuucaaauacauaaauccacccacaaucaagaucaucccaaggaagaucccuuacgccccucuguggucaacacuuucccccauuccagccccuagcaaccacugauuuuugccccuacaguuuugcuuuuccagaauguccucuaaauggaaucauauaguauauagcagggguguccaaucuuuuggcuucccugggccacacuggaagaagaagaauugucuugggccacacauaaaauacacuaacgauagcugaugagcuuuaaaaaaaaguuaccaaaaaaaaauaauaauaauaauuacaauuucuaagaaaguuuacaaauuuguguuggggccacauucaaagcuauucugggcugcauguccuggccgacgagcugcgaguuggacaagcuugguauauaaccuuuugaaucuggcuuucacugaagguuuuuuuuguuuguuuguuuuaaagaaagaagcagcuuuccauugaauagcuugcuacacagauaacauuauuuaggauucuacuucacauuagaugaaaaggcagauuuaggaucaaaacuauuaaagaaauaaaaauacuggccacaguaaccagaauauacaugcuuauaaucaauguuuuguuucaaugggauauauuuaggaugcuuucuguuuuucacuaaaugcaaauuccuugaguaagaaacuuuugggggaauaaaauacuuagaaaggacuuuaauaaucagccugacagcuaauacauaagucuuaggaguauuacauuuacuuuauaagccacuuugcuuuuuggauguuuuguaacuuaccgugucccauuuggcauucauuuucuccuuuucaaauuuagcaaacucccuucugucaugaauuaucauuaaaagcuuccauaucagcaguaaugcaaggccaauaagaacaauuccagcaaccacaccagcuacaauuggaaugaugucuggaccagugggacacucuggaaaauaagaagguaauaaugagcaccacaaagagcugugcagugucuuauaaaaaacauacaggaauaaacacccaagagagugaacgcacacuaucccaaagaaucuauaaaauagcucuuagaacuaacaagugaguuuacaagguugcaggauacaugaucaaugaacaaaaaucauguauuuuucuauauauauaauuuauuucuacauauugaaaauauaaguuuuuaaacaguaauauuuacuacagaaugaaaaagcaugaaaaacuuacauauaagucuaacaaaauauaugcaagauuugcauguuaagaauuacuaaauacugauaaaaagaaaucuuucagacugaauaaauggagagauauuccaugugcaggaguuacaaaaccuaauaccguuaagacgucaauucuucccaauuugaucuauaaacucaaugguaucccacucaaacuccuggcagaacuucuguagcaaucaguaagccacuucuaaaauuuacauggaaggcagggaacuaaggaagugucucaaaaacacuuuuguaaaagaauaaaguuggaagacccugcuuucaggccuagcuauaaagaaagcuacaagaccaugugguauagcuaacacucagauacauggaacagaauacagagucagaaacaggccuacacauguaaggucaccugauguucaacaaagguggagaaaagacagucuuuuuucaacaaaugccccuagaacaaguggacacugacaugaaaaaaacugagccuuuugucacacacuaacucaaaaugaguuacagaucuaaaugugaaaccccagaaacuauaaaacuucuaccaaaaaacagaggagaaaaauccuuauaaucuuggguuaggcagaguucuuaaagacaauguaaaagcaagagccacagaagaaaaacuugguaaacuguacuuaaucaaaauuaaaaccugugguguucagaagacacuuaaaaaaaugaaaugauaaggagacacaggcugggagacaauauuugcaaaacaccuagcugauaauucaaaacaguaugggagucuaagagucuggcagcuucuuaacaaaguuaaacauaugcuuaccauaugcuccaaaaugccauuuuuaguauuuacccaagagaaaugaaagcuuauguucacacaaaaacauguacacuaugguagaaaauuccaaagaaucuacaaaaaggcuacuaggaaaacuaagauuaaaaaaaaaaaguuucaccuccggagaaguugaacaaauucaacacuuuauauuaauauccuuuaacaaauuaucuuucccaguauucaagcuuaaaucaagcucuaauuuuaaaaucaucaaucaucaaaaaacucuuaauaugcacuuggugucaggcaucguucuaagugucuuauauaaaucacuaagcgucuuauauaaaucacuguauuuaaucuucaaacucuccacucagaaaacuuaaaaguggaacucucuuuuccuuauuucuuauacaguuaauuagauaauauuuuaagcuuugagagaugaaaaauuucccaacuugaccuaaaauauuccagcuggaggcuguuucuggauguuaggccuaaauaagcagaaacaagacauacaagauaugaaaagaaugucugcaaucaucgcauuucuaccuggauucuccacaacaugaaccaugaccucguuguucccauucacugaauacguaaaauagaaccaacagucgucaacauccuucuccuuacaaugggacacaggaucagguuggaccggcugggguaauuugucccgacuuucuaccuugguaauguuaaaauaggaacauuccugugugcaugugucuuucuuuucuccuuuauugaaggcucugcacugaacacauucucuguuacaaaaaacacaaauuaugauauuuacauuuuauuauuucaguaaauauuugcuuaaacauauuucccaugcuaaacucuugugaccaaauugaacaaacagcuaugaaggaagauuucaauaaaugaagaggaacauuacauuuguggauagaaaaauuauguaaaaagaugcuaauuuccauaauaaaauuaaagauuuauuacaguucaaauuaaaacccuauuaagaaauaaaagauaguaaaauaaauuagcccuaucacauauuaaauauguaacauaaaaucauaauaauuuuuuuuuugcgauggagucuuguucugucauccaggcagugcaguggugugaccuuggcucacuguaaccucugccucucggguucaagcaagccucaaccucccaaguaguugagauuacaggcacacaccaccauaucuggcuaauuuuuguauuuuuaguagagaugggguuucaccacauuggccagacuggucucaaacuccugaccuuaagugauccaccugucucggccuuccaaagugcugggauuacaggugugagccacugugcucggccaaaaucauaauaauuuaaauaauauguuacuaguauaauaauccuucaagaggaaaaaucuuuaauuuggcuuaguuuugucaaaagacaguaauuaagaaauugguaaugacaaauuaaauuaaauuaaaucuuaauugccaaaauaaagguuaccauguaaauucaauuaucuagcacauucagaucaaaauaauaguacaacucucacaugacacacuucauaccauguaauauauacuagcuguugagaaagaacuuuuaagaauuaaagaguaggcuuccacauggcaggcauuuuauuuacaguauauuuuaauauuggcacuguucugguucuagaaacaauacaggcuuaggagagccaagaggaaguaucaacuauuucaagcaauuaggaaauacuuacuuaugcucagcacagacaccaaggcaggucugacacaucucacacguuugcccuugaaacuucggaucuguacacuuacagacaccacacucgcagaugccccggccauugcagaucuguccguugcuggcuucacaaguacuaguauccaaagaacagucacaugcacugccaguguaguugggguugcacucacacacacgacacuugcaaacaccauuuccugcaauuaagcauaucauuucucaaaaugguaaaaauauacaaucacaguauugacugaaaaguaaaauaagcaacaacaugugagaaaguauaccuaggggcgagacugacccucaagcuaccccuuuucuacuuaugcaccaacuaaacucaagauuuuucguggcauuagaugggaucacaucuuacaaccacuucaggcccuuuacuuaccuccacaaauuaagccauuggaucuaucacaguugaaauuaucacacucgcagaauuugccagaauaaauuucauuuguauuaucccucuuccuacaaacacacuguccgcagacgcacucuccauuguuacugcagauuucugaacuguuuucuuuccugcaguaagcauccaugucuucacuguuaacuucaucugugcugcauucacaaugucuaccaacacgcccuucauugcaccugaagaaacaugccaaaauugcaaucacacaaaacaaaaauaauuuaagagguuccaagauggccaaacaggaacagcucuagucuacagcucccagcgugagcgacacagaagacaggugguuucugcauuuccaacugagguacuggguucaucucacuggggcuugcuggacaguaggugcagcccauggagugugagccgaagcagggcggggcaucgccucacccgggaagcacaaggggucaaggaauucccuuuccuagccaagggaagcugugacagacgguaccuggaaaaucaggacacucccacacuaauacugcgcuuuuccaaugcucuuagaaaacggaacaccagaagauuauaucccgcgccuggcucagagggucccaugcccagcucagagggucccacacccauggagccucgcucacugcuagcacagcagucugagauugaacugcaaggcagcagggaggccgagggagggguaucccccauugcugaggcuugaguagguaaacaaagcaaaaaaaagcuaaaacugggugaagcccauugcagcucaaggaggccugccugccucuguagacaacaccucugggggcagggcauagcugaacaaaauccagcagaaacuucugcagacuuaaacauccgugucugacagcuuugaagagaguagugguucucccagcacggagucugacaucugagaauggacagacugccuccucaagugggucccugagcccgaguagccuaacugggagacaccuccuaguaggggcugacugacaccucauacagcccggugccccucugagacgaagcuuccagaggaaggaucaggcagcaacauuugccauucugcaauauuugcuguucugcagccuccgcuggugauacucaggcaaacagggucuggaguggaccuccagcaaacucccaacagaccugcagcugaggguccugacuguuagaaggaaaacuaacaaacagaaaggacauccacaccaaaaccccaucuguacaucaccaucauggaagaccaaagguagauaaaaccacaaagauggggagaaaccagagcagaaaagcugaaaauucuaaaauuugagcaccucuucuccuccaaagaaaugcaccuccucaccagcaacggaacaaagccggacggagaaugacuuugacaaguugagagaagaaggcuucagauaaucgguaauaacaaacuuguccgagcuaaaggaggauauucaaacccaucgcaaagaagcuaaaaaccuugaaaaaagacuagacgaauggcuaauuagaauaaagagcguagagaagaccuuaaaugaccugauggagcggaaaaccauggcaugagaaccaugugaugcaugcacaagcuucaguagccgauucgauccaguggaagaaaggauaucagugauugaagaucaaaugaaugaaaugaagugagaaguuuagagaaaaaaaagaguaaaaagaaacgaacaaagccuccaagaaauaugggacuaugugaaaagaccaaaucgaugucugauugguguaccagaaagugacagggagaauggaaccaaguuggaaaacauuuuucaggauauuauccaggagaacuuccccaaccuagcaaggcaggccaacauucaaauucaggaaauacagagaaagccacaaagauacuccuugagaagagcaacuccaagacacaugauugucagauucaccaaaguugaaaugaaggaaaaaauguuaagggcagccagagagaaagguuggguuacccacaaagggaagcccaucagacuagcagcagaucucucggcagaaacucuacaagccagaagagagugggggccaauauuuaacauucuuaaagaaaagaauuuucaacccagaauuucauauuaagccaaacuaagcuuuaagugaaagagaaauaaaauccuuuacagacaagcaaaugcugagagauugugucaccaccaggccugccuuacaagagcuccugaaggaagcacuaaacauggaaaggaacaacugguaccagccacugcaaaaacaugccaaauuguaaagaccaucgaugcuaggaagaaacugcaucagcuaaugagcaaaauaaccagcuaacaucauaaugacaggaucaaauucacacauaacaauauuaaccuuaaauguaaaugggcaaaaugcuccaauuaaaagacacagacuggcaaauuggauaaagagucaagacccaucagugugcuguauucaggagacccaucucacgugcagagacaaacacaggcucaaaauaaagggaugaaggaagaucuaccaagcaaauggaaaacaaaaaaaggcagugguugcaaaccuagucucugaaaaaacagacuuuaaaccaacaaagaucaaaagggacaaagaacgccauuacauaaugguaaagggaucaauucaacaggaagagcugacuauccuaaauauauaugcacccaaugcaggagcacccagauucauaaagcagguccugagagaccuagaaagagacuuagacucccacacaauaauaaugggagacuuuaacaccacauugucaacauuagacagaccaacgagacagaaaguuaacaaggauauccaggaacugaacucagcucugcaccaaguggaccuaauagacaucuacagaacucuccaucccaaaacaacagaauauacauucuucucagccccacaccgcacuuauugcaaaacugacuacauaauuggaagcaaagcacuccucagcaaauguaaaauaacagaaauuauaacaaacugucucucagaccacagugcaaucaagcuagaacucaagauuaagaaacucacucaaaacugcucaacugcauggaaacuaaaugaccugcuccugaaugacuacuggauacauaacaaaaugaaggcagaaauaaagauguucuuugaaaccagugagaacaaagacacaacauaccagaaucucugggacacauuuaaagcaguguguagagggaaauuuauagcacuaaaugcccacaagagaaagcaggaaagaucuaaaauggacacccuaacaucacaauuaaaagaacuagagaagcaagagcaaacacauucaaaagcuagcagaaggcaagaaauaacuaagaucagagcagaacugaaggagauagagacauaaaaagcccuucaaaaaaucaaugaauccaggagcugguuuuuugaaaugaucaacaaaauugacagaccgcuagcaagacuaauaaagaagaaaagagaagaaucaaauagaugcaauaaaaaaugauaaaggggauaucaccaccgauccaacagaaauacaaacuaccaucagagaauacuauaaacaccacuaugcaaauuaacuggaaaaucuagaagaaauggauaaauuccuggacaaauacacccucccaagacuaaaccaggaagaaguugaaucacugaauagaccaauaacaggcucucaaauggaggcaauaauuaauagccuaccaaccaaaaaaaguccaagaccagacggauucacagccgaauucuaccagagguacaaacagaagcugguaccauuccuucugaaacuauuccaaucaauagaaaaagagggaauccucccuaacucacguuaugaggccagcaucauccugauaccaaagccuggcagagacacaacaaagaaagagaauuuuagaccaauaucccugaugaacaucgaugcaaaaauccucaguaaaauacuggcaaaccaaauccagcagcacaucaaaaagcuuauccaccacaaucaaguuggcuucaucccugggcaagacugguucaacacaggcaaucaauaaacguaauccaucauauaaacagaaccuaagacaaaaaacacaugauuaucucaauaaaugcagaaaagguguucgacaaaauucaacagcccuucaugcuaaaaacucucaauaaacuagguauugaugggaugugucucaaaauaauaagagcuauuuaugaucaacccacagccaauaucauacugaaugggcaaaaacuggaagcauucccuuugaaaacuggcacaagacagggaugcccucucucaccacuccuauucaacacaguguuggaaguucuggccagggcaaucaggcaggagaaagaaauaacacauaacaauauucccacaaagggaagcccaucaguuaauuaggaaaagaggaaaucaaauugucccuguuugcagaugacaugauuguauauuuagaaaaccccaucgucucagcccaaaaucuccuuaagcugauaagcaacuucagcaaagucucaggauacaaaaaucaaugugcaaaaaucacaggcauuccuguacaccaauaacagacaaacagagagccaaauuaugggugaacucccauucauaacugcuucaaagagaauaaaauaccuaggaauacaaccuacaagggaugugaaggaccucuucaagaagaacuacaaaccacugcucaacgaaauaaaagaggacucaaacaaauggaagaacauuccaugcucauggauaggaagaaucaauaucgugaaaauggccauacugcccaagguaauuuagagauucaaugccauccccaucaagcuaccaaugacuuucuucauagaauuggaaaaaacuacuuuaaaguucauauggaaccaaaaaagagccugcauugccaagacaauccuaagccaaaagaacaaagcuggaggcaucacgcuaccugacuucaaacuauacuacaaggcuacaguaaccaaaacagcaugguacugguaccaaaacagagauauagaccuauggaacagaacagagcccucagaaauaauaccacacaucuacaaccaucugaucuuugacaaaccugacaaaaacaagaaauggggaaaggauucccuauuuaauaaauggugcugggaaaacuggcuagccauauggagaaagcugaaacuggaucccuuccuuacaccuuauacaaaaauuaauucaagauggauuaaagacuuagaugucagaccuaaaaccauaaaaaccucagaagaaaaucuaggcaauaccauucaggacauaggcauaggcaaggacuucaugacuaaaacaccaaaagcaauggcaacaaaagccaaaauugacaaaugggaucuaauuaaacuaaagagcuucugcacagcaaaagaaacugccaucagagugaacaggcaaccuacagaaugggacacaauuuuuacaaucuacccaucugacaaagggcuaauauccagaaucuacaaagaacuccaacaaauuuacaagaaaaaaucaaacaaccccaccaaaaagugggagaaggauaugaacagacacuucucaaaaggagacauuuaugcagccaacagacacaugaaaaaaugcucaucaucacuggccaucagagaaaugcaaaucaaaaccacaaugagauaccaucucacaccaguuagaauggcgaucauuaaaaagucaggaaaacaacaggugcuggagaggauguggagaaauagguacacuuuuacacugcuggugggacuguaaacuaguucaaccauuguggaagacaguguagcgauuccucaaggaucuaggacuagaaauaccauuugacccagccaucccauuacuggguauauacccaaagaauuauaaaucaugcugcuauaaagacacgugcacacguauguuuacugcggcacuauucacaauagcaaagacuuggaaccaacccaaauguccaucaaugauagacuggauuaagaaaauguggcacauauacaacauggaauacuaugcagccauaaaaaaugaugaguucacguccuuuguagggacauggaugaagcuggaaaccaucauucugagaaaacuaucgcaaggacagaaaaccaaacacugcaccuucucacucauaggugggaacugaacaaugagaacacuuggacacaggguggggaacaucacacacuggggccugucauaagguggggguagggggcagggauagcauuaggagauauaccuaauguaaaugacgaguuaaugggugcagcacaccaacaugucacauguauacauauggaacaaaccugcacguuuugcacauguacccuagaaauuaaaguauaauaaaaaagaagaagaaucaucuuggagggaauaauaauaauaauaauuuaaaagggaaaaacugggaaagaaaauaaaacuauaaaaaaucucuucaagcuccuaaucuguuaggugggaguguccaugccacaagucacagucguguaguaaaguguacacacaugugcaagcagggacaaacauacacaggcgcacauguacauuccagccacucaaguucauauggaauauaugcaagagucuaggaaaaaaauuucuucaggaaaguaaccauuuuggucaagacaaaaauguaaucuagcaaugaauagugaaugacacauguggaaaggcagaauaaacuuaauuuuaaagagcacguuaguuacauuuucaaaugguaugcuauuacauuuacuauuccaggugaacugucuaaauuuaaagcaauggucuguuaaccuaaaaaaauacaauaaacacaugcaaaaaaguguauggaaguugaaaaaaaacauacuguguauaccacuuaaaauauaacuaguauacuauuuaaaaauaaauauauccuacaugugcagacuuuucagguucccuguguauuuuuagaacacauaaugcucauggacacugacugcacugauucuguaucugguaaaaauauaaaggaaagaaaggcaaaguauuuucaagauaaucuuuuugguuaaaugacauuuuacuaaaaauggaccugcaugauuaaaacaggauauguacaacauggaagauaaagaaacucuaacauuuaaauuguuacuuagcacagacaauuaaaaauugauagugagcuaaagccauauauuucuuucauagucaauagccuucuaagccuagucuuuuggggcugacacuggauuaaacacucuucccucuuccuauucuuuuacagagaaagcgguauucaauguauacucaguuuuucauuuucaauuacaaaaaguaaccacagugugaaaauaaaaucugaaguaauuuuguuaguuuucuuaguacuagauucuacauacugaaaauaccauuuucucuuuuguauuuuacaacacauauuuauuuuuuaaaaauuauuccaacaaugcagaaguacauguaguacaagacaaacaucuucuacugcuucauaauuccauuucccagacgaaaucgccaucaucgguuugauguuuuuccaaaacauuuuccuauaaacguuauuuuacacaagcuuauuuuguucuagaaaauugauugcucucacaugagagaaacgcuaccuuaacaauuuguugaauauacuucuuucauggcuauaaaaucuuuuauuuuaaagaguaaucacuuuaagaaaaaaaggcaggaaggaacuuucuauaaauaucacacacaagaucaucaaacugaucuuguggugagcaaccgugguuggaaaaaauaauuugcuccaaauagagagauauucucuggaugucccaaaauaugaccugccuauacucucuaaaccaauguagcucugucacugucugacaacacccagcuuaccugcacgcgccacacucaaaugucccauuuccuucaugacacuugggacuuucagggaugccuucgcuuuggcauucacauucacagauguacugaagaauaaccucuacuuccuccguaaagcccagaggccuaauuuuaaagcugucagaauccuuuuuuggacacuuauuugaaguuaugcuaauuucaaauugaaccuugaagggaaaaaaaagauuaacaaccaacuaaacaauuuaaaucuacuaaaaaauauuucaaaaaguugcucacuuauuuuaauguuucucaaacuauaaacuaaauuugcuuauaaauaaccaauguuuucuacagaaaaugcuuuauacaacauaccucaucuccaauggaaauauuggaacauuuucuuccauuuuccccuguuccauucaccccguucuugcaguaagauuuguaacuuauuguuacgccuucugacaauuugccguuuuccaaaaugacuucugaggaaagggacuaaaagaaugccuaauuauacacaggaaaagucaaacaaaaugcuacuugaaugcauaaaaccaauggauaaacugcucagaaaaaaauauauuucaauaaaguaucuacaagccaaauccaauugaguaacuagaaaacacagaggccagagaaacagguuuuaauuaauaaggaucaaaucuuuaaaauaaaauacacaauugaaaagaguauuccuguuuuaaucacugaguuaaaauacucaggaucacacagugcagagggcuguuacuaauuaggaggagucuuaaaaauguggaauaggccgggugugguagcucacaccuguaaucccagcacuuugggaggccaagguagguggacugccugagcucaggaguuggagaccagccuggccaacacagugaaaccccaucuccgcuaaaauacaaaaaaaaaaaaaaauuuauccaagcauggcagugugcaccuguaaucccagcuacucgggaggcugagacagaagaaucgccugaacccgggaggcagggguugcagugagccaagaucacaccacugcacuccagccugagcaacagagugcgacuccaucuaaaaaacaaaaacaaaaacaaaaacagaaaccccccaaaaaaaaacgaaauaaaugcugucuuccccaucggcaaaauggcauuucuguaguccuaccucuccagcuaacuauggacuaggguaaacaaucaacuaugcagucuaggaacaaauuugcuuaaggaaccauuguagcccagccaaaaaaaaaaaaaaacaaaaucccccaagaaggaaggauucaagccagggcuuguuuaacauaugagacuauucaggacaaauggagaaggguacaauggcaagcuaucucuuguucacaccccugaaagaacaagaguuaggaaaauuaucuaagacaggggagaaugggaaaagcuguggaacaaguaaaauauuaaaaaccuuuauaaaaaccccuccaagucaggccuuuccaaaccauuaugguaccccauaaaaaagggaagccucauaugguaggcuggccuuuccaaagcguuaugguacccccaugacaugaaguaaaaaugucuaaaauucaagcugccaaaggguuagggggaugggggcugaaaguggugcacgagacacacaaggguuaccuaccaaauuacaaccgccuucagauuauuuaaaugauuauuaaugaaggcuaacucggugugauuaaaguacacugaauuaugcucaaaaaggauaagccaauuccucuuuaauuucaauucaacuuccucccaucugugaggggaaaacaacacuauaaaucuuuuugaaauaggcaaaucacauguauauuuacauuuuuauauauuuuaugguauacguauauaugaguguguaccuccugaaauagaaacccauauccucugaauauaugggaagagaagaauuggcaaaaaaaaaaacuuuucuagcacaauucaucagaauagaugacucuauaaaggauauuuuggggaggaaaaagauuggagaaauccuguaaguuuaaauguaaguuauguuuuacaauugcuuucuaacaaggagaucuauuccuuaaugauaaacaaacaguuauuuggaaauacuccccacaugccuuuaucacauuuucacuuuguuuaggccaugaaucuugcuuuuguaagacaauauguauaaaguuuuuccucuagauacauacagaauuuaaguuuuucuguaguacuuugggcucgcuaaaguguguaugaaggaaguuuuacuuucuuuguacaaaguauucucaacaggguauuguccaaaacugaucuuauuuaagauguacucacauuguaugcaucaaugaucaacugaauuacauugcuagaauuugcagauaauguuccuacugcugacuuagggaucaaguuuuucagcuccugcaauuaaaagauaaaacacguaaaauacaacugcuauucauucaaccaauuaggauccacugagcaacuuuuaucuuuaaaugccaguucccauguuuccuccuaacuaacuuuaggagucaaaccuagaaaccaguuuuauaauaugugauuaaaaauuaauauaaaccacuuuuguaaaauucgguuugccuaucugguggcauuuucccacauuucaauucagacaugauuugccucuaacaaucaaaaauguuuagaaucuuguucuuuuuaucucacacauuuaccuuguaaacaggcugaaauucuucaguaacugcaaaaauugucugaauauuauuuucacucaguuucuggacaaggugagcaauagaaggauaauccuaagaaaucaaguaauauaauuuaguauuuaaauacacccuuauaaucucuucuaauuuuucaaucuaguuauacaugcaagauuacacauaacucgauuacaagacugcuuuagauaacuagauuacauauauaauccauauauagcuagauuacaucuaguugcauacauauaacuagauuacaagacugcuuucaaauaacaguaucaaauauaaacugcugaagugagucguguguauacaugaauugcuaauccucuucucuuuacuuucauguaugaauaaaaaauuccauauucaaaagguuuuaaauaguaaguuuaucuauguauauuaaauauaaggacaaugaaauuaaagaauagucaguaauuaaauauucuauuaucuacaacuuaagaaaaagaccaagauuuaccauuuggauuucuucuagaacuugaaugcuuugccaauauuuauuuucaauaaaggcagagugacugcuuuuaaaaaucguauaaaacaaagaguaugagacuagauaaauuauuuauuuagaaagaguacugacugugcuaccaaaugcugugggcggggaguugaggcaaagagugaaaguggcaucugggcaucccuuucccaccccagugaggcccuugucugagcagaaggaagcaaauacaaagcugcaucuucacaaacagcaacacuagcuuuccugcacuuucaaucaggaccccuacuuaccaaaacagcaaaaccucaaacccugagaaaccccaagccagucacccacaagcucuuaguauuaaacauuaaaauccaacauaaacacauucacuauguaaggaaccaggcacuuacauaauaauggcucauuguguacauauuauuuuccaggugacauuguccaucauuugguaaaacaaugccaccaaguuucccaucuccagcaaagugaaacccggcaucuguggaaaacaccagcagccguguaacauuccuccagccaaucagugacuugaaaagaaaaggauuucaauuuuaaaacacuauucacaguaauucaacaaaaauccuuuaauuuucauauaggccaccauuguauuuuuaaccuaauucuguauuuucugugucuucucuuuauacaaugguaauuaucuugcugagaaacacacaaagcccacugaaugaagcucuuccaucccauguacaacgauaucuugccugaccauccguaucucucaaucucucaguucuuuuuaaaaacuguuuuuuuguuuuguuugguuugguuuaguucugcuuaucaucauaucuccagcagcuagcaagccagcacacugcuuggcaagcaguaagcccuugaugagcauuugcugaauaaaugaaagugucugagccuauccuuacuuuaccccacugcugcugucuuguccccauccacccaucucugcucuauguucuaugccaugcaccuucuuuaucagcccaccauaugaggcuuccuuuuuuuauaacagaaauaaguaucuuguuuaaggauaauuucacccauucuaacuccucaaucaguacuguuuaugcacucauuuacuuuauccuugcccuuuccaauaaagaaucuaaaguaacuguaaaaucuucuugucacuaugguaauuuauaauuauaaaaucauaggacuauaggaauuuaccugcuuucguuaauuuauuuaauacgucuguuuagaucuucauaagacaguaaaauacuuuaaggugggaaucacauuuauuaauacuggcaaucuuucaaaaguggaaugucugauucuuuugcaucuagaggaguggaucagcaugaccaacacagaaaaacagccacaaucaaggguguuauggcuuguuuaauaccacagguuaaggccuaguuagaggcagcccagagaaugcccuccccacaacgagcugcuaacaggcucacacaucaauggcuaguaagaaaagagguguaaggcuagguacuaccuggaaugcuacuugcuucggcuauaacagcagggacuaaccuuaaauugcaaacacucuagugaaaagucgaaaguaauaacaauauaggaauuaguauuugcugaaugcucauugguacuuuauagagauugaugcauuuuaacuucacaagagcccuaugagguagauacuaucaugaucccuucuuaaagagaagaaaacagcccuggagaggcugaguaaauugcccagcaucaguggugauagaaaaauucuuaauuacuauccauauuccuucacuuauuauuuugggcaucaauuagcaccuuagcaaaaauugacugaaaaauaaccacuaagaggccucuaaaaucaaagaaggucaucuagagaaugggggcacuggagggaacaaaaaugagacaagaguagguacgcaggacaaacuugacaugacaaugucuucuaguuucagccucagccacaucauuaaagugucaucucaaaauacauagcugcuacauggaucauaaaauacaaauuauugaaccaauagggaugggcuugcuacugaaaaucuuacaauuaaaauuacaaauauuguaucacuucucaaaauacaucuauucauauagguuaaaaacuagagcuuaaaaaguucucucuuuuugaauuacuaagacacaggagaaagaugugucuuucaaagacagugagaagaaaacugaccaaaggaaaaugauacaagacacucucccuuugagcaauuucaagguuccuggugaugccucagauaauaacaucaauucuaucucuaguacaaagccagaaaguuaggacacaugggcuuuucuaaaauccagaccaccagcuacaguacagagagguugccccgcuguuucaaaugguuagcauucugucuuuuaaaagcccgcaugaauaaacuaacugugugguuugcauaaagauuaaauaugcuuuuauaaaggcacuuuauguauacaggcaauuuaaggguuuacuuaaaauuacuucucuaagauaaucaaaucuaugaaaauuaaggucaauuuuucuauuaucauaguaaaaucacacuuaaaauucacacacauaauagaaacaauauccccugauaggaaaugaaugcgcuuacuccacaaacugcaacuugcaugauggcaucgaaaccaccuucuggagaauccaaauuuccagauaugcgcuguuuuccaacaaguucauuaaauacuucuccuuuauuaguaagacugagcacauuuuuguagcuaaaugggcuggugcaguucuguucacuugugcaaggguuccugagcuuagcugguguugugcuaauguaaggcaucacagucuuuuccacaaaugagccaaauccugccaagaaaaaaaugguacauaaaugaaugaauggauggauagauggaaagacagagauuugcauuguuuaaaaaauucaucuauguuaccaaauguagguuacuauggacugaaugucuguguuaccccaaaauuccuacauugaaaaccuaauucccaacaugaugguauuaggaagugguuccuuuggaaggugauuagaucaugagggcagagcccucaugaaugggauuaguaacugauacaguuuggguaucuguccccgcccaagucucauguuaaaaugugauccccaauguugaagguacggccugguggaagguauuucgaucaugggggcagaucaaucccucauggcuuggugcuauucugaccacagugagugaguucucaugagaucuguuauuuaaaauuguguggcaucucuccccaacucuugcuccugcucccaccaugugagaagccugcuccccacuuugccuucugccacgauuggaagcuuccugaggccuccccagaggccuugcugaugcuagcgccaugcuuccuguagagcuugcaggaccguaaaccaauuaaaccucuuuucuucauaaauuacccagugucagauaugucuuuauagcaacguaagaauagacuccuacagugaccucaucaaagaagccccagagagcugcugucucccugcugcuaugugaguacaucgcaagaagguaucaucuaugaacccagaagagggaccucaccagaugcucaaucugccuggaucuuggacuucucaccuccagagcugugagaaauaaauuucuguuguucauaagccacccaguuuauaguauuuucuuaaagcagcacaaauggacuaagaccuaagacaaucuuuuuauuuugccucccuacuuuaaaaauaacucacauucauuuucuuggcacaccagcucucaauaaugacaugcugaacaaaugaauaaacaaauauucuagaauucuggccauuuuaaaaaacacuaauuugauaggagcucccuaaugccaugguccuugaauuaugcuuacagaauaaaagaacauuuuaagcaagugcuauuuuuaaauguuuccacuaaaauagggcuaauuuuugaaaggcagcucuuaggccucauaacugucaaaucuuucuaauauucuguugcuaaaccucuagagcaacaggaguggagagaagcaggcaaaaaagagguuaagcuggggaugcaugaaaugggaaaaauaagguuuggaaagcagaucaucaucauaugaaaaauccaggucuaagaugagaucaggcuguacgggcaggugcagacauacuaauuagcaauuagauaaaaucuggguauucaacacauguuuauaaaauaagucauaagggccaggcaugguggcucacgccuguagucccaauacucugggaggccaaggcagcuggauuaccugaggucaggaguucgagaccagccuggccaacauggugaaacccccaucucuacuaaaaauacaaaaaauuaguugggggugguggcagaugccuguaaucccagcuacucgggaggcuguggcaggaaaaucacuugaacccgggaagcggagguugcagugagccgagaucacaccacugcacuccagucugggcgacaagagugaaacucuuaaaaauaaaauaaaguaagucauaagauaaaugaucaaguuaguaugaaaauaagcaugcaagucauuaucuaugagguacaaucugugucaaacaguagcauccagugacagaggaacaagguggcagaaaagauuauuaaacgugugacuggaauaucaacuuccacucagaaaaggcuaaaaaacuggcuuguuuaucucacaaguauguugugaguaacaaaggaauaaaauauaaaacaacauuugagaauugccaagacuuuauaaugaaaauggucaauguucccaacauuccuaccaauucugaaguccgaaguaauccuccucauuucauucaucagaucuguuccaagacuuuuuacauucuccaaaucgucuuucauugaguaagacagguccauaagguaguagaggucaaugggauagucuucagcucucuugaauuuuaauguaaaugucuguggcuccccuaauuagacaagagauuagaaaaugaaacuugccuguuggcaaucaaacgcaaacgagaaaaaccaaauaaaugugguuuacacgguaaacacaauaaaauaaaacauguugucauaauuuuuacaaaaaccugggaauuccauaaguaacucaauggguauguauucaguuucauucaacaaauacuuuaaacaccaggccuucaggaugcaaagauaaaaaagauauucccaauccacaguggacaaaacagacaaaaagucaguuuauaagagaagaaaacaaauagaacaccauaaauuagucuggagagggcaaggcagaacacgugauaggguacaacugacuuuuuagacacugaaguugugaacucuguucuguguguagugggaugccacucccugcaagugaauaacaugauccgaucuuuacuuuagaaagccuggcagacagcuuuaaaaauaauuauuuauuuauuauuauuuauuauuuauuauuuuauuuuuauuaucauuaugaggcaaagagacuagcuaaucuacaaaagaaacccagagagagaugaugaaggaggagaagagagagauacaagagacguuaauguaauuuacuuaggaaauacaggagagagguuuggaugaaaauguaauuaaaauuuuaacuuguaguuuucucuauauagauuucuaauaggcaauuggagaaauggguuuggagcucaagaaaagucuguguugcugcagcauacaauuggguuuuaaagccacgagaggaaaacugacauuuagguggacugcaaaaagggaggaagaaaaaagacacaaaaagaggccuggaaggcaaugguaagagacacaaagaaaaaccgaggagugguaucauugaucaaggacagagcauuucaaaaaguacaaaguguuacuugguacagaagaguuaaaaaaaauccugacaaggguccccugggucugcgggcugaaggcgaugguggagcuuugcuagagcaggaugaggaggagagggcugaccugguugaggaggggccgggagggaagucaggggacagggccacucuaccauucuccugacaagaaaggucggaaaccagaaaagcgaggaugagggcuuguuuuuuccuucauguuuagaugugggacuaacagacauaauuacaaaaaccuuaacaguuuaauaauacuaaacaaauacaaaggaaaagaacagguuaaaauguugcuuuuauaauauauuauguaauuagaccagaggaugaacacuuucauuuuuaaaacucacuaaagcuaauuaauacuuucugaaucuuuaacaaaauuuacuuugaauauuaggcaacauuuaauauuauuccaaguaaauaugucuuacaauuguuauaucugcaaaaauuuucuaaaauuuaaacaauuccacauuuuugagugccaguccacauguaaaaacgagccuucaacagaaacuggucagaguuugcauaaagcuggugucgaaugccucaaguaaacacgcagguauucacagaguugggcuuccauaccugaucuuaaucgcaaaaccaacugcugugguuggaucugaguaauauccucuggcuugagcuucucugcuguuccuuugcuacgguugguuacauuuuuauuuuucuuuauaucuuuggagccucugggauuuucuaugucaucuggagggcaacccuucuuuuuuaaggcuucuaaaucaucacaucgugcagaaguaggcauuccuuccuguaaaaaugucuaaaugacauauaaaauauagguauaaaugaaaauuguaauggucaaaccuuuuuacauaauaauugcaaauaagcaauuaaauugcaaaacaucaaaucacaucuaauguaccccaauucuggcuuuuaaacaaaaugcucccuucauccaaacugugguaaguguucuuguuaaaaaacaaucauuuccaagaaaguaauaccuuucccagaacugacccaaguguacacaguaaaugcucuaucuuguaauucagaguaucuaaucaaaagcaauuucuuuagugaaaucacuaauugagcaugguuaauggcuacuaauaauguauacauacacccaaauaucagaucauuucuccaaaauuucccuuugaaaaguccuuacaaagcgucucauauuauguggcacucuccccaucgcaauaugcugaacaacccgauguuuagggaaaacagacgagcuuaaaaacaucucaauuaauuauugcauuuuuuaaaaggacaacacgaaauuuagcaccgauuaaauaaguauucccacagguuugaaaaaacuuuaaguauuagcuauuauuguaaauaaguuuuuaaaaaacuuuuaaaaagcaaaauaguaaguauaugacaaggguaaaaggaguaaguauaugacaaggguaaaagguccuaauggcagguaaauuucaaaaaaggaaaaaaaguucuuaauggcaggugaauggauauuugcaguaguaaaauuucuaguaaugacagagauuuuaaaugugguauacaucaaacaacuuagaaauaaaaauuuaaucauauaacugaaaagugccuuagugaauucaaaaacacugcuguuaaagaucuauauaaagacugugaauaaagguguuucaagaaaugugaaaaugugggggaaacagugacauuauauaugguauuuauuuaucaaauaucaauuuaacggugcuguauaaaguaacaguaagugaagauauuuaaauuuaaagaauacacaauaguuuuuacauaagauuuuuuaagagaaacaucauacuaaugagaguauuuauguaaucaacaacuggaagggaauaccaagaaucagauaauucaaagcugcacuauuuauuaaaccuaaacuacuaccuaccaaagcacaagauccuagugaauuacacauuucuaaauacuaaucaauccacgaaauuuacaaucaugacacccaaauacaauuucacugaauauauucagaaagccuuuaaaauuuuaaggauuaugcuccaaagcucaaaggcuaagauaauccuuaacuacagauaaacuguaguccccauaaaauggauauguuaacaauaauagcagcuaccacuuauuuagaaguuuuuaagugaaacugcuuuaaguucaucaauucuaauuauuguaacaauagauaaagcggauauuaucauccucauuuucagauaugaaaaccaagagcuucaguuacauaagccuugccugagacaaacucacaacacuccauauuuccuccacuguugccaauguaaucccaacacaccacuuuuagaaaacaccauuagaaaauuuuugaaaaacaacaaaaccucucauuuuuucuuucauguggucaaaccauacgacauaucugacacuugaccacuuaggcauacaaaaauaggcacuugaaacuugggcccaaaugccugcaugaaaacaaaaucaguaaccccuugaucuucugauauuaguuauucauucugugaauaaacuauacaaccucaaaaugacuucuccuuaccuucucuuuugauauauucauucauucauucauugacucacugaacauuuaguaggcuuuguggaagguaccauauuagcaaaaguauagagaugacaaaagugaauaaaauccaaacccuaauuaaccucaauaagcuuauauugggaugcaaaucaauuccaguaguuuaacucaaauauaauuaagaagguuaauuuauaccuccccaucaaaaaaggggaaaucugaaacagucaaacuaaaugacuaggauuuuuuugaagguucucccauaaaaaucuaauaugugccacaaagaugagcuacaaauauauguauuuuaaaauuguuuaguagccacacuaaaaaaagaaaaagagaaaauuuuaacacuguuauaacauuauuuuuaaauauacaaaaauuaucauuucaccauuauuauuuauuuaauacuaagucuuugaaaucuuguauaucuuugaaacuuagagcaauucuaauuuguacaaaagugcucaauagccacaucugccuaguggcuacuguguugaaccacauagcuccaaaccauuagguuauucauuuuaugauuuacauaaaaauuaauaugugcuucugaaggauacagcacugagccacacuaaaugaccagagaacaaauggaaaggacuugagcaaccuuacuuacugaauuugugcaccacccacaauuuggcccugcuuguauacauucuccacaugauuuggcauuugcuuuuaaacaucuauuuucaucugucagaaagaagaaagaacagaacauuuuaugugaagugucagagagaaaauaaugaaaaaucagaaucacaaugacaaugcaauacauauguuaaauauuaauacuaugaccuaguuaccaucuaaacuagaccuuccccaaagagagcaggauuuuuuaauuuaauuuuuaauuuuuguggguaaauagguguauacauguaugggguacaugagauauuuugauacaggcauacaaugcauaacagucauauaaugguaaaugggguauucauccccucaggccuuuauccuuuguguuacaaagaauccaauuauacucuuuuaguuauuuuaaaauaugcaacuauauuauuauugacuacagucacccuguugugcuaccaaauacuaggucauacuuauucuuucuauuuuuuuguacccauuaacacucccgacuuccuccccaccuucucacuacccuucccagccucugguaaccauccuucuacuaucuucaugaguucaauuguuuuaauuuuuagcucccacaaaccggugagaacaaugcaaaauuugggaccgugauuuuggaucaccuugacacugaaagccacagagagacauaaguuaucuuccuugucuucuguaucaaagacaagacauaauucagaauuuaucauucuugacugucauaaaugucaugaguucucuuaaaacugggcaaaguauuauuucuugucauuuaacuccuaccauacucacaagaaucuucaaggcuuucccuuugcuuucaguauguuaaauaacugaaaaguccauauucaucuaauccauaaucccagaauuucucaggcucuauguucaaaguauguuuuagguuucuuugcaucuaccuaaggaagaguaugccuucuacaugguaagcgcuaauacagacugucuccaacguaucuuuucugagauuauaaaaccagcauaugcuucuuauagaaaaucuggaaaacacacaagagcauaaagaaccaacucacugaaucuguuaacugagagaggacuguugcuaacauuuuugccuauuucuuuccagucuuuuuccuaugcagauaaauagcaaggggaagcaagcauauauauauuaauacauguauuauuuacaugaaacugaggaugcacuuuauauauacaguuguacaguuuuguauacuguuuuuuauaccuuauccuaaguguuuuauucuuaucaucacaaauucuuuuuaaaaagaauuaaaaagcuuuuaaugauuauguauuucaauauaaguguacucuauuuaaugcuggacaaauuuagauuguuuccaaauguaugugugcacaguucacacaugcuugcucacaugcacauauaaacaccccaaguacacauauacacauacuguacuacaugcacauacacaugcugaugaucuuauauauaaaccuuaguacacaucugauuauuuccuuauaauaaaaccuaaaagaauaauuaacuacuaaguugaagagcauauuaacauuucuaaaauucucuauacacacuaauuucuauccaaaaguaauauacaguugacccucugugucugugguuuccaaaucaguggauucaagcaaccacggaucaaaaaugggggaaaaaagugucuguacugaacauguacauacuuuucuuccugucauuauucccuaaacaauacaguguaaaagcuauuuaccuagcauuuacauuguauuaaguauuacagguaaucuagagaagauuuaaaguauacaggaggauauguguagguuauaugcaaauaucaugccauuuuauaucagggacuugaguauuuguggauuuugguaucugaaggagguccuggaaccaauuccccauggauaccauagggcaacacuacuaauauaagcucccacaaaacggcaguguacaaauaccauuuuaccacauuuccaaccgaagugcuuuaauguuaaaaaacuguugcucauuucauaaguguaaauuagaauaucaauucauuggugaagccuaucaauuucagguuuuacauuguuucauauuuuuacuaaccauuucuuuuauaauuuuguuaugucuuuugcaaauuuuuuuguuauguuccucaguuuuuauuggauuucuauacacauuaaugaaguggaaccuuuguuuaguuucucaucuuguuuacgguguucugacacagaauguuuuuguuauuacugauuuuauguaacuaacuuaucaauacuuucuuuuacggucuccugcuucauuuuuacuacuuguaguaaguccuuccaauccugauaucgaacugcucuaugcaguguaguuuuucaagauucagaggacagaacugcguauccauuauuccagauguggagccacaucuuuauagaaggguuaaauacauuuucagcuuuauuuucacugcuuuccuagaugaugccaacauuuugugagacuuuuuuaucaaagagugagaaugucuucuagaaagucuuugcagauaauaauggacaguucauaauccuccauucuacacauuuauuucauuugcuucuaaauauacuugcuuuugccuucuguucacuuacacacucucauguucucaaaagaucuucuugcaguguguucaaucccuagcauuuuaguacuucaccagccaacuugccucccaucaucccagguggcaggggugaggggagccugaccaugaaggaacuugaccuuucucugaguaagaggaacaauugcagggcuuccagaaggagcagcaugauuaugacuuagguucucauaugaaccuaacuggucaaagcgcaauacaagauacggaaaugaaaagacaacuaagaaaauuuuuuguuuuuaccuguuugagcaaacacacagcaaacugaacugaucaguccaauccagaaaauugguuguaaauucaucugaaauguaaaaugugccuuauauuaguuauaaagaaauaaaaugaaaaaugcauuaaauagaaaguauuaccccaccguaccuucuauugcuuuuauaaacaugauggcucucaaaccauuucacuccagccccucuccacagacccucgcccaucuccccucccuaucugguucccucaccuugcaccuacacugcgaaaauaacuuccauaccagagccccagaauccauucgugccuuucucuaaagcaaaccgauuauauuuuaacauuuaauuaacagcgcucaaaaaaaaaaucaguguuaaguauuccucaacaccauaaaaccuaccaauggucucagcccauagaaucucuaucuccauuaucuccugcggcucccaggggcccagaccagcauauccagaugccucaguuaccucaaugcugaacauucguuuucaaaaaccugaucaagucaucccucugcuaacaaugcgcuucaucaguuuuuauuucuucaggcuaaggccaacauccugcauaaggccccaaauagauuuuugagcuuguuuuccuauuaucucucuuuuuuaagaaaaucaacuucugccaggagcgcuggcucacgccuggaaucucagcacuuugggaggcugaggcaggcagaucaccugaggucaggaguuugagaccaacccagccaacauggagaaaccccagcucuacuaaaaauuagccaggcaucgucgugggugccuguagucccagcuacuccggaggcugaggcaggagaacugcuugaaccugggaggcaaagguuucacugagccaagauuaugccacugcacuccagccugggcaacagagcaggacuccaucucaaaaaaaaagaaagaaaagaaaagaaaaucaacuucuaugcaugcaauaaguaaaauacucaguuuuaauuuccuagaguguccagaccccccaccucucccccaacaaaaaaaaagagggcauaagacaaacugaaaaagucuugucuucuagaaccucuaaccaaaaaauuagguaauauucuauauacuaaauacaacuaccccaauuuccuaccauuagguacauauauaacuauuuucucugaaucaaagcuuucacgaugauaugaaucuauaucuuugauuggucaaagauggcuacggccacugguugcugacuugaucccuuaacuacuuacugcucuuggacuagcagccaaucuaauaauuauauauaaguaucugucccuccacaagaagaaauacucaaaaaagcaaauuuauacaaaaaaaguuuagguuuaaucguuauuggaaaauguaaauuaaagcaacauaagaugaacuagcaaaaauagaaaguuuuuuaacccaacaaaacuauagcagauggcugcgagaaaccaacugguagcucugugaacugauacaacuuuuugggaaauaauuugacaauuuauaucaaaaaccauaaaaaaauuucuacccucuaauaauccagcuacugggaauuuacccuaaggaaauacuuaaauauauaaaaggugacacacauauacacacacauucaguauaguacucuaguauauucacaagagcaaaaauguaaauauccuauauccaauaacagggaaaucuaacugcaucaaguuuagggacuuauuagucauugcaauaauaaaaugcagcaacauuuagaguuauagagggccaagugcaguggcucacgccuguaauccagcacuuugggagaccaaggcggguggaucacgaggucaggagaucgagaccauccuggacaacauagugaaaccccgucucuacuaaaaaugcaaaaauuagcugggugugguggcauacuccuguaaucccagcuucucaggaggcugaggcaggagaaucgcuugaacccgggaggcggagguugcagugagccaagaucgcgccacuguacucuagccuggcgaaagagcgagacuccgucucaaaaaaaaaaaaaaaaaaaaaaaagaguuacaaaauaauuuuggauguaaaguacacaaugagaagaacgugacuuucucaaggcaaaagaaaaaaagaugagaagaauauaaaaauaauacuaauaguuucauauaaucugaagauaacaaagaguuauaugcacaauauaaagacaaugagggccauuuguuuuuuaaacuguuagggucuucuuucuacuuucuuaaugaaaacaacuguagcacaauuuaacugugcaauuauuuuucuugacaaauuuccuuuaauaugaaaaaaguucacugaauuccaaguuaacacugaauauuucuuuuacagaccuccaucuucaagggcuuacauuccaggaugcuauuccccuggcucagagagaaugcuuuaaguugugcucugagcacccgagagaaaagaguuaagcguaacgugaaaagucauucacuucugcaaucgugcucagcccagcaggcuguuaugccugagcuugcaguuuugcuuacauaucacuugugacuguauccaagagaccagcaaaaucugagugucacagaagugugaaaugccuaccaaauucaccuuucaaggccugucuaaaagguuuaguguguaguaaauccauuagacuauaauucuaagcaagucaaauaauguuaucacgauuccaaagcuaugacaacagacaccugaaacauuaaaaguuccugaggaaaugcauuacugugaugaaugaagcaugcaggcaguuuccacacaaagggaauggaacaaauauuuguuccauauauggacagauacauguuucuucaggauacaacucaggcuguuuaaugaucacuagagacugcuuugagaaaucugucaacauaucauacaauuuagacaaucaccacuaagaugaaguuauuagguaacagaaaaugauuccuaacauucggagccacacuacuuuaaaugucacuguccuuuccuucuauaaaccuugacaaggcaaaaagucaaccuucugaaacccuugugccuccggaagagcuccaaacccggaagcaggcgaaacaaggcuucaguguugaagaacagcugagagaacaaggccagcagcuggaaacaguuuaaugacagaugucaacgauccugcgacuggcgacuggcggggcacuggcaagaaacagagaggcacugccauuggcuagugauaucuguaaaaggcgaggcuuucucucagggaaagggaaaggcuagaggaugacuccaauuaagaacacagaagagcuacaggaccagggggcggagaggagaccacaguuagaaguggccugagggaagcaagccacagagacccggacaggaaaggagaggcagagggccagggagccucgcuuucaaugcugcuggccuucccuucuaccgguacugggugcccccugcacaugcgcauggaaggggaaggaacaggugcccaaguccuacgccacaaagcucccaggacagcacuucucuaagugggccuagagaacaacugcauuggguuuaccuggaugcccuaggcuuaaaauccacaaucccugagcauggggccuggacuccaggugauucuuaugcugagaaaaggaccugaagggguuuccucccaauggcauuccauauaaaacagaguaugaggggauaacagggaaagaugccuuucaguugcuguccuaauucuaacgcuugucuccucuucacggucaaagaccuagaaacaguugucuacacuggucuccauuuccuaccuaccuucccucuccucaacccaguaccuucaugugucauuuaacaaagaaagagcucugagaaaugcgaaggcaaucucaucuuugugcaaccaucacagugcacuuacacaaaccgagaugguguggccuccuacacauccaggcucuacgguacagccuauugccccuaggcuacacaccuguccagcacaagacuguccugaauacugcaggcaacuggaaugcugcaguaagcauguguguaucuacgcacaguuagacacagaaaaacuacacaguaaaaguaugguacaaaagauuuuaaaauugaugcaccucuauuaccaugaauauagcuugcaggacuggaagcugcucuggauggcuggguggguaagugagugagugagugagugagugagugagugagugagugagugagaggggcaagugaguacacugcacagaacacacacugaacaggacauuacugacauuacuauacacaguacuguggacacaaauacacacuacauuagccuaaagccugcacagcugcccugggucaggaucaucaaugucacugucuugcgccugcauauccugucuccaaugacacauggagcugucaucuccuaaaagaucuccuucuucgggaccacuuccugaaggaccuggaccugccugaggcuguuuuacuuuuucuguaaggagagauacucucucaaauaacaacaggcugggggcgguggcucacgccuguaaucccagcgcuuugggaggccaagaugggcagaucacaaggucaaguaauggagaccauccuggccaacauggugaaaccccgucucuacaaaaaaauacaaaaauuagcuuggcgugguggugcgcaucuguagucccagcuacucuggaggcugaggcaggagaaucacuugaacccaggagauggagguuacagugcgccaaaauugcgccacugcacuccagccuggcgacagagcuagacuccaucucaaaaaaaaaaaaaaaaauuaacaauauagugcaguaaauauauaaagcaguaacauaguuguuuauuaucaaguauuaugcacuguaauuuagaugcuaugcguuuauaagacuggcagcauggucgauuuguuuacaccagcaucaccacaaacaugugaguaauguguugcacuaugacacuacauuacuaggcaacagguguuuuucagcuccguuauaaucuuaugggaccacugucguguaugugguccaucacugaccgaaaagucauuauguggcacauaacuguguaacugauguccaugcccaaccauauaugugaaauuacucuugcaaaagaacccuuucuaggccuuaccuuacucucugcauucauucguucaucacucauucauucacaaauuuuuugacucacuacaauaugcacuugaagaaguacaucgguuuacuaccaaagaauuuacacaaagcaacauguaagacuauucaccauucuuuaacacacucuacucccuugaacucuacugguuucccccugccuuucuggagguuccucuucagacaacucugucagguuuugagccauaucaggaaauacaagggucacugcuucagggaacuuucaguucaaggacaaaaauacaaauuauuaugauaugaugguuucaguaauaaacaaggacacagugcacugaggacacugaaaucugccuggacaaguucagaggcaucaggcacauggcaguguuucaguuagaccugaaggcacauaggagauggguguggagaaaaguggagagaagauauuccaagcaaaaggccugcauauacaaagccaugaagucccgaggcgaauuauaauaacuccuuccuaaucuuauuucuaagcauaugcauuugggcagcucccugcaacccaaaauuggaacugucucacuuuuucucucuuuauagaaaaaaagacuagaaaaauguauguuuuuguaacuauaucuuguugguggaaugagugauuauuuuauccuuauaauuuucuauuguaaguauaaguuauauuaucuuaaaaucuuaaaauaucagaaaggccaaaaggaaucuugaaguauuucugagacuuaaauuaugaguuggaaauaacaggaacgaagaccaagcaagcaggaagagcuacguuacagagagccaaauaccauccaugcuaaaagaguuuggauuccauucuauaaauaggaagggaacugaaaaaauuugggcaggcuaguaauaccucuacauauacauggcagaaacucaguggagaaaaggacagggggcaagacaggagcuggaagacaaauacagaauuuacugcaaagguucaagugagaggugacaaaugucuaaauucagauaacagcaacaaacaagaagacgaacaaacaaugauuagaagguagcuaugagggaucugcugcuuacuuggagaaggaaggaugggagaaagaaaggaauuuagaauaaucaucacuuuaaaauaaagaagauguacgagggagaaugggguuaggggaaaaaaugagguuuguuuuauugcaaaaucuagggaagaugccuauugggaagcuaggacaugaguauggaucucaggagauaagucaagaguuagagacacagacaugagaguugucauaaucuaggugcuaaccgaacuuaugaaaauggaugugauugggaugaaaagaauacuuaggaagaaaggagaacugggggcaaacuugaagaggugaagacacaggaaaagagaaaaggaaagugaugaagccaggccuccuuggagcaaagagggauggcaugugcagcccaaggggguggaucacccuaaacagagacauggugccuuucuucuaaggcagagcaggaggugagaaagcaaagagaguucauucaugcaugacuguuuuuuucugaaauaggaagaacuccuaggaaaagagguacggcuuagggguugcagaaaauuaggaagaugcaaugggauuacagugagagccugcaauggugagagcccaccagguauuggacacccuaauuuauacaggcauauuuguaacacucauuucacuucuaacuauuuguuaacaugucuucccugauggauucuaggcuccaagaaaauagggccuggguguaucuuauuuauagcuauugcaccuagaaauacuuggcacaaaguccaugcucaaaacucuuugcuguuaggcucaugccugcaaucuuagcacuuugaggggcugagguaagaggacugccugaggcaaagaguucaagacuagccucgacccugucucucucucucucuuuuuuuuuuuuuuggggggagacagggucuugcucugucgccuaggcuggaaugcaguggugugaucacaucucacugcagccucaaccuccugggcucaggcaauccucccaucucagccucccaaguaacugggacuacagguaugagccaucaugcccaccuagagauccuggcucuacaagaaaauaaauuagccugggcaacauagcaaaacuugguggaagugggggccaggggaaggggccaugaguccaggaguuggaagcugcaguaagcuaugaucacaccacugcauuccaggcugggcaauggagugagacccugccucaaaaaguuaaaaaauuaaaaauauuuucacugaaccauauugaauuguaugacauuuuucucugacauuacucagaagaaugucucagaauuacuuaaugugcagaacuucucuaaacagaaaaguguuacuauagacauccaagugacaacuuaaauuuucaauuacuuuaaguauauaagccaacuuauagauagauauaaaaugucucaugcucauagcucuuaaacauuaugaaaccaaaauuaacuuccaaguacaaacauagauucugaaguuauauuacuggguuauaagauggucaaccagauaaacuaaauguuuauuauuaacaugaaagcaugauuuuuuuuuaaauuuuguagaaaugcccaaaucucugagaauaccucccauggucccucagacuccaauuuggaaucacuaaaucuauucccuggugugcagggcaggugcaagaggaaagguggggguggggggcaaagaaggugcagugcuaccaaaaaguuaacaagaggaaaaagucaaaagaccagacaucacaacagggaggugagaggagaggggaccacggaaacaaggaagugaaaagagcuggaaccuacgacaguuaagaauuuacaauuucagagacaggcagucuugggggaaaaggccuguauuaaaaauacaguaccaggucauuguuuuagcuaggguucuguccaaagcagagccugggaacagaacuggugugcaggcaguuuauuggaaggugaccccaggaaaagagagagacacuuugaagacagugaaccaagaaaaagagaaaaagccaauacaaagauacuaucuuuaccauacugaguaccugggggcuugaucuuguggaaaacuuuugagaaguacguagaaagucuguccagugaaagucaacggggaaauggaucaacuccaguugcauagguaaaaagucgccucaaagggcauuaacuccacuaacacuucuaagaacuacagugcacgugcccagggacagacaagagggaacagacaagaaaguugguuagaggagccgcaggggaaaaagcaaaagagaggcaccugaggcagcaugcagucagccaggagugagccaccgacuguucccagcagcaccagcuggaaucagaggccaagaggaugugagaaagacacacgagguuuccaguacagugaccaauggccacuaaaguugagagacaagaaaacugcuagaccagaguucagggaaggccugggagccacaguccccgcccacuagcagcgcugccagcuggcugggccugggcggcagagaagguaaguucacaggcugggccaaagcccuuguucgggugcggcgugggccuuggucuguaaaggggcgucuacgcggcagcagccgugaucaugggggcccugggcuaggcaacagcacuaguugucgcgcgucaccaaacacugugaagcaccucucuagcggagaccugcuccaggaucaacaugcugcggggcacagaaauuaauguguuagcuaacgcuuucauugaccaaaggaaacucauccgagaugaugucaugacucagcuggcccuauaugagcugaaaaaucucacuuaguauagcuagcuguugggugguuuuccauggacacuuccacaggcagaagcccuagacuaagcuucuuagacagacaaagugauuagcccgaaugugcccuuugaggucauuaaacaaugccuuacugcucgcuagauucauccugccaguggcugagucuacaacauugaauucaacccucccaaaacugugggcacugaugaucugacuggggauccucucauucagcaugaggaugauaaaccagagacgguuaucaaaagacuaaaggcuuaugaagcccaaacaaagccaguccuggaauauuaccaagcuuuucuacaaacuaaaguuccacaaagaagccagaaagcugccauuacuccaugaggagaaauguguguaacuaguaagaugagcaaaccuccuauuccuugaauuuaaaaacugcuuuuccuaagaccuccagcauguaugaauucuuugaaaguuauauuacuuuuauuucuacugauuuuauucuggauacugaggaugugccaaacgagucagauacuaagauuaaucuuuugaaaucaucuaguguguuuuauccagucaccugcaaaaccaucagagaugucuuaacuuuuaaaacacguuagagcaaaauuaaaugaacaauugguaguaaucuaacuuuuuguucauuaagugguugauaggcugggugcaguggcucaugccuguaaucccagcacuuugggaggccgagauggugcaucacgaggucaggagaucgagaccauccuggcuaacauggugaaaccccgucucuacuaaaaacacaaaaaaauuagccgggcgugguggcaggcgccuguagucccagcuacucgggaggcugaggcaggagaauggcgugaaccugggagguggagcuugcagugagcugagaucacgccacugcacuccagccugggcgacagaccgagacucugucucaaaaaaaaaagauuaagugauugauaaaauguccauauuuuuuggaaaaguuuuaaaaaguuacaugucauuuggggaaaguaucucaucagaaauuuuugcagauuaaugccacauuucuagcauuguggagcauggugauacuacauaaaauuccagaaaaaaaagcaacuggauucacagauuuguuguaagauacaaauucacugcugccuuuacacuaauaaauauauaagcuaaccauauaugcuguauuuauuuuguuguuaaacauacuuucaauuuacucagaauuuucaauuugcuauaaaaauguaucaauuaacauacagaaaaauauuacuuuaagaugacucuucuuuugaaaauacauauguauugaggguuauaauuuuugucagaaauugacauuauaaguucuuggauaagcaccaaaguugaaugaauuuucaacaaaauauaauugaaaucuauguuuucagauguuacucggguuaagaaauguguuuuaggaucuacuugccaguuucucuuuuugauccaaauauaugaucugcccugauaaauaacaaguuauuauaccccuccucccaaaaauaaaagagaaaaccuauggaauuauguaaaguaagcauacuuugucauuaguaaauagaucaggcaugccugcggaauguucccuuggcauaaauagcaaucaaucaugauucguaaacaaggugugccaauaaaaagaauucacaggauagguuaacaaagaccaaaaaagugaguuuucugaaggaguucuuuguuccugaucaaagaaauugauaccugcuagcauucacugccaccuuaucuuaaggggaaagaauucuacugguuucaucugagcagccauuuaaauacuggaaucuaaagugauuccucaguggggcaacaaggauggcugcugauguacugugaccugguaggagaaguggggcauaugagagaaggaggaaaaaccugaccaucuuccacagcauauuuacucuuacuuuacuuggugcuaaagcaaaugaaacaaggccuuguauaagcuguuauuaauugccuuuaaaaaucuguccuguuuuucuccagguacuuaaaacacaagugccaauaagugguuuguauguauuucugggggggggggggggauuauuuuccuuuucugcagguauuucaaaaauucaucagucuuucaagaugaaccaagguuuuuuaaaagaauuauaguaaagacuucuuuuuuuuuuuuagacaguuucacuugaucacccaggcuggagugcaguggcaugaucuuggcucacugcaaccuccgccuccuggguucaagcaauucuccugccucagccucugaguagcugggauuacaggcaugugccaccacggcuggcuaauuuuuguauuuuaguagagacaggguuuugcuauguuggccaggcuggucucaaacuccugaccuccagcaauccacccaccucugccucccaaaguggugggauuacagucaugaggcaccauaccuggccuacuucauucuuuauaaaacuuucuauaaugccucacuugaauguuaauauuaugugcuuuguaaaaauguugugaacucccaaacuuauagauuaucacuagguuaugaggcauacauuagucuuuaucugaauaaacugaaauuucauuaaauaaaaaaaaaagaaagaaagaaaacugcuagaccaaggugugagaaguaucaucugcaugaacucuugaagcccucgaauuauggcaagaacuggggaggaaagaaagacuaaagccaggugauucacauauagccguguguguguguguguguguguguguguguguguguacguacauacacacaguauguuaaaacauauauaauaaucuucauuuaaaagguuuccuguuuggggcauauguagcucuuauacaucuacuaaugauguacaugguugacuugccuuauaaauugucaucuucuagaaguuucuccauguuuucuguaucuagcgcaaugucuuuauauugaauaaaugaagaaacuaacgauaaaaacaacuggagauacucugagguaucaaaaaauaaaacacugagcuucaugacagcagauauuuguggcaucuaccguuguacaacauuguguagugcagaguuacacuggcaaauuaaucugucucaguuuccucaucuuuaaaauggggacagcaguauuuaccuuguagggguuuugugaaguuuaaauaaguugauacacauaaaacauuuaaaacaaugucuggccaauuguaaguaccuggguguuacuuguuaugaucauuaccaaauguuacaggaagcgcucaauaacaacguaauugaauaaagaaguaacuaugguugaauuuuuuuuuuuuuucaauuguaauuauaaccagaaaacugacuggauccacuuuagggaagacacaagauaugaaagaaaggauaaagucugaaaguuagaaguaacacaacuacagaaaauagauuaauguggauuguuauagcuguucauacacugacauccucaauaucaaaaccuuauuauacucuuuauagauuccacauccaaguagaauucuauuuaaugugcuuucuaacaaucagauuccugacaaauguguucauaaaguaauaaaagcagcaaaaccuuaaauauuuuauacugacaaaauauuuaagguaguaaauguuagacaaaauacaaaugcucugaacacuaauaucauaaaaacauaguagacaaaauacaaaugcucugaacacugauaucacagaaacccuuaaaaaaagauugaggggagggaauaacauaccuaauacaaacagaaauaaggaggaagcuuugagguuugcuaugcuuugaacguguccccaagguucacguguuggaaacuuaauccccaaagcaacagugaugagaggugggacuuuuaagaggugauaaggucaugagggcucugcccacaugaauggauuaaugcuauuaccacaggaguggagaauggguuccagauaaaagacggaguuuggccuccuucucuucucucacucucuugcccuuccaccuucuaccaugggaugaugcaacagaaagacauuagaugccaaccccuugauaauggacuucccagcccccagaacccugacauaaauuacccagucuguggcauucuguuauagcagcacaaagacuaagacaagguucuuacaucacaaggaagcaaaccccccugaaaggacuagaauaccaauucuguguuuuauuaaucaaacccaacuagcaauaugauuucguucagggacugcugcucacuguggauuacugaaaaaaaaaaaaagacugacuucucaauugagagggccagacuaggcacaggcaagaagaagaguauaauacacuaaguuuugaugauuuaaaguaauuuguaacaaaaaguuauuucauuuagaacuuuaaaaaauuagaauuuuauuucagcaccuucaaauggauaugauaauaauaaugauaaaauaauagcaucuaucuccuccagguaacucaaugaggugaagaauaauagugucuuuguuuuacagaugaggaaacaaaaccagagagacuaaacaacuugcaaugguggaaucaaaaguugcacagguggaauugaaaccugaccaucuguauccagaagcuaugaccugacuucauuaaacuguaauuuuuucaaagccuacuuaaucacuauuuuaaaacaaagaacauccuucuaguguuagaacugacucagggcacagaaauggaaagggcuuauaauguucuaugaguuuauuucuugggcauuugaacuuaauagaggccaagaaaaguuauuuuaauugccauauuucauaaguacagacaaagguuuugugucuuguuccuauaaaagcauuucaccuuaaggucauuuuuuaccauaugaaauuuuaucuaaggggucauaauucauucccugaacaauaaacaaucuuaaacaccacccacaaauaaucucauuuuagugguuaacccaaauaugugcaauuguuuccacugucaaaaauagugcauaauuguuuuaaucuucacuguaaacuaaucuuuauccauaaaaguaugguuuuauaucauguucaaacuuuuaaauacacacucauuauuuauuaauuuuuuuaaacaauuuuacaaauaauucauuuggcauuuccuuuuaaauuuacaaucuuuagaaacuuuauauggacuaucuuuguagaaauuaaacaacuacacuuuagaaaaaaauuguaacauauguaacauauguaacauguuauguucauuucagaguugaaaaauaagccaccuaaaagccaacucaaauaaaaagaauacacaaaagauuucacaaaaucucaaaucuuuucaccuuaauaguagaaaagauucugauaccuauagagguauaucauaaaugucuccuaaaaauuauaauaaacuuggauucaucccaagucuguucuaccaucauuauuuucuguaucugcuuuuaaaaggggaagaaauaggccaauaacagauuuuaguauuuaaaaaucaauauauuccagaagaagaacacagagccaaauugaaagacaugagguuccucccacuuaucccacauagagaguaauaaaaacgagaaaaacaugaauggaagaaacugagaaaucuuucugaauucuguaccaucugagagggugacauguggagaugaguuccucccauggaaagggaaccuuuccccuuacaggaagaacaauuaaaacucaacacuuuuuuuccuuccaucuggcaggaagagguguguuggucacuacagagguguuuauggcccaaauauuaauaagcuagcauuaaugauuaacaaaacuucgcagaaagaauagagaagaaaaaaaaggagacaugaaagagaagaggcuaagggaucccaaagauguaacaccacauuugaaguccucuucuccucuccuugacaaacagaaaaguagucugaauuagaaaaccaucuaaaauucaccacucccacccagaagaaaaauggcuuuuuaaagagcacuaaccccuucucacacaaugauaaugauagccugggcuaagaagcucuaacaacaaagguuuggcugcuccaaagcuauagguucacaaaacaauuugaaaucugagaacagcucacaacacggcgagauacuuuaagaaaauuauacaacagauugaagauaaaauucaucacuagugacucuacccgccuucuccaggaaaaugaaauauggaagauuuuuaucaccacccaaucuacaagugcaagggaaagauaaauaauggauauaguacgcauuggcaaacaaaaugccuaaagauaauacguuggggguagggggagguaaagccuggaaacuuaacaccuaggaaagacuuccacagaacaaaaagugaaaggaagucagugaagaaucuucuuuaaaaauaagagaaaaucuagaucucauucugcucuucaagaaagucagaaaaucucaaauagaucuugacagugaucaaagagcaaaaccacaaaagucgaggaaaaguaaacagaacuaaggaagaaaauuuaggcuggaauccucuacagaacucauagacaccaagaacagaaucaacauaacaggaaaaucacacaaaauucaaauaauucaagccaaugagaaacguugucuaauggugaucucauaaacagacaacugguacagcaccaccaccaccaccagccccucccuguccugaaaaaaaaauagcuuuaugugagaaacgggaaaaaaaugaagcauuuaauucaaauggggguaaaggggcacaaaauuaacucaagacuucagaggaugaacguaaaagcagaaaaauacacuauaaacaaagcuauuaagccauaauaugaagggcugauccaaaaugagcaaaaaaccugcccgaacuuaauucuucccagcuccuccuuccacucaaaagguaagacauuauuaccuagcaauugauuguuuuucaaaccagccuaguaugcuguuccuucuuuccacucucuaugccugcggacuuuuuugccuuucccugugaggaggaaagaaguugggaacgguuuugguugagaaaguuuacuuuggggcaaguugucaaagauaauugugaguggagccagcaaaagaaccagcaugaucaacgguaucaauaagcaccugagagcaagacuuauuccccguaauuucaauuaaggagaauuaucuucucaaacugcguaauuauauccacuuuuuaagcagaucauuccaaaaugcuuccuugauuaaaacuaauuuugaccacaucuuuugucacaucuuccucuccauccugucugugguggagugcauacaguauuuuaaauacaugauaaauguuuuaaaaccaugauaaacauaggaaaaaaaguuucucauuuuacacaucaguaagcuguaaacaguaucuaauuguuggaaagauaaaauaugaucauuauaugaaagcucuuaucagcaaauauauuucuagguggucagcagcucauaauuuacaugauuaccaaauuugcuucuuguucuccaacucauuaaucauggccuucuaaaacaagaaccucagugacucuuuaauaaauguuucucaaucuuuuuaauccaugcuucuuuaauaagcauaaaucuuacucccuauuguacuuuuuuguaacauuuuucuaacauaacauuauacuaccaaaugugcuuuuucaaacuccaauuuccuccuccaauaaacaugacccuguaccaccccuuuaaaagaagcacugaaaucauaauaugaagaaaaucauacauaaaccauaaaauauuguacauggagaagaauaaucuauugcuaauuucauagauuacgaaagcuuaaguuauuuacauauucauucaauaaacauuuauacagaaaaaugugacuuccauacuccaaaugguacauaccuaauuucguauguaaauauuuuccucaucacuccacugaaacuauacucccuacacaaaauagaaugcugauuuuucuucuuccuuucugucuuuauugccucuucaucuccucaccaaccacaaucaacuuaauuaacuacuccuucucugugguuccaaaacagcuuugauagugcccagcagagugaaugacaaaucuucagugaugcuuaauaauauaguguuauuucuauucaaacuucuauuguaacuaauuguauucaugucugugucucucaucaggcuaguauuggagggcaagaacccaggccuucauuuuauauagccuucacauauccuucugauauauaugauauuauacauaacuccuaauagguaacaaaguggccagguacuaucugugaaauuagauuggauucuucccaugcuguccuugaaugugacaaccaucugucauccaaccuucgcucauaccauuccaagcucaggccucaucuccuacacaacguguuccaaaaccacacaagccaaugcugagauuuuucuaacauuguuagggaauauuacaugguacaguauuuuaugguacaguacauuguauaaaacacucuuugguauuuauguuuuccugaacugaacacaacuuguuccaauuagacaacagacucaacaucaaagagcaugccaacuucuugauucauguccacugaguaaagcauuuuucagguaacugguacucaauguacugauagaauaaaauguaauguacagccaagcuacauccugaugcagagcugacagggacagauguugcuggucagcgcuggcagguauccuuaacagaguaaguggcacagugccuacacucucuggugauacaaaaaaaaaaaaaguugcucauggagagagaacugcacucuacuuacaucaggcagcagcuauccuccaacuccucgaacgagagaaugagagaaacaugcaggcugcuuuauaggguagauguggaaaccaacgcucuggaaguacaguacucugacaaaggucacacagaaauucaguggcagacccggcacugacacccagguuuccugucucccaaucgagaagccuuuaguacaucaaacugcuucucugaucagguaucugaaaauaaauuaccacaaagaaaugugaccaaugaagucuuucugucuuuaacucaaacaugccaaucacuggaaaaacccagaaauaccuaugucacucacaaaaaugccacucaaaggaauuagaaguucagagaagaaacuggggaagguaaaugcuuuucuagauuccucuuccuccacccccccuugacuauuaaaaguguucccagguccuccuucagcccguuuuucacuccacacccuccuuugguguuugcaugcacagccuauagcuucaaccagcaauagacuaagaauugucaaauugaaaucucucagaguuuuuucuuuuuuuaagcucucaaucuguguauucaacugcaauuuagacaucuccaccuaugucccauggucaccuuaaaaaaaaaaacuuggccucauaaggucaucauuuccccucugcuccagccaaccagcacccccagcuuguggucacccucucaccucagugaacagcaccuccuagccagaaaccagugucacacuggguuucuuuuauuucucuuaucaagucuuaucaguucucccucccaaauacaguaguucuugaaccccacucaaaucauccuccauauagggaucugcaaagcuuucugaccacucaccuuuaucagcaaaaaaauucuaggcauaccuguacccaaaauaaaugcaauuuauaaauucagauacauguacuucuacagcaauauaguaagauuaucaaucauaaucaaaauuuuaaauuuuaaagugaugagaucaacaaacauaauaguagaccuaaaauuuucucccuauacuucagugagucuuuuuaugcaucccuggagauaggaaccugugcuuugaaauuauguacaaugagauugguccuauaagaaauacauacauauaugugcuuguguguauguguguauauacauauguauguguacuggaggcagcuuuucucaugcacacacacguuucaugaggugauaugcacacgcuuaagcauauugcuaaauauaguuaacucuaccuucuaaagucacaaaccaaacggcaaguuuaaaguuagcugaccucuaaaaacucacagccacuuuuaaaacaauaacaaauguacaaaguauaguuuggauccuuuuguacacagcuccugaaagagagaaacuuuuuuuuucaccuaccgacagacauauuggaaggcugcuaauauucugacuuuuacggacuguacccccuuuaagcuggguacauaccauaauaucuuuucaguuuuccacagcuauagauaccucuagcauaacacuucaggauucagaagacgaauguaccuuucuguaucuuaacgucucuacuccauaccucccaccucugaaaaaauaaccagccaaacucucagaaccuaaaaccaagucagaguaaacacugcuaauacaauacagguacuuacauauuuacccggcauaaucuccaggauuccacccacaaccuaacagauccuaacucucuggcagagugagaaaaucugcuaauaucuaacagaagucuaaaugaacccuuucagauacaugcagcuuguuacauauucagaaaguuaaguucucugaaacuuuuaccaguuacaagauguuucagcuuaucacacuagcagcauaguuaagggcaaaccagagcagcuacagaauauuaaugaauauguuuucagacagaacacuauacuacucaccgcuguaagccauaacuuacuuaucaagaagccaaacaauaaaagcauuacaaucaguggcaagcacgcuuaggaaaacuggcaccauguuaaguuguuugaccacuuuucauuauuauaauaugaccagauguccccagugucacucccagaguuaggaagaacaccaauguagagcuacauuuucauucgugaugguaauucggggcugauuuaaauuaaauuauacugaccagaaagcugccuaauuguuaaaauuacuaaauccagugacuuucagaauugcugauuccaugcuucucaugugcagaauguugaggguauuaaaaaauaacuuuaauauagaacuuuacauuaagaaaaucacaaacacuuaaaauuguagguuuaggucugaagucaacacagacgaguuaaacaaucuauuugcuuccuguuuacagaauuaaaguauuaaccacauucuuuguccuuuuaacuagcauucuaauaacaucuuccaccuucauacucaauuuugggauaaguaaaaugacuuucuccccaaaugccuguaaugaaaauaccaauguuuuuuauuuaacacuucaccaucuucagucacuuauauaauauugaucaaugagucaacauuauuuaaaaauaugagaauuauagugagacucuaaguccuaaccccucugggccuugauguccacaaaugaacagguaacugccaacugaaguuccuuaaucauuucuaaaauuggucuacuguauaaccuaucguaaaggacguaugugguuuaagaaaggugucuaaucuaaauuccucuagcauguuauuuuuguagcauuaaaacuacaauuaaaaaaaaaaaaauaaaaaaaccuaagggccagguucaggggcucacgccuguaaucccagcacuuugggagcucggugagagaggacagcuugagcccaggaguuugaggccagccugggcagcauagugaaauccugucucuacaaaaaauaaaaaaauuagccgggcacgguggcaggcgccuguagucccagcuacucaagaggcugagguggaaaaguaacuuaagccucggagguugaggcugcagugagcugugauggcucuucugcacuccagccugggcaacagagacccugucucaaaacaaaacgaaauaaccuaguaauucuacccaccuaaguuaaccauguggcauguuggcccaaagaaaccuuaccaaugauguuaccaauuaucuuccgagauauuuuuaacaucuuuuuacuauaaaagaagggcugaaaaggagucaauacucauugagcaucuacucucaagcuaaguuuuuuacauuuugcauuugauuuucagaacuauaguuaggaagguuacuugugguuuaaacgcggacucuggaacuagaccccaugccuucuccaggagcuccugaugaccacaggcaacuuacuuuugcucccugugccucaguuucuucacucggaaaaugggaaucgaaacaguaccaaucucauuagagcgguuccagaauuaaauaauacauguaaaaugccuagagcuaaacuuggcccucacugucauuauuauaaaaaugaauuauuaauguagauauuacuguuccuauuucacagaugaggaaacggaagcuuagagaaugcaacuuacuaaugaucauaccaaugagugcaaaguuuuggacucaaaagcacgaauuugauuaaauaaaaguuacuuagagaguaggagucucauaaauccaauuuaugaagccuaagaaaugacacgcgguaaaaugauacuagacacaggccgggcucucaggcucgcggaccgggucugagcacaagcuggccauggccaugcguccuggucccggggugcccggcagggaccggcgacucuugacguuuauaaacacggggaaguggacugcacugccgccaccgcacccccgguccccagcggcuccacuaagccaacuucuacccggcucccgccgcccccgcccgcggcgcuggccccagggccgccuccuggcagccggaggagaccaguccccgucgcgggcgccgacggcuggcucgacgcugcuccaaggacagcagcucgcgagggagcgagagacaaaggcaccggacccguccaggggagcgccgagucccaaacgccgagccccggguggccucgcuggcucccaccugcgcuugcccagcccggcgggagaccgcaggugucaggggccguucgggcccggucccccgcagcuccggcagccccgacgugacagcgcccaggccggcgacccucacguucggaacgcggcugggcuggcucugcgcccgggggcugccagcgccggggacccgaggcggguggcggcgugcggacuuccuccuggacuagccuggaauccugccccagcccccaaccgcuggcggccgcccccgcccccgcccccgcccccacccccacgcccggcacaaaggucccggcgcggcccggccggcggcuuuaagugcugccgcgcacaggagaccggaggccgcggcccgcgcucccacacccgaggcccgccggccccuaccuuuuccgcgcggcguccggggcccggcgcggugggcucgggccugcuguuccgcgacucccgcugggccucucccgcgggcuggcggggccucccgggugucgggcgcggcggguggcggcggcuccuccuccucaggggcgggaggaggggacucggcggcccagagccgccccccggcaggaaaccagccgcggccccgccuccucugcgcgucugaucccgcucccgaggccgccgccgcccucucccuccggaaacg

SEQ ID NO: 15870 - RNA, 6243 nt, Homo sapiens
aauauuuugauaguuuuuacaauacaauacaauuaauguugaucaaaauauucauagugacuaguuuuaggcuccucaacugaaaagaaagucaaaaaguuuuaaagguucaguaaaaguccaagaugacuaagagccuggaaaagauaaaagguuaaaacacuugaaauuauuaacuuaaagaaaauuagggugauggacugcuuagaaauaguuuguaaauguauaaauaauucuuaugcugacaauguugccuagcuacaucuagcuccaccagcaaugcuauuacugaaauaaucagaaauggaacucaaacuauggggaaauuauauaggauaaaagaaaaacuauucucuuacuagaaaaaaaaagucaucaguuaaugagaaugacaaacauguuucugaauggccucgguuaauaucucccuucccuacuugguagcuuggcagagacucucaagguccuucauugauaacugcaauauugcaaugugcucugcucgcuauucugcuuguaaguuuuucucaauaaaccuuguuauguguagcuagugguaugugacucguguauguuacagcuuuugaaaaacagagaguuugggcuaccgcugaagugggaaauaaccccauuggaagccuuauaccagacaaacuacuaaguugaaauggccaauaucucaguguccauaucguauauagucuuaaaaacucaagaaagaacaaauugcuuguucucagugagaauggcuauagugaucagguagcuaaggaauuacgggacaccauaaucucagauuaaguaggauguuucuuuuggauuuuuaccaugcacauuuucccuuugcucauuuugcuuugcauccuuuuuauguaauaaaucauggucaucguaaugacuauuugaugagugcugugagcucuccuagugagggcaguagucuuggggaacccaaacacacaaggcuacuauuuuuguacucuauauuaauacuguuugcuguuucuuucucagauuauauaauugauauaaggacauucugaauuauuaaaccgagaacagguacacagccauauuaguuggauaauuaucuauugauaaccuccauaauggcuggccaagcacauggugaaaaccugucugaacuggcaagaucauuccauaauauuucauacaagaaacauaaaaauaaaguauuuuucaaacaaaauguaaucaaugcacuaugcaaugcuagucuguuugguuaagaaaaaaaaaacaaaaacuaguacuugacacuccauaguggacuacugaaacuuaaacaaggaaagaaacagcucuacuuacuccagucucuguccuuacacaagcuauagaauaaauugcugccacuacugacacacauauguagcugaggauuuggcaagauaugccaagauuaguacauauaccuuuaauaauccuucuugagaauguuuuaauuccuguuacacauuuucaaugugggacaaaacccaguaaaaugugcauugcuagaaucuccagauauuauaucacacugaugacugugaucaacaccgaagaaacauuacauguugucuaggcauaccugauuaaagauaacuuuaaaugauccagggcccuguuauucagauaaauuuggagaaggcagucaucaucuggacagcaucaaaaagauacauucuauaucacuuaaagcaggcauccccaaccccuggaccacaaacugauaccaguccauggccuguuaggaacugggcaacacaacaggaggugaguggcgagugagcaagcaaagcuuccucuguauuuacagccacucucccaucgcuugcauuaccaccugagcuccaccuccugucagaucagcagccgcauuaguuucucauagaagcacaaauccuauuguuaacuucacaugugagggaucuaguuugcgugcuccuuacgagaaccuaaugucugaugaucugucacugucucccaucacccccagaugggaccaucuaguugcaggaaaacaagcucagggcucccacugacucuacauuaaggugaguuguauaauuauuucauuauauauuauaaugaaauaauaauaauaauaaaguguacaauaaagguaaugugcuugaaucauccugaaaccacccccuccauccuggucuguggagucuuccacgaaacuggucccuggugcuaaaaaggcaggaaacugcugcuuuaaaggaaaauuuaucgggccuccagucccaaccacaaacgauuuuccuuguuagguaguggugauaucacauuuuacaccuggugauucuucaaagcacuauaucaaugcaacuaauuuaaaauagaagcccauauauuaacaugccuuggaagaggucuaggcauccuaaaaacaaguucuaacuuuagauuuugccguaucuuucaaacucaugggauuacacauaccuguaagaaaccauuuucugacggaagcuuuuggcaaaaauacuucaaguuauuugucauuuccuacaucuuuggaugaaaugauuuucuucuccugcugaguggcacaugccagugacugcuagccuauuacugagcccuaauggggcagacuuuucucacucuucaacccgacauuccuaucgcauuaugggucuucucuaauccaaaaucugauaaggugguacaugcccaggaaaauucuauuaaaagggggauauagcacauccaaucaauuagaccuuagacaaauucauaaaauauggcccuacacucacaggcacagagaucccucugcuguuuuaaacaagccauugacucaguaaggcacuugccugaaagauuugccaccugacaagaaagcaugauucacuaauggaaaagccucucucaaaggucauaaaaucuuauggagugauacauuccuucaccauaaugauggugaguuguugagaucccaugguauuggacaugcuucaaaacuggguaaacuucaggcauucuucauggccauagagcacaaucuccucagauugacugaauugcacuauuauaaagacuaaugagccauuaguaaugagccuaguuacacugucaggcuauuggguucccuaggacagaacucuuuauuuuauuuuauuuuauuuuugagauggagucucgcucugucacccaguggcacgaucucagcucacugcaaccuccgccucccagguucaagugauuccucugccucagccuccuaaguagcugggacuacaggcgcgcacgaccaugcccagcuaauuuuuguauuuuuaguagagaugggguuucaccauauuggccaggcuggucuugaacucuugaccucgugaucugccugccucagccuccccaaaaugcugggauuacaggcgugagccaccacacuuggccaacagaacucuuuacacaugcuuuucugagguaacauuugcccaaggaaauaguuacaacaacuuagucacaagcucaauucuuauauucuauguuuauauguccaugagaaagaacugaaucuaaaggaaaacaugugacaugaaaaagccaauuaagaauguguaaccaucaucuccaguauagucuugggugccuguucaaauccaucccgcuaugaaggaacacaauggccaauaaggaauuuauucaaaagacauagaagucuuuaggaagcugaggugcgaaaagucccugaguccaggaguucuagaccagccugggcaacauagggagacugagucucuauaaaaaauaaaacaauuggcugggcauggugaugcaugccugugguccccgccaaucagacagcuaaggugggaggauggcuucagugugggagguugaagaagcaguaagccaugauggugccacugcacuccagccuaggggacaaagugauacccuaucucaaaaaaaaaaaaaaaaaaaaagacacacaggccacuguuguccaucaggcuuauucuacuugccauuuaaggcagccuuuuugaaaacaaccuccacaaggcuugucaguccaguuuucccuaauuguuuacaagcuauaggcuaccguaccaagcaagggccccucuuaccaugguuaaacuccaaagcaccuagaaguuagggaguagagaaaaauaucauuucaagaggaauaguauacuccuuuucuuuuuuuuuuuuuuuuaacccccuuugcuuugaccucagugcaugggaacacacaacauauugcucauuuaaaagcaacagauggugcugcagacauccucuuugaaaccugcaggugaccuaugauggcaaaaugguaacuuugggguccccacugaacuaucauuccagacaaaggacaaucuggcucaucuccauggagaaaaacagaucuguuugucagaugugaacauaucugacccugggaaaugguuggagauggauguucaagggaggugaugaacgacuuucucuuuccuauggcagauauggaacagacauuccuaaacaaagguuucugugcuuggccaggaaaaagaguucauaaugugaacuuauuaggauguugguucuacauccucaucuaacccagcuggugaccuuacuaauauucuucucccagacaauacuaaggaaauugguaugcucagaaccaggugucagccagggcugauggagagaucuauaauaaugagucucuaagaucaaaggauagacagcagugaggcaaaucuuuauuuacggauggucccggugauucucuuucuucccucuuuuugugguuucacagagcuggcucaccaggacuguuugacucacugauaccagcuacauugguauacaaaguacauacucccuucucccuuuuuccaacaaggccacugccccaaccaggaagcucucagugauacaugguugacuaggugcucucuaugcccucccaauuccccuauaauuuugugaagugauaugugagaaggggguuccucucaggagcaucuucuauggugaauccagcuuugcuuaaucuaagucuauuucucuacggaauaaugacagcucaggggauauuauauccucuauugcuuccuggauugcaagguuuccucuauaaaaucuaccuuaugcguacuauuugggucacuaguaauaugccccuuguguaacaguuaacugaggauauuaaaagcuccucuagucuagaucuuuuaguuauaacauacauuuucauuugcagaaauuuauuuugauaaaaauugaaaagaaacaaaauauuuuaacagccuuuauuucacaauuagauaaugccuuuucuucauuguuaauaccuuccuugaccacccaaucuaaauuauccuucccugugacugucagauauguaguuucauuaucuccauguauuagucucuaaaauuaucuuguucauuuauuuuuacuuguuuauuuuuugucucuccuguuauaauguaaguaccacaagaaaaggcaucuuaucugucugauuuuucaguaaaacacaauacccaaaagagaacuggacauaugaaggugacaaaaguaucucuugaaugaguugggugaauaaaugaaugaguaaauuuaacagcuaaucaucuaaucuauggagaaaaaaaauggacauguuccaacacucuucucuuguauguuuucgugcuugauagcaaacccaaguaauaaugaaaguccuaaugaaaguauuuagaaagaacuagguugacuguguaacucuucaaaauaaaacaccaugaauuaguucacauuuucauuucuaaaaagugugaauuucaaugccacaaaacauuuaagaaaagcuaacaacgcacaugaugugaaacaauaaauuauuaaaaucuauuguuugauuaacuauuuaccacuaacucauucccuaagccaaaauaaacugauaaauguuguaaagagcaaaaauguacuuuauuguaagcaauaccauguaucugcucagguggggucuccuuacuucgcucccauccacucucugaagguuugggagacuuuuccaaaguauuucagaaacucuauuagcaucuaagaaguaacccaaaaugaagguugaugaauaauauugugccaugugcuuaauaguuugaauuuuuauuauauuuagcaacauaauauaauauguaauauauuauauuauuauauaauauauaauaauuaaccuaaagcuauuaagugcaauucuauaaaaccuaucaagcu

SEQ ID NO: 15871 - RNA, 7836 nt, Homo sapiens
agcugcgcucccgagguuggaccuacaaggaggcaggcaagacagcaaggcauagagacaacauagagcuaaguaaagccaguggaaaugaagagucuuccaauccuacuguugcugugcguggcaguuugcucagccuauccauuggauggagcugcaaggggugaggacaccagcaugaaccuuguucagguaauuaacacuaacugaccuggccagguggggagcuuccagaguaagcugaaaccauucugugugucuuaaaacccacauagaaugcuugagcuuacuguguaggaacaguucaagaauagagaguuauagaguguuggaaguggaaaaggucucauuaucacaccauuugggcuucuccucuuauguaggaagaaacaaaggccagaaauauuagguguuuucuuaagaucacacaacaccauagcaguagcagcacuggggcuuaaggcacaugaguaacaaguggagaguggaugaaccauaucuugcuuuggaacagcuucaguuuuuuuuuuaaugcaacguaauuuuagcuaaauauuuguguugcuaguaucauauuauaaaauuugccauuauuucagcaagcuagagaaauacuccaaauagauuaagaagugagcaacugcaaaaacuuacuauaaauagauagcuauaguaaaaauuguaagagugaccuaaaaacuauacuuauucuguuagaaauaucuagaaaacuacuacgaccucaaaaaagaugugaaacaguuuguuaggagaaaggacagugguccuguuguuaaaaaaauccgagaaaugcagaaguuccuuggauuggaggugacggggaagcuggacuccgacacucuggaggugaugcgcaagcccagguguggaguuccugauguuggucacuucagaaccuuuccuggcaucccgaaguggaggaaaacccaccuuacauacagguaaugguucagagggguuuucacauaagauuggaauuuuauaaacuauaucauaggagaaaauagcaucugcuucaauuuuucuccuacaggauugugaauuauacaccagauuugccaaaagaugcuguugauucugcuguugagaaagcucugaaagucugggaagaggugacuccacucacauucuccaggcuguaugaaggagaggcugauauaaugaucucuuuugcaguuagagguaaaaaaaaaaaaaaaaaaaaaaaagcaaaacaaaacaaaacaaaaaacacaugaaauguauccauucaucuaucugguguuguuguacuggaaaaggcucaaaagggauccuuguuacauaucuuuccaauaaauuuuuuuccuacuagaacauggagacuuuuacccuuuugauggaccuggaaauguuuuggcccaugccuaugccccugggccagggauuaauggagaugcccacuuugaugaugaugaacaauggacaaaggauacaacagguuaguuacacaucucucagaaugauuuuggcauuaauuuuuuuauauguagaaaucuguuaauaaccaagaaugcucaagaaaugagauguucuggauuuuccaguggaucagagaucagcagaauauauuuuuguuuuaauuauuauugaaaauauuuucagaugcuuuaacaguuuuccuauauugguaagcacaauauaggaaauaucauuaaguauuucuuuaaugacuggaucuuugugaucuagggguaaccauuauuaagaaaaauuucucauaucaaaauacaaacauucaagggauaguauauugcacugaaucuacauuaaaaugugcucuggauguuacuuauguaauuuccuccauuuacuucuuuacucuucaaaccagaaauaagaauuaaauuucagaaacugagauucucuuuuuuuuuuuuuucuggcugaggcauuauuuuaguacuuuuagguuaaaagaauuuuuaugggcuuguucugaaggaaaagacuaacucccaaauacaacguucaaacuguuuagguagaagaauguuucucaguucauaacuguauguuuuggggaaugacauccaaaguuuucaaaaaaaucagcuaaaacaauuaacacuacuucuaaaaaaauaggaaaacaauuaauacuaugucugagguuuaacugggauuuauaaugaaaauguaaaccucuguaggacguacaaaugugaguuuaguccuggauagaauucuugauugguugaguuaacgaauucuuguaaagaaaccuuccugcaaacucucaaaugagauuguuccuagcaucacaaguuacacaaguaauacuagcaaaaguaagguagauuuacuuacuauauugaucauaauuacccaaugccucccaauuuuagcauuauggguguuuuuaaaaauaugaaggaaaaaauuuugaauaaagccaguguuuauguauucuaaaucuguugugugacaaaugcuagacaugauugggcauacuguguuuuaaaccaauuuugcaaauccuaugacaucuaucauuauucauguuuuuagucucaauauguacuucaugaugaugaggcugagacauuaucaauuaacaugaauauaguuuccuuuaacugagacugcaaauggcaaauguaaauauauuaaaacaguguuuagcuuugcauugacaaaugaagguaaauaucugauaugcuaagcaaguggguucauuccauuccugaguacaagaaaagggaucugguucuucuggaguuaauaugcuugugaggcuggggguggguuuggggccauggggggcaaguggauguaacugggaaaucaaucucaaagauugauuacagguaugaguuuuaaaauacacuuagcuuuccauuaaguguguaauuagucaauuguucaauuaaccaacaaacaagguguaaaaagcccugugugguuccaagaaguaaaaaccaauacaaugcacagcagaccuguguaaugcacauguauuuaaaaaauaaguaacuauuguucucaauuucuuaaauagggaccaauuuauuucucguugcugcucaugaaauuggccacucccugggucucuuucacucagccaacacugaagcuuugauguacccacucuaucacucacucacagaccugacucgguuccgccugucucaagaugauauaaauggcauucagucccucuauggugagugacacugggaaaaucagccauuguaguuuugcaaugauggucuucagaagagcuuucaaaugcuacauaaaguauuuaugauuuaguucaaagcaccgugagaauguuuggaaagcauacaaaugggcauauauugaaacguaucacauuuccccuaauguucccuuuaggaccucccccugacuccccugagaccccccugguacccacggaaccugucccuccagaaccugggacgccagccaacugugauccugcuuuguccuuugaugcugucagcacucugaggggagaaauccugaucuuuaaagacaggucaggcugaaaaauuauauuuuccuaccauuuuaaucuacaauguuuagaaaggaaaacacgcagaaacuugauagagauucuuagacauuuaaaacaaaaacguuucuucugagcuuggaaucauuuagaucuggugcugccuuuucccacauuuuccuaaaauugucagguucauuuuugaaggcacaggcugaucugguucuuagcuucuaauugcuguuuccaaaugucuuaagucacaguuacuuuucaaaaggcaugaguagaucuuucgaauaauaauuuuauuuuuacuuccuuuaaaaaugacaucaggaucaacauuacauuuaaucaaguaauuuacuuacugauggaucaauaugcacaugacaaacauucaaagagcacaaaugagaagcaaauuaaaaauuuuaguucccaguucucccuguacucauccagagucaagacuuuuugugcauccuuccagaaucuuucuacacacauacaagaauauauuuacacagcacauacacguauacaaacacggccuagcuuuuggaagaggguauagcacacgcacuguuuugcauacauugcagguaauuaaagcuuaugcugggcuaauucauuugcacgauagaauaauuuuucuuucauagaagacauuacucuggaaaccuaugacgggagacucacuacagucuucugaagaaaaaggaaagaaauuuucuaauggcaauauaccugauuucuaucugucauccagccuagaagaugagagaaugggggaagcugggugaggcaagacggugaggaaaauauucuaaaggugaaagauuguuuuucaauuuacauuucuuuuuacauauauuuuaggcacuuuuggcgcaaaucccucaggaagcuugaaccugaauugcauuugaucucuucauuuuggccaucucuuccuucaggcguggaugccgcauaugaaguuacuagcaaggaccucguuuucauuuuuaaagguaauuacuauaucaucauuuguuuaacuugccaaaguaaacccucucauaagaaauugaacaacacuuuaauuuucccuacuacaaguucuggcuaauacaguagucaacgguaaugaagaaauaaccagggcugauaucauuguauuuauauuucauagaugauaaaaauaaagacaagaagauaaauuacccagaguuguaaauucucucauuugaccuuaguucauucauucagucugcaaauuuuugugaaaagcccacuguaagcuggugacuaaaucuaaaauuugggcuacuacuuuaccaugaaaaucaaagaugcuaaaguguauuucuaaagcgaaagggcuuaacuguuauaauucaauaugacucugaauuauuuauauuuaacaggaaaucaauucugggcuaucagaggaaaugagguacgagcuggauacccaagaggcauccacacccuagguuucccuccaaccgugaggaaaaucgaugcagccauuucugauaaggaaaagaacaaaacauauuucuuuguagaggacaaauacuggaggugagaugcaagagaaaugacuuuguauggagccuaauuagggaaauuaguuucuuuuacuaaggaaaucccccaccccaaccuuaggccugcuucucucuuaguaggaaggaugggacuucagacaacugugggaaaguucuuacuuuaaaacagcagcaccuuaggcucuccugcuuucagucccaagugcaguuggcuggugcuucccuuggugcugucaccccaccugccuggagcccccucuucucuccucaaccuauucaaaucuugcccauccuucaaguccuggcucaagucucaucaccuccaugcagcuuucccucguggacuuuagacccauugggaaaauguucugagaacccagaccgcaauuuagcguucccuucccauugucuuuuaguuuggcucacugucucacuguguguuugucacugucucauuguguguuuguuuugucuuccuaacacuacuauaugauuuucaagggcuaccucuaaccucacccacuugucaccucuaccugauaaugauggcucauuuaagagaugaugaucaauagcaguccaguuuauggauacaacccaacacucacagacagguugauuccugggucauuuggccagacuuugagacaucgaggccgaccaucugauauccagccaaugggcuaaaaacacacuuacugugcuuugcuucuuauccuaaucccuuuucccaggaggccaccagagaagauuuagaugugcaggggaggggacagcaggcauauaugggccaauugugguagggaauuaaaauugcauuuuagauguugauucaauucacuuuauauauauguucacacuuucaugucuuugugacagaaagaugauuaagguucuuucuguccaggcuuaagaaauaugaugacaaacagcaugugcuacauacagcaggaugcggccccuguuccggauggagauauggcuuucagaacucuuuacaguaccauuaaagucacauauuucuauagucccaaauaugcuuggcauuuauuugcaguauuuauaaaguuuaguaaaauuccacauuaaaccuaacaugaucuaagauguucgguaacauggccucuaugcaaugcugagcuguuucuuuuacuugguacagauuugaugagaagagaaauuccauggagccaggcuuucccaagcaaauagcugaagacuuuccagggauugacucaaagauugaugcuguuuuugaagaauuugguaagaggauacuuacuguguuggccauagagcacuugaaacauuuuaugauaucagagggaagaggagcauugaaacuuuuuaauaacaaguguuucuuagggccaguucccuucucaaaauuuugauucgccuacauuuguacucauuauagaacuacuucacaaaauaacuuguuuggaaccauaaagauaauuacacaaaucucgcuacuuuaucuuauacaugcauauaaaaucaaagugcuccagugucacuuacaucucgagcuaacauguggagucaagcucgacuuucagauuaccauguuagcauaaaaaucccaucaagugguguggccagguuuaauguugguuagcuggccuucuccuccacccuaucuuauugcugcuacuaauucccagggagauuuuuugucugucuuuccugaguugucagucauugcccaugccagucauuugcaaauacuuaccuuuccaugugcccaaaguuuaaaaaaaaaaaaagauuuuguuuucuacucaagguaaggaaguggaggcugaugaucuuuauugaaagguaaccugaucaccauguuugcagagcacuaaaggguccccugguguuuugaaauaguugcugugcuuccuaggcugcaaugcagggaaaagggaggaggauuuuuggggaagaaagaaauaggugaugagaguuuccaagcaaguggagaauuuaucugaucggaagcagaauaacccuguaaccuggaaucuggcuguguuuucagacagagcuggcaccgagugcugucuccauucuuccuugcugaguaaccuugaggaagcaucgaaaucugucucaaccucaacuugcucaaucuguaaauggaguuagacauacaaccucauaggguuguugcagaaauaaaugaaaauaaauucauguaacaagcuuggcauagucccugacauaaaguaaagcucuauaaacacuuucuauuuuuaguucucuaugauucugaguuuuguauauugucaaaugucuuuauuuggaaaaauaucuuacuauuucccuugucuguauuugcaggguucuuuuauuucuuuacuggaucuucacaguuggaguuugacccaaaugcaaagaaagugacacacacuuugaagaguaacagcuggcuuaauuguugaaagagauauguagaaggcacaauaugggcacuuuaaaugaagcuaauaauucuucaccuaagucucugugaauugaaauguucguuuucuccugccugugcugugacucgagucacacucaagggaacuugagcgugaaucuguaucuugccggucauuuuuauguuauuacagggcauucaaaugggcugcugcuuagcuugcaccuugucacauagagugaucuuucccaagagaaggggaagcacucgugugcaacagacaagugacuguaucuguguagacuauuugcuuauuuaauaaagacgauuugucaguuauuuuaucu

SEQ ID NO: 15872 - RNA, 10123 nt, Homo sapiens
gcuagaagcccaguagacaaagaagguaagggcagugagaaugaugcaucuugcauuccuugugcuguugugucugccagucugcucugccuauccucugaguggggcagcaaaagaggaggacuccaacaaggaucuugcccagguaauuaacgguggcaucuauugcagcuacuggccagcucaauugugucuacuuggucuuccaauacaaagcagaaugauuagacuagagaucacuuuguuagaaaacuguagcaucagagaauaauuaacaggcuggagguggaaauuauuuuuauguuaacagagaagaaaagaaagguucagaaagggaauauaacugcucaagguuacaauaaaauaguagcaguauauuuguggcuaagugaaaagaacauauggagaauauaugaaacuccucuggcuuuagaauuuauuuaguuaaaauuauuggggaggggagcaugcuaaguuugaucuuuaaaucauaucagguaauaguuuucauauuuuuacuugucauauuuggacaaaagaguuuaccacacuucagucuuaaaccaggucuauaauaacaauguaaguagaaaagguuaguauucuaacuuuucacaaaacuauguuaaaagaggguuucuuuaaaaacuaacaaaaauaaugcuagacuugaauuuucaauccccaauuccuuacuugacuagcaaacuaacauugcaauaaaauuuaaaaauuuguaugaaauggggagucuuaaugaaaaaucaaauuaaaugugauagccucuuuuguuuuaagaaacuagaggaaaauuacgauggauuauaaaaguuggauaaaugauggaaaaucacaaaaaugcccuaaaaauucuauuuuccauuagcaauaccuagaaaaguacuacaaccucgaaaaggaugugaaacaguuuagaagaaaggacaguaaucucauuguuaaaaaaauccaaggaaugcagaaguuccuuggguuggaggugacagggaagcuagacacugacacucuggaggugaugcgcaagcccagguguggaguuccugacguuggucacuucagcuccuuuccuggcaugccgaaguggaggaaaacccaccuuacauacagguaaugguucagauuaguuuucacauaauauugaaaccuuauaaguuacucgucauauuuggauaaguaacauaaaguuuucuuuaacaauuuuucauaaaggcaggagaaaauaacauccucuucaauuuuucuccuccaggauugugaauuauacaccagauuugccaagagaugcuguugauucugccauugagaaagcucugaaagucugggaagaggugacuccacucacauucuccaggcuguaugaaggagaggcugauauaaugaucucuuuugcaguuaaagguaaucaaauaaagcauccauuuaucugguguauucaucuguucagacugcuauagcaaguuaccuuagacuggguaauuuauaaacaacagaaauuuauugcucacaauucuggaggcugggaaguccaagauuaaggugccagcagauuuagugucugaugagagccuauuccucauagaugguaccuucuguguccucacacgauagaaagggccaggagguucccucaagcuucuuucauaaaagcacuaaucucauucaugagggcagagcacuuacgacauaaucacuuccuaaagaccuaaccucuuaauacuauauuucauugggcauugaguuucaacauaugaauuugcagcagacaccaacauucagacuauagaaucuacuguuguuuaauuggaacaggguaaaaagaaauucugaacacuuauauuuccauuaauuuguucccuaucagaacauggagacuuuuacucuuuugauggcccaggacacaguuuggcucaugccuacccaccuggaccugggcuuuauggagauauucacuuugaugaugaugaaaaauggacagaagaugcaucaggugggucguaaaccucucgggaacauuucaggaauaauguccaauccuacccaaaaauaauuggauuaucuagaacgagcaauaaaucgaauauacuaguaacugaauuuuuuuauuaccugaguuuuaaacagaaguacuguuuguuucaaucauuauugaagaauuuuauaaaaugucuguauuuucauguuugcccccaccaaguacaauauuguaaaaaccauucaaccucaucuccacaacucaggaucuuguggggguuugaggaucagcauaauuaauaauguuuuucaucacuuuaaugauagaugauuaggauagaaugaauuccauuaaaccaguuccaauccuaacauuugcccucagguuuucuuucuuucuucucauuggccuccuuuuuacuuaaaaguagagaucaggagaaaaugccaggaacugaaaaaaaacuguuaggucaucuuuucgaauaaacaugucacugucucuagcuuagauggguuuuuuucgcccuaaauuggcuuggaaacacuuuacaucuaaacauaaugacuaaaauuaacuguaugcuauuuaauuuuuaaaauggcuucugaaguuuagaaacacacuguugaaauaaucacuauuucugacagugccugggauuuuuaauguaaaugcaaagaacaucuuuccugaguacaagacucaggaggcugaggcacgagaaucacugaacccaggagauggaggcugcagugagccgagauuguaccacuguacuccagccugggcaacagagugagacucugucucacgagacugaaguuuguguugcaugaaaugauugccuuuuauuugaacaacuguucuuuucugcacaauucuuggagccuugguuaaauaauaucuacuacuaaauucaauaaaacccuuuuuauaauauuuuuaaaaagcugaaucuagcuguguuugugcugcagaaaacuguuauugggcauguuucuguuuuaaacuaaagauuguacacauccaauggcaccuauuacugggaagauuuuugacaaucaaaaauuauuugauuauggccaggcaccaguggcuaaugccuguaaucccagcauuuugggaggccaaguugggugaaucacuugagaccaggaguuugagaccagccuagccaacauggugaaaccuuaucucaacaaaaauacaaaaauuagccgggcaugguagcacgugccuguaaucacagcuacucaggaggcugaggcacgagaaucgcuuggacacauacuccagccugggcgacagaaugagacucugucucaaaaaaaaaaauuacuugaguaugaugaagaggaggaagagaaaaucagacuaaaccccacaagaaauaaccacagucuucuggcuuaaaaguuugaacguaaauguuauaugauuaauuuuaaccaagguugcaacuggcaaguguuccuaaauuugaacaaugacuuuuuauuuuuagacaacgaagaguuauauuuacugacaugcuauuagucuuguccuuucaaaaaaaaaucuuuugaaaauaaugcuucucauuugucaauauaggaaaagugucuuaguuuuccugaccaaggagggaucuagggagggauacggugaaaaacugucuuauauauugacuuaaagucaaccuugaaaaacacauuaauuucuauaaaguauggaaugugccaaucaaugaaccaauccacaaauacugaaaagacauugugguuucaaggauggccuguacagcuggcauauguucuguauguguauuuauggaagaaagagcuggugaauucugaacauuuaugauuuucauacaggcaccaauuuauuccucguugcugcucaugaacuuggccacucccuggggcucuuucacucagccaacacugaagcuuugauguacccacucuacaacucauucacagagcucgcccaguuccgccuuucgcaagaugaugugaauggcauucagucucucuacggugagugaugcuggaaaaauuaggcauugcagaucuacaaugacaguccuccagaaagcuuuccagugcuaccuaaaguauuucugauuuggccugaagcacuuugagaauguuugaaaggcacacaaauugacagaugcaucacauuuuuuuuuaauguuugcauccccaaaucuguuuccuuuaggaccucccccugccucuacugaggaaccccuggugcccacaaaaucuguuccuucgggaucugagaugccagccaagugugauccugcuuuguccuucgaugccaucagcacucugaggggagaauaucuguucuuuaaagacaggucagaccagaaaauuauauuuuccuaucuauucuuuugauguacagugcuuagaaagaaaaacagaaacuugacagagcuuuuuuuuuaauuuuagguucagggguacaugugcagguuuguuauauagauaaacucgugucacagggguuuguuguacagauaauuuugucaccccaguacuaauccuaguacccaguaguuacuuuuucugcuugacagagauuuuuuaaaauauaaaauuuccucuacauuuuaaaaucauucagaucuaguucuugcugaauuuuuaacaucuucuuagaauuguccagaucauuuuuuacagacuuauaagggaugauucuuggucccuagacuguaaguuugauuaaggcagggaguuauaucuguuucguucauuuuuuuaaaauaucauauaucauggaacuucuucagaaagcacugguggauccuuagaagcagggugguaucuuuccauuuacuaauauaugcuacuauuuaaauuaauuacuuuuggaaaaaagugauaugugcuuguggcacaauauuuaaacacuaccaaaagauacggaguuaaaaaaucucucuccagucuuuggccuaccguccuccagcucccuucauaugugcaaccacugcuaccaauuuccuuugacucuuuacaaaaauguucuacucauauacaagcaucaauauacacauaauauuuuuuaaaauauuaggacauaauaugcacacuguuuauggacuuuuagaauggaaccaagcuaaauaauuuuacuggaaccagucacaaguccugccaucgauuucauuacccuggaaucacaugcaggaggaugguuuaauacagacuucuaugaaugggugaauuagcauggauuuaaaaaaaaagaauuuuuuuuucacauaucuaaaagagaaagacaauugcaaguaauuuuauguauuacagauauuuuuggcgaagaucccacuggaacccugaaccugaauuucauuugauuucugcauuuuggcccucucuuccaucauauuuggaugcugcauaugaaguuaacagcagggacaccguuuuuauuuuuaaaggugaguacuauauaagaauuucaacuugcuggaauaaauccuauugcaaaaauuuuauugacaugaguuuuauccauuauauuaaaguuuagauuacugaaagaccuugugcuaacacuuaaauaaaauuuguacaaagaacauuauaaacuuuauuuuagagaccucuuaagaaaauagguggcauuccauauucauaaaaaaugcaagauaguaaaaaugucaauuuaucuauagauacaagacauuuucauuucaaauaccaaaugccaaaagauuuuucauggaacuugacaaauuaguuuuacaauuuauauggcagaggaaaggccaagaauagccaggaugcuccuggugaacccaucuuauuagaugaggagaaaagcccuguguuauaaaacuuuaaucgguaagauguaguaucagugcagggagagauaaauuaacuaauggagauauucagguauagaggcuucuuuaucagacuuuuaaacuacuguuucaauuuguuuuauugguaauaugcuauuagaguuucuauuacuucuugagucaguuuuguuaacauguuuuucuaaaaauuugccaauuuugucuguuuucaaauccaucagaaaaaguuuuuggaaaauuauuuuguuguaauuugaauuauugcugaaguuuuguuuucuuuuucauucuuaauacugaauccuuuugccuuucucuuuuuucuucaucaaucucauaauauauguaauaauuuuacugaucuuuucaaaggacugacuuuuggcuuuauuuacucucuauauuauauuuugauuucccguuuaauuaguuucuguucauaucuuuauuguugccuuaauuuuuguuuacuuugaauugauccuguuauuauuguuauagcuuaaguuugauacuuaccuuauuaacuuguaacuuuuuucuuuucuaauacaagcauuuauaccuauaaauaaccauuucuucuguuucauccagcaaauuucgauaugcaguauuuucauuuuguucaauuuuaauucuuuaauuucucauuuuuauuuuuucccuagacucauaggugauaauggaauauuuuuaaaugucaagcuuuauggagauuuuaaaaauauuuauuucuggcaaucucacuuaugugaagaucaaaugaaugugaaauugcaguagaaauuguaaaggauuacauaacucuaacguauuguuaucaaguaauguaucucacauuuacauaucacuugcacugugucagacgccauucucauugguggaggucaggacugaaaagggcucauauucuagaaggggcagcagagaugaagccuuuggcagccuacauaugacaagugcugggacugagagaaggaagggugccaugggagcaccugacucauacccaggacucagcaaagaucccuuaggggaggugauguuaggaugggucuuaaaguucucuauuguugugcagagaugggcuggguguacagaaaguagaaaggucuuuaagaaagaagaaauuguuuuuaccaaguaagagcauaucuggaacugcucagacagauacaagucauucgguucagacgaagcaagagagauaaacaacagauggacauuuuagauuagugaaucuggcagugagugcgaagaaggaauucaggcuuggggucugggagagugauguaacaaaguaaaugcagagagauugaugggauuuuauuguccuaacucacuagaauuugaaugaauuccgauaguguucacaagaagcacagauuggaauuggugacugugaaauaucucaaaggaaguguccaauaagcaacugaucuauugguaugaaacuuaagagagagaggucuaggugagaaauucagguuaaaaguuuaccaacaauuauaagaaauaacuaaaacugaucuauaaauaaacuauaacauauagauacaaauauauaagacacagaaagggcagugaaucagaguuaucuacucauuuauucauucauucauucacucgcucauucagggaguauuuauuaaggacuggcugugaacuggacauuauuagguuggaauuaaaaccaagccuuccucuuuaccacaacaaugcacuauaauuauuuuuaaaaucaauggcuucaaguaaaaugucuuggauuuauuuuuucaauaggaaaugaguucugggccaucagaggaaaugagguacaagcagguuauccaagaggcauccauacccuggguuuuccuccaaccauaaggaaaauugaugcagcuguuucugacaaggaaaagaagaaaacauacuucuuugcagcggacaaauacuggaggugagaugcaagagaaaugacuuucuaugaagccugauuaagaaaauuauuuucuuucuuuaaggauauuucccuacccuacacccacccucuaacuuucucuaacuucaaaauuuaugauuaugaggaagacagcuuauuguucuaccuuccggauacaaaggccucucagaauggugaucacugggccauauacucagacacuaaaagacaucaggagaggccagcugagguccaaaggcauucaccucuuauuccauuuccagucaccauguggcugccauaggaagcccagguguggcaggcuuuggagacaggaucuacagggucccagugugacugagaaccagagguuuauuuuuagcuaagugauuuaauuaauuuugcauuaugaauucauuaugucuacacagucuuuauguauuuauaguagacacagggaaauuugguuucuguguguccaggcuuagaaaauuuaccucagacauauguauggaaccucuguaaaauggcauaauguuccuguuucuggaaaauauuguuuuauguguuaaacuuguaagcccaggaaaguaaccuauucuuguagcucuaaaaauguuuaacacuuuuuuacacaacuuaaaaaguuugucuaggauuccacacuggaaaauuaacaucacauuauacuauuguguguaaugggacuacugcacaucauugaacuguauuucuuucauuugguuuagauuugaugaaaauagccaguccauggagcaaggcuucccuagacuaauagcugaugacuuuccaggaguugagccuaagguugaugcuguauuacaggcauuugguaagaagacccuuauuucauugucaugcaggaaucuccaggcauuuuuaugauuucaaaauaaagugcagaaucaaaacaguuuuuaaaucauucagucugauaucuuuuuuacuccaaauuccugaaaaucuuaacuuuccaauuuaugcaaaguggguuuaaauuuguguguguguguguguguguguguguguguuuuccugaauaacuuccuagucucuguuucauauccgcacauaaaaucaaaggauacuuccucacacagaagccauuaucuuucaggucacuauguugguauaaaaauacaaucugugugagccaggcuuacugauggcugguugucauucuacucuaucccauccuguugucccuuuucuucuaucccaccccaggggagccuugucugggcuucuguugcagucugcgauugccugcauuagucauuuguaaauaaaauacuaguccucccauaugcucaaaauaggucaaaugugauuccugguaaugggcaaauaggaaagcaaaacuuguucuugauuacucugaaggaauuuuggagggagcugccagugcuugacaauccaauggucaugaggcugaugaucuuguuacuaaaaugacuuaaccaugauggaugcaaagcaggaaauggaccucuggcucauuuaucauuugucugauucucuugggucuaguugucucccaaacuguaauuuagaaccuagcagaagaggggagguuggaaagaaaguaaaacaagguuuuaaaauauuauagaauuuuaucucuuuagaaccaguaugacguaauguuuuagagcacuuccuuuggagucagaugagauggaguccucccuccuuccuuccuuacagaugcuaccuuguuaaaauuacaaaaccgucuuaauuuuuaguuuuguucucauuaauaacacaucacaguuuuuuguaaggguaauugagauaaagcauguaaagcacuuagcucagugcuuggcauagaguaaucacuuaauaaaugcccuccauuauuaacuuguacuuaaucuaaguuauauguguugcaaaaugacauauuugaagaugucucaucauuuuccuuaucuauauuuacaggauuuuucuacuucuucaguggaucaucacaguuugaguuugaccccaaugccaggauggugacacacauauuaaagaguaacagcugguuacauugcuaggcgagauagggggaagacagauauggguguuuuuaauaaaucuaauaauuauucaucuaauguauuaugagccaaaaugguuaauuuuuccugcauguucugugacugaagaagaugagccuugcagauaucugcaugugucaugaagaauguuucuggaauucuucacuugcuuuugaauugcacugaacagaauuaagaaauacucaugugcaauaggugagagaauguauuuucauagauguguuauuacuuccucaauaaaaaguuuuauuuugggccug

SEQ ID NO: 15873 - RNA, 2432 nt, Homo sapiens
auuauuuuaaaagauaauguagccaaaugucuuccucuguguuaaaucuuuacaaaacugaaaucuuaaaauggugacaaaaauucuacuucugauagaaucuauucauuuuuccaauuagauagggcauaauucuuaauuugcaaaacaaaacguaauaugcuuaugagguuccaucccaaagaaccugcuauugagaguagcauucagaauaacggguggaaaugccaacuccagaguuucagauccuaccgguaauugggguagggaggggcuuugggcggggccucccuagaggaggaggcguuguuagaaagcugucuggccaguccacagcugucacuaaucgggguaagccuuguuguauuugugcguguggguggcauucucaaugagaacuagcuucacuugucauuugagugaaaucuacaacccgaggcggcuagugcucccgcacuacugggaucugagaucuucggagaugacugucgcccgcaguacggagccagcagaaguccgacccuuccugggaaugggcuguaccgagagguccgacuagccccaggguuuuagugagggggcaguggaacucagcgagggacugagagcuucacagcaugcacgaguuugaugccagagaaaaagucgggagauaaaggagccgcgugucacuaaauugccgucgcagccgcagccacucaagugccggacuugugaguacucugcgucuccaguccucggacagaaguuggagaacucucuuggagaacuccccgaguuaggagacgagaucuccuaacaauuacuacuuuuucuugcgcuccccacuugccgcucgcugggacaaacgacagccacaguuccccugacgacaggauggaggccaagggcaggagcugaccagcgccgcccucccccgcccccgacccaggagguggagaucccuccgguccagccacauucaacacccacuuucuccucccucugccccuauauucccgaaacccccuccuccuucccuuuucccuccuccuggagacgggggaggagaaaaggggaguccagucgucaugacugagcugaaggcaaaggguccccgggcuccccacguggcgggcggcccgcccucccccgaggucggauccccacugcugugucgcccagccgcagguccguucccggggagccagaccucggacaccuugccugaaguuucggccauaccuaucucccuggacgggcuacucuucccucggcccugccagggacaggaccccuccgacgaaaagacgcaggaccagcagucgcugucggacguggagggcgcauauuccagagcugaagcuacaaggggugcuggaggcagcaguucuagucccccagaaaaggacagcggacugcuggacagugucuuggacacucuguuggcgcccucaggucccgggcagagccaacccagcccucccgccugcgaggucaccagcucuuggugccuguuuggccccgaacuucccgaagauccaccggcugcccccgccacccagcggguguuguccccgcucaugagccgguccgggugcaagguuggagacagcuccgggacggcagcugcccauaaagugcugccccggggccugucaccagcccggcagcugcugcucccggccucugagagcccucacugguccggggccccagugaagccgucuccgcaggccgcugcgguggagguugaggaggaggauggcucugaguccgaggagucugcggguccgcuucugaagggcaaaccucgggcucuggguggcgcggcggcuggaggaggagccgcggcugucccgccgggggcggcagcaggaggcgucgcccugguccccaaggaagauucccgcuucucagcgcccagggucgcccugguggagcaggacgcgccgauggcgcccgggcgcuccccgcuggccaccacggugauggauuucauccacgugccuauccugccucucaaucacgccuuauuggcagcccgcacucggcagcugcuggaagacgaaaguuacgacggcggggccggggcugccagcgccuuugccccgccgcggaguucacccugugccucguccaccccggucgcuguaggcgacuuccccgacugcgcguacccgcccgacgccgagcccaaggacgacgcguacccucucuauagcgacuuccagccgcccgcucuaaagauaaaggaggaggaggaaggcgcggaggccuccgcgcgcuccccgcguuccuaccuuguggccggugccaaccccgcagccuucccggauuucccguuggggccaccgcccccgcugccgccgcgagcgaccccauccagacccggggaagcggcggugacggccgcacccgccagugccucagucucgucugcguccuccucg

SEQ ID NO: 15874 - RNA, 77408 nt, Homo sapiens
auucaagaauauggaaacucauuggacugaaaaacccaaaucuucauuauaccaaacuucuauaaugaucuuaaugguaguuagcuuuaaaaaaacacaaaauaggcugggcgugguggcucaggccuguaaucccagcacuuugggaggcugagguggguggaucacaaggucaggagaucgagaccauccuggcuaacacagaaaaacccugucucuacuaaaaauacaaaaaaaaaaaaaaaaaaauuagccaggcgugguggugggcgccuguagucccagcuacuugggaggcugaggcaggagaauggcguggagcuugcagugagccgaaauggugccccugcccuccagccugggcaagagugcgagacuccgucucaaaaaaaaaaaacaaaaaaaacccaaaauacuaugaauuaaauuuaugacagauacaaaaaggacaucagauuucuuugggggaaagucgcuuuuaaauucuauauuuccaaaaaagauauuuuacauuuagauacuuuuuuuuuuuuugagauugaguuucacucuuguugcccaggcugcagugcaauggcacaaucucggcucacugcaaccucugccuccuggguucaagcgauucuccugccucagccuccugaguagcuaagauuacaggcacacaccaccaugcccagcuaaucuuuuguauuuuuaguagagacgagguuucaccauguuggccaggcuggucucaaacuccugaccucaggugaacccccuccucggccucccaaagugcugggauuaaaggcaugagccacugcacccagcccauugagauacuuuuuuacucaguuuuuuucuaagaauggauuuuccucuuuaugaaaacaaaauauuccuuuucuuuauaaaacuuuauaggcaaauuuaucaagcugguaaauuccauaacaggcugaaccaaaugaaauaccuaaguaaagcaaauuacaugauuagaaggcuaauuaugguauuacugcauagguuuaguauuaaugcauauguucuaaguuuauugcaacuacacuaacuucguaauuuuagauuugcaguugcauccuccuaacugcgucuaauggcagaagcaccaccuuguggcaaaaguaggagcuuuuaaauuacagaaguuagggcuuguuacccagaaaggagaaaacaauauaaugggcauccaggacacugcgcuauuucuugaccuguagagggauuccaucagugcucaauuuauaauuauuuauucaaccauaugacuuuucuguauuuauuguauuuccuacuuuuaaaaguuugggaaaaaagucuuuuacauaccugaauuaaaggucacauuccuaaaugcuugaauuuucuaagcaccacuuauauuuucaagaauuuccuagaacuucgaggaaucuuuaaccuuguaaaugcacuguuguauuuuuaugauaggaaauaaaacaccagaaagacacuuauucuuugguaaguaacagaagaauucccuacagaugucuuccucugaauguuuucauuccugcucucccaaagccuccaagagcaaaugcagcugcuuucaaaucaucugaaagacuucuacauuccuauaccaacaggucugaaaauuguuagaaacaaaaaacaaaacuccccuaaaaccaacagauuuugcaggaucaauauaaaauauuaaggauauauagcacauuuaacuauguaacaauauucaaucaaaaaaagguuucccugucacguuuuauuuaccauauuuucagggcuugauacauaguauucacaaaaugaccugaauuagcuggagagauuuaucacccucuguaacugcuaugucaucacuuuccuuagcggugaacugaaucgcauuuaguaccucuuuucacagccaagagcaauuuuuuuuuuuuuaaggaaaaaaacuuuauuccuuuuuuccuaggaacuugucaggauacuuuagugaccauucccucacuauaacucucacccagacccaccuaacugaugcaugagaagagccacuagcugauguggcccacagcucagacugagccagcauggcuugugcagggguagguagcacagcaucauccagacacugccuccccugguagcuuccauuacaucauggacagcacugcucuucccugacuuaaccuucugcuuuguucaaauacuagaaauauuagauuucaaguucaauaaagaugugggcagaucugccuaagaauauuucacaggacaaugccuuccacugaguuaauguuacuugcucaaauaacccuuaugcucaaguuagguacagaaaaaauauuuuuaagaaagucaauagaauguuauauugcaaguuuugacuuaggccucuucaaaagugcuauaugaggcagccacuaaccaagugucugucucuuauaauuugacacauuccagguaugacuauucuaauggucaugaguaucacugagucaaguauuuguuucuaccuaugaagaaaugucgggccauuguacucccaagauguauaacuugaauuuuaaaguaaagcugucgcauaaaacuagaagaaggaauaaucucagggaucuuuuuacagaggauuauaaagaaugggauuauuuaacuuaaaucugaagaugucuaauucuuauuucuccccgaaaacaaguaaaaaauagaagcuuaacaugggcuacuaagauuucuggaauugcccauucagaaauguaucacaggaaccaaaguugagauaaaauauuguuaaugagaaauccuggcauugacauuccacauuaaauauauuucuauacuuuacuguaagguucaacugaccacucuaccuaaaacaaauucuucaauauuuucaagauguaguuuaaaacaauuuuuaacccguuuccuccuagaacuaggcacgcauauauguaugaaagagaagaaaaagcaaaggagaaaggaagaguggggaacgggggggagagggagagagagagagagagagagagagagagaacaccauuaaggauacagaauaauaaaggaaauuacuaccacuuaaugggaacacaaucuuuugaaaucuuugcuacaacuggaauaaaaaacucaguaauucugaaagguuauucuacucuuuuaaauaaaaacauaucuguucaaacuauuagguacuucuaaucauuuagucuuauaagaagcauuggaaaaaaacauacauaguaacaaacagugaauuuagacauagguucgcauaaauuguuuuacuuucagaaaacccagaaccucuaggaaauuacuaaaauuaugaagaaguuaaauuuuauaagcucuuucccucaacuuuggcuaaauguaaccauauuaaaauacugacauaguuuuucauuaugaaauagaaauguaaaaugguagcuuuauuuuaaucuuuacucaagagugauauugaaacaaagcucuuacuacaacaaccagguuaaaaaaacaaggugaaucaaugcuauuguaugucugugaacuagaaauuucuuacuuauggaguuaugcucaggaaacaauacuuaaaaucuuaaacuguaaacucuuagcuuguaacauuuucauuuuuccuguaucuugcauguuucucagugccauuaaauauauuaucuucuauuucuucuuaaagaacuaguguucauaaaaggaucaucaucaucauccugaaaugagauacaaauguuguauuagugauuguucccugcuucacugaaacaagacagaaguucuuaugggcaaaacaauaccagugagagucauuucacaugggauagacuuuauuuuucuauuuccuuuauaacugcaaaauauauuaaguacaauuaaauucuuaaugagcauuaaaaugaaaauuuauccugcugugugugcauguaucuacaauauaaaccacacacauuucccuuacuaaccuuaauaaagauaaaugaaguauagguaagccagaaaaauaauucaagucauuuuauauuugguuuuugaauauauuuucucauuuacauuuuauuacaguuguaucuacucuucuggaaauucacagcgaaaaaauaaugaagccacauggagauccaacucagaaacagcuguaauuuuauuucccauuaccauuuaauacuagaaauagcuagcuacucucacacuuaugcaaaaaacaaccuagcaaagcaagcuuucaaauaguuuuuuggauaaaaaaagaaauacaugcaguuauuucaagaguucccaugcuggccgggcgcgguggcucacgccuguaaucccagcacuuuggaaggccgaggcggguggaucacgaggucaggagaucgagaccauccuggcuagcacggugaaaccccgucucuacuagaaauacaaaaaauuggccgggugugguggcgggcgccuguagucccagcuacucgggaggcugaggcaggagaauggcgugaaacugggaggcagagcuuacagugagcugagaucgugccacugcacuccagccucggcgacagagcgagagacuccaucucaaaaaaaaaaaagaguucccaugcuauugggcuauagauuguaugcaugguaagaauaaauaggaauaucagauauuaacuaauaauuuaauuaaagagaaugaaaacaaaccucagauaagcccaauuauauaauuuuaugaagauaaaaccaauucuuacguauucuauaaauauucagaaaauaaagcaaauuuguuuauaaguuuuuuauuuguguuuaagacauuaaaagaaauuaaaagaaauuauuugaugcuaggcuuuguuggugguaucagcacuuccaaauguuagcuaaauuaacuaucucugaugaguaauggaugccuuaagaaauauaaauucauuuucauuuauugauucauuuucugcugcuaucaaagacaaaacuuaaauaaaccagagacaaauccaaaugaagucuaauagauaauuugcuaauaguuugucuuugcaguuaacaugaacuaguauacaaauuuuuaacuguaacauauaaccgcauauauauccagauguuuuggaauaaacaauaauugcucacuucccuccuggaagcaacauguuaguauuuaauagguagaaugagcucuugcugccauuuuucuuggcagccugaguugaguccucucaagcuguuuuaaaccacagcuuaaauacagggaacauggcagcagcagccaaagcuaaaaaugaaagguguaagucacaggcuacaacguagauaaaccuucagguacuuacgcuaugugaaauaagccagucacaaaaaggcaaauacuauaugauucuacuucuaugaaguaccuagaguaguugaauucauagaaagagaaaguggaaugguaguuaccaggggaugaagaaggggaaacagagacuuguuauuucagggauauagauuuucaguuuugcaaaaugaaaaagugcugaagaucuguuuaauauggaucuauuuaacacuacugaacuguacacuuaauaaugguuaguuuuauguuaugcuuuugcuacaauuaacaauuuuuuaaauaaaaaaauaaaugaaaggggucaugggccuaagagaaacacuuucaagcaaaucaacaaaaacuagcaaaggcccuucaaauggcagccuugaaggaaaggggaagggcaguauccuucagucauguaguuuuauuuaaacuuaauugaaacagcaaauuaauaaaggcaagagguaaguccugacuuauaacucuuccucuuccuccuccuccucauucaugguggggagauuucaugguugcagacgcgaucuggaacuggaguuuuuuccagacauccucccagagaacauuucggacaaugccugaauaccuguaugucaugaaaucaccaccaugcgccacccucuacaugacacauguagagcauauagugaguacuuaauaaauauucauuaaaguaauauuaaaagcucuugggauaucaucaucaucaucaucauuucuccaaauauaaguaaaugguagaagcuaaaaaaaauuccgaucccacuguuaacugggcaaauaagaacugagugaauaucauauuuuaaaaaucuacaggacuuuuauaucugagguauuacacugaugggcacucaacauauguuacuuguuaacucuuaacauuaacuauaguucaaaggaagguuaucaaugaaacuauuuuuuuuuuuugagauggaguuucgcucguguugcccaggcuggagugcaauggugcaaucuuggcucacugcaaccuccacuucccagguucaagcgauucuccugccucagccuccugaguaggugggauuacaggcaugugccaccauguccggcuaauuuuguauuuucaguagagacgggguuucuccauguuggucaggcuggucaugaacucccgaccucaggugauccgccugccucagccuuccaaagugcugggauuacaggcaugagcuaccgcgcccagccugaaacuauuuuuaaaaauaauuuuuaguggaagaaggacaagauggccaacuagacagggccaagaagcaccacugccacuaauaaagaccaaaauaucgaguaagccaacauauuuugagcagaucuuuggagaaaaagcaccaagagcugauagagaggugauacaaacuggaagcugaagagggaggaagcugguaaccuuguggggguugcccaaugccagggcugguucuuggccuugaaaggcuccuagaaaggggugagugaauggaugauggggcagcacacucucacuauggaccucagagauccuagcuacaagauuccaugcccccuggagacguuucaacuggcagggggauuggcccaaacaguaggcagagacagagcuccagaauacauggagcccagggguuuucauaucuaaggcagcugcagcagaagguggccauaggcgcccauccccuaagacuucuuauuuccccuggaguaggacuagccccaccugaaugcuggggcaggccagccuggggccagcuucccugugggacagaggaacaucuguucugcaggcccuccuccccuacagccccuuccagggccccugccaagcugcccugcaggaaugugugcacagggcagccucugcugccuagccuuguuuuuugcuggugguuccaccugaguaccuuccuggcagccugggagcauuucagauuccccagcacagcuggugccugacccugaggguccagacgauggagccacaggcuggucccagugcuacagggcuacagcacacagcuggggcugucgagcuaagagcuggggcuggcacucaaguaggggagaaaucccacuuucagaacacugaaaggagugagacacguggguucgugggccagugcaggaaugggacaugccuuccuccacagugcuggucugggaaggguguggccugucuggcagccauggccucugucuaagggagcccugcaacccaagacaccaaacaacaguaaugcagguacagugccagugauaggagggaccucacccaugguccaggaguggcccuuaugaguggucaucucucuccccaaccccaccacagagcacggcugugaacacacagaaauacaaaagaacuaugcagcugaguaagagccuauccacuggacacuaauguuaaaugccagcuacuggaucacagccaaaauuacaacaccaaaauaauucugccaauauacaucucugugacacccagggcaagaaucuaggcacaguaaagaucuauauagagcuguggcccucugaaagcacccagaaacaaggccaguugacuauacucgacuuacacugcaguuaaaggaacaauagcccucuaacaugagaaagaaucagugcaagaauucuggcaauucaaaaagccagaauguccccuuaccuccaaaugagccugcuagcucaccaacaauaguucuuaaccagauugaaguuacugaaagacagacauacaauuuagaaucuggauggcagggaagcucaucaagauucaggagaaaguuaaaacccaauccaaugaauccaguaaaacaauuuuacaaagguaaaauagccauuuuaagaaagaaccauacugaacuucuggaauugaaaauuucacuacaaggauuucauaauacaacugaaaguauuaacaacauaacagaccaaacugaggaaagaaucucagagcuucaaaaccaguucuucaaaucuacuuggucagagaaaaauaaaggaaaaagaaugaagaagaauggaaaaaaaaaaccucugagaaauaugagauuauguaaagaggcaaaaccuaugacucauuggcauuccugagagagaagagagaauaagcaauauggaaaacauauucgaggauacaguccagaaaaauuucuccaaucgugcuagaaagguugacaugcaaauuaagaaauacagagaauuccuaucagacauuauauaagaugaccauccccaaggcacagucaugagauucaccaaggucaacaugaaagaaaagaucuuaaaggcagcuagacagaagggucaggucacuuacaaagggaaccccaucaggcuaccagcggacaucucggcagaaaccuuacaagccagaagagacuggggaccuauuuucugcauccuuaaagaaaaaagaaauucuaaccaagaauuucauaucccaccaaacuaagcuucauaagcaaaggagaaauaaaauccuucucaggcaagcaaaugcugaggaauucauuacaacuagaucagccuuacaagagguccuuaauagagugcuaaacauggaaacaaaaaaccaccaccuacuaccacaaaaacacacuuaaggacauagcuuagagacacuauaaagcaacuacauaaucaagucuacaaaacaaccagcuaacaauacgauggcaggaucgaaaucucauauaucaauacuaacucugaauauaaauugucuaaaugucacuacuuaaaaggaauacaguggcaaguuggauaaaaggacaagaccugacugcugucaucaagagacccauuucacauguaaugacacacacaggcucaaaguaaagggauggagaaagaucuaacaugcaaaugaaaaacaaaaaagggcaggagucacaauucuuuuaucagauauagccgauuuuaaaccaaccaacaguaaaaagggacaaagaaagguauuauauaaugauaaacgguuugauucaacaggaagaccuaacuaugccaaauauauacaugcccagauucauaaaucaaguucugcuuaaccuaaaaaaagacucagacagcaacagaguaauagugggaggcuucaacaccccacugacaguguuagaaagaacauccaggcagaaaacuaacaaauucaggacuuaaacuugacacuugaccaaucagaccuaauugaaagcuacaaaauacuucauccaguaacugcaggauacaaauucuucccaucuacacacagaacauauucuaagauagaucacguguucagucaaaguaagucuaaauaaauucaaaaaaaucaaaaucauaccaaguauacucuuggacuacagugcaauaaaaagagauaucaauauuaagaagaucucucaaaacuacacaaauacauggaacuuaaacaauuuauuccuggauaacuccugggucaauaaugaaauuaaggcagaaauaaaaaaauucuuugaaauuaauaaaaauucauucauuaauuaaugaaauuaauuucauuaaugaaaauaaaaauagaaucacaacuuacaaaaucuuagggaugcagcuaaaacuguuaaaaggaaagcuuacagaacuaaaugucuucauuaagagaaucaaauuaacaauuuguuaauuuaaaucaaauuaacaauuuguuaauuuaaaucaaauuaacaauuuaacauuguaccuggaggaacuagaaauaaaagaacaaaccagcccccaaauuagcagaagaaaagaaauaaauuagagaagaacugaacaaaacugagaugcaaaaauccauaccaaagaucaaugaaaucaagaauugguucuuuaaaauaauaaacaaaauugauaggcugcuagcuagauuaacaaaggaaaaagagaagauccaacuaaguacaaucagaaaugacaaagaugacauuacaauugaccccacagaaauacaaaagaucuuuagagacuacuaugaauaacuauucacacacauuagaaaaucuagaggaaauggauaaaucccucuaaacacacaaccucccaagauugaaccaggaagaaagugaaaaccugaacagaccaauaauaaauucugaaauuaaucaguaauaaaaaacugaccaaccaaaaaagcccuagacuacauggauucacagccauauucuaucagacauacaaagaacugguaccaauccuacagaaauuauuccaaaaaaaucaagggaggcuccucccuaacucauucuacgaagccagcaucagccugauaccaaaaucuggcagagacacaacaaaacaaagaaaacuucaguccaauaucccugaugaacacagauguaaaaauccucaagaaacuagcaaaccaaaucuagcagcacaucaaaaaguuaauauaccaugaucaaguaugcuuuauucuugggauacaagguugauucaacauaugcaaauccauaaaugugacucaccacaaaagcagaauuaaaaacaaaaacgauaugaucacuucaacagacacagagaaagcuuuugauaaaauccaacaucccuucaugauaaaaacccucaacagacuaggcacugaaggaauauaccucaaaauaauaagagccagcuaugaaaauccacaaccaacaucaugcugaacaagcaaaagcuagaaccauucucccugagaacuggaaaaagauaagaaugcccacucucaccacuccuauucaacauaguacuggaaguccuagccagagcaaucaggcaagagaaagaaagaaaagacauccaaacaggaaaagaagucaaacucucucuuugcugacgauaugauucuguaccuggaaaacccuaaagacccugcccaaaggcuccuagaacugauaaacgacuucagcaaaguuucagaauaaaaaaaaaaaguguacaaaagucaguagcauuucuauacaccaauaacguucaagcugagagucaaaucaagaacaacacaaucccauuuacaauagcuacaaagaaaauuaaauacauagcuauauagcuaaccaaggaggugaaagaucucuacaaggagaacuaugaaacacugcugaaagaaaucacagauaacacaaacgcaaaaacauuccaugcuuaggaacuggaagaaucaguaucauuaaaaugaccauacugcccagugcuaccuacagauucaacgcuaucccuaucaaacuaccaacgucauuuuucacagaaauuagaagaaaacuauucuaaaauucacauggaaccaaagaagaacccaaauagacaaagcaacccuaagcaaaaagaacaaagccagaaguauaacacuacccaacuuugaacuauauuauaaggcuacaguaaccaaaacaauaugguacugguacaaggacagacacacagaccaauggaacagaacagagaacucagaaauaaagcugcacaucuacagccaucugaucuuugacaaugcugacaaaaacaagcaauggagaaaggacucccuauucaauaaauggugcuaggauaaccggcuagcaaugugcagaagaaaauggaucccuaccuuucaccauauacaaaaauuaacucaagaugaauuaaagauuuaauaguaagaccucauacuauaauaauccuagaagaaaaccaagaaaauacccuucucaacacuggccuuggcaaauaauuuuuggcuaaguccccaaaagcaacugcaagaaaaauacaaauggacaaguaggaccucauuaaacuaaagagcuucugcacaguaaaacuaucaggcugggcacaguggcucacaccuguaaucccagcacuuugggaggccgaggcagguggaucauaaggucaggaguuugagaccagccuggccaacauggugaaacccugucuguacuaaagauucaaaaaauuagcuaggcguggugaugcgcaccuguaaucccagcuacucgggaggcugaggcaggagaaucgcuugaacccgggaggcggagauugcagugagcugaggucacaccauugcacuccagcccaggcaacaagagcgaaacuccaugucaaaaaaaaaagagaaaagaaacuaucaacagaguaaacaaaaagccuacagaaugggagaaaauauucacaaaauacguauccaacaaaggucuaauaucaagacucuaaaaggaauguaaauaaaucaguaaggaaaaaucaaauaacugcaucagaaaaugggcaaaggacaugaacaggcacauuacaaagaagaagacacacaaagcagccaacaaacaaaaagugcuuaucaucacuaaucaucggagaaauguaaaucaaaaccacaaugauaccauuucauaccagucagaauggcuauuacuaaaaagucaaaagacaacagaugcuagugagguugucagaaaagggaaugcuuauacauuguuggaauguaaauucauucagccauuauaagccauuuggaaauuucucaaagaacuuaaaacagagcuacgauuugacccagcaaucccauuacuggcuauauaaccaaaggaaaagaaaucauucuaccaaaaagacacauacacucauguuuacugcagcacuuacucacaguagcaaagacauggaaucaacuuaagugcccaucaauacggauuggauaaagaaaauggugguacauauguaacauggaacacuaugcagccauaaaaagaacaaaauuauguccuuugcagcuggaggccacuauccuaagcaaauuaacaggaacagaaaaccaaauaccacauguccucacuuacaagugggagcuaaacacugaguucacauggacaugaagaugggaacaacagacacuguggacuacuagagaguggaggcugagaguaggauguguguuggaaaacugccuacugcucacuaccugggugaugggaucuguaccaaaccucagcaucacgcaauucccauguaacaaaccugcacauguacucccugaacauaaaagaugaaguuauuuaucaaagaaaaaaaaguucagcaacuagcuggcagucucuauuuaaauuuuauaaaguuaaaaauuaauuaaaauuuaacaauauuacuuauuuaccucacuugauucaaaaucaaccccuuucgauacuugacucugggacaugauuuugcuggaugaugugcuggaccaccugaggcaaaacaaaaacaaaaacaaacacaaugaacuacauaauucaucaagugugccuuucuggcuaaguuuuucaauccagcagcugccacgaauauaaauaacacacaauucccuuaaaaucuacauuagcggcaauaaaacuuaacuguaaggaaaaggacucuggggccgagguuugaacucugguuuugcccuuuacuaccuauguggcuuugagcaaguuacuuaaccucucugugcuucaauuuccucaucuguaaaacggggauaaugguuuuauaaagacuaaauguguuaauaugcuuaaacacuuagaacagugccugacacauauuaaguacuacaacaauacuuacuuauauuauuauaguacuuaucauguaccaaaauguauacauuaccaucuuccacuucugaaaaccaugggaacauugaaauauuuucuauucaaaucucaguuaauaagaaaaucauaauuccuacucuuuuuacucuuuuuuuuuuuuuugagauggagucucgcucugucaccaggcuggaaugcaguagcaccaucucggcucacugcaaccuccaccucccaguucaagcgauucuccugcaucagcccccucagcaugccaccaugcccagcuaauuuuuguauuuuuaguagagacgggguuucaccagguuggccaggauggucucuaucuccucuaucucuugaccucgugauccgcccaccucggccucccaaaugcuaggauuacaggcgugagccaccacgcccagccgauuccuacucuuacaaagcuuaacuugcaguaaauuccuaugucuuuuaauuaauaagaaauuuaagucacuuuagaucggggccaguaagcaaaucuagcccaccaccagguuuuguuuuuuuuauggccuauaagcuaagaaugguuuucacauuuugaaaugguuacauuuuaaaugguuauacaagugucuaccuacauaauauccccgguuuugccucuugaccugccgagccuaaaauacuccuuaucuggccuguuaagaaaaagucugcugauucccgucuucaauaaaaguaguguuuauaaauucuuagucuacaauuuuauuaacaugcuuugggaugucauuauagcaaaagaaauauguccaaagguuuuaucuggaaaaaagaaugagaaucacgagaucuuaugucagaaguaaauagaaaaauucacagguccuuugcacuaaaggaaaggacagaaggauuuaucaggcaaacuugaagagcaacuaagguucagagguagcagauuagcacaauuaucaagguccacucugguaaguggcagagcuuaaauaguuuaaauuauaaauaaaacaccaugcauaaccugcaauuacuaaaacauucugcaaaaacagucuaaauuaucauuuagaugcuguaauuagaaacaccaaucugccaaagcugauuucugauguguuuccaaaaugucaauuuuggaaauugccucuaaaauguuaaacagccucucaaaacuuaaaugauucuuauugcuugcacaauggucagagaaguuaguuaccauaccaagaagcaacaacagagaugaguuuggggucagaaugccuggacuguaugacuaguugggugaccuuagguaaguuacuuagccacugugcuucacacuucaucuguaaaauggggaugauaaaguuauaacuauaaucuaucuccuggggaaguugugagcaccacgcaagcuaauucacauguaaaaugcucagagaagugccuggcacauaggaaguaccaaacaacugugaguuauauuacuauuucaugucuaaagaaaucggcagacauuuauacagcugaaaaguaaacaaucuacugugauaucaaaagcaaacuauuuuuucuuuaauauccuuaagcauauaucaaaaauaucagaauagcauuuugauccauuucuggaaaaaaaaaaacuuagaaagcuagaucugauuugugugugcuucaauuuacaaagacaagaacaaccaaacaaggacucagaaaggggcccuuacuuccuuccaaaaccugagguaucccgauaaucuuccaauaaaucuccuuuucuguaagagaaucugaguuagguuucuaucagcuggaaccaaaggaguccuguuaaauacacauaaaugagccugagaaauucaaguaaaccuucgugagcuaaaauaagucccuccacuacuuaccauagacauauaaacugauuugcaucugcgcccaucuugguauuuuuuacuccuauaaaggccaguacggccuucugcaacucuauacucucccggauuuuucucaugucuuuauuguuuuuuucuacucuacccaaaggcugaguaagguuaaaacugcaggcuaggaaaacaaacacucuucugcucugccuucuuuuuugaggugauccuauccaucccaaugguuuuaaguaccaucugcacgcuguccagagguaaauguaaguaccauuucaaaccccuuaucugggacgagcacgguggcucaugccuguaaucccagcacuugggaggccgaggcgggcggaucacgaggucaggagauccagaccauccuggcuaacacggugaaaccccaucucuacuaaaaauacaaaaaauuagccgggcaugguggcagggccuguagucccagcuauucgggaggcugaggcaggagaauggcgugaacccaggaggcggagcuugcagugagccgagaucgcgccacugcacuccagccugggagacagagcgagacuccgucucaaaaaacaaaacaaaacaaaacgaaacaaaacaaaacaaaaacccuuaucugaguucugaauucacacauucaauugccuauaacuucccuucauguaaguuucuaggcaucucaaacuuuucacaucuaaaguggaacuuuuaauuauaugccuaucauucccuacaacacaucuguccuuucuuuuguccccuucucaauauauggcacaauguaaaugcuccagcaagaaaccagaaaaucagucuugauuccuuauucucccuuacuccaaauguuuaauccaucuucaaguuuugucaugucuaucuucaaaauauauccugaaaccaucuguuuccuccauuucaccuaccaccagccugugcaagccuccaucgucucucuuagcucagacuaccugcagcacccuccuuucagauaagcuuguuuacacuuguucugcaaccacagugauccuuuguaaauguaaaucacaaggugccacuccucucuuaaaaucuuucuguggauucccacugcauuuauaacaacauccaauaccuuuguagugcucaccuguuccugcagcaugauuuacccugugucucuuuucuauucucaucucaaacaaccuccuuuuccaccacacauuagucauuggcuccuaaauaacauuauuaaacuugcuucuucaauagacugugauaugguuuggcugugucccuaccaaaucucaucuugaauuguagcucucguaacuccuaaguauucugggagggaccuggugggagauaauugaaucacgggggcaguucccccauacuaaucucgugguagugaauaggucucacaagaucuuucacuuggcucuuuuucucuucuuuugucugcugccaugugagacaugccuuucaccuucugccaugauuaugaggccuccccagcuauguagaaauuugaguccauuaaaccucuuuguuuuguaauugcccagucucggguauguguuuaucagcagugagaaaauggacuaauacaggcugcaugcacuugucccucugcuuuuugcaaggccacauuucccuuauuaaaauuuccgcuuaaauguagcuuccucagaggcuuuccaugaccauccuucaaaguagaugcccguccugugccacuguuucuucucucuacaccagaucauuuccuuuaaugcaugcuaacugaucggcugaucaccagcucaaaugucaccuaucuucuuuguaaaaccuucaaugaccuuucccaggaagauacuggcacgucccuuagguuucauuacaccugaagaaaacauuuaucuugguggauuagcagugcccuguaauuagcauaccacuaaaguguaaauuccuugaaggaagaaacauuuaucuuucuauccccagaaccuagcaugauguuugaaggaucuaauaagugaacguggaacuauacuuacacuugcucuaacauuaaccuuuaagucacauacagcuuauauucucaguggggucaguaucauaaagaacaaaaauuggcuccaggggauagagugggaugaaaaagcuacgguuuuuggcccucucagacucaaccauacccaaaaaaauuucauucuuuaaguauuuaauuucuaacguuagggagaaauugacuuacaucuaaguuacuuaauucuucuccuuggauaaucaagaaauggcugagauaauggaaaaaaagcuugagaaacacugauauaaggcuuuuuccucaaucacccuucuuucuggaguuccugcucaugcccuuauucucagcugggaccaccguuuuccacccuacuaagccaaaucuuaucuuugaaaccucaggucaauuuuauucccuccaugaagcugcuucuucuagcccacauuccuuguuccuuuuuucaccagcccauaagcacucacacuuaugggucuguaauauaaaauucuacaccuaauuauguacuaauucauucuuugaugaauucaaauauguucauuucucuuuuccacuauaauugaaguuaccugaaggcagaggccauauuaaaacauucguuaugccccucccucaucagaccuaauauaaugcucaaacagaaaauaaguacaaaauaaggcaguugauuacuuuauuaaguagaaauucucauuauucgagcuuuaguuaagcaguauucaaccaaaauguuaacguauaaaagcaaaugguaauagugaaucaagucaagcuuaacagcaauaggcaaaaaaucccaaaacacacaggaagagcaugcaaguccucugaaggcagacugagucuacgugauccccuuuuaaguguuuaguacaguaccauguguaguuaagaauauaaaaauaagacaaugacaaaaagcugaaaucaaaugauagcaaaauacaaaauuauuuucuguuauuuggagagaacacagucuuccauuaagaaaagcacugaggccaagcgcacuggcucacaucuguaauccaggcacuuugggaggucgagguggguggaucgccugagcucaggaguucaagaccagcuugggcaacauggcaaaacccugugucuaccaaaaauacaaaaaauuagccacgugugguggugcacgucuguaaucccaacuauucaggaggcugaggugggagaauugcuugagcccagaaaguggagguugcagugagccaagaucgcacuacugcacuccagucuaggcgacagaaugaggcacugucucaaaaaauaaauaaauaaauaaaaagaaagaaaagcacuaauaaagucaaaaggaaaaaaauuacaggcuauuucaauuuucacugaaaauccuuguacuaaugcugcaucaacucuauaaacuagcccuuggucuguuuucauuccucuacauacuuuacuaguugaaaauaagucuguuaaacuuacauggcauagaaaaauguguaacuuuggaauucuggauaauuuuuaauuuuuuucagauguuucuuuugcagaaaaucacugcaccuaccuuugaucugucuuugaagugguaggaaaaaugucuucuuccacaucugauucaucuaccucaaucaccuggcaaggaaacaaagcaacaaacaguuuuugugagaauagacucugaauaaaaaugaaaaugaagaaaugaauuacacgauuaaaucuuaaguuauauaugagccacaaaaaaggagacagaaagccauaaccauuaaaacuaacacucagucugaccucccuccaaugucccucuucauucacaaauguuacuuuuugcucaccucucuccuggccaucccaggagccugagcaccuaagggaacacaguuacacuggugaaugacuugcauaggcucauaugcagaccuuaugacuuuccucuuaguuucuuaugagaggugagaccaucaguguuccaucuccaacuuuaaaugagguaucagaccaugugggaaauacuagauaucuuucuguuaaaucugucccucuuaaauaccauuuguuaguguuaagacccaauaaagauauuucugacuguugauucuaccacccaaaauacuauuucucuacauuuuguuaucuugacauuugauacauacauuugccauaucuucaucuaacuuaaguacagaugaggaugaagccaaagaccaaauacugaacgaacagccccugaggcuaaggaugcuguuaaauauccuacaaugcauaggacaacccuucacaacaaagaauuaucuaguccaaaaugucaacagugcuacuauggagaaacccugauguaaagggaagaguauuggcucgggaguuaagacacacaguuuugaaagugaaguaauaagagaaucaagcccauauuggacucuucuuggaaucgaaaggaagagcagaaggcccaggcuaaaccuagggcaaaccacauggaucgcuggacuccagccuuuucauucaucuuaagucuagcaacagcuguuaaggcacagcuaguauuuugggaagauaaguaacaaaaggaaauccagcauagaaaaaaccucuauaaccauugaacucaccuucaauauuaguauuccauguaugagcucuuuugguucaacacuguuauccuugaaaacauuacuguauacauaacauuuauggauuucuauaauaaccauuauuuaaaaaaagagagcaaccaagaaaaaaaaaaucaaauccuagaagcccuagagauaauugguaaagcuccuuccagcuuuaauguuccauaauuuuucuucuuuuauuuacuuuguaaaucagagaguugacaauucauaaugcagaaaacauaaauuauuaauacacaaccauaaaacuuuuuuucuuaccucugaauaauucuuaguagugacauuucgggaaggcugcugucuuguagauuuaaaggcuagaaugaaaaagaugaaaugugcauuauguuauucuuaaaauaacuuagaaaaacuugcauacuucuuuagcuaaagauuuucugaguccuaucugcaaaacugaaugaugccuaauuauaaaacuauuugauauuuuuaaaaaucuaaagggagauagaauuauagguacgcauaacucaaugcccaacugucagucucauuauuucccagcuuauugagauacuguaguguuuauaaauacacacacuaaaaauauuucauagaaaaacaccugaaggauaaaaucuaaucaccuaaccaaaugaacuacaaauguauugaaggaaagccuccuaaucccuucuuuguuguugacgauaccuuuaucccuguugcuacauuaggagccaugggguuccaguaguuucucauuuuccucuaccuuaguagccauauucaauaucuaagaaauauuccagaggagaauucuagaaaacagcauucuaugauaaaaauuccuuuguauccauaccuuuuuuccuuuuaaacuugguuagauacuugaaguuuagcuagcucuuuaucuuucccuuucuuuuuccuugacaucgaaaccuacaauaaggccaggcgcaguggcucacgccuguaaucccagugcuuugggaggcugaggcgggcggaucacuuaagguccagaguucaagacaagccuggccaacauggugaaaccccaacucuacuaaaaaauauauaaaaauuagccaggcaugguggcaggugccuguaaucccagcuacuugggaggcugaggcaggagaaucgcuugaacccaggaggcagagguugcagugagccgagaucgugccacugugcuccagccugggcaacagagcgaaacuccgucucaaaaaacaaaacaaaacaaaacaaaacaaaaccuacaauaaauuucaaacgucuaauuuagguuuauuuucuccuaugccuuaccaguuugcuaauaucaaaaauaucuuccccaagauaacucacaaacuaaauagggcacagaaaaacaaacaaauacucaaaaaauccugcaaaguccaaaauucuccuagucagaaaacuaacgaaucuuucuaucuaaccuaaauuuauuguguuugcacauguuuccuauucuagguucuguccccaaacuuguaauaucuaagaggagaaacgagaggcagaaacaguguucuuaucugcuuuacucaguuacuuuuuucacauccuacucuacucaaaaggcuagacagagcaacugaauaaaaaauccagugaucaugaugauuucaaagaauauuucuguucaguauuuauucacugacuccuuuaacucugagauccuagaaaacaagauaccuuucuuuuuaucccacuggaaggcaaaagaugagugauguugugaaauaauuuuaucagaaaacuaagcaauauguucuguuaggaagacaauaaaguguggugguuaaaagcucugguuuuggaguuagacucauuuugacuuacuagcuugacuauggccaagcuccuuggcuucuuuaaaacucaauuuccucgccuguaaaacaguguuaauacuucaugcagaaaacugcugagaggguaagaggaagugucuagcagauagaaagcauucaaauacauguagcuguuuggguagcaaacauaguagcagcagugguacccauagugguauaaaugaaauguaaaggccgugacuucagagguacuuuuauucaccuagccacuauccucugcugacuaacuucaauggaaaaaucugggcugucaacuccuauuuacaacucccguggcuacaaguguaauuuuuaucuuuuccaauaaaauugcagcacaauaauaaauuuccauacuccauggaccuuguuauaagagaauuugaccuuuauuuaucucuucacuccuccauuuaaaacagagaucuagaaguuacagucuuaauuuguugcuucugucccaaagugaugacaaguauaguuacuacuucacagguauucugucagagacuuaaaaaaaaacccaccaaauccaaccugauaaaaauguuucacaaauuuauacuuaaaaaaucaguucauuuuucaaaaaaaggccuaguacuggagguaaucaguuaaguuagcgaaaccauuauaucaaaucaauuagauaaaagacaaauuuagaccaaugauucacauaauauucaucuucauaaucuuauugcaaaacacuaccacuaauauuaauaacagcuaucaucugucgcauuuuuaccaggugcugugaucaguacuguaaauacuuaagcucauuuaauaaaauuacucugaagucaguacaacauugucaaauuuuauagcuaagggaucugaugcuuguagaauaacaccaguuugcacuuacugagggcuuaauaugcauagacacugccugauacuucacaugcauuuucucauuaauccucaaaauaacgcaaugagguggacgcaaucauugucccauccuacagaugagaacacucauuccuaaagaugaaaaacuuaacauauuugcuggaggacacacaacuaguaaaauugagaagucaggauccaaaccaagaucuuccucacuuuagaaccauggucuucacccuuacgcuacacaaucuccaaguaauuuuuacucagucauugucaaguauuuaacaagcaucuacuauguuaugugccaaauauaguggauacagugaugaggaggaaugaugcagaccccuuucucacagcacuuacagugcaagggugcuaagccagcaguaaagagcuggcugugacugacccaauggaccugacuccagagccugcauucuuaaccaucaugcucugcugcaaaagguaccauaauaagauuuuugcuuacaacauaauucaggaaaucugacguuucguauuuaguuuauuuacauagccucuuuucauagaugaauacuguuuccuuaaaaaaauuagucaagccauucuguaaaacuuuuaaggcaucauaacuggucuccagucuuucuacacaaauagaagcuuuauucuauguugucaauggguaacagucauugcaggcuagguuauucagacaaaaugaccucucauugucuucaaacucacuucugcugacaacaauccaaauuaguaccucaaacauuuaaaaaaaaaaaaaaauucucaauggcauugaagagcugaucacauaccaaggaauuaccaggccaaaacugaagaaaagcuagaacucagagagguaagcagaguccuuucccugaguucacuuuucaauugggaaaauguuaacauugguuuugagaauccugaagaaaaauagagagggcuaccacagcccacggcugcccaaagugaaaaccccgaugcauuucccuuccuaagguggagccccagugguugaagagagaagcagagguaaacaggauuucauaagcauguaacugaguacccucauuuuucuaagagguaguucauuacuuuuucucucucuucuuuucuccuuucccccacuuucuacuuaguucuuuagaaaugcaacuauagucuuuuacuuccucuucaucagagacucccuaaaaggggaguucaucuaacuaugugcuuggaagcuccagaguugaacuaucacccaccaggggguugccucuagagauaacagucaauucacaauccaaaguccugcuaugaaacucucgccaaccuagagaguauucggccaccuuuauagccuauuucuacccaugaagaugccaauucaacugccugguagauaagacaccaaacuagaaugcaaaccccccacuugcucgcuuccuccccugcaugccacuccugauagguccccuuuaaaagaguccacuuucugcugcaaagggggaagcaguacccuuaagguaggaagccuguauuucuuccccuaaguucgcuuuggaauaaaaagucacuuucuuuauaccacaccuugcucuuguuaauuggacuuugcaagcagcaagugacugaaccugcauuuuaguuacaaguacguaucaaaugacugguccaagaaacccucaaauuuagcuuaaaguggucuaugacuuguggugcccuacaaaccuagagaaacaaacgugaaucuucucugaaggaagauggcuucauccaaggucucaaauuauuccuguugauaauuuucuagggacaguaaguaacaaagcauggaaggaaauaagucaccauaaauaagaacccacagaaacagacaacagaaagaggccaaagacauucagacacuagguuauuagauacaaaauaaaagaaguccuuacuguguacacacgaaaaauuaaaacaggccuaaaaauaucuucagaaaacuucuaaaaacuauuaaaagugacagagcauauuuuaaaggaagcaaauaggcugggcaagguggcucaugccuguaaucccagcacuuugggaggccgaggcaggaggaucacaugaagccaggaguuuaagaccagacuagccaacacaguaaaaccgugucucuacuaaaaauacaaaaauuagccaggugugguagugcacaucuguaaucccagcgacucgggaggcuaagacaggaaaauuguuugaaccccgggaggcagagguugcagugagccaagaugaugccacugcauuccagccuaggcgacagagagagacucugucucaaaaaaaaaaaaaaaaaaaaaaagugaucagaaauaauuauucagaauguagcacagaaagagaaaacagaaaauacaagagucaugugaggagagaguaaagaggucuuaucauuauuuaacugaagacucagaaggagaauaagaauagcauagagguaacaucugaagggauaauagcuaaggauuuucuagaagugacggaagauagcaguucagagauucaugaagcccaauaauugcuaagcaggcuaaacaagaguaccaucuuuagauucaucacagugaaacugcagaacaccaaaaacagcaagcugagagaaaaacagguuauuuuuuaaaaaacaaaaaccaacaagcuuaacugauaucugauuucuuaauuacaguggaaacucaaagacgacucauuuuaagugaugaauucuacccacuggagucaaggaaagcuuaacauaaaacaagccaggacacuggauuccacaggacacaaaaacacaaaaacaaaaaagaaaaauaaaacaagacaggacaaaaaaagacgauuugggcuaagguaaagguggguaaucuacaucuaugacucugucgauugcaugcuaaccaauuuuggugguuuaacauggaaguguucauuauuuuauucacucuuuuucuauguuccuguuuucucauuuuuaaaagaacacuugauaaaugccuacugugccaggcuuuuugaucauuuaaucuucagaauaacccaauacaauagagauuauuauuuccaaucauaucuaaacaaacuaggagagugacugauuugucucaagucacaaagcugucauuuguugaaugcaagguugaacucagcaugaauccuuuacaauuuuccaggcugccuuuucucucuuucuuccucucugcuuuuauauuaaaccuaccaagaauggaacagcaucuuuccagauaccacucccuaaauggcaauaaagacaacauguuugugaagcaaaaagcuaaggaucuuagcuagcucuucugaaguacuaaauaauacuugaguaaaaauauagcaauggaauuuuuuguaagguuuaagagucauuuaaucaaccugauuuuguaucuuuucuucaaugucagcugucauuugauaaauguugaaaauuccuuuaauggagugauacuuacuuccaaggcaaauuaguccaucuuuauauuaauuacauagguuauucugcauaaugcaaaaauuauucuauggagaacuaguagcuaggucucuaaucuuaccuugcucuggaaacuaguacaguggucaacuacugguuguagagugcagagaaugugagaucauucccagaucugguacugacaaguuaugagaucuaggauaagcuaccuaucuuuuuaaagccuguuuccuuuucuguaaaacagaaauaauauaguaaguaccuaccccacagaccuguuaagaggcaugcaguuucauaaauauuagcuauuauugcuacuauuagugguuuuaucaacucagggcaaaacugcuuggcuuaguucccucacauauaaaacaggggaacaaaguuguucuuaaaucuuccagguccauucuaucagaugagaaacuuaaaucaguauguuucuagcuauucccauccauccccauugggccaggaguucuuaagcuggaaaacacgaaugcgccucaugggaguggcugaacccuuugaaauugggugcaauugcaugugaguacuuauuuaaggagagaagacauagcuuucaucagauuuuuagagaauccauaagccaaaauagauuaaaaagcauugccuuugggacuaaacagaucaaaucuauucauuccacauuuuacacgauagaacauaaucuacauaaagaucugaauguuucccagguuagauauccuaaauccuaaguuccuucaaccaauuuuuuuuuuuuuuuuuuuuuggagacgcuccgucacccaguucaguggcaugaucucggcucacugcaaccuccaccuucucgguucaaguauucuccugccucagccucccaaguagcugggacuacaggugcacgccgcccugccuggauaauuuuuuguauuuucaguaggggacaggguuucaccuuguugcccagacugguuucgaucuccugagcucaggcaauccgcccgccucagccucccaaagugguaggauuauaggcaugagccacugcgccuggccaaccauuuuuuauauuauuugguaucucuucugaaugaucauauauaguugacagucuccuugaaauauaauuccaaagaggaguacaguauccuuggcauguuauggccaauuuaguacacagagagaacuuccuugcugugcaagcuuguccaacccaccucauuuuguuauuguuuuuguucuguuuucguucuguuuucuuuuguuuuaggcuuuuagcagcugaagccaugguuuuuaguuucugucgcuagugauaugaggaaaagaaggaugagaaaagggcuuuacuggcccaaccagaaacagaaacuaagaauccaugacuguauucucucccuuggacaccucugcaagacucauuaaaugcuguuuaaaauaucaauagauuuggacaguuggguaugccugcauaacucuuacugaccuaagucuuuuucaccuggguugcuguuaaacucacauaccucucacaacucuacuugugcagcuguccuuuuggacauaaaugugguuuauauuacccuugauaaacuucaucuucugagaauuaguucagcuccccagugugucaacaauuaauccuagcuauaagauuauaaauauuacaauuauaauauuuaaaaaauauuuauaauuauaaaagugaaacaauaaccucaaauaacugauaauauaaauaauauacauaugaauauauucuaaaugcuagguagaaaaaaguaucaccaccuaucuuaaugcauacuuuuuguaaauaugacuaacauuuuaggcugaucucaucaucuauaauauuaaaaauaguuaaacagauccccuugaggccaauuuuuagaccauaggauauacacaaauuaauuccaagggccuagccauaauuucucuuaaauauaggucacaugacuucucuauauggaaagcagagacugacagggcaguaugggggaagcaaggaaacaguagagacaguuccucucucuuucgaccacuguccauauagugaccaacuacuucacuuuccuguuuccagggucucucugccaaacagaaacagcauuugucugaaaguaagaaauuauaaaacauaauuuuuguuuuguuuuguuuuguuuuugagacggagucucucucuguugcuaggguagaguccaauggcaugaucuuggcucacugcaaccuccaguuccuggguucaagugauucuccugccucagccucccaaguagcugggacuacaggcaugugccaccacgccuggcugauuuuuguauuuuuaguagagaccggguuucaccauguuggccaggcuggucucgaucuccugaccucgugaucugccugucucggccucccaaagugcugggauuacaggugugauccacugugccuggccuauaaaacaugauuuuaaaagcuuacccucuucaguaacucuaaugcauagcaaagaucuuuuaaaaaauaauuuauccugugauccuaauugcccuuauaacuucccaaugauugcaacacaaauaagggcuaccaauggugauuaccuuggucuuucuaauguuggaauuuauaaauaaucacuugcagucuauacucaccaucuauaauagacauauuucuagaugcugacacagcagucuuugaguuccugcuacggguagaagucuccagaccagugucugcuguuagaaaaaugaacagucaauguacaagccuaucagcagcuaagguuuauuucauacaacacuaaaaaaugaaagcuaaauaaacuuaugucaaauaguuugucuguaaaaagccagacauauauauaagaacaaacaucuagagucugaccaauuuucagagacuauucuuuuaggccacacuucaguuuauccaauuuaauuuauccaauuaaaauguaaggaaauaggcuggacgugguagcucacgccuguaaucccagcacuuugggagacagaggcgggaggaucacuugaggucaagaguucaagacuagccuggccaacauggugaaaccccaccucuacuaaaaauacaaaaauuaacuggcaugaugaugggccccuguaaucccagcuaccugggaggcugaggcaggagaauugcuugaaccugggaggcggaaguugcagugagcugaaaucgcaccauugcacuccagccugggcaacagagcaaagacaagacuccaucucaagaaaaauuaaaaaacaaaaauaaaaauuuuuaaggaaaaauuuuguaaauguaagaauagugaaaauaaucaucauuaaaagaugaggauuucucucccuggagauuuuaaaccaaauuaauauucauuucaccagcuuaaaauuccuauggaugcauauuuaauaaaaacaauuuuaaaaaaucuuuagagaugaacugacauaaugugugagaaagucacugagugaccaauuucuauuggcgugaacuauucaaugacaauagucucacaguaaauacaauguugacuauguuaaugacuaguuuuaggaaucaaauuggggggcaguuuucuuucuuaaacugacuuuauaaagacuacuugauaagcauauguguauuuguaucuuaugacaguaacaaaaauaauaauuguaugaucuggaguuuuccuccuguugccaaaggcuuuuagcuauuuucuuuaacaacucauauuugccuauuacuuugcacaugugaaaauacauaugacauuaaauguauccaaaagguacuacgugacaaacacagugaagcuuuuauaagguaugugcuaagaacaauuaaaacccuaagugcauguggccauucaaaauuuauuuaaguaaaaggcacaugucagaacugccuuaaagacugucuuuauauauuauaaaaauagauuuuuaaagaaccguguuuuagaaauaaaacuuauaauucaacucugacaagaucuaauucuguauuuuccacucaacugccaagugugaaugugcacaggacugaacucagugcucaccucuuccucuuugagacccuccucucgaugcugaauucugcccucuuccaccucuucgaccucuuccucggccucuuccuuuguugguugcugcugagaugcuaucaucagagucauuagccaucuguucugcuaaaucuauacucauaaggucaucagcacuaaaggcagaagcagacuccucugacugagaucugagugcucuggcccuggucauagccuaagagggagaagaaggagaaaguacacacaaugagauaacguaccauccuaaaaaucauuaauuuaggcauugacaugaacuaaucauacuauaaaaacauaaaggaggcugacacaguggcucacgccuguaaucucagcacuuugggaggccgaggcgggaggaucacuugcacccaagaguuugagacaagccugggcaacacagcgaaaccccgucucuacaaaaaaaaaaaaaaaaaaaaaaaauuaggcaugguggcaugcaccuguagucccgagcuacacaggaggcugaggcaggaggaucacuugagccuaggagauacaggcugcagugagcuaugaucacaccacugcacuccagccugggugacaaagagagacccugucucaaaaauaaaaauaaaaacaaaaaauauuuauauauguguaaaggagaaccuccccaccaaucaaauuuaauacuuauuaucugucagaccaaucuaccauacuaccuauaaaaugagacccuuugaaaagguuuaccaagaaaaauaaaauuuuacagaaucaaaauuuucagaacuagaaggaauacuggcaaucaucccuaauucaaugccacauuugacaguaacagacugucaucauuugagcuacuuuuuagaaucggcuccuaggaaauaauaagaaaaaaacuuacaaaaaauagccguuaucucugggcacuaauauuuuagggugcuuuuguuuuuuguucuugaauauuacauauuuucuauauuacacuuuuucuaaaaaauuaguuuuauaaucagaaaaaaacaugaguaacaaucucucacaaauauaugguaaagagaauuaagggcugggcgcaguggcucacaccuguaaucccagcacuuugggaggccuagguggauggacugcuugagaucaggaguuagggaccagccugggcaacauggcgagacccugccuccaccaaaaauacaaaaaaaaaacacaaaagaacaaaauuagccaggugugauggcaugcaccuguagucccagcuacuugagaggcugagguaggaggaucgcucaagccugggggaagcaguggggaggggaguuguugcagugagcugagauugcaccacugcacuucagccuaggugacacagugagaccuugccuaaaaaaaaaaugaaaagaaacggaagaauuaaggagaauauaucaacugaaagccuaagccuaagaaggaauaaacaccuuaggaccaagaacaugccacgcauuuuuaauuugguaagaauccauuuagaaaagacaucgugccacugcacuccagccuggcaacagagcgagacccugucaccaaaaaauaaaauaaaauauaaauaaaagcaauuuugccuugaucuucccuuaaaccaaucaaaagguaguaagagaacaaaaacaaaauacauuuuccauaaaauuaaaaaauaguuccaaacccccaaacacacaaacuauaaagaagaguuaaugaauaugauaaauauuugaccuagcuaagggagaaaggugagaagaguuucagguauuauacagcucuccaaaacugauguauaaaucccaagaagacaugauaacagucucucuugcuuggaauggcaguucugggucuaagaauagcugaccagaacauuucuaagcucugugauaccauaaaguaaggagacccagggcuaaaugaggagaugugaacaaggcaggcagcauaaagugggacugaaguggcaacuucaugaugagaugaucucagcugaggugaaaucacagcuaacucacugcaugcaggguucaauacagcauuacaaugcaaaaagaaaacacuucaggaaauacaacaaaaaauauaagaaacaacagugauuucaauucaucuuuccugucccacaugaaauacaguuaauccucauuauucauuaauccuauauuugcaaauucaccgacuugccaaaauuucucuguaacccuaaaaaucaacacucacgauacuuuuggcaucauuuauggagacgcagagugguaaauauuuugaauugccugacacacauauucccagcugaggcugaacaaugagccacucugccuucuuguuuccacuuguguacuuuaaaguguccuuucugugauagucaugcauugcuuaaugauggaugccucaugagaaaugugucaucaggugauuucauuauugugcaaacaucauaguguguacuuacacaaagcuaaaugguacagucuacuacaaacccagacuauaggagauagccuauugcuccuuggcuacaaaccuguacaacauguuacuguacugaauacugcaggcaauuauaacaccauagcuauguauuuggguaucuaagcauaucuuaauagaaaagauauaguaaaaauaugguauuauaaucucaugggaccaccacuggauaugcagucugacaucgaucaaaauguuguauguggcacaugacuacauauuuauugcauuuucugcauuuuuguacuuuugcuuugguaaugugguguuuucaaaugacccccucaacauguuuaguguucauuccuacaugcaaaaaggcugcaauaugacuuuuggagaaaaaauguauauuagauaaacuuaauucaaguauaaguuaaagugcuacuggcuaugaguucaaugcuaaugaaucaaauguuaaauacaguaucuuuaaacagaaacacauuaaaaagauuacguauugaucagcugacaaaaacguuaucaguggcucauagaaagcuaauuuuguauuuccccuaggagcaaugauucaccauuugcuaauucugugcuggaagugauuuuauacgacauaacuaccacaaauaaaaggaaccagcuguaugcuuuuagaaagcagacuuaagagaaaaaagaugaucuaaaucacauaauuaauaagauagaucuaauugauaaauguugaauucuauacacugaaaauuaauaauauacuucaagaccccaugaaacuuuuuagcugauacauaacagggugcaaacaaaaaucucaauacauuuuugauaggagaaauaaauuuaucacacugucuaaucaucaugcaauaaaauaaaaaauuaauaauaaagcaaaaaccugccuccugaaaacaaaccagagucaaaacuauaaaacaaaacgaaaguugcagaacaucuagaaaaucauaacaagaauacugaacaucacaacauaugagagagcuaaagcaaugcuuauaagaaagccuauagccugcuaagaauaaauguaaauaaguuaauucuguauccaaaaagcuaggagaaacaaaauaaagccuauccaaguauuagaaugaagaugaaaccauauauuaauagauuuuaaacaaaaacacauuagaaugaauaaauauaagcacugguccuuugggacaaaacaauaacauuaauaaaaaucacaaagcuuuaaagaaaggaagaaaacacaaauauacaucauuagaaauaagagggacgggcguagaggcucacaucucuaauacuagcacuacagguguagaagcucacaucuauacuuugggaggccaagucaggaagaucacuugagcccuggaguuagagaccagccugggcaacauaacgagacuccgucuauauaaaaaaaaaaauuaaaaauuagcugggagugguagcacacuacagagcaagacccugucucgaaaaaaagaaagaaggaagaaugggagggaagacccaagacuuaugagagaaugcucaauucuaaauaaucuggaaaaugaauaacuuaaucugauccaaggugggaaaaaaacagguucaacaaaccaauuaucaaagaaaauuuugagaaaauuauuaaaagaaaaauacucccaaaaaaggaccacaaucagaaaguuucguagguaaauucuaccaaacuuucaaaaaacagauaagcccacugcuauuucaauagugccagagcauacagaaagacagcuuccaaacuguuuucacaaugccaguaugacacaguacugacaaagaacugcgugcacaaaaagaaaauuacagaaucuuauuuauaauuaugaaagcaaauagagacuccagaagcuuauggaaagaccaauauauccauuaccaggggguaauggauauauuaccaggaugggucaauaagcuauguacauaauaauauaacucacuauauuaauggaacaaagaaagaaaaaacccaaauguauaucuucauaaaaucagaaccauguaaucaccaaucauuccugauuuaaacaaauaagcugaugaauaaguggauacuuuaugugucaaaaaacccuaaauaugcuauauuacuauguguauauauccagagagagaaagagagggcacacacacacaaauguguucaagugagugcucuuacaaaucaauuagagaaagaccaauacccggccaggcgcgguugcucaugccugucaucccagcacuuugggaggccgaggcggguggaucaccuaagguaaggaguuugagaccagccugaccaccauggugaaacccugucucuacuaaaaauacaaaaauuagcugggcaugguagcgcgcgcuagcuacucgggaggcugaagcacgagaaucaccugaacccaggaggcagagguugcagugagcugagaucacaccacugcacuccagccugggugacagagugagacuuugccucaaaaaaaaaaaaaaaaaagagaaagaccaauacccuacucgaaagagaaaauguggccaaacaaaaugaccauguguuucauauaaauacaaaugauuuauaaacauaaaaauuaggcagacucauuaguaaaaaaaaguaguaugaacugaaaacaacaguaggaaauaauuucuuaccccuuagacuuguaaagaucaaaagauacaguaauacaucacgaugguaaagaugugaggaaacaagcacucccaaauacuaauggugagaauauaaacuaguuaagacaucuuuggacuaauguggcaguauguagcaaaauuuaaaauaaauaugcccuauuaugauuacuucuuggaaucaauuacuaaccaucauuucuaaacuuuguauuuucccuuugucuaaauacuguaucuucauuuuuaucaucucaaauuguauauucaaauuguauuuuaacucuaccuuuccuaugaaaaacagaguuuacuguuaucuuuggaauguauuacuucuaagagcuuaacucaugagugcaggucuagagccaauggcaaaaauguuuccauauacauuuugugagauuugaaaacauacuauccuacuguuaaacacuuuuuuuuuguggugaaauauacauaacauaaacuuacucuuuuuaccacuuuuagguauaguagagugacauuauguacauucacaugguuaugcaaucauccccccauccaucuauagaacuuucucaucaucccaaacugaaacuccauaccuauucaacaguaacuucacauuccucccucuccccaguaaccacuauucuaccuucuguuucuaugaaucugauuacucuagguaccucauauaaguagagucauauaauauuuguccuuuugcaacuguuuuuuuuucacucauaauguuuucagaguuucauccauauuguagcauguaucagaaugucauuccuuuucaagacugaauaauauuccauuacaugcacauaccacauuuuguuuauccaucuaucuguugaugaccaacuggguuguuuccacuuuucggcuauugugaaucaugcugcuacgaacacugauguacaaauaaguuccugcuuucaauucuuuugguuauguaccuagaagugaaauugcuauauuacaugauaauucuauguuuaacuacuuuaggaacugcuaucguuuuccucaguagcugacccauuuuucauccccaccaccaauguauaugguucuaauuucuccacauucuugccgaaacuuguuauuuuaugguguuuuaauaacagccauccuaaugggugugaagugguaucucacugugguuuugauuugcauuucucuaaugucuggugaucuugagugucuuuucaugugcuauaauuuguaaagcuucuuuggagaaaugucuauucaaguccuuugcccauuguaaaaauuggguuuuuuuguuauuguuacuguugagcuuuagaaguuuuaaaaauauauucugcuuauuaaucccuuaucagauguaugauuugcaaauauuuucucucauucugugggucacuucuucacuauugauagugccugguauuauauuuugaaagaggguaucaacccaccucaaauugagguagaacauaagaaaucagaggccagguaaacuaacgacuguggguaagacuaagaauaguuuuuauauuuuuaaagggccauuaauaaaaaaacaaacaaacaaaaaaacacaagaauaugugauagagaccacacaugucccgcaaagccuaaugguuacuguuugcucuuuuauucaaauaugaauuuaucauuaaagaaaagauuugagaguuuuucuaugugaacaaaagauuuuuuuuuuuuuuuuuugagacagggucuugcucugucauccagguuggagugcaguggcgucaucucggcucauugcaaccucugccuccugggcucaagcgauccucccaguuaagucuccugaguagcugggacuacaggugggagcuaccaugccuggcuaauuuuuguauuuuuuguagagaugggguuuugccauguugcccaggcuggucucaaacuccugagcucaagagauccaccugccucggccucccaaagugcugaaauuacagguaagucacaaugcccagccugaaagacuuuaaagcauacuguuuuuucuccaaauagaagagcuaauagucuuguuugucaguauaaguaauuuaagcauggcgcugggauucauauucuaagccaaaugauucugcaaagcugugaauuacagcuuggcagaguuucagacuccauuaccuaaguucuaaauaguaugcugaaaaugaaaaaauauauaauaucuuaugauaugcugaaaaauuaccuaggaagccccaauuacauuuuagucuuaaaauauagcugaauaucugaacuuguaaguuauuucuucuguaaaacucccauaugaaauuugucacagccucucccaccuuccuuguauaagacguucacucuuaacucuuuuaaaagcuuaaugaaaaauugagguuugucgcuucaaacaugaagaacucacucaaacguaaagaaauauuucuguacccuguuaaauugaaaggguuaaucaauuuuaagcuagauauuuaagaaucaggaaucauuucuuccuagcauuauucuugcaauuuggcaaacuauuucuauuuuaaaugcaccuuauaagauaaauagaaauauaauaaacguguuaagccauuucuaaucuauagcuucuuuuccuuagcuuccaaaaaacaaccuguaaaagauacagugguugcaacuauguguauuucaacagugauucugauguguugcaugacacuuuuagaaguuuuucauuuuuagaaaaccauccauuugcaaugcaccgaauuaauauuauaauaaucuaaaauuuugauaggacacaggaugauagaaaagucuacacuuggagucagaaauauguucaaauucuagcgccacuccaugaccuugagucuggucugucuccucauuuauaaaaugggcaccuaggaaaaauaauucaauaaauaucuuccuuacacaaaugucucuuaucuacuaaauugagaaaaucuuguggcuacagaccucagcuuuuuuauauguacaguccuaauauaaagcagaauaucuaacccauaacagggacaauauaaaauguuugcugaaugaaagcaaucaagacaaaacuaacaguacauaguuuauaacuuuuaaauacuagauagcaaucauaaaacacuaagggcaaucagaaaauaagaaaauacauuucaaucauaaauucaacaaguaccagguagaggccccaaauuuaaguaaaugguugcuaacuuguagauucaaaccugcaaugagacugagaagacagugaugauggugcuuaagcuaauuuuaauauuuuagaauagauaauagaaauugucuauuugcccaugcuugcuuacuuaugguuaacauugcuaaccaaaacacuuuaaguuucuuuuuugcccaaaauaauaucagcucaguaagauaagauuuuaucuauaagaugcucugcuaacaaagagauauuauuuugaguaauaggggcuuuuguuguauauauccccacacacauacaauuaaauggguuuuauuuauuuuuauuuauuuauuuuagagacagggucucacucuguugcccaggcuagagugugguggugcagccauaguucacugcagccuugaacuccugggcucacgcaauccccuccaaccuuagccucucaaguagccaagacuacaggugugagucacugcacuugcuaaacagguuuuagacaagaacaaaauggaaaaaaagagcaaugagcagaauauuuguaggcugaacugaaaucaaccaaaagcagccauccuaagccaaccccagcucacuccuauccccuagaccuauggacugacuauucuaacuaaaccuacugguuauucuaguuuaagaaagugauauauaaacacaagaauuugcagcagaauaauuaccucacggacuucaucaucuucuucauuaguauuuuuuugucugguuucucugaaacgacguaccuagaucauaacagaguaaaucacaaacauguugccuauuccaguuauguaaauauaaaacaaggggcuacaauuaagaaaugcuuuauguuauaaaacuugcaaauuuaacaaugucucacaaaaguaaaucauauuuuuccaauuauuaacguuaaaauugcacaauguacucuuaaaaaaaaaaacucauauugacccgaagcaaaauuauauuaccugcugccaaaauguuucacaucacugaaaaagucuuucagacuguacaggaaaaauucuaauacccuauggguauuacacuucaguaaacuaguuaaaaacaaaaauaucuccuugacaaggcuugaaauauuuauuacauugcaaaucacucuugugcaccuugcugcaagacauccaggaggcucugugaaaugggaucugaaguggguggccccugaagauccauuuuuauuaagagucaacucaugaagguuugcugagcaugguccugguaucaagaaggagacuacagguuucuuuuuuaaugguuccugcucacaaggcucuuauuauacagcuauguauauguucuuuaagcccauuuauuuaauaaucuacucagcacauauuuacugagcaccuucaaugugccauauauuaucguagaaacugagaauacaguuauuaacaaaacagacaaaaagcugcucucauggaaucuauaaucaauugaugauaugggagagggaacagcaaauaagacuccaauguaagaggcuggagcaauuagaggaaucaacaaaagacacugaaaauaugcagccagugaggcaggaagauaacaagagucugguauccugaaauccaauaaaaaacauguuucaaagaaggucaagugagauguaagauagaaaacugacaguggauuuagcaauggcagucacuggugaucuugacaagugcagcuucacuagaaugaugggaucaggagccugaguggauagauuuaauagaaaauggagagagaagaaugagucagcaaauacagaaaacucuuugaagcgauucugcucuagaagaggaacagagagcaguagcuaaaggaaaaugggaucgagaguuuuguuuguuucuuaagcugaaagaaauaacagcauguuuguuaugauucaguagaggaaaaauacaagaauaacaauauuuuaaaagaugagacaguauguaaucgugcccuaggugauaaguagcauaccaaaggugcuaagccauucacagaagagaaaugagagucagagugggaacacugaacaggcacuaugugucagacaguauucuaaggauuuuacauggauuaauucuucuaauccuuacaacaaccuugaaggagggccuauuaucaucaccauuuuauccucagaugaggauacugagggauagguggguuuagauaacucaaugauggguacacagcuaauaaggguuuugauuuugaacacgggugucuggucagagccaccaugacucacacacacucuuucucuuucucucucucccucucucucucucucacacacacacacacacacacacacaccccacacagacuuugcugcucaggagucaugaugucacuccagguggggaugguuauguuuuauuucugguauguaccugagaaaucuauuuaugcuauaaauuagcaaacccaacacauccagagucauagagugaaugguuuuagagggugaacugccuguccuaccucuggaaguacuugguauuaaauaauauuaguuacacauugacaccauaaggcuuuaagagaaccauguuaaccaaaagcacuaaaauaagggaaugaguuuuuuuuuuuuuuuuaaauaacauuguuuuguucuucugcuuagggagaaucugggaaauagagaaagugauccccuguaauauaacuaccuugacauaacuguugauaauauaucugggauauuuucuuuauuuacauaaacauacacaauuacauauaaaauaaaaauaauugagauuauacuacgcaguuuuuuaucuuugaaaucuuucccaauuaacauuagauuagaaauaucuucucauguucuucuuccaaaaugucauuuuuaagcuguguaaaauuuuauaugguauauguaccaacauuuauuguaucaaaacauuuccaauuauuccccacuaugaacaacacuaagaugaaucacuccauacacaaaucucuaccucacuauuuucauagggaaauuucccaggcugaguuaaaggguaaaucuuaagccucuuaauauacucugccaaacugcuuuucaguaaagcuauucaaacguaauacuacuaccagcagugugcuagauacuauuuuucucaaauugcugccaauuugacaaacaaaagauguauuugaguuucuuugauuauccuaggcuaaacaccauuuucauaugcuuauuagcuauuuauauuucuuuuaugaaccaccuauucauguccuuuguucauuauucuaucaaauguuuaauuauuuuuaagauuucuaagagcucauuaauauuaagaauauuaaacuuuuuucugcccacauacaaauauuuucaugucaauaucuuuuaauuuuguuuuuugacaaugugauaugcaaacauuuauaauuucuauguagucaagucuagacagcuuuuccuguaauuuuuccacugcuucuugcuuagcagaaauuuucuaaaugaaauucaagaucucaaucaaaacuuacuaaaaaaauuaaaaugaacaaaaauuaccauccuacaagguucacuuuaaagcccuuucaaaggaucuuuaagagaagauacuauccauggggaacaaaacacuuuaguaccaaccauaugcaagacucuguucuaggcauuuucuacauuuucuaauuuaaccuucauuuuaucauuucaauuuuauagaugagaaaaacuaaacaaaucagagagguuaaauagugauuuaccagaaaaaaaucucagagcuacucuuaaagacagacuauuuaaauagaccuagacacucaaauuaguuacuuaccuccucaucgauuuugucuucgagggcaucaauaugacguucuuuaagaaaucgcuguguuuuuuccaacugguauuucacuaauuccucaauggcaucuuucuccuccuuguccacaaauucuuguacugcuucacccaucccucuuucuguuagcagugagagcugcacauucuguaagauacaaaucacuggaugcagaaauaguuuuuauuccuuacaaaauaauuauagaugagcaaggaaaauuaccaaauauguuaccagagaaaaaauauagugaacagcuguaguuaagccuacuaauaucaggaaccagaaaaagcaaagucaaaaccagaaaugggggaggaguacaggacacgugaaauguagaggccugauggcuaggauauggaguccaaaaauggcagcuaugauuaauagagaugaaauuaaccagugucauaggcaaaauaagagcccccuaaagauguccacgucuuaaacucugggaccugugaauacauggcaaagaggaacaaagguugcuaaucagcugucuguaaaauagggagaguaucagagacuauccaggugggcccaguguaaucauaaggguccugaaaagcacaagagggaggcagaugggagcuggaaggaaaaauaacucuggggaaaugguuagagagauacaacauugcaggauuugaagauaaaaggagagcaagagccaaggaacauaguaggcaccucuagaagcuggaaaagguaagaaaauggauucucccuuagagccuccaaaaaggaagacagccaugccaaaaccuugauuccaguccuguguacgauuucugaccuacacgacuguaagauaauaaauuuguguuguuuuaaaccacuaaguuuguggaaauuuguuucagcacccauaggaaacuaauacaaccggaggaucuuagaguggcauauacuuaugacguaaguuucaguggcuucaccaucauuuggcugucuuuguuuguagaauaauucugaaauuacauccaaaugugagaaaacuaaaucuggauugagaucuuuguaacagagauacaaauaaaguaagaaaauaacaacaacaauaacaguuauguuaauaaugguauucacaauuaacauuaauuaaacacuaauuuucuuugaugugcagcaacuacaaaugaauguaaaugucacccuaguuacuucuaaguuucacuuaagaaugucccugauuuaaguuaaaauuauucaguuuaauaauugcaacagagauacaaagaaagagaauaacaacaucaacaauaacagcuauauuaauaacaguacuaauaacuaacauuaauuaaacacuaauuuucccugcugugcagcaacugcaaaugaauguaauuaauugucacccuacuuacuucauagaaacauuuugaggauucauuuuguuuaaacuaucaacuaaacauauccuaaauuaaaaucuguuacuauaagguagccauuauucaaaaugugaacuguaagaaauuaccuucucugcgguuugaaaguacuguuuuacaagaucuucuacccuuaaaguuguuccuucugaaggcuuugugauaaguuucccaaaguugaucucuucuccuagaaaaaaagaaguauaucaaaaaauagcuucuaucauaauguuaaaaugugcauacucauugcaaguugucaguggagaagguaaggccaaacuuuagcaacugccagcuugcucaacaugguaaauuuugaggcaaaacaagccauuuuuguuaauagccacggucuuuuccccacagucaguauuucucguucauaccuccaggauaggugucuuguagcuguucucacugggugaagcacagacuucuggagguccucaagacccauucagggaguaauaacgucaaaaauacuuucauaauaauccuaagauguuauuugccauuuugccaucugccaucauugcuacacugacgaugcaaaagcaaucauggguacugcuggugccuugugacgucaagguaguucgguauugauggaacauaucucaaaauaauaagagcuauuuaugacaaacccacaaccaauaucauacugaauggacaaaaacuggaagcauucccuuugaaaacuggcacaagacagggaugcccucucucaucacuccuauucaacacaguguuggaaguuccggccagggcaaucaggcaggagaaauaaaggguauucaauuaggaaaagaggaagucaaauugucccuguuugcagaugacaugauuguauauuuagaaaaccccaucgucucagcccaaaaucuccuuaagcugauaagcaacuucagcaaagucucaggauacaaaaucaaugugcagaccaggcgcgguggcucacgccuguaaucccagcacuuugagaggccgaggugggcggaucacaaggucaggagaucgagaccaaccuggauaauacggugaaaccccgucucuacuaaaaauacaaaaauuagcaggggcguggugacaggugccuguagucccagcgacucgggaggcugaggcaggagaauggcgugaaccugggaggcggagcuuacagugagcugagaucacgccacugcacuccagccuggguaacagaucaugacucugucucaaaaaaaugaaaauaaaaacaaaaucaaugugcaaaaaucacagcauuccuacaccaauaacagacaaacagagagccaaaucaugagugaacucccauucacaauugcuucaaagagaauaaaauaccuaggaauccaauuuacaaggauaugaagguccucuucaaggagaacuacaaaccacugcucaacgaaauaaaagaggacacaaacaaauggcagaacguuccaugcucauggauaggaagaaucaauaucgugaaaauggccauacugcccaagguaauuuauagauucaaugccauccccaucaagcuaccaaugacuuucuucacagaauuggaaaaaacuacuuuaaaguucauauggaaccaaaacagagcccacauugccaagacaauccuaagcaaaaagaucaaagcucgaggcaucacccuaccugacuucaaacugcacaacaaggcuacaguaaccaaaacagcauggugcugguuccaaaauaagagauauagaccaacggaacagaacagaggccucagaaauaacaaugcacaucuacaaccaucugaucuuugacaaaccugacaaaaacaagcaauggggaaaggauucccuauuuaguaaauggugcugggaaaacuggcuagccauauguagaaagcugaaacuggaucccuuccuuacaccucacacaaaaauuaauucaagauggauuaaagacuuaaauguuacaccuaaaaccacaaaaacccuagaagaaaaccuaggcaauaccauucaggacagaggcaugagcaaggacuucaugacuaaaacaccaaaagcaaugacaacaaaagccaaaauugacaaaugggaucuaaguaaacuaaagagcuucugcaaagcaaaagaaacuaccaucagaguggacaggcaaccuacagaaugggagaacauuuuugcaaucuacccuucugacaaagggcuaauauccagaaucuauaaagaacuuaaacaaauuuauaagaaaaaaucaaacaaccccuucaaaaagugggugaaggauaugaacagacacuucucaaaagaagacauuuaugcagccaacagacacaugaaaaaaugcucaucaucacugcccgucagagaaauacaauucaaaaccacaaugaaauaccaucucauaccaguuagaauggcgaucauuaaaaagucaggaaacaacaggugcuggagaggauguggagaaauaggagcacuuuuacacuguuggugggacuguacacuaguucaaccauuguggaagacaguguggugauuccucaaggaccuagaacuagaaauaccauuugacccagccaucccauuacuggguauauacccaaaggauuauaaaucaugcugcuauaaagacacaugcacacauguguuuauuguggcacuauucacaauagcaaagacuuggaaccaacccaaauuuccaucaaugauagacuggauuaagaaaauguggcacauauacacuauggaauacuaugcagccauaaaaaaugaugaguucauguccuuuguagggacauggaugaagguggaaaccaucauucugagcaaacuaccgcaaggacagaaaaccgaaccccgcauauucucacucauaggugggaauugaacaaugagaacacuuggacacagggcagggaacaucacacaccggggccugucaugggguugggggaggggggagggauagcauuaagagcaauaccuaauguaaaugacgaguuaaugggugcagcacaccaacauggcacauguauacauaugcaacaaaccugcacguugugcacauguacccuagaacuuaagguauaauaauaauaaaaaagauugcuaucuaauuuuuagaagacaagagaauuauucccacugucaauuuguuuaagacauuacaaucauauuaaaacaucuuccauuauuauguuacaguuuuuaauaaagauuccuucacaaauccuauaagaacauuuuuuuaccucauaaaaauaacuagcuuaccuguuuuuuccuuuuguucucuaugccugaaaaaauggauaaugucuuuuggauuagcuacccgauccacaaauuucuggcuaaagcgaagaacacugaaagguucaaaaccuccacuauaguccaccugaaaacacagaauaaucuaugaacgcuaggaaacaacaauuugccaauuuuuaaaacacacacuaauccuucaguauucacaguguuuaugcuugauacuuugaaauuuaugaauuaauuuucuacaguagaucaugauggagcuauaucauuuauccuacugagaaacuaauguuugaaaaguuuauaagcauaagcaaaauacuuuguucgauggaaucaagguauugcaauaauuuccacaaugcagaaugauuacaucucccccugauaacacuaauagucuagguaccuaccaagcaaaccaucugaaaacaauuuucugaacuuucaaaacaaacaaacaaacaaacacacaccaaaauaaaauacuagccuuaaaugcauuaguaaauuggucuaucaucuuagagaugugccucaagagaaagaugaaugcuaggaacauccagguaauaaagaaucaaaucugugagccuugagaaaugauuaccuccaaaacaugguaucucacugaaacugagaacuucucucaagguagacucuuucuacagaagucuguagugguaaacagaccuuuacaaagacaaauaccaccuuucuuucucagagauauguucuucucaacuagcuguucccaaaguacgcuauggggaccagcacugcaccaccucacagcuuauccagaaugcucccuaacuaaagugcucccacuuucacucaucaucacuaucugcuaagguuuuuuguucauuuauuugauauuuguguaucaugucucucuuugcaccuccaccuccuguaagcucgacgaauucaaaaccucaucuguuuuaucaucccuauauccugcagcauccauaauagcagguacucaguaagauuuagucaaugaauuaaugaaugucuuuuagucaguacaauguaguuuuguaauauuacuuauaugacaauaugugcuguuuuaugaaugaauucguaauuuacugugcuuaggaaaagaaaugccaauuuucuauuaaagucugguuaguuuuaaugcugugaggcagacacagaugagaaaauugggaucuuuugccauaaugaagagaacuaugugauucccuuaaaguaauuauuuuuguauuacccagaccaucucucucucucucuuuuuuuuuuuuuuuuuuuugagauggcgucucacugucacccaggcuggaaugcagaggcacaaucucagcucacugcaaccucugccucccggguucaagcgauucucacgcuucagccucccaaguaguugggauuacaggcaugcaccaccauaccuggcuaauuuuuuuauuuuuaguagagacaggguuuugccauguugcccaggcuggucucgaacuccugacgucagaugauucagccacuucggccucccaaagugcugggauuacaggcgugagccaccaugcccagccuuacccagaucaucucuacagcuaccauguuauaaaagacaaaauacuaaaugcuaaagcuauuaggucucuccuucaaacuucucauuuauaaauguuuggucauaacaaauuuuauuggauguccucaauguucuaaguaugcuguucagggccagggauacaaccauaaauaaauacaaucuuggcugucaagaaauucacaaacugacugggaagaaaaacauguaaacagaucacuggaagcagacugugaguggugcuauaagagguauguacaaaguuggaugaggacacaaaggaagaagcauguucucugugggcaggucaagaaaggcuucuuugaagacagaggcuuuaggugggugcugaagaagguauagagaaaggaggagagaaguaugucccacgcaacaggaucaacauggacaaagguuccagugaaauaaacuccacugcacccaggggacggcagcuuuuuugguuuagaccacaucauguagaccccugaaugcuaaccuaaaaaaguuuagacuuuuuccuguuagugcuggggaauaauuaaguuauuuuuagcagaaaagacaugcaaaacuguguuuuacaaagaucauuuuggcauuaguguggagagagaaggaaacuggaggcagaguccugguaggaggcugcagcaauaggccaggaaguauuaauaagggcuucacuaugccagcgacagugggauaaagaaacgggaacagauuaccuacugugcaacagacacuauuuaauccauuuagaucucauaaaucuacgaagcauuugguuggugcacaaguaacugcaguuuuugccauuacuuucuacgacaaaacccgcaaauacuuuugcaccaaccuaauacaaaccaagggauaagggaugcgguugcucaaggucauacaacuagugguugggccagaaugaagcucaggaagucuggcucuacacuguacucuuuaccuccacagucuacaucccaguacuucucaaauuuucaugaacauauacauuucuuggagauuuuuguuaaaauacaguggguucugaugcagggucugaggcucugcauuuuuaacaauuucccaggcaacaacaacacugcugguuuaaagacuacacuccucaguaccaggccucaggggacuccuggagauacagaacaagaaggaggucuacguaaagauuuugaagucaucacucuauugguggucauuaaagcuguaugccuacacugaaaagagggcuaacuaugagacgggacggauacaaauaacucagagaaugcccaagaguaauucagcaagaugagacacgaucuauuggauugaacaauuaaaggucaucuuuuccacugguuauggugaagucagagccuugguuauagugaacugaagaagagaaaguuaagagagauauagguuauauacuuuuaggggcuuuuaaagagaguaagcaacaugggguaggaguuuggaaaagggaaaagcauagugguaaagaagaagucuguuguuguuucuuuguuuauaacacgauagaaaggauaagcagauuuauaggcacaggaaacaauccuaauaauaaccaaaacaaauaaaccguacauagauuagaaggauguguuacggggaaaaaaauaagaagaaaagaggaagcagaagaagguaagugaaaucagggcacuggagagaagguaggggcugcaaucuugaugauagggcugcagugaggugacacgggagcagacuaaagggagauaagagcacaucccacaugcccaagaaacugcgagaaggccaagaugccuggaaugaagugaguagaggagguaguuaaagaugaagccagagagcucagccaaucuauuaaauauaacaacaaauuauuuagaaaaugagaaaaauaaguuaccaaaccuaucacuuaaacugugauuaacucaaauccuuauaucuuuguuuuugccuccgauggugauugcucuucuuauuacuaugagcacucuccucacuacuuuucaaagaaaccauguaaacuguacauuacuaugcuuugaaaauuaauaauauucaaucuauauaaauaggacuuacucgcagucguacaagaggcuucucuggcuggugagaauuacccagacguucccguucagcauuuucaagcauuucuucaaucucaaaauuuuuaaaaagauuaaaaaacaacguaguaaacugaguuuaacuuggcugaauagcagcuuauuaccacaggaauuuuccugaacuacauaaucaucuuuauuuccuaggucauuuaugacaccuuuucaaauauaccuucuuguaaugcuccuuuaauacuauuccuuaauguuuuccuuucaugaaaguucuucauaauuuuucaaucucuaaaauaauucuuuuagaauaaaacuuaaaauauuacuacucauguuucaauaaggcuuuccucagcuuaccaacuuaaaaccaaguaagucuaguuuuugcagucauaugauccaugggagacucaccagaagauuuagggaucaauaagcaaggacuuuagauuauuuaucuuggaagaguucaagguaaaagaaaauaagacugauguuuucaaauauguggaguugucucauacucugagaggauaagauuauaacaucuuagacuugaaagaguucugaagacaaaagcacuuguucuauauuguucuuaaggguaaaaccaaguuacaaggagacagcacuagauuauuuucauaaauggcugugugcacagugauuagauaucuccagauggccaacuucauagcugaacaauucuaguucuuagaaaguucuuguauuggaacaaaaacugccuuccuauaacuugguccugaucucaagaacaauacagaacaaguguuuuuguccucagauuucuuucacaucuaagacuuuauaaucuuguccuuuaaacugucuguaacaaugaaguccaaaagaguuuucugcaauaauuuuuucuaugugcauauucaauaugguugccaaaaccauauguggauauagaguacuugaaauguggcuaguacaagugagaaacugaauuuuaaauuuaaauguaaauaauuaaauguaaacgccacaugugcuagugaauacauaucagacagcacagagaaaaucuauaagaauaugaucuccuaggucaauuauuucaauccaacaagcauuuauagagcaucauuuugccagguacuaggucaagugcugagacagaaaaguaagauauggguccuguccucaaagaguucagaagacacucacaugcuuauaaaaaauaauauaacuuaacuaaguacaauaacagaaauguacauaaaauacagagauaacagaaaguuaugugcacaccugguguuuaaaaugaaccucuauuacuuugugucaccagcgucuacuuuccucucuggauucaugucaccaaagcccacaggauuuaggugaaguucauacaguagaccucaaccagaggugacuuugcuucucuaaggacauuuggcaaggucuguaaacauuuuugaucaucacgaccaguuagaagggguacuacuggcaucuaguggguacaaaccagggagaauacugcuaaacaucccagagugcacagaacugccucccacaacaaagaauuauuaguacaaaaugucaacuaagccaaaguugaaaaacccaggucugacuccagggaagggcacaugacucaggccuggaucaaucaaugcaaaagcaauuaaugcauuuucuaucucuuuggcuugagagauuggauuuagggaugccagaaucuuaaucuauguuugaguuucuagagucaaucaucuugaaacaagcguacacuuuugguuacgugagcuacacacugcucaaaaagcugugacacugaaugagucaccuuaucuaagguucaguuccucuaaacuauagaugguagaaacuacucacauauaguauuguuggcuagauuaaaugcugucaacagugcacaucacauacaguaaaucaguaaguaucacuggucauaauuauuaucauuguuacuauguuaccugauuuuucaugaaaagaaaacauaguaggacagcugacacagaguuaagaacugagcgucagcaagugaugcuaauuaagcugucaaaccacauauuauuaaaugcauuaauccacccaaccuuaguaguggcugaaauuuucuagagauuuagggguggcaaugugcauagagagggagguuugggacuuacauugcagcaauaggguggauagcaaacacauuuuucacauuucauuugggguagcuuucagggugaaagggacgccuaauacagauuauuagaagcuaaggcuuuucucacacacgauagucucccauuccucaaucaaaguuacugccugcuuucauaaauaaaaugaacaaaucaucaaaucaggauuaaaaaggagaaaagauuauguauuauguuuuugaaaaggaagaaagaaacuaggagagagauuuaauuuuuuuuaacauccaguauuccucucucucaaugacuuaaaaaaaaaaaucuuggacacaauuaaacacauucacugaagaacaguguccuuacaggcuucaugagaauguaaucaacauaaaggcuucccucuacucuauuaaauuacuuaauugaaggugaauaauucuucaacuaaaguagaucucauugacuuuaucaaaaagaauuaccuucuccaaacagaagcuuuguauggcuuggguuacuuuaggauuaucuggguuaaaaaugucuggaugauuagcuagaacaauauccuccaugaaaaacugccgcacugugugaagaggaauuuuaugcauauucaucuuccucccuuuaauacgcagcaaaccaacaugucugaaguggagagaaaugaacaccgagucacaguguaaauuuccucagggugaugugcaaacgaaagcuuucauauuucuuaguuucuaaaaaugcuucuuuauaaaaucauacucuuaaaaauaaauguuucugcuaauuuaaccuuaauguuaucaucacaggaaaagaugguagacauuuuccuuccccagaguaaaaucaacucauccauuauuaucccugucugaucagucuuguaagauagacauaauaagcauaaaaaaauguuaacaggacuaugaugguagcauauguagacuauaguauuacaucuauauaccuauguauauguacauacauguacacauauagacaaaaugauuuugcaguggacucaugaagaaaaaaaaccaaccaacauagauucuacuaccauauucuuuaacccuauuaucauuguaacaaucagaacucaagugauucaaaagauaaaacccauaauaaaaauugaguuuaaucacuguuaacuacuucuuacaaucauaucauucccccaaaaauguuuuaaaaaugagaucuauuauacugcacuuauaaucagaaaauuuucaauuaaaugguuuuaggauaauuuuuuauaaugaacuuugugaaauuaguaaucaucaaccuaaaacaucuaccuugaaauauaauaaaaaugugcaucuugaauuugccuaaugagcagcaaaauaacaccaauuggaugcucucuuuuugaaaauggcuuaaaaucuggaaaaacaauaagacuacacagaaugaucaauuuucaaaaauaaagcuaucauauaaaugacaauacugccaguuagcgguaaccuuaacauaggccuuaaaccuaugagaugauuaguuauuauagcaaagauuucuuaaaaauuggcucaaaauauauaacacucacuucuuuacagcuucuccuggggaaagagaaguaaccacugagcuuccagguugugagauauaaaacagcuguuguucauuuuugguuggagcuauuuuacacucauguucauggccccagauaacaagaucaaugaagucauccaaaaauuguucuggaaugaaguuaguacuuccauguuuacuccuguaucaagauuuugaaaaauauaaauucggugauuagaaaaauuucauauuauugaagucuauacagaucuuucuuucuccauucacuaaagauuuuauugcauccuucuauguaccagaaagugugcacaggauugggaauguaaagaucaucaaugcuaacuccugaccuugagagcuuuacaaacuuauuggacacagacaaguggaaacccgaaaagagaaagcagucaauucuauauuuggaggaagaucaugaaagguuuuacauaggaaggauuuccccuuuggucaaucagaaaagcaugaauucuaucaauaguagaaaucuauaaaucagucuaacuauauacuagagaaaacacacagaaaaugcaaguaaguauaaauauguccaguaauuucuuaacauuaucuuuuuacuaauaaauauaaugggaguaaaaacaucaaucucacauaagugcuaagaguuuucaauaucaaauauuaaauaaacaagugauaugcaaacuaugguauuauaccuauaucaguuauuauuuaaagauacaugaaaugcaaggugauagaagacaagaaggaauaguuuucccuaauauuaacuuacaucauuggagauucaaguaaaaguguucacauaguuuaaccaagcauucauuuaauccaaaccaauauucuuccauucacccaacaaauacuguuacccaaacacugucuacuuuaugucagaugucccaggcuucuucuagauauggaagacacagcagugaacaaaguccuuguucuagugugggaaacaagcaaugcagguugagucccuaaucugaaaauccaaaauccaaaauauuuuaagugccaacauggcaccacaagugguaaauuccacacauaaauacuuaacacaaacuuuguuucaugcacaaaauuauuuuaaaacauguauaaaauuaacuuaaggccauguguauaagguauauauaaaauguaaacaaauuucauguuuagacuuggguuccauccccaacauaugugcaaauauuccaaaauccaaaaaauccaaaaucuuaaacacuucuggucccaagcauuucagauaagggauacucaaucucuaauacaagauguauaugcauguguguaaguaugcacauguauaacuugucaguuagugauaggugcuguaaagaaaaauaaagggaaaagugacauagaagugccauacuccucucuacauacacaggguagucaggaagaccucucugacuagcaucaaaugagcagagaacugagaugaagcaucaguacgcggagagagaaaguccuaagcaguagaagagcagauggugcuaaagugggaauguguucagugaauucaaggaacagcaaggagaacagaagggcuaagcagaauaaaugcagggaagacagaauauacaggcuuguguauccaggaauguuuuuauguaaaaaacauacaucuaagguaugagauuaucacaacuacuaaagaaaagcagaauaauucccaaauacaacaugaugccauugugccuucauugagugcugguucuuucccggaagaagaagggaggaugaugcugguaggcugacuguaauuugugaccuagaagugaucacaauauccuuguugaaagauuuugcaugaccaagucaucuccaaauucagauucuuucuucuuugaaacaagagaaaaaaacaguugauguagagaaacaaaugggaaauaaggcaaaaugcagaaggcucaagauucucacccaaucugugaaaaccuucuuuguuuuaaauaugaaagcagaaguaucuugagaaugcacagggugacaaaugaaucuaacagcauuaccaaagaaccacauaaccacagugaaggggguggggagaaaaugagcuaaguaaguuugaaaaauuagguuucaacuagauacagaaaggcuaaagacuaaaauaacuuacacaaacauuguaaccuaguugggaaaguuguuuugcacagggguaugaguuagcaauuuugaaauuacuuuauaauuucaaauuauaccaggauuggaaauauaauuaaaccaagauugaaaaaauaaguaaacauauauauuuauaauaugauccaggcuucuguuagacaaagaagucacaaguaaggaaagggagaagacaaaaauggaccuuguagggcuggauuagaaucagucugaacuuaucauugguuuuuuaagcacauauauagacauguauguaugcauggguuacuauauacacauauaucuauucccauaacucuguucauucagagugcugagcaagcccugguagcaguaagcacaccuaguacgcauuuguggauuucugaauaccacucuccaauaaaaagaaucagagcaccuuggagaaaugguugauuccagggcuagguaggaaaauaucagguuggugcaaaaguaauugugauuuuugccauuacaagagccaagagccuagaccaucuugaggugccaaaaagcuaacuaaggucaugaccucaaaacagaugggaagacauugaaaggacacagaggccaacauaaaagagaaugcaauggucaaagcugcaacaaucagaggaacaguagcaaccaaaaaacugauaguacuggaucuucaaguccauaaugacauaaauaaguaaguaaauagagaagaagggacaaauuuuccuuacagaagaauuccauuaauaaauauagaaagaaugaaggaaaucaaaacuuacaauuaaaauaccacaguauuaauuacuggaaauaagaucacccauggaugcuaaaauuagcgaguaaaaguuuaaggugaaacaggauauuugcauagucucaaaguauuuucccaaaaauauuuauuaauugaaaaguagaaaaugggaacuuuacagcagagaaagcuguuacacauucccuuaaucaaaugaugaggggggcaaugagaaaaaucaacaucauauggugacuacccauuccccuuaccaaugcugcuauucuaccuuucauuuggcuuaaauucuuagaauuacuuaugaguuuuccuuucaacucaucaucccuacuuuggcauaguacaaaaaaaugguagaccugggaagcucuauggaagagaaggaacaaaucccaguggugcaaaguuauaugaagaccacacacauaucuaaacucuggccugccccuccuuugaaacucacaguuuauucaagaacucacacauaagguaacacaagucagccucuuaaacccuuucuuuuaccgaguauuuaaccuaagucugcauucacugaaugcacagaguagucugcauucaauaaauguguucaauaaauauagcuggcccucuguauuggcagauucguggauucaaccaacuaaagaucgaaauauucaggaaaaaaacaauaaaaaauaacaacgaaaaauauaaauuuuuaaagcaauacaguauaacaacuauuuaaacaguauuuacauuguaucagguauuacaaguaaucuagagaugauuuaaaguacauaggaggauauauguagguuauaugcaaaugcuauaccauuuuauucaagggauuucagcaucccaggauuuuagguccuggaccgaacaccccccguggauaccaagggacaacuguaauaaauuauauaaucaggccccaaauccuuugaguucuucccugacaacuucuccggugugucccucccauuucuguuucauugccaucacugucaccaccucacauuuuuacugcagugaucagauaauaaaucuugcuucuucaagucugucuucuuuucaaucaauccuauacccugccaacagauuaaauuucuuaaaacuacuaacaaaagaaagguaaucuagcuauauuuguauauccuggaagaacacuugcauauauguagcaggaaacaugucuaagaauguucauaacagcaagguuuauaaaagcaaaaaacuccuguucacugacaggaggcaaagcauaacuguacacaucaguaaaaauaaauuacacauccaagcaucaaaauggaucucaguaauguaaugcugaacauaaguuggcuguaaauauagcauaauaugaguauacaugugauuaaacagcaaagaaaagcaaugaaauaauuaauucaaaauuaauaaugcuucccuuugggauagggggaagcaggugggaucagggaaaaggaaugggauaaaggaauggauaauccaacaaaaagauucuaccuuuuuguugaauugaggaguauucauguguaugccuuauccuuauguuacaaauauucuuguagguauuaauauauacuaaaaacaauuucaaaaugaaaucacacaaagcaaaucuauguuuugucugaucuugcauugacaaccuugaaagauuaagggcauuucacuaaaauagguaagcucagaaacagauuugggaagccucagcacuuggcucaaacuuuuucagagaaaaguuuuaccuguucugaugaaucacaaauaaguuaaaccaagaguucucaucuuccuuuggucucaacauuguuacuuuuuuauugacaaacauucgauagagccuuucaucuggaauggauccugaaauggacauuacauuauuuuuaaauuguuuucuuacuucggcuuaaaaaaugaaucuauuuugcuucuaaauuauguccuucucaaaguauuucacuuuacuguugggagauauauuugaauucuggaauaauuuauaaguggguauguugcagguucuuuuuuuaucuuuuuuuuuuaacugagacagggucuugcuauguuguccaggcuggucucaaacuccugggcucaagcaauccucucgccucagccucccaaagugcugggauuacaagcauaagccaccaugccuagcuguuucaggguuuuuuuucuuuucuuuucuuuucuaaacacagucuugcuccauugcccaggcuggagugcaguggugugaucucagcucacugcaaccuucaccuccuggguucaagggauucuugugccucagccuccugaguugcugggauuacagcaugcaccaccacgucuggcuaauuuuugcacuuuuaguagagaugggguuuugccacguuggacaggcuggucuugaacuccggaccucaagugaucuaccugccuuggccucccaaagugcugaaauuacaggcgugugccagcacgccuggccuguuccagguucuugauaacaguaguuaguugcauuugaaaaacauuuuccauuucagacauauacauguucaaaaccagcaaaauguagaauaaaaaugugaguuuucuaugguaaaauucuuauuaaaacuucuaguaauacuauuuuucaccaucccuuuguuauaaauuauauauacuuuugaucuaauauauacauuauaacaugugcagaaauaaauauuaaaagggaugauaaaaguguauuuaaaaacaauauucuuacauuguuuuaauauauugugcuuuuuaaauaacucaaugacuuucaaacaauucucauacuccacagguucaccuugaucuagugaaagaaacuaacaaaaacaagucaacaaaauaguuacaaauauuaaauauuauaaaaggagaaaaagccaggaugcuaagauggcgaauuaacacuauggaauuaaaaggguggacaacacugcuacuuuauauacggauuagagagggucucagaagaaaagccaacaauguagaagucuagaaguuagaaguggccuagcucccaaggagaaugcuacaggaguggccaauggaauacauggcugagguggaauguagaacauguaacuggagacaaaaaagucaaggcacacaaagcccaaggcauuagaagauuaaucuacuugaguguugaaacacuaaaaacacuggcaaaauugaagguagguaaguagguaaaaagucugagagaaaaagcaaugcgguuuagccagauggcagaagcuuaaagggaacaguguguuugcaggcagaaaaggaagcaguggguggagcaaggagaacagugauccccgcuucuuuccaaaagcccagggguaagagaacugcaugggacacaggaaccucaggggacagcugggcuucacugaagguuagaaaguggagguaacauucagagaagagacugauaauaaugaggaaucugauaauuauaaaaagaguucuagaguuuauaaugaagagcugggggacagggaggggugcaggguggagacagaguccaguuaaggaagguauaauagaacaggauaagauaagaguuugggagaaaauggaugacuggagagaugugcuucugguggugacugaggcauaauggaaucuguccuuagucugaauggaggaggaaaggcaauuuucuggagauaugaucccuaauaacacugcagugauuaaaacaacuguuaauagcuuuuuuaagaaaaguauauuucacuuccugcucuuucacuugcagaaucagauauaacauccagauuucauuuuccuuaucucuaaaauauaaauaaccaugaugcuuuucuacuugccagagguauuaugaaagcugcacaaaauuauaagcuagcgguauuguacagugaagcauuagaccuuucaaagacuuccaagauaucaaagugcaguuuugcuaauuauucuauaauucuaacauucaggauucuacaccugagucuaaaaaaaacccaaaauaauaaauaguaacgaaaagacauuuuuucaccaaaaauuuuuaccaaaaccauccaucauuuuuuauagucaccaauaaagaauaagguuugccccauuuuuuccaaacagauacaaacuuaucuccaaauuucucaauuguuuaaagaaucacacauggacauaaacaguaaaauaaaacugucuuaccuaaaccauauagcgcaaucuuugugcuuccuuuuugaagcaaaaccggacuaaugucuaucuucuccacagacauugaacguccaaagugauuuacaaauccagcacaacuuaaaauguccaaggcacaaagugcaucugccuaugcaaaauaauuucaaagaauguuaguguguauguaaaaguagguaucugcaugaauaucguaucaccuguuaaaagcauacuccauauucuacuuacaaaaacauagaugaggauagugucuucucaaaacaaaauuacaauaguaaaaguauuugcuacauuuuuguacuacaaaucaccuacagcaacuggaaucacaugccaaaggcaagguuaauaucucaucaaaacuuaugaugucuuggccacaaaaaaauaaaaauuagccaugagauaaaugcuuuguaauauuaagcaaccgucuuaaagccuggggaaaaaagaccauagauaaucagugauucauaauauuaaugaccagauaaaaugaaaaaauacuuguaggaucucuagucuuacuuccauaucaaacagguaauaagauaaucuaauuuagauuuaaagauggucuugaacaaucauuuccuaaaagugagauuuuauaagauaguuauaaaaacacugacaaacuguaaaccacuauacagauguuagguguucacuccuacuccuggcuucuuauuguuaacaucaguauuaaugaaauaaaagcauagcucauacaccaauucuuauuucagauuuuuaaaaaaucuaaaaagcaguauaaaagcuuguaugaaugugaaaagucaacuugacuuuugacucaauuugacuacacaaugagaaaaagggaaggcaugcuuuccacagacaaacuaaacugaucauuuccaaaauuccaacaaacucuaagaaaacaauaauuaccccugugggaucgucaugauugccaugaauacuaaacacuggaauugaaauguugagguugccaucuugauaguucacccauggaaaccuuaaaaaaaaaaaguuacuuaaaauuuccauacgggacaaaagcuguuuucccuaagauucuccuccaaaauauuaaugcaaucauaggcaaacugcauaaucuacauuggcauaugaccacuaguuuagagcuuuaaaaaauaaaaucauaggcgacaauucauuucaauuaguuugaaaauaucucaaagcacuacauuuuaaagaaaccccaacuauaauaaacagugcuugugguauguaugaguaguauaucuaauuaaugaaaaguuaauaagccuucaaaauuuuaaaaacuuagcauaugguuuuuauucguaguggggggagggaagaaaauccauauacuuuagaaucccaaagagguagauuaaaacucccagcucuaucacuuauugccuguucaaauuaaagucuccugucagccccugcccccagccauccagcuccucuucucagaggcaaauaauguuagcaauuucuagugcaucuuucaaaaggauccuauaccuauccacacaaauaaacagauuuuucuuucuccuuacauaaaugauagaaaaauauacauuucugcauccugcuuuuaucacucaacauauuuuagaaaucauuccacaucaguacaugaagaccuuucuucugcucugucagccacacaguacuccauugcauggaucaccacaauguguuugagcaguucccuaccaauggacauuuagauucuuggcagucuuguuuuacaaacaaugcuacagucaguaaucuuguacaaaguaaucuucuacagcgaguaaucuuguugcccuggugagucgaccuguaaaggaauaccuggaagggaauuguuaggucaaagaguacauguauuuguaauuuugauaggugcugccaauuucccaccauagagauuuacacauaaugcaauggcagugcacaagagggacaguuuuccccuaccucacuaacacaguaggucauccagcucuuaaaucuaugcuagcaguucuuaaugcuagcagcauguuggaauuaucuuggggaucuuucaagaaaugccaaugcccaugacauacuuggagagacucuaaguuaguuggccuggagagggggccauccauauuuucaaagguucuuagguaacuguacugugcacucaggauugagagucacagaccuaugccaaccuuauaggagaaaaauauuucaguauagcucugucuuuuucuuaugagugaaaucaaacuuuuaaaaauagguuuaggccggaugcgguggcucacaucuguaaucccagcacuuugggaggccgaggugggcagaucaccugaggucaggaguucgagaugagccuggccaacauggugaaacccugucucuacuaaaaacacaaaaauuagccgugcaugguggcacaugccuguagucccagcuacuugggagacugaggcaggacaagugcuugaaucugggaggcagagguugcaguaagccgagaucgcgccacugcucuccaaccugggcgacaaagcaagacucugucucgaaaaaaaaaaauaaaaguuaaaugucauguuauuuccuuuucugugaaguauguccauauucuuuauuuauuacuaacucaugaauuuuauugucuugaaagaacugcuuauuggggaauucaaccuuaauuugcaauugguugcaaauauucuuccugauugaacugugacuucuggcuuugcuucaggcaguuuuuggcaugcagaaauuuauuuuugcaaagacaaauguaugaaucuuuuaugacuucugggucuugugucauacuuagaagccuuccccacaccuagauuuuuaaaauauguguaacaguuucuccuagcaguuuuacugaauccauuauuuccccuacauugugagauggugaccuucaucaaauacucaauuccuacauguauuugaggcuauuucuagaguuucuauucucuuucacuuaccuaucuacuaauucaugagccauaccacauuuucaauuauuguagcauuguuauacuucaaaucuaauuggcuacuaacuccuuaguagucuucuuuuuugggauuucccuaucuuugccuauuuucuacaugaacugugaacuggaagauuaaauuauccaaaaugaaacacaaagagguaaaguuaugggcaauauuuuuuuuaauaguaugcuauauaaaugauauucagaaagagaaaggaaacaauauuugaaaacauaaugaauagaaugggaauuuccccaaguugcugaaaaacaauauuacauuagaauauaugauaaagcccacgcggaacaaacagaauuaaauccacagcuaaauaagacugcaacauguuaagaacaaugagaaaaucuuaaguuacccaaguauugucuuuaugcuggucacuacucuagccauuuuucuuaucaucucaaucuucucaacucuguaagauuggcacauuucuuucccauguuaugaaggacagaacuaagguagaguaguuaagugacuaacauaauuuuacaacuacuaaaugacagaaccaggauuugaacuccagcuguuuuauaccggaacccaugcucuuaaucacuaugcuaaacuuucuagcaacucaccuaacaguagacuccucaacagcaacaaaaaauaagaguuuaccacucacugacacuccaugaaaaaacuacugaaaacugugcuucagaaagaaggaaacugaaucuacacaaaagaaaugaaauacaaggaacaacagugagcaaagaaauagguaaacauguauauaggguggggaaacaguuuucaaaacagaaugcaauuuaaaaauaagaugaaagaaagaaaauacugaaguuaaaaaaugucccggcugggugugguggcucacgccuauaaucucaacacuuucggaggccaagucgggaggaucacuugaggucaggaguucaagaccagccucaccaaccuggugaaaccccgucucuacuaaaaacgcauaaaaaaauuagcugggcaugguggugcacacuuguagucccagcuacucaggaggcugaggcagaagaacugcuugaaccugggagguggagguugcagugagccaagaucgugccucugcacuccagcuugggugacaguaagacuccuucucaaaaauaaaaaauaaaaaauaaaaaaugucccaaguuuuagauuugaauagaaggaggguaaagacauugaucacaauuuugaaaaacaaggacaaaguauuauacaaaucuuuuaaaacucaauuauauaugcagccaaacuaucaaucaaggggaaagugaacauaaacauuuucauguggacaaaaucucaaaaaaaaauuuaccucccaauauaaagucacacuuuaaaaacuaaauaagaaauaaauaugggcugggcaugguggcucacaaguguaaucacagcacuuugagaagcuaaggcaggaggauugcuugggcccaggaccagcugggcaacacagugagaccccaucucuaccaaaaauaauuucuuaaaaauuagcugggugugguggcugauaugcuuugacucuguguccccacccaaauuucaucuuguagcucccauaauucccacguguuaugggaggggccucgugggagauaauugaaucaugggggcaggccuuuccugugcuguucuggugauagugaauaagucuaaagagaucugaugguuuuaaaaaugggaguuucccagcacaaccucucucuuugccugccaucauccauguaagacgugacuugcuccucuugccuucagccacgauugugaagccgccccagccagguggaacugaaaguccauuaaaccucuuucuuuugugaacugcccagucuuggcggguaugucuuuaucagcagcaugaaaacggacuaauacaguggcacaugcauauagucccagcuacuugggaggcugaggcaggaagauggcuugaacccaggagguugaggcugcagugagcuaugaucaugccacugcacuacagcauaggaaagagagccagacccugucucaaaagcaaaaauuaaauaaauaaauaaauaaauaaauaaacaugaguaugucuauucucauggguuaguauguacacauauuuuucuuagcucuguccagugagagccuagaagcaacaauacaauaguaaugugcacauguaacauccagaucuugguuuccaaauaccauucuccaaaaggaaccaggguuccuugaagaaauggcugagucugaagacaagaaagacaaaguaaaaaaucagaagaaaaggugggauauaucaaaaggauacaggagccaaucucaaaaggagcccaauggcuaaagcuggaacaauuuaagccacaaguaaauuaugauaguaauaaauuauaacccaaaggaaaaaaaaauggguuucuacugauauagacaauugaauaaacaaaugugggacaagggacaaaucuuccuuacaaaagaaucccaauuaauacauguagaaagaauauaggaaauggaaaaucacaauuagaauaucacaguuauaacuguuguagguaagauccacugaugaaucuaaaauuaaugaacaaauuuaaggaggaacagaaaagucgcacagccucaaaauaucuacccuaaaauauuuauuaauuacuuuggugguuuuaacuuauguccaucagaaguggaaacuuaacucccugcccuuugagaguaagcuggacucagagacucaauucuaaccaacagcauauggaaaggaaaaaauaaugacuuuacacuggagaaaccuggcagagaccagcuuaaccaagugaucaagguuaaaaucaccagugauaaaucagguugaugucacgcaccuccugauaugaugcgacugaaaggguacuucacuucuugaauauucucccccaaaaccuguaaucccaaucuaaucauagaaagcaggagaaaauaccaaauugagggacguucuacaaaauaccugaccucuuuauaaguaucagggucaugaaagacaaggaaagacagaaaaccugacaugggcugaagaaauuaaggaaacguuucuacuaaaugcaaugugagauccuguacaauguuuaagacaugaugggccagaagcgguagcuugcgucuauaaucccagcacuuugggaggccaaggcagguggauuaccugaggucuggaguucaagaccagccuggccaacauggcaaaacccugucucuacuaaaaauacaaaaaauuugccgggcguggugaugggcgccuguaaucccagcuacucaccuguaaucccaacuacucgccuguaaucccagcuacucaggaggcuaaggcagggagaauugcuugaacccaggaggcagagguugcagugagccaagcucaugccacuguacuccagccugggcaacagagcaagacuccaucaaaaaaaaaaagaaaaaacacaugaugauauuuuuauaauauagggauugacaaauaucauaaauagucccaaaggcacaaauggaaaaaaagaaaaaccaauagauuuaacuacauaaaaauuaaauauuucugucaacaagaguccauaaacaaagucaaaagacaagccauugauugggaaaaaauauauguaucacaaagguuuacuaauuagaauauauaaguaacuucugcaauucagguagaaaaacaaacaaaaaaaucucaauuuuuaaaauaggcagaggauacgaacaggagaggauaccaaaauguacaauauaaaccugagaagauauucagucccaccauguauuuuuuuuuuuuuuuugagauggagucuugcucuaucaccuaggcuggagugcaauggcacaauuuuggcucacugcaaccucugcuucuggggcucaaguaauccucccaccucagcuucccgaguagcugggucaguuccacuauuaauuaggaaaauauaaauuaauacaaugauguacaaaaaaauucaaagaaugauauuuacuaagaaaauagcuuauauggaaggcaaaacaguuguguguuuacgugucuuauacagcaaauaccauacacaaguaaucacucacucaaguaaauaaauauacuuacuuacuaaaaccaaaguugacugacugaucacugagaauuucaaacuggacaggccgaucacccauacaauauuuucuuaauaacucgaggcagguauguaauguuuuccuugagggcuuauuuucaugaaaaagaucaccaccuaacaaaauaaaauccaccugaucaacagaaaaagguguuaaaauuaguauguuuuacagguaaaauuuuuguaaacuacagaugaaagagauaaaaaaaaacucacaaaagacacuauuauauauggcaacuuaaaaauuuacauuuuauuuauucaaagggacuuucaaucugguaauuaaucugguucuaauuuagcugacuaagcuaucuucaaaaaagccaucuuccaauuacaccaagucucugauucaggccacacaaggugaucauauuuuuucuauuauuugaaucaaacauaaacuuagcacuuuaacagaacguaugggaagagauaccaaauucaauccaaaucauucauuuaauucauucagcauuuauuuacagaauuccuacagguucuagaagcucaaaaaauagcaaucuacaaaauagauuauaucccugcccucauuaaauacugacucuaugcaagacccucuacugaguccugaggauacaaugaugaauaaaauaugaucccuauccuaaauauguucaaacucuaauggaagaggcaaacuguuauacauuuaaacauaagucaaacucuggggugcacuagaauggacacguaagcaaccagcagcagagaugacacuacgaugaauuugaacucaagggaggacaauucgccugaggacagaaagucuagaaggaaugaacuaacaugguggcauguuaguugcacuaggaaagauaaaugauugugaggaagagaauucuaggaauaacuucagugaaggagggaaaucauacagaaaaagucuaacacaggcuuucaagacguauacgaugcaccuaaagaaacuuaaguucuuaaucacacaaaagaauacaagguauagaucacugugcguaugguaguuaggauaacuuuaauaaaaaugugagguuuaagcuaggccuuccagaaugaacacuauuugaguaaaaggaagaaaaugaucucaaucaaaggcauggaagaaacaaaacaaaaacaacaaaccaaaugaaaaacauacuggggcgaaaagaaguuguugcuuaaugggugucauuuuugcaagaugagaguaauucuggagauugguugcacagcaauaugaacauauuuaacacuacuguacuauacacuuaaaaaugguuaacaagggaaauuuuauguuauguauuuaauauauuuugccaucauucaaacauuuaaaaaaauuuuuuaaacuggcuggcagugacuccaggaaauauugaaaagaacacgacucacuucugugguauucuugccgaaagugcagaaucugaaccuaaucaugaggaaauaccacuuauagccaauuugaggaagauucuauaaaauaacuggccuguguacucuucaaaauauuagggucaugaaaaacaaaggcaaggcagaugcaggaaaauguaccagauuaaaggagacaaagagacauggcaacuaaaugcaauauguaaaccuggacuggauccuggacaccaccaaccagccuccaaagugcuguaacagacauuacagggacaauuggcaacaucuuaacauuauauaauagcacugaaucaauacuaauuuucugguuuucuaugauuauacaugcgguuuacucucaaaugguucaggaaaaaaaucguguguauuuguaaagagaagauaaagcaaaugugacaaaauguuagaaaaccugggugacggguaaggaauucuaugcgcuauucuugccaacuuuucugugagacugauguuguuucaaaauaaaaaguuuuuuuaaaaaaagacuccaagaaacuagggaacagaacuaagacugguuagugggcaugggcccacauaauaagggacuuaaaagucaggaagacuuuagauucaauaauaagaaauacuaaauacaaaucaagagaaugaguaaauauaauacacaucuagaagucccuaccugggguuaugggggguggaacaguuacaauuaagggacgcagggaagagaaacaguagaagcagaagugaaggaaagggcaaaguagaauuaaguagcuuacacucaggagaagauucuguuuuagggcucaagaguuaaaaaagaaagagcacauacaggauucucuggcaggaaacagaccuccuuuggccacaaguuuuuuugccuucaaggaaggaaaaaugcaccuuacauucuauuauugaaaagucaaaaaagaacagaugcuggugaaauuacggagaaaagggaacacuuauacacuguugauggggguguaaacugguucaaccauuguggaaagcagugugacgauucuucaaagagcuaaaaauggaacuaccauuugacccagcaauuccauuacuugguauauacccaaaggaauauaaaucauucuaccacaaagacacagcacacauauguucacugcaguacuauucacaauagcaaagacauggaaucaaccuaaaugcccaucaaugguagacuggauaaagaaaaugugguacauauaaaccauggaauacuaugcagcuauuaaaaagaaccagauaauguccuuugcagggacacggauggagcuggaggccaucauccuuagcaaacuaauggaggaacagaaaaaucaaauacuuguaagugggagcuaaaugaugagaagacauggacacaaagaggggaacaacagacacugggaccuaccagagagcagaugauaggaggagggagaggaucaggaaaaauaaugaauggguacuaggauuaauaccugggugccaaaauaaucuguacaacaaucccugucauaugaguuuaccuauguaacaaaccugcacauguaccccugaaccuaaaauaaaagaaagaauccagccauugccucacuuaauuaagaaauuuaaaauauguauacccacugcuuucugauucuuucuaagcacuaagauacagcaugaacaaacaaaagauuuccacucucauggaguuuuccuucuagugaagacaacagacaauaaacaaguaaauaauucaauaaauuauuucagauagugcuauuaaaaauaugcuaugaaaaaaagcagaguaaugugauaaaacagugcuuggaaguaucagggaagacgucuccaaaaagguaagacuugaacucucagaagucggccccaccaagaucaaugugcuccaagcagaaagaacuagaugugcaagggccucagaguagaacaugccgguguggauguagcacuguaaaucaggcagagaguaguaggagaugaaguuucauggcaggggucaagaucaagucgaaccuuguaguuugaauuuuauacuagauucaauggaaggacacuuggaaaauuuuaggcaacagagugccaugaucugauuuauuauuuuaaaaguucacuuuggcugcuaugcugaguagauguagcagaaaagaauagaagcagaaagauggaaggggaccuccugcaggccaugugaaaugugaucguuuuggacuaaguuuauuagugugaaaagaguaguagagaggaaccauauauauuugggaggaagaacuaaggaccuagcagauaaacuuaagagaacucuccagaaaagucaaggcuggcgguguuaauuugcaagucaauuuuuacauuuauucuccaacucucuccugggcuggcguguuaacugccugcugaaauuuuucccugaaugucccauugcagucuccaacucuaaguuugucgaaaucaaacaaagaauuugucaccuucccacaugaagcaguaccucuuccuuaucuaccuauuucuauuuuugguacaacuauucacccaaacuccacacacuucagagucacugucaucccuuugcccucauccccaccccgcuacaacuaaccaaaguacacaaauccucuuuuugcaguaucccuugcauucauuuccucuuuuccaucccuaaggucaauacuucaaaaaaagccucuaacuggucuccaauucaugguauuauacuccgcugccaaaagacuuucucuugaacuggauacaaauuucucaaucugauauuugaaguccucauuaaugcagcucaaauccuuccuucuagucucucagcaugcuugcuaacuaugaccugcuggugagccaaauugacuacagggccccuaacauaccuuauacugucucacggguuuccucacuccugcuucacauggauguacauucucuaugcuccccacuggccaaaagucuacccuuccuccaaagcccaaguuaaacacaaccuucuucauuaaacucaucuugcuauaaucuaaacgugauuuuuucugccucuaaacucaaaggaaauguuauuuagaauuuucuuagggcuccuaucacauacaaccuugcaucuguggauuguggauauuugucuuucacaccaguuuucuucuacguuaucugaaagcagaagcuuugacagucaccuuacauuucgaauagacacugccacaggauccugcauucaguaaacaccccaaaaacauuuguaaauuuuaacagacuauuuacaaaaguagcuccuacuugaauuuaagacacaaagcauacaaaaucagcuuugagcuuucaguauauugauauucaagcaggcaagguaagcaccugagcuuauaaaacaaaucucuaacuuuagaaggaaaaauaacuuguuaaccaagggaauaugguagauagugcacaaauacaaaccacacucacuucauuuuccugggcaagucuuaaaauuucaucgaguguuacaaacguaucauuuccucugacugcaucuuucuccauaaauccaagaugaauaucuguugcaacuaauauuuuaaauguguuuucaucaucacuauauuaagaaagaagaaacauuucaauauauuaauaauucauuaaaggauauucaaacaaauugagacaaacuuauaaaauaaauaauaacaguuauagaguaaaaucauuuuuuuuagccuuagaguucaucugaaaaucugaaguauucaacguuaucauuaacauuacaguuuuccuaaccacuaguucaauacagaacaaauguacauaaaucuuuacaagguucuauaacugcuucaaaaauuuauaaccuuguuauaaccaguuuuacaaacucauguaacccaggcccaaaaguuugcuuguuuuccucagauaaauaaacuuguuauuuaucugacuucguacucuuccaggaaaaucgaaguuaauuuaaaaagccuuccucuaaguuuaugagucaauuuuauacuaauaugcaauaauuuacauucagggccuugaagacacuugcaugacucuacucucuacagaguuagauuucauuaauaaaguuggccaacacagaauuguuucaauuugaauuugguaauauucaaagguacuuuaaugugaaguagcaauguaauaguuauuaauacucuuacacuaaauuuaauuguaugaaauacuuuuauuuuuaugaucucaucucaacccucacagauaaagagucaggcauuauuaucucugacaaaugagaaggcuaaacccagagaaauuaacugcuuuaucacauaacuagugacagaaacaggacuaaaacccaugaugaaaacucaggcuauuuucaauaaaccacaaugaauuuuuaaaaaaucucuguauauaucuccaaaauucaaaucuuuacaaacaaaagauauuuccacaaacgauuucucuucaaaaacuucaaaaaugauaugcacacaguucucacugauauauccaagaagguaggucagauacuuuucaaaucauaauacuacauguuucuguagcaauuuaugaaguauuuucucaugaauucucucauuuaagccucaaaauuaaucugaaaaagguauaauuauuccaauuauaccaauggcaaaauugaggcaaggcucagagaacugcugacuugcccaaggucacacagcuaguaggguccaaggacuugaaacuaggguaaaagacuccaagucuaaagucuuucccacauaacuuuuuuuuuuuacgaucucggcucacugcaaccuccgccucucggguucaaaugauacuccugccucagccuccugaguagcugggauuacaggcaugcgccaccacgccuggcuaauuuuguauuuuuaguagagacgggguuucaccauguuggucaggcuggucuccaaauccugaccucagaugaucccgcuagccucggccucccaaagugcacauaacuuuuacaguccuuuuauuuauucccauuccauucaaauucauuuccagcuuauuuaauacuagaggaauuuacucuaaaaaucuuaaacagaacugcauugacuaauaagaauuugucaggaaaauucaagaauauuuaucacuucaauaauuuaagaugaagccuaagaacauaaacaauacuauaucaauauaucaaauuacugcaagacuccaaucuauagcugcauauuagcuuccaguuaacaaacagauaaauauuuaaaacauuccaaauacccuuuuugaugacuaauauuucuguucauaaacagguuccuuauuuacugcuuauuaaauaaguuuucuuuuacugugaucacaguugacgagcuuuagaaaccccaaauaacaagggauuccagaagucaggugcuuacagugcaucugcaguacucauuuuuauggucagucaagcuccucugggaccagguucuucuccaagaaccccuggguacuguacucaaaugucagaaaaugcacucgauuccaaauucuagaaauucuaaaaacaaaauuacaucauaaaacacauuuuuuaaaagccugcacguauuuaaccaacaugauuuacgcugcacaagguacagacgucuuaauuagacuggcaaauuuagaagucucauuuucaucuaagcacccacuauacuuuuuuuuaaugaacugagcauagaaaauaauauaucuccaguguacauccuguuuccuaguuucaccaagaugauuaaacuccuauuuuccuuucccgugcucuuaugggaaauuaauguaugcuaaauaaaugggcagaaagggucacauacgguucugguucaacacacaaacaacucuagaugugcagauauuuuuaaguugcacgcauagguuacucuggagaacagaggcaauccuguauuuccuauucaaaccccacgauuuuuuuuaaaggaccuggcuaguuuggaaaagggaacgggcccgcguuuaaagcgaguguaaauaaacaaacacguggucugcggaggaacaccuuuaagcaccagcaggaugacugaaaauagccagguuuggggaagaguggcugccaccgcgagacaacccccaccacaucuggagcuccagauuccgucgggauuccaagccucaacacgcccucaccgcagggaaccucggaaucagaacgcugagcccgccaggaccccuccccugcccacucggcccgcucuucccgagguuccaguuaacucugggcuuccgccugggaaccugcagaaacaggagacgaaugcgauuccuaaauuaccccacugcuggacucuucgaagccccacaaucgcgacccaaggcugucuucuuuucgggaagaaagggcaggauccgugaaaagaaaacaacacggucugaacuugccucugagaacccgcagggccguaaaccugaauuccgcgggagagaacggcguccguuucucucgcgacacuucaugg

SEQ ID NO: 15875 - RNA, 762 nt, Homo sapiens
uaaaccguuuauuucuccccaccagaagguuggggugggcgggccuagaacacagcgugcggcggguucccggguggagccagcgcagacagcgugggucccugcggcucuuaggcgaagguggaguuguuccagcccacauuggccgcguucaugucguaauaguugauguagacccugcggggggaggaggccggacucagcggguggcucagucccgggccuggccgcgcgccgccgccccucccccgccccuccgcgacuccgcguaccuguccgggcugaugcgcaggcgcucggccagcaggccgcacagcagcuugcuguaggagcgguucugcgcgccgccgaucuugccgaugcugugcaggcugcagagcgcgcacggcucgcuggagccgccgaaggccaugagcugguccgggaccacgugcaccgcgauguacugcgaggaaagggcgcggucagcccgccccagcgaccucgucgggccccgaacguccacuucgggcccgagccaccguccuccccccgccccgccccccagcuccguucaggagucgccuccccagcucccagcgcggaaccccucguccggugggcaccccccucuuccuguccccucccggcaaaccugggggggcuugccgguggccugcgccagcugcugggugagcucggagaggaacccguccggcacggaggcgcggggcacguugguguuuacgaugaacaucggcaugauggcagaaggaccaggag

SEQ ID NO: 15876 - RNA, 6207 nt, Homo sapiens
uaaaaaacaauaauuguuugcuuuuguuuuugguagguuacacaggcagucuguugaaacagccaggaaacaauuacuugaauaucaaacuauguuaaaaggaaggugcccaucggugucagcuccaucauugauaacugauucuguuauaucagugccaucauggaaaucugagagaccgacugcuauaucagagcauugggaucaaggucagagacucaaguugaguccuaacaaauaccaacccauacaaccuauacagaccuccaaauuagaacaagaucauuuucagguagcgagacaaaaucacuuuccacaaagacagguggaaacaacagaaacauuacgcgcuucagauauuuuaaccaaucaagcuuuagaaucacaagaacaucuaaggcaauucucucagacugaaacacaacagagagacuauaaauugguccccaaagauucugagacacuuucaagggcuuugucacaugacaggcagcuaauaucacaggaugcuagaaaaauaucugaaacauuuggggcaacaacuuuucaaaguuuagaaucccaacaauuguucucagagaauagugaaaauauaucuuaccauuuaacugaaccuucuucauuuguaccacugguaccucagcauucuuuuaguucucugccuguuaaaguugagucaggaaaaauucaagaacccuuuucagccaugagcaaaaguacaguuuccacaagccauucuauaaucagccaaaugcaugauaggccuuugcugccgucagagaauaucacagcccagcaagguaauaugaaggcccuccaagaacaguuagaccuacagaagaaaguucuucaggcaacucaggaagcucaggaacaguugcuuuugugcaaacagaaagaaguggaacagcaaacgggccucucgguauuccuucccuugguaacuccagauucaucugcuuuauugccuucugccaaagcagauuuggggagaauccaggaaucuucaccaaccaagaauaauauugcaguuuccucagaccaucaugugaucucacaacuucaggauaagcguuugagucuuucacagccuauccuaucacagcaaaauaauuuuaaauuucuccaagagcaguugaauauucagaaggauagccuucaggcuaggcgagaagcccaggaaguauuguauguacauaaacagagugaauuggauagaagaguauguuccgaacaggcugagcccucuuucccauuucagguagcucagcauacauuuacuucacuaccaucugcugauacaaaaucuggaaaaauacaggagcaacauucaucuaagagcgagaaaggacuuguuucaugccaaucugacauccccauaucucaggaugggucuuugaguuuccuacagcaguuccuaccucuacaugauaguuugaaguugcuccaagaacaguugacuaaacagagggauacucuucaggcuaggcaugaagcucagguggaauuacuuuuacauagacaaagagauuugggggacaguaagucugggcuggugagcucuucauccucaccagugguuguucagcauucaguugcuucacaagcuucugcuaaagcugagccuaggagaauucaggagcuuuauuuaucugagaaggagaauguaggucccuccugucauuugauaaucccaacauuucaggauaagucucuuaguuuuccacagcauagccuggcacagcaagaaaauuugacaauacuccaagaacagucacaaauacaaaggguaauacuuggugcuaaagaaggaacucaggaauuuguacacacagaaagugaauuggagaaaagaauuucuucugaacagacuggcaccuccucaucccuuucccagguggaugaaucugagagauuccaggaauguauaucaaucaagagugacaguaccauucccuuaagccauccuaagaucccaagaugucaggaaagacuuuugagaguuucacaacauaugcuaccucuacaagauaauuuggaggaacaccaagcauggcuagacacugagaaagaagccuuucauuucagccagaaaacccaagaaaauacaucuucugaacaaacugguucaucuucauucauaccccaguugguacagcuuucauuuacuucguuagcuucagcugagucuggcacaauccuggaaccucuuuuuacagagagugaaaguaaaauuuuuucaagccaccuucagaucccacaauugcaggauaggcuuuugaggauaucgcaacuuauccagccucaacaagauaauuugaaggcacuucaagaacaguuagcuacacagagagaagccaucauucuagcuagacaagaagcucgggaagaauuacuuuuacaucagagugaaugggagggaagaauaucucccgagcagguugacaccucuuccuuaccccuaguaccacagcauucauucgccucauuaccucuuaaugaaucugaaagaaaccaagaaccauguucaauuaacagugauaauauaguauccucaggucacucagagauaccaacauugccugaugggcuguuggguuuaucacaucuuguuuuaccucaacaagauaauuugauugcacuugaagaacacuugcaugcacagacagauuuccuuccuucuauugagaaaacccagaaagaauugguuuugucaaaaccauguaaauuugaggaaaagguaucuucugagcauuuuauccagucucaccauggugauuugcaggcacuucaacagcaguuagauacacagaagaaagccauucgaucuauacaggaaguccaagaagaauugcuuuugcaaagauuaagugaauuggagaaaaggguaucaucugaacaaguuugcuccucuucauuuguaucccaggugccuguugcugacucugaaagaacccagaagucuuucccaaccaaaaguaaugauacucuucccucaagucaucgugagauuccaagauuacaggauagacuuuugaguuuaucaaagccuauucugccucagcaagauaauaugacagcacaauuggaugcacaaagggaagugauguauucuuaugagaaaccccaggaagaacugucuuuaaacaaacaaagaaaguugaacaaaagugaaucugcugagcauacuauccccucuuuguuucuacccaaggaaacagagcauucguuuauuccacuaccuuuugcagaagcuaaaccuaaaagcacuugugaauuguauucaucccagaaugaacaugcagcccccccaaguaauccugugaucccaggguuucaagauagacuuuugaguuuuucacagucugucuuaacucagcaagauaacuugggacuucagaaacaguuggaucuacaaagagaaguucugcauuauagccagaaagcccaggaaaaauugcuuguacagagacaaacagcauugcagcagcagauacagaaacaugaagagacuuugaaggauuucuuuaaagacagucagguauguuuuaaaccugaauaauaaugaaacacuagaaguuuaaacccaaaucaguuuuuaauacuaggauuacaaguuuucaguuauugagaaaaaguaguuugaccuuaacugugcuuugauuuuucacccuaaaugauguggaaguuaaaacaaaaaucgauccacccacaugguguuuaugagguuaauaguuacgugaaguccaauuaauuuuuuuaaauuuucuuuuguuuuugcuuuuuuuuuuuuuuuuugagacaaggucucgcucuguuguccaggcuggaguagaguggcaccaugucggcucacugcaaccccuaccuccuggguuuaagugguucuugugccucagucucccaaguagcugggauuacagacauguaccaccaugccuggcuaaauuuuguauuuuuuuuuuuuuaauagagacaggguuuccccauguugcugggauuacaaagugcggggauuacaggugugagccaccacaccugacccaaagcucaauuaauuucaccugcaaacacaccacaaaacaauguagauucuuauuuuagaguuuuguuuuaauguauuuuaagcuuaccauaagauuuaaauuguaaaaauaacugguuagcagaauuucucuuaugcagcaacagacauugugcucuuuguugacauuuauauacaaaucaaaaucaauaccaucuuuuuucucaagugacacuauuaugguuuguuguaaaacgggcaugauuuuaggcugauguagagcuggaccugcugcuuuuaucugaauuguucauaagacucggcccagugacucauucauaguugcccuaucugggagacaaggguauguucuaaauuugaauguaucuguuuuauuuuaaaaggccaguucugcuggacauggugacucaggccuuauaaucccagcacuuugagaggccguggcagguggaucuccugagcccaggaguucaagaucagccugggcaacauggcaaaacccugucucuacaaaaaauacaaaaauuagccaggcaugguagcauguaccucuaguccuagcaacucuggaggcuuaggugggaggaugacuugagcccaggagguugaggcugcagugagccauauuaugccacuguacuccagccugggcgaugagggagacccuaucucaaaaaaauaaauaaaugaaaggccacuuccuaaauuuauuauuuagucuaaauagaauucuacaaauccuuugaugucgagaagaagcuugaguuggguucaggaagaguuaacgucaagagauuuacuggucauuuaaaggaaaaguaauggcaaaagaaaagcagagggaaauacucaaauauaaucucuuauggaaagaugaaauggaggcuaaguuuuuuuuuguuuguuuuuuguuuguuuguuuguuuguuuuugagacggagucuugcucugucaccaggcuggagugccgugacgucaucuuggcucacugcaaccucugauucccugguucaagcgauucuccugccucagccucccggguagcugggauuacaggcaugcaccaccaugcccagcuaacuuuuguauuuuuuguagagacaggguuuugccauguugcccaggcugguuucaaucuccugacaucaugaucugcccaacucggccucccaaagugcuaggauuacaggcgugagccacugcaccuggcuguaggcuaaguuuuuaaguccaaggcugugaaugguuguuguuuuuguuguuguuguuguuguuguuugagacgaaaucuugcucugcugcccaggcugcaggcuggagugcaguggcacgaucuuggcucacugcaaccucugccuuccagguucaagugauucuccugccucagccuccuaaguagccaggauuacaggcaugcacaaucacgcccagccaauuuuuguauuuuuaguagagacgggauuucaccauguuggccaggcuggucuugaacuccugacuucagguguccugcccaccuuggcuucccaaagugcugggauugcaggcgugagccaccgcgccuggccgaaugguuguauuuucaauggaaauauccuuuuggcauuagaagcauaucuuauuuuuuauauauagauaaaauuuugugauugauggaacuauuuauuugguuuacguucuaauuuaagaagggagauauaaaucuaaugaauaaugcuucacaugaucccccaacuugugcuuccccacccucaucuccacuuuuucagauaaguaagcccacaguugaaaaugauuuaaaaacccagaagauggggcagcucagagacugguuuccuaauacacaagaccuagcaggaaaugaucaagaaaauauuaggcaugcagauaggaacaacucugaugauaaucauuuggcuucagaagauacuagugccaagcaaagugguaagauaauuguguuugauuguaauuauuucacugauuauuccuuguuuucguccccuguagcuugcuaguugaagaaaaguuagaaguauguuaauagauuuuguauuguauccaacuuugucauugacuuaauaggugagcaucuggagaaagaucuggggagaagauccucaaagccaccuguagcaaaagucaaaugugguuuggacuua

SEQ ID NO: 15877 - RNA, 1289 nt, Homo sapiens
uuuuuuuuuuuuuacuuuauuaaaauacugaguuuuauuucacauguauauuuuugucuccccaccauuuccaugucugaccaccgcuaguacuauguccuaucauaacauuccauacauacuuaaaaccaagcaaaggguggaguugaucuuuaaaaacuaaacaggcauuuuggacaacacauucuuggcaauagaaccuggacaacauuuaucaaacacgguagagaaaguucucacucugcauuauaaaaaggacagccagauaucaacuguuaacagaaaugaaauaagacggaaaauuuuuaacaaauuguuuaaacuauuuucuuaaagagacuuccuccacugccagagaucuugaauagccucuugguuagucauccggaagcaauucuucacauaauugaugaauuuggcuuccacuuugggaagagaaccaccuuuuucuauacuugcuugcauuuuugcuuuaaugucuucuacagaacuagguccuuuugguguuuuaggaguuuuuuccuguuuuuugaaggauucuuguccuuuugaucuugguguugaugguuuugagucuuuuccauucugauuugacuuuugugcauuuuuggcuggaguaucucguauagauuucuucacuggcgcuuuuucuucagcuuccucaucaucaaaaucaucaucaucaucaucuucaucaucauccucuucaucaucaucgucaucaucuucaucagcagcaaguuuuacuuuuuucuguggaaccuugcuaccaccuccaggggcagaccgcuuuccagauauacuucagaguuucacauccuccuccucuucaucuucugacucugcaucuuccuccacagcuacuaagugcuguccacuaauaugcacuggcccugaaccacacuucaaccuuaagaccacuggugguguuauuucaaagcccccaagggaaacuguuggcuguacagacauuuucaaaguugccaguguuacuuuaauuggacugccuucguaauucauggccucugcuucaacaaugugcaguucauccuuugcaccagcccuaaacuggccguucuuaaggauaacuggcgcucauuuucaucauuauccaccuuaaagugaucaucuuugucggccuuuaguucacaaccgaaaagauaguucuggggccucagggggcucauguccauguccaucgaaucuuccaucggguggcggcacgcacuuagguaggagagaaggcggacggagauaaaacaacgcugcugcagagaacagccgcgcag

SEQ ID NO: 15878 - RNA, 25213 nt, Homo sapiens
uucugccccggaaauuucuccuccgcuguugucugggcuccacuuccgacccccaguugcuaccagcuguaguccgaccuaucguggcccgggcuagugccagccucccgccgcuaccuccgccucgucccuucuccucugcgccugcgcgaccggaaaauucgcgaagguuccugaaacgcaacggaucguuuccggaagccgguagccgccucagucgucagaccggugcuagcgacacgggaguggcaaacgcauccucuugccguucccgguguuugggccuugccugugacggugggaaaagaaaauggccuugcugugcuacaaccggggcugcggucagcgcuucgauccugagaccaauuccgacgguaagaggaacgcgccgccagcccucccuccccuccaccucaucagcaggggaggcccuuugggccggaggguguccgcggaucuccugcagccguccucgcgcggccccagguccaugccccuccugggccucccuuggcugcccgcgcagcccgccggccgccccucuguugcgccgcguucccuuggcgagcgcccggccccggcgccugacuguccucugccacugcggagagagacgcucccauggauccacguguuucccccgucguccccgcacuccuuuuaagucgccuggaauuuagaacgaacacguuucuccucuggcccuccagucucuggggaagcaaaaauuaacgagguacuggugagcuugcuuuguaguucccgaaguagugauggcugugauugccugcgcgagagggagagguggccgggaugagcagcggguuguccuagcauguaagcucugccuuguagaaguuuguguucagucgauccgcuguuacaaaccucuuacaaguguucuugguaagggacauuacucuguaucuucacgcuguuuugauagguucauccuggugguacguuaguuaucuuuuuauuacuagcggcauuuguugcuuguucuucuuguggccuccacguuuuacuaccaugccuacucccguauaaaaugagugaaugucaucuacagcaccuagaugucgaguuaaggauccaaagcgaaaaugacuauuaggugaaggacgggaaaugaucagugaauugaaauuuugauugacaaagaagugagaugauuccuugcguaucgugagaagugacaacacguuuucagauugaacuagcauuuaguuuauauuuucugcaugccagccauuauugcuuuaucuuauuuaaucuucauaaccacccugggacgcauguaauguuaauuagacccauuugauagagaagcucaguucaaugagguuguauuaauaacauccuucauuauuguggaggagaugaaaacugaugccuuuugaacucuucaccucugagauguuugaaauacuuauuuuuggcacacagguaaauugauagcguuauuuaaaauaagaccauugauacagaguuuuaaggaaaaggaaaauccaaccuaugcaauacucaaguuaccgccacugacauuuuuaugaugcaaauaugaugcuacucaugaggaaaauugugagauuucagucgaugacaaaaucgagaaacgauuuuaaagcccuuugguguuggcagccuauguaaaacauuaauugcacuuaugucugcagauauucuacuuuaauauagaauacaggggaaagacugacgcuuugcuuaugagacaauaaaguucaggggcgauagucauuuguuggaagucuguauccaugugugaauuggugcagugccuaggaaacagaaagcgaccaggaaaaccgucucaaaacuuggguggucagcaguacuaguuacagcagagaaauuccaauaaguauauuuacuuuagcgaaaugacgguuuuuuuagagacuuagaauacauuuuucaaguaaacugauugagugaauggaaggagaagaaaauggagauacggaguaggagacaagaacuaaauagaaagguugguuaggagguuuuuuaggaagagguuugaccuuguacaguugacagaaauaaguuaaaagagguaaauacacaagcaaguuccauuuugcguaagccagauguuggaucugucaucuuuaaauauuucuuaaucuacacuaaaugcuuuuuuucucggugcuguggcauaauuaccgugcucguugacuuauagucucaugauuuuuuuuucccccuagagacagaaauuagacucccuuuuaagcugauagaacguuuuaacuuguaacugaaguuaaaggguguuuaagggagacacaguugguaacuuacauauguuaaacacuuauucuagaauaaacacagcuucacaaacgguauuuuuuuuaaucgacguauacgaggaaaacugaaggaacuacuagcgaguagcucagugagaaauuuagccagggucagacccaauguuagaagcccuggacacuuaaccacugcuacugucuuguagcuucucacccauaaaauauuaauuuugccaaaacucuuaaaacugauaaagaaaggauggauauuaaagaaagaaugaagaauguccauuugcuuguuacuucuuguuuuugaaagcaguggcuuucuaauuguguucauguuaguuguaugguucagaucugacucauuccugcugccaugcugccaaaauugacuuauugugacauuuuaugccucugacucuguuauacauugcguuuauguuucugacuacuuuaaauuugguguuugaaaauacuggaucuauucucuacuuccauuccccucucaacuucauguccuucugcauacccauuucuacuuccaaccuccuuuuucagcccuuaauuccacaacuacccuuaauuaauaacaucuuucugaucccacggauuuacuuacuguaucaggaagauaccuaacacuuucuacauuagcuaguaucuaugcagcacaugguuacuaaggaagcaauacuggcuaguaacgggguagggagauuucugugagcaccaguaguaaauuuugaggcaacaccaggaaucaggugauagagcaaggguguucaaucuuuuggcuucccugugcgacauuggaagaagaggaauuaucugggccacauuggaagaagaauaauugggucacauaugaaauacacuaacacuaaugauagcugaugagcuuaaaagaaaacaaaaacaaaauucauaauguuuuaagacaguuuacgaaauuuguguugggcuacauucagaguugucuggggcggcauguuggacaagguuguuguagagcauugaaagcuaaauagacuugaaagguugaaagauagucuuuuaagcagauugcagagggaugaagcugacuguuaccugauuuuuaaaaauauaguacuccaucuugcaaauugcugagagcagcuuggucguggagacccuaacccgguggugcuagaggaauuaaagacacacacacagaaauauauaguaaggagugggaaaucaggggucucacagccuuagagcugagagccuccaauggagauuuacuaaaaguauuccuuacgggaaauaaagggaugggcucuggcuaguuaucugcagcaugaacauguccuuaaggcacauauggcucaugcuauuguuugugguuuaagaaugccuuaaguguuuuuccgcccugggugggacaguuguuccuugcccucauucagguagacucacaaccuucuagccugggcaucaaagccgucacgagcaugucacagugcugcagagauuuuguugauggccaguuuuggggccaguuuauggccagauuugggggccuguucccaacacaaauuguaauaaacccauuuacauaagagaaguaaagauugaugguguaguggggagggaaguauagaauaacacccagugagaaucuagaaaauaggcuguagaacuugagaguuuuuuuuguuuguuuuuuuuaagauggagucuugcucugucaccuaggcuguagugcgguggcaugaucuugacucacugcaaacucugcuucccaaguucaagcgauucuccugucaagauccugaguagcugagacuacaggcaugcacuaccacgcccggcuaauuuuuguauuuuuaguagacacgggguuucaccauguugguuaggcuggucucguacuccugaccucaggugaucugccuaccucagccucccaaagugcugggauuacaggcaugagccaccaggcccaccuagacuucuauuuuuuuuuuuuuuuuuaauuaaaaaguaaacuuuaauguugaaaaugcacacuuggggaaggcagaaagaucacacacaaggcugucacuucacacuuggaagguugcacaguggccaggcagaggugcuccucacuuuccagacagggcugccgccaggcagaggcacuccucaguucccagacugggcgggggcagggcagaggagcuccucacuucccaaacagggcaggggccaggcagaggcacccuagucuucuuuuuagugagguuuguaccuaggaaugacugugucuaggaaaguuaaauuaccaauuagauacugcaaaaaaucuuuacaguauuuaaaauguugagccuguuauuacaaaaugucuuuaagggaaucucuugugaaaccuuuauggaugaaugcacauaagaauacuucaaguuugauaguacauuuguaaaagcagguuugaaaaaugauggucaaaauuuggggguuugaaguuuugguacuaaacaaauuuuacuaccaagauuaggggaauauaaaauauaauuguuauacauaaacaauucuguauuuuuguccuuagucaucauaugcuugaauuagaauuuuuaauacuauuuuaauauaguacacuuugugcugcacgucaaacucaaucauuuguaccuuuuuaagguacuugcguuuggaaaaaggauuaaagguuaacaccuuaaggagaugaucauguauauauuuuucuucauuauaaagagugguacuuuuuuuuuuuucucuguuuucuccagaugcuugcacauaccacccagguguuccggucuuucacgaugcauuaaagguaggaacuauauuuucauuuuuuucauaucuguguaguaaauugagagauguaauacuaaaucuuuauuuucucaucuuuuuuucucagcuagugacuuucuucuuaaugaccuuugcgggggaggugcuuuaagcguauacuccacuaaagacaaagaaaagacaguagaugaugaucuuaaggucuuuuccaguuauaaaauuguauuuuaauucuggguuuuuuuuuuuuuuuuugagauggaguuucacuguguugcccagguggagugcaguggugcgaucucagcucacugcaacguccgccuccuggguucaagcgauucugccucagccuccugaggagccgggauuacaggcaccugccaccaugcccagcuaauuuuuguauuuuuaguggagacaggguuucaucauauuggucaggcuggucucgaacuccugaccucagaugauccaccugccucagccucccaaagugcugggauuaccaugccuggucuuaauuuucauuuucuacacccauuucuucacuuuucuaauuuugagggaaaauagagugguuguauugaaucucagucugucacuacuggcuaauaacagcucugaauuuuagaaaagauucuuauaaacauuuagugccaaucucgggacagaccugugaguuuuccagcuauacuucuuggauguucuggagaauugguggaauguuguuugacuagguuuuugcuggucaucuuuuuaaaauucaugauaguaugauacauuuaaagaguuuccuuuguauaucucaaaagaugaugcugugguagggcugccaugguuuuagguucuacuucuuugguucucaggaacauaagcagucuuaacauguuuaaauauuguuggugcccuuuaaaugucuaauuauaccuuccaaagaguaguuagacuguuuuggcacuucacuguuaacaccaccaaaucuaacaaaagauguauuagucugguuaguucugagugaggaaaacagagaagacauucaguagggcaaguugagaccuuauuccuccauacauuuuuuuaguuuuuacaaaucuuuguugugguggaaacuguggugcuguggaaauguuuauuuuucuuuuuguggaauuuuauuuuuccuagacugccauuucuucugauauuuuuguuuuacugugucuuuuucuuuuuuucccuaugcuguuuuccucuuagcucuuaaagguaaccuuuggcuguuuucucucauucaguucauucauugguuuucucaaaugucaccucuacgccgauggcucuuacaacauauuucuauuuaugugucucauuggcaacaucaaaccaguuucuaguguguaccguuuauuccaaaaguagucugccucucaacuuuacugcuccuaguaaugauacuacugacuuucugaucauuugguccauugcccguuuuuucucuuaccgcauuguuaaucacuccaagucuuaaugaauucacuuugaaguauuuuugcuucucucucuuuugcaguuguaguguuuauuguggucucuauuuuauaaccauuucuuaaaguccuagacuuuccaagauuauuggauuucacaguccagaagauuucagacaaaaugcguauacaucaauacagggauacuaguugaccaaguaagaaguuaaacauugcauugacaaaagaaauacuauuuuaauauuagaaggggcauauucagagaaaaggacaaucuugcugaaaaaagacaacuagcaaccuuauauucacauaacuuaaauuuaucuuuccuuuucucauuguacugaagacuagcauagaauccagauuggcauuugggaacagcuggccuguauuguauuuuacauguguguaucacaguaucugacauaauuuaguacaugauuaagacaguaaaacuuuuucucuuauagaauaacuuuucuguugacuauauuauugaugcuauuuaaacccuauauuuaagguuguaguaauugaucuacaucucaauucggaguaaaagauaauuaaauuucaaauuaaaggaaaauuugaauuauaggauauuugaaauuaccuuuaaagaaaaagaaccuacaggugcauauaaugagaaaaaucacuaccauauuuuuaugcagucuuuugaaaaucagcgagguccaggcggaugugugcaaaguugcaucuuaaucugaauuuagucccaaaucuuaaucugaaguuccaaguuuugagauuuugcauuuuuguuucccuaugcucuauaaacauuggaauuuagagauaauuauuaaagccauuuuuugguaaacuacuugauaguuuguucaaaaaucacaaauacuaauaguuucucugucuuuaugcuucucacugaaaagaucaccuucaaaggcuuaauagugcuuuagcugcuguguuaauuaaucuuuguuguucugaaaauagaaugcuuauugugaaauuaaaauuaacuaaagauaguuacuaucuuuaacuuaauagauuuuaaaaguaaaauaccuauacuuauuuugaauauucuuuaaauaugauaguuuuaggaauuauaacauguuuuucuucuaaaaaaaaagcagacacgauuguugaaaagagaaacaguuuuuguuuuauaaaggugcuucccuugaugauagggcauagcacaaaucacuuuaacauugguuaauuggcuuuuuaaaaaucaaagauuaauauucauuuuacuugauuaggugaauuauaugcaacacugaaauuuugcacucuauacgcaaguuacugcaggauucaaguagauaagugcaaguagaguguuuuagugggucguguuucucaugcaaauagaguuuuuaguuuccuucucuuguuuuucauaggguuggucuugcuguaagagaagaacaacugauuuuucugauuucuuaagcauuguaguaaguacuaauuauuuuuucuagauuaucuuccuaaaaauacauguuauagaaagcuucagauuugaggagucugauuucugauauagauugauuggucuucaucaacuugcagauaacaccuuucaaaaagcagcucaucucccuuccacagcuuguaaaauaaagaaucuguuuuggaaauuaacguuuuaagguaucaguuaccugcuuaucauuuuagguuuguucuuucuguuauguugaaagaacaucaaggagaaagugguaagcaacaauuuaaagccuuuucaguuaggaacgauaaaguuuuaucuaagaugcuguugaaauauuuuacauaccacuuuuauauaaaaccacuuuauauaccacuaagaaaacuaaagcuacuaacaaacugauaaugcuauugauuguaucauuucagagguguuaaagaguauguauaauucaguagaauguaguagaaaaguagcuaacguuuguugaauguuaucaccugccaaaugugccaggcauuuuauuauuuaacucucucagaaaauaucuuaccugacauuaccuccauuuuacaaaugaggagauggagguuuaaaaagauuaucuugcuuaaggucauauaacuaauaaguauguugagaacuaggucucaaauugaggccuuucgaguaacagauuuuucuguauaacuauuuuuuacaguucuuugugagauucuccagaauucuucuguaaacaagagguuuaugccauauuuuuaauagaauaaguagauguuuaugaaguguaauucaaagacuuuuuaaaaaagccgucauucagagauucagcaaauauggcaaauuuggaguucuguuuuuaauuucuuaaaaucaauguauugaaacuggagaaaacaugaaauagaaucacuaucaauaaagaacugaaaagauaauauuucuaucaugaaauguaaaauagauagcucuuaaugaauuaucuuucacuaacagggcuguacaaaagguagacauaauagugagaagccaccugagccagucaaaccugaagucaagacuacugagaagaaggagcuaugugaauuaaaacccaaauuucaggaacacaucauucaagccccuaagccaguagaagcaauaaaaagaccaagguauacuuuauacaguuacauauuuuugucacacuugaauaguagcacuugugcaugguacuuuccuuuaugauuuagcaugauaccauuuguagcuacuauguaggccaccaagcuuugaaccauuugguuucucccuuaaaucugccuuaaauuuuuauuucucuucaacuugagagcauguacacaauauaacuacauaacagauuugcauauuguacugucauaauuacagggacauguaucaucaggguagggaagucacauuuuucuugugccuuagagugcaucuuuuucacuguggcaugguaaaauucuuugaagcaguuuuccuuuucauggcaugaguuugaaguagaaaauaaugcagaggccuaaucauccaucuuuacuuucagaugccugaaaacuaccguuaaucucauuacuacuggucaauuuuuaaugcauuugauuuagaugacauauuugugaaaguagucuuaaaaaagcguuugcucauugugcaauagaguuguacagauucuucauacuugccuucugauaaccagacucuguauucccacacauguauauugaguaccuuuguugaaccaggucuucuucgugcuacacuugaguacuaaauuguuuuagaagcaaacuacaggacuuaaaaaaaggugauuuuuuuuuuuuuuuuuggcugcaaguaggcacuuauuguaauuuuuauucaugcuaugaacucaugauuuucccuuuauucuccuuugauccuacuuaaauaaauuuauagaguauugaauaauauagaaccaagauaagaacccuaagagacuuuagauguuuauuuguucauuagcacucugaguacagauuauugcuaaggaaacuacucaggaugauuuuauucucucuccaucuucauaguuagaggagaccauugaaugcuuuggccaguuuagcaguuagaaaaauaauugggaaaagacaaaacuucagucauggcucauucuuaaucucuuuaguaauauaauacagucuguacuauaauaguaugaguuaauuuuuucuuuaaaugaugggcuguuauuuuacuuaaagggcagugagaggccaggcacuguggcucaagcccauaauccagcacuuugagaagccuaggagggaggauccuuugagccuaggaguuugagaaccaaucugaaagagauccugucucuccaaaaaaaauaaauuagcuggguuugguggugugcucauguaguugcagcuacucaggcugaggcaggaggaucuugagauugacuuuuugaaaaaaaaggacaaaggcagugagaugagaaaaacuaaauauuuuauccuaaauucauuuggugguauuauaacaauuaugaggauaucaguuuuuacauacuuuucuuuuuuuuaagaagaaaagucccucucuuacccaggcuguaaugcaguggcauuauagcucacugcagccuuuaacuccugggcucaagccauccuccucccuaacccuccccggaacuauagguguaugcuacuaugacuguauuaguccauuuucacaguuacgaagaaacacccgagacuaagugauuuauaaagaaaaagagguuuaaugaacucacaguuccauauggcuggggaggccucacaaucauggcagaagguagagcgaguaauaaaggaauguuuuacaugguggcaggcaagaaaaaaaccaucagaacuucugagacuuauucacuaucaugagaacagcaugggaaaaaggcauccccaugauccaguuaccucccacuaggucugucacacaccauguggagauuaggggagcuagaauucaagaugagauuugguuggugacacagggaaaccauaucagugaccgacuaauauuuuuuauuauuuugcggagacaggguuccacuuuguugcccaggcuucaagcaguccucuugccucagccucccaaaguguugggauuaugggcauaagcgaccaugccuugccuauguacuuuuaaaaugccucuuuugucaguuuuuucaucgaggauauagaaugaauagccuacgauuuuuauuuuuauugcuguguuuauuaauauguuuaauacuuauuuauugaguggacuuaaauuauguauacaacacuuagccauuaugaaauguuagaagauguuguuuuuuaaacccuacugaaauugccuugcaauacgaucguaucugaauuuacagauccauaugccaguguccacauaaauuaucuccacugguagaagugaguauggauucacuuagaacuuacuuauauuucauguuuauuaugugcucagcauugagcuugggcaugggauguaaaaguacauuauggucccuuccucagcauuacucaucuugaaaaccuuggauuccuagucuuuauuccuuucucguuagugcaacugauuaauacuuaaauaugcugacaauagcgugauuauuugagacuuacuauucuaauauaaggagcuuuucuguuaagacagaauguagauacauuguaacaauuauuuauaaaauaccuuuuaaccuuuuaaugggaaucauuugauacacaaagcauuuggcuucucagaaagcuuuuaagguuauuaauuuggaguacaaagaaauauuuugguauauuaauaaugguaauaagguuucaaaauucuccagcccagaugaaccaaugacaaauuuggaauuaaaaauaucugccucccuaaaacaagcacuugauaaacuuaaacugucaucagggaaugaagaaaauaagaaagguaagauuuuauuuuguuuuauuguuaauuauuuucugguacaguuaagcaguuauccaaaagagagaauaguaguuuacugcauauaaauagggaaaagucgcacauuguaguuaagaaacuuuuucuucuaaaugucagauaugauaaacuacaaauacuucagaaccuaauagguuaauuccauaugucuuuauucaaaacgagaaccuauauuaaauuuuuuuucuuuuaugguucauuauuuuuuuaagaaucagcuaaauuucuuugauauuuuaaaauguuuucuuguacauuauacaaaauauauucacuauucucugacuuuauaccugguaccaugggaggaaaacacccuuucaugauuuauuuuacaaaguuaagauacuggauauaacauuuuguuauggaaaaaauuguguccugcauuguugaagacaccagguccucaaaagaagaagaaaugugucauauaucaauuuggggauauaagcaaauccuagucacagucguuuucuaaaaaguauuguuuucuggaaaaaccuaguuuuuaagaaugaugccacagcgaaguucuauuuuaacuuuuuaauuugauuuuuuuuucuuuguuacagaagaagacaaugaugaaauuaagauugggaccucauguaagaauggaggguguucaaagguauauaucacaagauuugugauguguuaugaaguaaaauuuuaauuuugaggaaagugcaguuugcugacucaauucaacaaacauuugcaugcauauuauauauugaacauuaugcuggggacuagggcuacaaucauggauaagagacucugaguagcaucauguccaguagaauaaugaaaauaaguaauuccaauucacuuaacauuuacugagcacuuauuaugugccagacauuuuaugggcuggagacauaguaucaaauaaagcaaacauuucuuuucuuauggagcugauauucuagaauggggagaagagcaacaaauagguaguuagauauuacaaaaucaggaugauaggaagaaaauaaaacauacuaaggagugcuuaucagcaaagcccuucuugacauaguaacacuaaaucagaaaucuucauguugcacuggauggauuauguaaaccugggugaagaguguucuggaugcaguaacaugagcagaggcuuuagaacuuggcuauucaaggaauaacaaggucuguggagcuugggcaaggguagcagguaagacagguagacagaauuauggugguucuuuuaagccaugaugagguauuugggcuuuauucuaaguauuaggagaagcuauuacuugcuuuagggaaggguuuuagaaagauucugugacuggugaaugguaaauacauggugaugcagcaggaguggaauuggaagaagagaaaccagcuaggaugcuauuguggaagaccagacagugggauuggagaguaguuuguugagaagugauuaaaugugggaugcggucaaacauaccaguaagccauuuuccugccucuugcuacuugauauaaaacuugcauauccuccaacauuucuucucccucuccuuuuuucuccaucgcucuuaaucacuuuauauuacuuauuuuguauacuuauuuuacuucugagcuauaccaucuaacccccaugcugaguaaaaguugugaggauagggauuuuuuuucuuuguuguaucuugaauccuuagaacagugcguguagaaugaaugauagaauuugaaaguacagaaaguacagaugguuccgaacuuaccaugguguaacuuaagauuuuuuugacuuaacaaugguauuaucaggcuauaaccacauuguaagcaaaggagcaucugccuguauuagcaggauuugcuaauggauucgaugugaagggaauucaagcaucugggugauuggugacaccauuaaccaacaaggugaaaauggggugggggcagguuuauacuuuuuccucauguuaaauuuuagaucacuuaaggaauggagauacaauuguauuuacauguauaugagguagaaguaguagauaaaagggaauuaguaauuacuggauuggggaaggcagugcaaaugguaggguaauagaggaagaucaaggagaagguaucagauguguuuugaaaagugaaugacagggaaaacagagaaaggguauuucaagcguaaguaauagcacaaguauagagaaaauuauguaaugguacaaauuugcugcuguggaauugagauuaauagagauaaguagaccuggccagauccuaaaaggguuuagugaugcagggaaguuagauuguacguuagaguguggaggccauugaaauugaagaauuuuuuagucuuuuucauugaaauauaacauugaaguuuguuaaaggauauacaaauauaaauuuguagcucaagggauuuucacaaaauuaaacacaccagcaaugcagagcacuccuuauguguuuucucauucauuaucuuccucaaauguuuuucugucagucaacauauguuuuuucuguuucugaguuuaauguaaaaauaaccauagaauauguacuuguuuuugucgucuucugcauaauaaugcuuguuuuauuuaucuuuguugcauguagcuuuaguuuuguuuuuuuauuucuuuaagguaugucauuauuugaaugugccacaacuaauuucuacuuuauauuguccuuuaauuuuaaaaaauuguuuuuaauaaugcuauuaugaacauucuuuuugagauggaguuucacucuuguaacccacccuggaguacaaugguaggcucucggcucacuacaaccuccgccucccggguucaagcgauucuucuguuucagccuccugaguagcuggguuuacaggugcccaccacgccugacuaauuuuuguauuuuuacuagagacaagguuucaccauguuggccaggcuggucucaaacuccugaaccucaggugauccacccgccucggccucccaaagugcuggaauuacaggcgugaagccaccgcagccggccuauuaugaacauucuugugcaugacuuuugugacacauauacacauuuccauuucuaguauuuuggauuuuuuuuuuuaaauuuuggcauaugugcauuauacuuaucaguuaguucagcaucccuaaucugaaaugcuccaaugagcauuuucuuuaacugucauguuggcucucaaaaaguuaacagauuuuuggagcauuugagauuuuggauuagguaugcccaccuguauaucuuuagcauuaacagauacuuccacauaguuuuccaaggugguuguauuuguuuacguuucuaccagcaguaugugaggcuaguucaacuuguccuaugguuucuuaacauuuuguuauacgaguuuuuuuuguuuuuuuuuuuuuuuuuguauuuuaaccauucuaguguguguauaguguuuugucaugguuuugauuuguacuucccuaaugaugacugcuuuuuuguauguuuauuagccauuuguauauccucuugugaagugugcagaaucuuuuaccuaucucuaaugucucuugcuuaccaguuuguaagaauucuuuauauauuuuagcugugacucuuaucagaaauucuaugcuuuuucacugucuuaaugacgacuuugauaaacuuuuuaucaaauugcuuuuuaacaaaauccaauuuguccaucauuuuguuuaugacuagugcuuuccauguucuauuuaagaaaucguugcuuacuucagggcugugaguguuuucucauauggaggcacauuuaaauauguaaaugaccuggaacugauuauuguauaaggugugacauggauguaauuaaagaacuuuaaacaaaagggugauaguaauuugauaauuaguagaaaauagaagucgaaggcugagaaauaguagaaaccuguuaguauagucugauugcuuaaaaucugcuagcuuaugaggaagauuaacaaauuaauauauucaagucaaauugaugagauuucauuauagacugccuauggguggagggagaggagaugcugaagaggaacgaauggauuuugcuuugagaaacugagucuguacggugccaucaaauaauauggggaaaagaauggacugugggggcaauagcauuaaguuuaguagaugcuaacauacugaguuuuauguucuugugaaauaucuuaaggagaaauacacaucuaauacuguacuuuggauuuauaaaagauaaacacagaauuuuauuuucuguuuguagguagugcuauaaauacaaaaauagaaaauauacuacuggcuacauccauguuuuauuaacauaauuuuuugugaauucaucuguagagccuccaucuacagcagcaauggggcccggaucuuccagacaaacccuggauauauauauaggucugcagcucauuuuacccuuuauagggauaagaaaucaccaucacucuagaacuuccagaauugcuuauuagauuucucauauuauuugacaauacuuacauggaguuuacuguacacauaagucaugcaguaacuguauuuuuauugagaguauuaaucccuugguuucaacauuguuuuugaaauuaguaacuaaguaaguacuugaauaugauuggaugggaucucauacucaaaaggcugaaagcaucuuaauaugacuuucucaaaggaaccuaaaacuuaaccaaguccaaaagggaaucauuuuucauuuuuuaacagaauggcgugggauggauuuaugaauuuucuagguaauugucauuuaaguauuuugcaaaguucguagaggucaccaauacugcaaauauguaugagauguaacuguaagauacgcagcuaauuuuuuuucucuuuguuuccuuuuuagacauaccagggucuagagagucuagaagaagucuguguauaucauucuggaguaccuauuuuccaugagggguaacuuaugcaugacuuauuaaaauaguuuaugguagaauuuagaaaguuaaaccuuucugucuuuaaacauuguuugccaugcaguguuauuaggcauuuuacuuacauugccauuaacaucuucacaauagccuacacaaacacagggguuuguauguuguguguuuauacaugagaaaacagaaacaagguuacaguucuuaaguggucauugugauauaaacugccuguuuuucuucauauucuguauuuaaaagugaugcuauuugggcuaaauguuuuguuugaaggacuguccuacacauugcagggcauuuagaauuuugggcccuggggcacuaagacaacauuaucccaagacgacccauauuuuuccgcauccugcaguugagagccucucuucuguauuaugcucuaguuuauagaaaugcagcacuguguaaaaaucuuccacucuguuuccacauucuuccugauauacuguacauucauuuuuaguaacuuagacacuuguaaaaugcuagaguuuguacacuuacuggcuuauuaaaaaucagauuuaucccuaaaauacuuguggauuuaauugguugugagauuuuauuucugaaguuuuucugugauaauuuaaaggaugaaauacuggagcuguuguagaagaaaaacuucugauuuuaauacauucuuagcccaagagggcuguacaaaagggaaacacauguggacuaaaaaagaugcuguaaguaacucuuccaaaaauagcacacuggguuuauauucaucugagucauuuuuuaaagauuugaaauuauucugucuuuagauuuuaaaaaaaaguuuucuuuuuugcaccauagagcuuugaugugacuacgaaauaaaaugaaucugagucaagcugccaguguacugccuuuugagcaaaauagccauugucuguuuugaugcaagcaugugagguuuugugaaauacuuaagccugacaaaauugaagaauuuuugucuucuuuaauuaauaaaauuagcuccauggccucuuccuacuuuuuguuuuuuaaaaauuacuuuucuaugaauuugaugacguuaaacguuuagaccucuguuauucuuuuggccacuuaaaacuucaaucauuuacagaugcacaaacacuccaucuaguggccagagaggaggauugcagucuuguuucaguggaauuguuuugaaugccucugcuugcuaaugggauauuuaucaaaaggggggaaaaaagcaucauuuccuacuucccuggacagcuuuuuaaaaagacuugggggcuaugcaaauaauuucccaaaaccccauuaaauugugagaggaugagcaacuuauugcucaauaaguuuuugucuguuagcuauuguuaauguauuuuauaauguauuaaauuuucaaauuaauuuagagauuucaauauuuuagucuucuguaguugcugccccucccccacuuuuuuuuuucuugagacagagucucgcucugucgcccagacgugcagugcaggcucacugcaaccuccgccucccggguucaagcaguuauccugccucagccucccuaguagcugggacuacaggugcguaccaccacgcccagcuaauuuuuuuguauauuuaauagagacagguuuucaccaucuuggcuaggcuggucuuggacuccugaccucgugauccacccgccucgaccuccaaaagugcugggauuauaggcgugagccaccgcgccuggcccuaguugcuuuuuaauaacacaugguuggauauuauaaaaauacccugaaguuauaaaaauucaucuaccacaaaacuaucagaaauguuuuuaaauaaaaagaguguauuuuuuauaguccaaaaguuugaaaauuuuaguuugaaaaaauaaaauguuguuuuccauuauguuaaguuugggaguauaauccuagauaaaaugauguaauuucucuuguuuuuuaauguaugcaguuaucaaguauuaaguaucuaagcuaguagcuaaggggaaaaaugugagugauauauauaauuuaaauuuaguuaauguaauuuuaucaaaacgaaaauaguaccuuuuacaacaguagugucucaguuuccugaauuauguaacuaaauuguucucauuuauauaacaaaucaucauuugccucuauaaaaaaaaauacugguagggcaguauaguauacuacugguauguaaggauuauuuucauaaucagaaaauccaaaaaucauuuguucuuuauuaaaaugggaagaaaguaauaacuggucagauuuuuuucuuagauucugauuuguagaaaauaaauaagguuucuagugcaugagguuaagguguugucugauuuaucccaguaaacaaaugucuuucauuucagucuucaaagaauguuuugaugacaguacuuaguagguuacagaauguuaaauuggauuaaauuuaguaggaguucuuaaauugucuuuuuagcuguguaucaauauuauggcccugaaagaaaaaaacaaagggaaggaguaaguguguucugaaaucauaaaauuuaugaagaaucuuuguaccaugauauauuuucuuguuuaagccucuugggaaauauagaaguuuuuugcccuuaaacauuaagugcuuaguuguugugcaugguaguuuuuucucagaugggucaaauuccucuuuuuaagaaauuaauuauguggcacuuuuuuaacuuacagaguuucucuuacauuacaggggaaaaaaguuguuccauguagacaugacuggcaucagacuggaggugaaguuaccauuucaguauaugcuaaaaacucacuuccagaacuuagccgaguagaagcaaauagcacauugguaaguacaucuuauaauuuuggguaaaaguucuuuucuauacaucauucuuuauguuacuguauuuuaaaguauuguuuauaucucagcugauuuggggguaagauuuuauaaugacucccauuaaaaaaaauuaaauuacuucuaugaaacuauuuuaaaugaaaauuucuguauaguagacuuacugcugaaccauucuggagauacuguaguagauuuaucaaguaauauaguacuuaguucucaauaugaaacuugaagccaguuauucuuuuuugucaguggcuuuucucauaugaaacaauacaguauuggcaguuucuuaaaauagcuuaauucauuuuugucagucuuauuuuuauaaucaguguuugauagcauaaaucuucaguuugaauuagaucaauuaacuguguauaucuuuuucaguuaaaugugcauauuguauuugaaggagagaaggaauuugaucaaaaugugaaauuaugggguguaaguauuacaaauuuauaagaauuuuuuuucugauaacuuagaucauuuguagaauaaaagacaauucuucaguaaacauugaugcaaaguauagauguauaacuuaacaguguauccuaccaaaaaguuuaagacuagauauaaaagaggccuuuagaagcuuggauuugggauuauuggcauaagcaagucugauguuuuccucugagacuaauaaaacuacugagguuuccuguaauucucuuugauauguuacaggugauugauguaaagcgaaguuauguaacuaugacugcaacaaagauugaaaucacuaugagaaaagcugaaccgaugcagugggcaagccuugaacugccugcagcuaaaaagcaggaaaaacaaaaagaugccacaacagauugagugggagauggaaggaaggcuauuacauuauuuccgaauuuuuaauacugugugaagugguggcuugcugcuguaaucuuuuguuuuguuguuguguuacugaauguggcauuucaggguuaacauuagguucuuaaaagccaaagucaguuugucuuuuugugccucucaucuuucuuuuguguuauguaagauugauuauucauuucucccuacugguaggaaccauaguuguguccuauacuugaagaggcuggaaaguagcccauaaccauaauugcaguauuucuuuguauuucucuguuaagcaaagaaauauuaaggaacauuuuuuuuauguuuuuguauuauuccauaauuaguaaagcaagaugaaaugucaaauuuuaaucaguuuuuucauggauuuguguucuuacaguacuugaaaauauuuaaggaagagaugaagcucugcaguuuuuucuaugugggaugauuacuuuuuuaaggaggauuaauucugagguaguauaguaacuaaaggggaauauaugaauuguuuaacaaauuagaauuuguuuacaacuacuugaauuuuuaaauuaugucaaaacuuacauuacuugccaagcaguaugauguuauaggaaacauaaauaagauuacagagguaucaauuugguuaaaauucaccauuuuauaagacuaagcaauaaucuuaacaaccucuuuccugaauauuuaaauguguuuguaugguguuaugacuaauuguuacugauuuagagacuaagcccucuuaaaaccuuuaguuaaauauaaaaagaaauuauauauaucuugccucccugauggaaaacuauauaaaauuguagacuuaaaagguuuguggaaauacauuaggauaucagaaaacuaaauauauggaguugcuuuaugacuauuacauguuaaauaaaaauagcuuaauuguuuuggaguuuuuuuuuaaagucaugaagagcuucacaauucuagugauacaauguugacuauauauuguacuuuauauuaaauauagguaauacagaauuagaucguuuggauagguuuugaguuagugcagaacucaagaagaaaaauuaggaaauauucugaaggccagaacucuggaagaacuuagaaaguuugggaauaaauuaaacuuauguagauuuaaaauuaaaagggguuuauuucccaaaccccuugagucuuuucuuuuccuugguauuuauggaauucuuacaaagaaaaauuugcagaaguacuauuuucgugaauaaaacauauguaucauucuacuaccauuagcaaauaacuuaguuguaguuaauauaauuguuaaaagguuuagcucuguuacaaauaaaaacauaaagaucuggcaaccagacuuucaugauguuacauuaccaugacaagaaacucugggcaguaaaaguuggacccacauggaguacauaagcaucugauaccuggagauguauuuaaaauuuuucaaguuaucuuccaugauuuaggaaccauuuagagacaugaagucuuuauggguugggggaaagguugauaauuaguuugauuaaagguaaugauuaauaucccuuuuuguucauacuuccuucugaggcuguuuuccccuaaacaguaucuuaaucuguuacauguaauugaaauauuauuugaagcagugaguuauuguaaccucagauuaguuacauugaucaaaacauugauuuauacacacacacacacacauacauauguagcuuuuauauuuagucugguuacauuagugaccaugguauuuacuuucuucuuaaggagccuuugaauuucuuguccagauaaaaauccgaauauuucucuuagacucauacauaaagggacacaguuaucguuagguagcauauguuuuacuaucgguuugucaaaaaaguuaauaaaaagugcuuauugauuuauuucucuagaaauuugcuuugucuuuuuuagcauuaaaaauaauuacuauagcaaagcagucaaaguuagguauauuauauauauacuugguaacuaaagaugggaaaccuaaaaugcuauuuuucuuucauagcacauuuacuaguauaaaggaaguaagauccuaauaaacugagccuuuauuuaacuucuuugaccuaguuuuagguuuacagaaaaguuguaaaaauacaacaguucuuuaugucuuauauuaaucuuaauguuaaaaucuuacguuaucauagaacauuuauaaaacuuaagaaauuaaccuuuguauaauacuauuaacuaaaguagaacauuuuauuuuuaccaucuguuuuuaguggaauucuucaaggucuuaagacuuguccuacuuuuuugguaauaauuuaagccaguaauuuauaaacaauuaagauaugauuaggaaucaacaaauguuuauagguugaagauguaacuucuugguguaacuauacuggcaaaggacuguaaugauuuuacuuuauucuaauuuauauuuuaugcaaggauuuaauuaagaauuuucuucagaaaauuauucaaccaucaaaguguagagaaacuuaaagaguucuugcaaauauuuuaaagggacuuugaguuauuuccccucuccgaacucccaauuuuuuuuuuuuuuuuaaucaguuauuccucagccugaaaauuuaugucaugcguauacucacaguaaguaaacuuuuuuuuuuuuauuuuuuuuauuuauuuauuuuuuuuuuuuugagacggagucucgcucugucgcccaggcuggagugcaguggcgggaucucggcucacugcaagcuccgccucccggguucacgccauucuccugccucagcuucccaaguagcugggacuacaggcgcccgccacuacgcccggcuaauuuuuuguauuuuuuuuuuuuaguagagacgggguuucaccguuuuagccgggauggucucgaucuccugaccucgugauccgcccgccucggccucccaaagugcugggauuacaggcgugagccaccgcgcccggccaaguaaacucuuaaaagcucauuuaugagggcuggugucccuuuuaggauauauggguauguacucuguaaauuuuguuuuuagcagucagguacuuuuaaauuaucuauuugaacauuaacaggguuuuuuuuuguuguucaucuuuuauggcaaauuauuuugacuuggcauucauauuuguuauuuacuuuguuuucaccaguauaauuccauggccucaguuuugaaaugcaagcuauuaagcccagcuuguuuuuagguuuuguuaauaggguuuucuguuucauuuguuuugauuguuugauagguuuuuuguuguuguuguuaauuaucccugacugcuucccuacugcccagguaucuuaacaacuuaaucuggugguguuggauggcuugccuucuucaguuacguauaugccuauggcuuuauacauauggcacuaucucuaaaauaccaggcuugcagagguuuucuucugcauguucuuuaacuuuuuaacagaauucuucauugugaagauuaucuuuaagaacaguuuuucugaagaccauguuuucacuaaaaacucaaugacuuuucuuaguuuuuccguuuagugggucaccuuuaauguccauugaaaagaaauauaacuuccagccuuaaacauuuuuauguuucuuaaagauuaugugucaaaauaauucaauuugccauuccuuuuucauuaggcagagaugcugcuuaaauguuuaaauuauuuuuuaaaaacuuugcuaauaaaaguaaaaucagugauugagucuggaaaagggaaaccucccugaacuugaggcacuuuccccucguucaguaaagagguuagauggauguauuaauauuuuuaaacacccugauccuuuucuucauuuugcuuauuucauuuugcaguuucauauuuauucagauuuuauuuuuaugauuaacuuguuaaucuucuuuaccaugcugugagguggguuuuuuuauucuuauauuacagaugaggaaacugacuuuaugacauugguuaaguagcuuauccagaguucagacuaaugaguugugguauaaagauuucaaacucaugcagccugccucuguguuguuccaugcucuuaaccacuauucugugcugcuucugauauaacaugggcauauagcauggaaaacucuuaauguguuugguaaccaggaacaauuuuuuuguuguguuaguaaaguuauaaaauuauguaguaauuuugccuggaugguuuuggauauaauagccaauucaucacuugugauuugaugacucuu

SEQ ID NO: 15879 - RNA, 909 nt, Homo sapiens
uuccucaagguuccuuucauguccuuauuccucagacuauagauaaagggguucaccauuugagggaacacagaauacaucacugaagccacugcagucuuccuaggugagucaguaaccacagaacuaauguacacccccaaaccugccccauagaacaagagaacaauggagaggugagacccacagguggaaacugcuuugugcuuuccacuugcugauggcauucucaaaacacaggaggugaucugaguguaagacaaaaugauuccagacagaggaacaccaccaaauaugcaagcugcaaaauauaucaggauguuauugaugagggugucugaacaggugaguuggaugaccugagccaguucacagaagaagagcgggauuuccaggucugugcagaaggacagccucaacaccaucaggcugagaagaagggcauucacaacacuagucaacagagagagaagaaucagcaggccacagaggcggggguucaugaugacuguguaucuaagggggugacaaauggccacauagcggucauaggccauugcugcaaggagacaauuuuccaagccagcaaaaaacaagacaaagcagaucugggugaggcagccugaguacgugaugcuccgauucugagcuuggauguucaccagcaucuuugggaucgugguugugcuuaaacaaauguccaaaaaggagagauuggagaggaagaaguacauggggguguggaggugagagucagagaugacagccaagaggaugagcagguuccccaggauggugaccaaguacauggacaggaacaggcugaaaaggacgggcugcaguuccggauccucuaucagucccaggagaaggaauuuugaaauagcuguuugguuucucgcuuccaug

SEQ ID NO: 15880 - RNA, 942 nt, Homo sapiens
gucauugagcauacagcauucucccaagcaguguuucuaggguccucuugaugucccuguuccgcaagcaauagaugaagggguucagcaugggggugaccacaguguacaugaccgaggccaccaugccccaccaggaagaggacgaugcauuggaacuaagauacacaccaaggccugucccauagaauaaagaaaccacaaacagaugagauccacagguagaaaaggcuuuguguuucccaucuguggaugagauucucaggauguaggagacaauuuggguguaggagaaaaggaucccugagaagggcacaaaguccagaaggccggccaccacguagagcaggauguaauugacaugugugucugagcagguaagccugaggaccugagcaagcucacaguaaaagugcugaaugacucaacuggugcagaaggacacccgcagcaccaacagacucuggaucagggaguaugacaagcugaggaaccaggacacaagaaccagcaggccacagaggcagggguuccuggugacacaguaguacagggggugacagauggccacauaccggucauaggccaucacggugaggagaaauguguccaugccuccaaaaaccaugaaaaacauacaucugggcgaugcagucugcauagcugauggcauugcucugcaccuggauguucaccagcaucuuggggacugcgguggaggugaaaccgaugucagccagggacagauuggagaggaagaaguaccuggggguguggaggugggagucagagcugauggccaggaugaugagcagguuccccagaacggugaccagguacauggacagaaacagugcaaagagcaacuguugauccucuaggucuugggaaaaucccaggaguaaaaauucugaaacucuuguuugauuucccaaguccaug

SEQ ID NO: 15881 - RNA, 6923 nt, Homo sapiens
ugcagaaaaggugggaaagaugugacuuguacuuugguaaggagauagggaaggaauuaaggcuauuacucugaagaaaguuggggggccagggcuccuauuuuuuugcugaggagauggaagaucagggcuuguauucaauaagaaugggaggggccaggggaugccuggcaaaagccuugcacugugaggugcagguagaggcuuuuauucuggugagaggacauggacucucucucuccccucagguaacugugcccuguaccagcggggaggcuggugguaccaugccugugcccacuccaaccucaacgguguguggcaccacggcggccacuaccgaagccgcuaccaggauggugucuacugggcugaguuucgugguggggcauauucucucaggaaggccgccaugcucauucggccccugaagcugugacucuguguuccucuguccccuaggcccuagaggacauuggucagcaggagcccaaguuguucuggccacaccuucuuuguggcucagugccaaugugucccacagaacuucccacuguggaucugugacccugggcgcugaaaaugggacccaggaaucccccccgucaauaucuuggccucagauggcuccccaaggucauucauaucucgguuugagcucauaucuuauaauaacacaaaguagccacagaccgugucugguuuguaucugcaccuggcaggggucacucccugggcccgcccuccucguccuccaccuccuccucuuccuccuccuccuccuucagguccuccaggaugagguuguccaggucuuccaggaggccacccuggcucaagcagguggccacaguggagccacugcuaaugugaggguugcugggguggagcacuuugggcaggugguucugcuuccggcucuuggggugagcacaggaugucccaggcacguggggcucuagggagggagaggugcugcagacauggggcuggaggucccaugagagucuggggaggaggggacuuaggccacgcggggcucuagggaggagcugagaccaccagauacggggaccagcacaacuggacauucagggguguugaagauacaggagaccuggggacaugggggucaccugagauuacaggggacaaaacaggggccccaaacccagagaccaugggggcagaggccauggggacccucaggcacgggccacuggggugaaaccucagagccuccugggcaagaccacggagacuggggggucauggaggccauguggaagcaguggcugcugcugugggagacaaaguggacugaguggagauuuggggacuuaaaggcacagaaggggacaaagacuguccaggcuguugggggagaagagccucaccucgccgguuguagcagucggcagcugagcaggagugagugugggugcugcggcgauccgggucccggucccagcgcggggggaggauccguguuggauacacggggaagccgcacccguagcagggggacggggaccccaucugugcccagccccugggggcgggcagggcugugaggguccgagggcgaggcugggccaggguggggccagggcagggaggggcagggcugggguagggcagggcugagggggagcugggggucagcgcccucaccggaaguugugccgacacuucgggcaguggaacucagccaggccccacaucuugucagcuggcacuggcucguagcgcuuccggcauuuccggcaccgggauaccuggugguggugggcaggaagguacagagaggggaccaaggauugucagaggugucugagguuggggucagggcuagcagugugcugcagcggcuggccucagcuugagcaacccaacucaaucagugacuucacguggguagccugauauugaccauggugggaauauuuacaccacagaaauuggcaaacacuacacaucuuggcuuccugccucuuuugcaagaacuaguuaagcauugaccagaagugaacuacuagucaggagguucagaagccagauuuggggcuguguuuuugaggucagauuugguuucuuuucuuucuuucuuuuuuuuuuuagagacagagucuugcucugucacccaggcuggaaugcaguguugugaucauggcuuacugcagccucgaccucccaggcucaaacgauccucccaccucagccuccugaguaguugggaccacaggcacacaccaccacucccagcuaauuaaaaaaauuuuuuuuugccaggcacaguggcucaugccuguaaucccagcacuuugggaggcugaggugguagauugcuugagcccaggaguuugagaccagcuugggcaacauggcaaaaccccaucuccacacacacacacaaaauacaaaaauuagccaagugugguggcgcaggccuguagucccagcugcuugggagguugaggugggaggaucaccugaggccaggagguggaggcugcagugagcuaugaucccgccacugcacuccagccugggugacagggcgagacccccugucuucaaaacacauuuuuuuuuggagacagggucucacccugucacccaggcuggucucaaacuccuaaauucaagcgauccucccuacuuagccucccaaaacacugagauugcagccaugagccacugcgccuggccagguuugauuucuguaguagcuguucaauugugggucaagggucagguucugggguaaggagguauugggcuucucacauuuaaggucagaaguccaguccugggucagggguugggaucagagaucaaggcugagcucugaguuuggaggucagggauuggacucucagugauugaaauccuuaggucagagguacagucacugaggauaggagucaggaguggaguucgggacagucaaagucgagguuaaguuuuaggucaucaccuccuuccgcuggggcacgcggcgccaccagacguggucgcaggaggagcaggcaaacugccgguccacagcagggauaaggucguccugggcacguugaaacaugcguagguuggcuucugucaguggcaggagggaggucgccacugccuguggaauggggcagguggggaugaggugggggggugucaccccuucugcaccaacauaagcaucagcccuccucucccuacagacgaguccucuuccugccccagugaauaucuccccuccugcccuaauggacauccuucugugccugcagaugucccccucccaacucccccaucccaagcccuagccaccaacucaccugaaugucccgguccugcuucauaucuucugguggauccuggguggagauagcaggggcagaaacuggggauggggcucaggccucuuuccacccguuugcugggggaggcccccggccgcaaugaguagggugccccuaacucgccagaagcucacagagcaccacucacuuauugagagccagguguguggccucaguuguccucauagcagcccugagaggugggcacaccuguuaccuuauugcucagauggggaaacugaggcuuaggggagggcuugccugagugaggcuagccugacccccauacucacuuccugccugcaaaugccacaugcuuguugauguugugacauaucgccccuuugaggccacguugugcucggcuaagugggagagagauguggguucaaaucccagcuguaucacuuccagcuguggggacuugggcaagccacucccugcccccuggguucccacugacaggcauguuagagcccaggcucugacuccagguggccaggguucaaaucgcagcugccccugcuugcuggcaagugacuucggccucaguuucuuugucugugaaauggggauaaauaauaggaccugucuccuggggucacugcagugaugaaauaaauaaauuccuggaaucuugccaugugggaaguacucaaugaaugcuacucucugcuaauauuauuauuauuauuauuauuauuauuauuauuauuauauuuuugagacggaguuucgcucuugucucccaggcuagagugcaauggcacaaucuuggcugacugcaaccucugccucccagguucaagugauucuucugccuuagccugccaaguagcugggauuacaagcaugcacugccacgcccagcuaauuuuuuguauuuuuaauagagaagggguuucaccguguuggccaggcuaaucucgaacuccugaccucaagugaucugcccgccucaaccucccaaagugcuggaauuacaggcgugagccaccacaccuggccccucugcuaucauuuuuaucauacuuuuauauguauaaauguagacuaugauacauguuuuguuauacucugguuuuguuuguuuuuguuuguuugagacggagaaucgcucuguugcccaggcuggagugcaguggugcgaucucggcucacugcaagcuccgccucccggguucacgccauucuccugccucagccuccugaguagcugggacuacaggggccugccagcacaacuggcuaauuuuuuuuuucguauuuuuaguauagaugggguuucaccauguuagccaggauggucucgaucuccugaccucaugauccgcccgccuuggccucccaaagugcugggauuacaggcgugagccaccgcgcccggcauuuuuuuuuuuuuuuuuuuuuugagacagaguuucgcucuuguugcccaggcuggagugcaauggugugaucucagcucacugcaaccuccgccuccuggguucaagugauucuccugccucagccucccgaguagcugggauuacaggcaugcgccaccaugcccagcuaauuuuguauuuuuuaguagagacggguuucuccauguuggucaggcuggucucaaacucccgaccucaggugauccgcccgccucggccucccaaaauguugggauugcaggcgugagccaccgcgccuggccuauuauacucuuuaacagcccuacacuaagccuuucaggcaggcuaaauccacagcguucccaucaccaaagcugucaaagaagcaaaguagccaugaugcaccugugcuucaaagccauucauucauucauucauucauucauucauucauucauucaacacaaggguuccauuccccugccucucucuccuccccaauccucugcucauccuagccuuucuagagacugccacuaacaacccuuccccaccucccagccuuugcuuaugccauucccucccccaccccaagaccccugccuuucuuucccuuuccccucccagggcucacuccuccccauccuuuaagacuugguaccuccuccuccaguaagccuucucugaccucugcgcccccgcuaugauggcaauaauccuggcuccuuucauugcuuaguuucauggcucucucccccauugaauacaaucagcacauaaugagcgccuacuguuugcaggcucccuggccggacaaaugauggagaggugaaaaagugagauugggugaugaguuauggaccgacaaugccuggucccuccuguuucagaggggggucagucaccaugaacgggucggguccccccucuugcucucccucccgugacccgguccuuugcgaggggaggggauagguuaccugggcauccagaucguuacuuaguucuuggccaucuuuuugcuuuaccccugcgggggagagugcauauaagggaagggcccuugaagggucugugggaguuccaggccacccagagccgcgacgcagagccuccccaaggcugggaccuccgggggaggugaucucaacgccucucccuagaccacgcccccucggcgcucccacgcgcgguccccgcaccaggcccgggaccccugcagccucaccguacacgauggagcgccccacucccguguggucgcugccgaauuuccucaucagagcccccgccuucuuggaggauaccuucccaugaaacuucucccggaggcgccggacgcucuucuccagcugggauggagacagggggguuccggugggggaaggggaaacgggaucaucccucccccaucucuaggcaccguucucccggcccgaacuugacccuugguuuuggccuccgccgccccccccccgccuuucaucccuuuacggcauuuccuggaaaaagccaaaguccccacagggcguugggggaaggcgcggacuggggcgagcgucccagccuaaggugugggggggcggccagguuaucucuggccucugaccuuugacccugcagcccccgcuuuuccucggggaggccucauuucgcucuggggaaacgugggagucacuuuccuuuucaaggggggcgagcgccaggcagggguaaggaucugggguucuaggauggggguccccaggaacugcgaagcccccuccgcgccucccggccgcuccucggggucugucgcggcugaccccggcccagccguagccaucgcuuaccuccacaccuuccugagacaugguggcggcggcgcaguuccccgcgaggguccgcacugcgcggcucagccgccccccuaccugggugcgcccgucgguccagcagccgcgcagggcagggggcggugccucggggccggcuccgcccuuccuccccggccccuguuucgcuuucgauucaggggggacccggcgcgcuggcuccgcccuggcuccgccucugcucuugcgccccaaacccaggcgggcgccccgggucugcacccugcggcggagcgcgcagaccucggacgggggaggcggcgcggccucugcagucggucacauguccccacgcugcgcgg
